United States Patent 9,518,277 (GENETICALLY ENGINEERED MICROBIAL STRAINS INCLUDING CHLORELLA PROTOTHECOIDES LIPID PATHWAY GENES) - sequence listing, part 14

SEQ ID NO: 44995 - DNA, 49305 bp, Chlorella protothecoides
  modified_base (119)..(304): a, c, t, g, unknown or other
  modified_base (1053)..(1062): a, c, t, g, unknown or other
  modified_base (1362)..(1371): a, c, t, g, unknown or other
  modified_base (1603)..(1612): a, c, t, g, unknown or other
  modified_base (1941)..(1950): a, c, t, g, unknown or other
  modified_base (2828)..(2837): a, c, t, g, unknown or other
  modified_base (3645)..(3654): a, c, t, g, unknown or other
  modified_base (3891)..(3900): a, c, t, g, unknown or other
  modified_base (4882)..(4891): a, c, t, g, unknown or other
  modified_base (5156)..(5165): a, c, t, g, unknown or other
  modified_base (5618)..(5627): a, c, t, g, unknown or other
  modified_base (6599)..(6608): a, c, t, g, unknown or other
  modified_base (6748)..(6757): a, c, t, g, unknown or other
  modified_base (7187)..(7196): a, c, t, g, unknown or other
  modified_base (7574)..(7583): a, c, t, g, unknown or other
  modified_base (7905)..(7914): a, c, t, g, unknown or other
  modified_base (8587)..(8626): a, c, t, g, unknown or other
  modified_base (8837)..(8846): a, c, t, g, unknown or other
  modified_base (8954)..(8963): a, c, t, g, unknown or other
  modified_base (9159)..(9168): a, c, t, g, unknown or other
  modified_base (9328)..(9337): a, c, t, g, unknown or other
  modified_base (10207)..(10216): a, c, t, g, unknown or other
  modified_base (10832)..(10841): a, c, t, g, unknown or other
  modified_base (11392)..(11401): a, c, t, g, unknown or other
  modified_base (11785)..(11914): a, c, t, g, unknown or other
  modified_base (12258)..(12267): a, c, t, g, unknown or other
  modified_base (12785)..(12794): a, c, t, g, unknown or other
  modified_base (13567)..(13576): a, c, t, g, unknown or other
  modified_base (14076)..(14085): a, c, t, g, unknown or other
  modified_base (14540)..(14549): a, c, t, g, unknown or other
  modified_base (14978)..(14987): a, c, t, g, unknown or other
  modified_base (15175)..(15184): a, c, t, g, unknown or other
  modified_base (15777)..(15786): a, c, t, g, unknown or other
  modified_base (15997)..(16006): a, c, t, g, unknown or other
  modified_base (16152)..(16161): a, c, t, g, unknown or other
  modified_base (16249)..(16258): a, c, t, g, unknown or other
  modified_base (16756)..(16765): a, c, t, g, unknown or other
  modified_base (17024)..(17033): a, c, t, g, unknown or other
  modified_base (17391)..(17508): a, c, t, g, unknown or other
  modified_base (17773)..(17782): a, c, t, g, unknown or other
  modified_base (18020)..(18029): a, c, t, g, unknown or other
  modified_base (18548)..(18557): a, c, t, g, unknown or other
  modified_base (19329)..(19338): a, c, t, g, unknown or other
  modified_base (20063)..(20072): a, c, t, g, unknown or other
  modified_base (20370)..(20379): a, c, t, g, unknown or other
  modified_base (21014)..(21023): a, c, t, g, unknown or other
  modified_base (21756)..(21765): a, c, t, g, unknown or other
  modified_base (22611)..(22620): a, c, t, g, unknown or other
  modified_base (22712)..(22721): a, c, t, g, unknown or other
  modified_base (24252)..(24261): a, c, t, g, unknown or other
  modified_base (25410)..(25419): a, c, t, g, unknown or other
  modified_base (25850)..(25859): a, c, t, g, unknown or other
  modified_base (28415)..(28424): a, c, t, g, unknown or other
  modified_base (29365)..(29374): a, c, t, g, unknown or other
  modified_base (30969)..(30978): a, c, t, g, unknown or other
  modified_base (31260)..(31269): a, c, t, g, unknown or other
  modified_base (32261)..(32270): a, c, t, g, unknown or other
  modified_base (34240)..(34249): a, c, t, g, unknown or other
  modified_base (34971)..(34980): a, c, t, g, unknown or other
  modified_base (35181)..(35190): a, c, t, g, unknown or other
  modified_base (35245)..(35254): a, c, t, g, unknown or other
  modified_base (35308)..(35442): a, c, t, g, unknown or other
  modified_base (36980)..(36989): a, c, t, g, unknown or other
  modified_base (37371)..(37380): a, c, t, g, unknown or other
  modified_base (38391)..(38400): a, c, t, g, unknown or other
  modified_base (38600)..(38609): a, c, t, g, unknown or other
  modified_base (39150)..(39159): a, c, t, g, unknown or other
  modified_base (40439)..(40448): a, c, t, g, unknown or other
  modified_base (40933)..(40942): a, c, t, g, unknown or other
  modified_base (41447)..(41456): a, c, t, g, unknown or other
  modified_base (41519)..(41528): a, c, t, g, unknown or other
  modified_base (41770)..(41779): a, c, t, g, unknown or other
  modified_base (41863)..(41872): a, c, t, g, unknown or other
  modified_base (43091)..(43100): a, c, t, g, unknown or other
  modified_base (43707)..(43716): a, c, t, g, unknown or other
  modified_base (43992)..(44001): a, c, t, g, unknown or other
  modified_base (44251)..(44260): a, c, t, g, unknown or other
  modified_base (44681)..(44690): a, c, t, g, unknown or other
  modified_base (44893)..(44902): a, c, t, g, unknown or other
  modified_base (46056)..(46065): a, c, t, g, unknown or other
  modified_base (46844)..(46853): a, c, t, g, unknown or other
  modified_base (47099)..(47108): a, c, t, g, unknown or other
  modified_base (48290)..(48299): a, c, t, g, unknown or other
  modified_base (48754)..(48804): a, c, t, g, unknown or other
ggggcagggcggcgggggccgggagtcgcgcggcggaggcgtggtccccggccggcggtagggctggaacgcaaacccgccgccgacgaggcccttggagggcgccgtgcgcgtggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggaggacgcgtccccgtcgggccgcgcctcgggccgggccgacacgtcgctggtgctgccggaggcaaagccgtcggtgcccccacgacgctcgcggggtgcggggcccgccgccgcgccccgctccagcacctcgggcagcgccgcccggagcagggcggccatggactcgtcgctggagcggcggggggttggggcctcgcagccgctgtcctcccgccccgaggtatccgggctggcgcagcccaggtcgagcgccgcgccgccgtgcagcagcgcgcgccttggcgaccccggggcgccggcgtggagcacgaccgtgcccagcgccgactcctcgctggaccaggtggccaggtgctgggagtcgaggccggggtgggggcggggagggccgccagagaggggctgcaccgcgtcgcgggcggcgccggatcccggcgcatcgttcagggagtgaaagatgcgctccagggacttgacgcgacggtatggccacctgcggtgtggcgtcgggggtgggggggaccaggttgggtgtgcgcgggagggacagcgcgcactgagcgtgctgcgaggagcgtggggcgatgcgacacaaggtcagagcagaccggctgggagggcatgggagcgggccgcgggccgtgccatcaccctggaaagctcgtgaccggccatgatgcctgtcaccgacccacccacccctgttttggggaaacccaacaatccgagctctctctcgannnnnnnnnnacgggccgcgggccatgccaccaccctggaaagctcgtgaccggccataatgcctgtcaccaacccacccacccctattttttggaaacccaacaatccgagctctctctcgatacctgtccacgccgacgcgacggcaaacgcgcttgagcacggtcagggagatgcccagctgctggcatgccttgtcggcaggcaggtgaaaactggagaggttggggggagagacaagggttagagcgctgggtctcctccacctcaaagtgtgttcatgggtcggaggcatgcagggccagcagnnnnnnnnnnggggggggggagacaagggttagagcgctaggtctcctccacctcaaagtgtgctcatgggtcggaggcatgcagggccagcaggcagtggagcgggcactggtcgccacccctcgactcactgggcggcaacatcctccagggtgatggacgatgccagcactccctgaggggagagggaggggggaagggtgtgggcttgcgatcttggggcgacgcgtcgcttgcgcgnnnnnnnnnnacagggagggggaaagggtgtgggctcgcgatcttggggcgacgcgtcgcttgcgcggacggcgcgacacgacgcaatcccccatcaactgtgggcacactcacatgcttggacagcttgcggcgggtactgcgcgtgcgcgaggggcccgaatcgctgccgtgaagattcgtcgctggcgtggattccaacatgtacgggggaccccgtgtgagggcttcagcctggtgcttcgaacccgcgtcttgcccgtgccaggaaaggcctgcatcatccatgctgtattatatcctggtcggtgtccgcggagtactctgcggcacgggggnnnnnnnnnnacccgcgtgagggcttcaggctggtgcttcgaacccgcgtcttccccgtgccaggaaaggcctgcatcaaccatgctggattatatcctggtctgtgtccgcggagtactctgcggcacggggggggatgtagaccgttggagagtacgggagacttgcgggcgactcatgggagactcggccagaaccgcgtacgattgggcggggagaagatttgtggcatcacaagctcccacctgagcggctgtgggaagcgctgaggtccacggactagaattggtcaccctcccgattccttcgagataggggtccagagttacgttagcgcgtgcatacctcaaggccggcgcaaggccactcgcaaatgcacactgaatcgttgcagcctgtattgatgtttcagtgcggcgtctggcgcacacgtaggttagatacgggtctgttgggcctcgcctgggcaggctggaatttacccgggacccttgcaacgcttgggatggagcgggtagcttccacgacagctgccaagaaagcaatccgcaaccggaccgggactctgtaccatttattgccgtattttgagggcgagtgagtagatatgctcatgaattgtatattattcgtgaagcatagctttggacacagcaaaggttggatatcgctaggacgttctgcaaacaataccaacttccgtgtcaccccccggacgtgctcatattccttgctagaaggggccgcgcgcgcatctcgatcgcggcccgggttgggcaccgaagaacacacgagaatgagcatatactggtatttgattaaatgttcgttctgaacacaggagagacccgatcctctgttgtttgcgccaggctctgccttccacnnnnnnnnnntccgggttgggcaccgaagaacacacgagagtgagcatatactggtattggattgaatgtttgttctgtgcacaggagagacccgatcccctgttgtttgcgccaggctctgccttccacatacacatgacgtgtccacctgcggacgttcccaacctctgcggttgatcgaatggcctgcctcccgtcagacgagcctctcgcgaagcgccccaaggaacaagcgcggtaattctgaggttgtagtatagtacaagaggactgcacaaataatcaatatcttgagcaggcatggacgcaattacgcgccgacctttccgccctgttctgtttcggtgaccagtccgcggaatgcggaccccggctgcctcatgaggtcccccggcgtcccgaattccgcgaccctccccgcatccagcaccagtatggcgtccgatcgcatgatggtgtgcaggcggtgcgcgatggtcagcacggtacagctcgcgaaggcccgtgcgatggtgccctgggtggttccggggatggtgggagtcaaggggctgccccgggcgtgacccccgcgcagcctccacgaccccccagaaaccccgcctcacctgcaccatcgagtcggtggcggtgtccacgttggaggtggcctcgtccaggaccaggacgcgggtgtggcgcagcagggcccgcgccagggccagcagctggcgctggccctgcgagagggaacccccgccctcgctcacgccagagtccagccccgcaggcatgccacgcaccgcacgctccaggcccgactgtgccagcgcgtccnnnnnnnnnncccctcgctcacgcccgagtccagccccgcgggcatgccacgcaccgcgcgctccaggcccgactgtgccagcgcgtcccacagccgctggtcgtcggcgccggccgtgccaaaggggtccaggttggacctgatggtccccgtgaagatcaccgggtcctgtggggagagtgggaagtagagagatttaagagagtgtgtgggtaggtgctccccaggcgtcagcggccaaggcannnnnnnnnntgggtcctgtggggagagtgggaggtagagaggtttcaaaagagtgtgtggctgggtgctccccaggcgtcagcggccaaggcacccggcggataatgaagcgggcgtggcaggccttcgccggggctgcagaccctgggactcgtccaccggcggacctgcggcaccagggccagcctggagcggaggtcgaacaggccgatgctggccacgtcgatgccgtccagcacaatgcgtcccgcacacggctccaccagccggtacagcgccagcatgagggtggacttgccacatcccgtccgcccggcgatgcccagctgtggtagaggggtagggggggggggcccgcgggacggtgtcacccggtcggttgagaaaagaatggggggagccagggtcacaccgtcgtgggcgggtcgggcagacgagagcagcgcaaccaggcttgcactgcatggtcacagtgcatccacggcatgccatgttgcgtgcctgcccactccacccccttccccacgcgccaagcccaccttggaccccgccgggagggagaaggagacgtcgtgcaggacggggggcagagagggacggtagcgcaccgataaaccctccacagccagtgcgccctggtcagaatgatgggaagggggttggtggggggctctcgacagcacctgcgcggcaaggtgcgtacctgtgacagcctgcccctcctcccacccctgtactcgcctgggtcggccagcccgggaggggccgccgcccctcgatcacagcgggcgcctcggtctcgaagctggcatactccagcagcctctccacggagttcatgctgatctgcggggcgcaaagggggggagggtgggggggggcttcctcacatgctagtctagtcagcacccacggcaccgcaccgccagtgaggactcgcatgcccctgcgggccacccttttgccacacctccatctctgtggtctggcnnnnnnnnnntgccagtgaggactcgcatccccctccgggccaccctttgccacacctccatctctgtggtctggcgcacagcccaggacatgaggcccgtggcctggagcgcggaggtgatggccagccccgccaggccggcggagtgtggctggagcaccgccgcaaacagggccgcgccaaacaccactgcatgagggtgtagggttttggtctggggtactgctggggaacagcggtcttgcgaccagggattcggtgtgtggaatgcatnnnnnnnnnngtgacggtgtagggttttgctctggggtactgctgaggatcagcggtctggcgaccagggattcggtgtgtggaatgcatggcacatcggatattgcatcttgacagggacatgtcacccgaaccaggtggggtgacagccgcggcccggcttgaagcacgacgcctttgcgggggagggcacgcgccaagggaaattcccttcggccgcccccggccacccacctgatgtccccaggagctccagccgcaccgacagccagcggttgaccacctgcgcatgcatgtgggtggcgacggagtgacacagacagcgcgatggacaactcgggtctctggagtgcaagtatttctgagaccgacgtgctgctgcgggaacagcgagtggagcatccgagcaacccaggaggagaatcctccaggaagcctctcgcccggtcacccatggccaccnnnnnnnnnngacgcgggtctctggagtgcaaggatttctgagaccgacgtgctgctgcggggacagcgagtggggcatccgagcgacccaggaggagaattctccagcaagcctctcgcccggtcacccatggccaccctgcatcacctggctgggccaccacgccctgttggaggcgtcgagcatgacgcagttgctccgtgcaaaggcgtcctgctgccggaaggcgcgcacggtgaccaggccctgtgatgaagatgaccgcaatcgagggcagtcggctggggtttgtgcaggcgcgcttgcggactagaacatgtccatgagcagccttgtacaggagggtcatcaaccacgccacattcgtcttcatcgcccccccactctgcatcgctcatcctcttaccccctcagcagcccccctcaccgacagcgtctccaggaagtggctgtagatgggggacatggccaccgagtccaggcgcttgatctcgcggctggtggcgatgaagcgcgcctggacccagaggtaggccagtgccagcgggaccagcatggccatgatggcgggggacaccgccaccaccagcaccaggcaccacagcacgctgcgagggcagaggaagggtggaaagtgggaatggtgcgccagttggtgggcgctccagggcaggacaggcgtagaggtcctggggcggcatgacacatcctcctcgcacctgacggcgcaggaggtaaaggacctgaccgagtcgggcaactgcacgtccaccgcctcggtgtcacgcgtgaagcgattcaggagccggcccgtgggctgggagtcgaagaaggacatgggcaggcgcagcacccgagtcagcaggtcatcctggcaaaggggtcgggaagggggggctcagcagggagagggaaccaagacatagtctactcaagcctgtgaacccagttgatctgcccatgcatcgcatgcttgccacnnnnnnnnnngagcgcctcttggctgtatgcatctttgagtgtctgtcccactactcattaccactgcgcaggcgcccaagctcccctcccccccttacaaacaacccacaagaaccctccacacctgcagggtgcgggccgcgcggatnnnnnnnnnnggggggcgtttagcagggagagggaatcaagacacagtctactcaagcatatgcacccagctgatctgcccatgcatcgcatgcttgccacaggatggcagccttgagtcggctgcccccaggccccaattgtgccccgccgacaggatgagccagacacacaagaccagcgcctcttggctgtatgcaccttcgagagtctgtcctgctacacatcaccactgcgcaggcgcccaagctccccttccccccctcacagacaacccacaagaaccccccacacctgcagggtgcgggccgcgcggatggccccccacaccaggcacagccctgaggccagctggacgaggagggaggcgctgcccagcgcagcgtacacgacgaggtaatagtttgcggtgtgcgcgctgtgcggtgccacgatgtccannnnnnnnnnaaggagggaggagctgcccagcgcggcatacacgacgaggtagtagtttgcgctgtgcgcgctgtgcggtgccacgatgtccaccgaccagagggagagccaccagctctgcgcggcctgcatgcccttgtcggtcacggacagacccagcatggcgagggggagccaccaccaggcgccccacgccgcaaagtagcggaggtagagcccgcggtccacccgccccaccgcccgctgctccacgtccgtggtgcggctgccggcctgcgccgcgttcctcccggtgacagccagcccgggcttgggcgcgggcaggccctcggcgggctgagccgctgcaggccgcacctgccctgcggacaccacgacgcacgccgnnnnnnnnnncgcgccgcgctcctctcggcgacagccggcccgggcttgggcgtgggcaagccctcggcggcctgagccgctgcaggccgggcctgccctgcggacaccacgacgcacgccgcctccgccaccgccgcagctccctgcggcgcggggtcctccatgacgacgtcgacgagccctggttcaccttccccgggcaccgtgctttggtcgaagtcagccgcgtgacggggctccggcagcggcggccccacccctgcactgcccgccgcctccgccgcccttgcctgccgctcaaactggtggaagtcgacgccggcggccagcnnnnnnnnnnagcggcggtgggtcctccatgatgacgtccacgagccctggtgcaccttccccgggcactgtgctttggtcgaagtcagccgcgtgatggggctccggcagcggcggcccctcccctgcactgcccgccgcctccgccgcctgtgcctgccgctcgaactggtggaagtcgacgccggcggccagcagggcggcgtaggggccggtatgcgtgattcggccatcctggagcacgatgaccacatccgcagcaggcaggtactgcagctggaagtagggagtttaggggggggggggtgtgagggagggctttggggggaggatgcatgcagggtcactgcgatggacgacattttggacgaaagggtgggcagacacgtttctcagggggcaccggcagcatcatttgcacacacggcatagactgggaacggccccatgttaatttgggtaggcccgaggggcacagtgcttgctagtccgggacccctgacgcccgctgcccatccccttcatgcagctcccgccaactcaaacccgcacagacctgatgcgtgacgaggacgcgcgtcttaccggccagcaggccgcagatgcaggaggaaaggaggtggcgcccgacgtgcgcgtcgaccgccgacagcgggtcatccagcaggtacacgtctgtgggnnnnnnnnnnnnnnnnnnnnnnnnnnnnnnnnnnnnnnnncggctcctgcacgtgagcaccgcccttgggcacacacccaatccggccttcatgcacgaccccagcagcacgtcatggcccacatcttccctcagggcagtgcatgcaggccagcagcccctgtgccccctatccttcatctccccctccccggggccggcctcaaaacagaaagaatctacccaccggcatctgcaaagcaggcccgtgnnnnnnnnnngtgggggaaaaggggagcggctcgatgcaaatcatggggcccctagccatcttgtacccagagtttgcatgggcagtaccccccaaccggcccagatgtgccgatccnnnnnnnnnnagaagtgccaagatgaatgatcgctcaatgcatcttacgaacttctgcttcctcaccctgcctgcaggtggcagctcccgcagtacctccacatggtttggagcggccccttccaggtgaggcatgattcctgcgcagcattatctcactgcggtcatcttcagcgcaggtgttacgcccccgcgctgagcagggnnnnnnnnnntttccaggtgaagcatgattcctgcgcaacattatctcactgcggtcatcttcagtgcaggtgttacgcccccgcgctgagcagggatcccgctgcaccgcgcctgggcacccagtggcccattcaccgtccctacctcacatagatcctgtgtgtcatnnnnnnnnnnatatccttgatctccccctccccggggccggccccaaaacagaaagaatccacccaccggcatctgcaaagcaggcccgtgccagggcgacgcggtgccgctgcccccccgacaggttcacccccttctcgccgatctccgtggcgtcccccgccggcagcgccgcgacgtcctgtcccagggcgcaagcagccaccgcggcgtcgtaggcagcggtccgcgccgcgcccagcgtcacgttcttctccaggctggcgttctggatccagggctcctgcgccgtgtacgccacccgtccccgcaccgacgacgtcccctggtggggtggggtggggaggaccgggggaagagggcggtattgagcgtggtgaggcatgtgatggcatggaggagcttggcagggggccaggcattgaaggcgatgagggtcaggagaaactgcccgagcacccaaactgggcccgctcggtgacacaggtccgaggggtgatgacaaggcaagcccagggccccctgcacacggggaatgaccaccacaggtttcaccccacctggagccggaccatctcgttcagcagggcggccagcagactggacttcccgctgcccaccgggccaaccacaatggccagctggcccttgttgactgtcgagcgtgtgtgtgtttcatgggttgtgtggggttggaatgaggggacttggaattccaggatcacctggtcacgccgtttgagcacaacatgtcccgctccagggtccagcaaaccaaatgaggaagaggaggagtcccaagacaagggcgaatctgccatccccacaccttccaggcagatgtcgtgcagcagcggctcgcacttggcgtcccaagannnnnnnnnncaatgaggaagaggaggcgtccccaagacaagggggaatctgccacccccccaccttccaggcagatgtcgtacagcagcggctcgcacttggcgtcccaagagaagctagcatgggaagcctggaccaccggcgtcgcttcagggggccccgcgtccagcggggcgtcgggtcctgcctgcgccacctcccccgcctgcatgcaggcgatgggaatgagcggagcctcagcctcttgcctggctcccttgaaagggagccgtgagtcggagtaaagtgtctgcacatgcatggcatccctcccacagccatgcacagcagcgcctgcaccccagatcgaccaggcacacacctccatgaaggtctggatcctcctgagggccacgccgcaatttatgaggtcggtgatctggcgcgggaacatgatgatcgggaagcggagcaggttgaagagcgcaatggcggggaacgccacgtcagcggacagcgtgtggcccagcaaggtgtaggtcatgaatgcctatggtggagggtggagagagggggaagtgagtgggtgggaggggagcgacactgggctccaaccacgcaccaccaggcatgttcagcttgcgannnnnnnnnngggagagagggggaagtgagtgggcgggaggggagctacgctgggctccaatcacgcaccaccaggcatgttcagcttgcgatcgctgtgctgcattgctgacgagctccacatctcaacagactggctgcatgagaatttctacagcaccgttccccctctccacccacaacgatggtgatgatgatgggagcgccctgaaagacgagcgagttcacggtgttcagcagccccgaccacaaaatttgcgccagctcctggttggggaggtgggtggtgtctgagcgcctgaagtggcgggggacagaaaggtgcagcatggtgctgggatggcactcttgtgacaacgcccatgggctttaataccgccatttcctgccccagcatcacctgctgccgtaggtcggtgatgagcagacggtatggctcctcccaggcgtacagcttgatggccttgatgcctgtatgtgggagggggcgtcagctaccgggcgaatttgacccaaagtacagaccctattgggtgcagccttgcttgggaagcagcccannnnnnnnnnggggaggggccgtcagccaccaggcaaaattcgacccaaagtacagaccatactgggtgcagccttgcttgggaagcagcccagacggcattgtcgaataatcctgcgagggtcccccagccacctgtcaagacttcggtgcacagcttgacccttgcgtcggtgagagtcatgctctccttgcggatcgacgccagcttcttccccagcagcgtcagcagggggatgagtgccacggtgacggccagccccgtcacggcagacacgacgcctatcacccgcatgaggaggcccatgacacacaggatctatgtgaggtagggatggcgaatgtgccactgggtgtccaggcacggtgcagcgggatccctgctcagcgcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaggaagcagaagttcgtaagatgcatagagcaatcattcatcttggacacttccgggacaccaatcggcaacggactggatggagtccaagtcagtacatcagtctctcaaagccagtgcggggatgcaggactccagctccaaaccccatcccaagtccactgcctgccccacgacagggcaggaacgccggctgcaccaggcacacgccaacggcccaccaaacatctcctgaacccaggcaggccccaaaccccacgagcacaaccctggtcggcacgcacagcttggcggcgtcgttgctctgcagattgttcaccacccccgcgccgagctcggagnnnnnnnnnnccggcacgcacagctttgcggcatcgttgctctgcaggttgttcaccacccccgcgccgagctcggagcgggcgccgcaggagatgcgcaggctcttgcggtacagcatgtccaccaggctgcacttcaggtgcgcgcacagccggtacagggagtggaagtagacgttcaccagcagggtctgcaggagactcgtgccggccaggcccagggcaagcagcaggccgatccagggtgaccccctgagggttggaggggttacggcgagctggggtgggtgccggctcggggggttgtggcgagtgcagggggccgggagggtgacggcgcgagcccttgacttacggctctaccttgcacactcagaggggtgttagactctgcccctcgcccccacacgacgccgcagtggcgcgaaggggccgtcacccctgcggtacatgcccccgcgtgcaacgtccgcccccaggcccacctctgctggacgtggacgaggaggcgctgcagcaggacggggnnnnnnnnnngccgacctacgactctaccttgcacactcagagggatgtgagactctgcccctcgcccccacacgacgccgcagtggcgcaaacgggccgtcacccctgcgcttcatgcccccgcgtgcaacgtccgccccccggcccacctctgctggacatggacgaggaggcgctgcagcaggacggggctggccagcatgacacagtcgtgcaggagcttgaccacgcccgaccacaggaggcgcccccggtagcagcgccacagggcggcgtgcactcggccgtgtggctgggcgctggaggaggcggtgctcgccaggtgccactggaaggccgcggccacctcccccgccgcgtcttcgggcatggtgccccagaggtcctcggcgtccagcgacttgtgcaggcccttggccaggagggggtccacccatgtgaacaggagcctgctcaccaacccagcaccctgctccgggcaccaggcaccgcctgtgcatcggtgggctgatccatgttggtatagatgtgtgaccaagaggcgctggcgttggcacatggcatgcccagccctcccgcaccccggcgcacctgtggccgaggtggcctcctcggcgcccagggcggagtatgcagggtcgcgacgtagccacctccacctgcatgcgatcgccacaatgcacgtgagatgcagttaccgggccatggcgaggcatgccctcgccttcctgcagacagatcatgcacccaggcaccgtgccacgacctcgtaccatgacgtnnnnnnnnnnactcgcattcctgctgacagatcatgcacccaagcaccgtgccacgacctcgtaccatgacgttggttcattctgggagacggggaccttgacaggccccccctcgacgtcgaacccgtacatctccttctttaatgcacatgagagccttggtagagtagtttggagaaatattggctgatgtgagccctctgctcatctcggtcggcacctgggtgacgtggcatcccgggcagcgagatcaaaaccctggggaatggctgatgtcttcgtaagcccgcacctgaacatctcatctggccgtgcaccctcaggaaaaccatcgatgcggagattgtggctgcttataatacccagctaggtgcccggaactcaccaggtggtcccaagaatgcttgccggtggcttgaaaaattgagctcaccagaggacatcagaaggaaatcctcccaaagatgactacaatccacttaatccatgcgagggagatgtgtgagcannnnnnnnnntgtagagcccttgatgcggttgttgtggctgcttacaataccaagctaggtgccctgaactcaccaggtggtcccaagaatgcatgccggtggcttgaaaatttgagctcaccagaggacaacagaaggaaactctcccaaagatgactacaatccccttaatccatgcgagggagatgtgtgagcatttgcttaccgctacaaatgctttttctgatccggggaacacaggaaagtatcctgcctgtagtgggatgttaacatcttcggactttccccaccccgccaggaataggaattgacaccctgaacgcagcacttgcgtgccgagtgtttgtcagatggactatcccttgaataataatattgaccttaaaactcctttgtgtatatcaggacggcctggaggggtgccgctgagatcttattgctcgttcgggatttgagggccttgnnnnnnnnnncttgtcaggtggactatcccttgaataatatattgatcttaaaactcctttgtgtatatgaggacggcctggaggggtgccgctgagacattattgctcgttcgggatttgagggccttgatgcggaggggtgtcgagcctctcgatctcatgacgcgagtctcttaagagcctctgccagcggtgagctgtgctctgttgggattcgtggctggaatcatggcgctttagcatccaaatctggtcgtaggtatcccagcgcaaatgtggaccagaccgagacgtcgcactccttcccttgacacctatgcagaggagcagcggcgacatggagggtcacggtcctcatacaaacctaattgagcgtgtgatagaagtcgccaagccgtgccatgaaccccaggctgctcctacgaattcgtccgggcnnnnnnnnnncgatagaagtcgccaagtcgtgccatgatgcccaggctgctcctacgaattcgtccgggcaggttcgtaacactcctgtcgtcccttaacactttgtattgcatcctggctgccttccggagattctttggcccgctggtcatgatagaataaaatcaacgctccaaccttccctcggtgcgcagagnnnnnnnnnntttggcccgctggtggtgatagaataaagttaacgctccaaccttccctcggtgcgcagagctcggccagcttggagagagctagacctgctaccagcgttgcccagcgggaaaccccctccaccctgcggcctgccacctacactccatggaaacccagtgtggatgtggatctgacgagggacgaaaacagtttccccccacgcccatccaccagtcctccacagggcccaatcgctgggtctccggctgccgcggctgccatggtggagcttgagatggttgggtcagcgggccgcgaccccaggcgatgcatgccacgccaggacccccttcccatcaagactccagggaggccgctcccggggcctggcagcagccctgcaggccgcgcgtgtcccagcgctgcgtcagcgccgctctcatccggcgtgctccaatccctgggtctcgcccagtacctgaagcacctcctgtcccggtgcggggagtgctccgtgacgtggagcgagatggcacgctgcctcctgcatctggatgcgctggggctcctgcacatcccgtccacgagccacggggcggcgcccggggtnnnnnnnnnncccgtggcgtggagcgagatggcatgctgcctcctgcatctggaggcgctggggctcctgcacatccagtccacgagccacggggcggcgcccggggtgctggaccgcctgatgtgggtgctgggcatcctgtacacgctgtggcgggcacactttctcaccctcggcagggcctccgccccggcggccggccgcgcggcagccgctgcannnnnnnnnntcacgccagggaccccttcccatcgagacttccaggaggccgctccccgggcctggcagcagccctgcaggccgcacgtgtctaagcgctgcgtcagcaccgctctcatccggcctgctccaatccctgggtctcgcccagtaccnnnnnnnnnngaggccgtgaaggtggaggccctagccgcggcacgcgtggagggtggctgcccgacaccggcgcccacggcccgcctctcgatgaagnnnnnnnnnnaaggccgtgaaggtggaggccctagccgaggcgcgcgtggagggtggctgcccgacgccggcgcccacggcccgcctctcgatgaagcccgcgaccgagcgtggcggaccggaggaggtgcaggcgccggccctgtgccccgcaccggaaccctcgacggccgctcgatcttcgggggggaagcggcgcggcacccggccgccgcagcacctgggcctggcacctgcagggcccagagagcgcgacggagcgtcctccttgccgggcgccgacagcgcgtaccctcccacgacccagggcgtgagtgcggccgaggggcgcggaacgggtgcggccggcgacgcgaggtgtgggggtggagcacacccgatgatgggcggcggcgccccggccgtcactgccgccggatacctccccacccgcgacgcctgtggggccacgccggcatgcacgaagccagggtccaagatgcggcctggcaagcagccctacaccctnnnnnnnnnntgtcactgccgccggatacctccccacccgtgacgcctgtggagccacatcggcatgcacgaagccagggtccaggatgcggcctggcaagcagccctacaccctgctccggagttcgcctcgcctggctgccaaggagagtgcggatgttggcagccccaagagcaacgattcccccggctctccagactggggttccgactcgaccccccacgctgcgccgcttcacggaaagacgcggtgggccgagcgaggtcannnnnnnnnnacccccgcgctacgccgcttcgcggaaagacgcggtgggccgagcgaggtcacgagaccggggggaggggtggcccgaagctccactctgatccccgtggcaaagtgttagagcttaccggaggagcggcggaggggggcggcgcggaggggagcatcccccgccgccgcgagacgagtgtcacgaacatccctgcccaggcccgctcgcggctggggagcagggtcaggcccagccccgcagcgccggccgtccagcggccctgggccccgccgccgctccagcggcagtggccggagtgcctgaagcgcaagcgcagcgggagccccggcgtgtcgcaagcgacggcgcccacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctgacctcgaccctggaacccctgcatgccggtgcggcgttgccaggcggggccggcgcgaaggaggcagcgccggcccagcctggccaggcgtcagctgcggcgcctgcagcccaggcgtctgttctgcaacacgagcacccccagggtcctacgccggcacagcaggcacctgcttcgacgtccccttgccagggaggacgcaaggaggcggcgagctgtgcgccgctgagcccgctggctccctgtcagcccccggcgcnnnnnnnnnncacgccggcacagcaggcgcctgcttcgacgtccccttgccagggaggccgcaaggaggcggcaagctgcgcgccgccgtgcccgctggctccctgtcagcccccggcgcctactctccggggcggggcgggcggcgagcacgtcccacaattcggcggcttccccggcgtcaggctcgaggccgccccaccgcctgacctgggcggggaagctgaggcgagcgaccccgctcgtgcnnnnnnnnnnctcggcggtttccttggcgtcaggctcgaggctgccctaccgcctgacctgggcggggaagctgaggcaagcgaccccgctcgtgcggctccgggctccatcccgccgagcgccgacgcagcatctccggcctggtggcaggccgcgccgccagcggcgccccccaccaccaccgcggcgccggctgcgctggatgccccgtggccgcctgcgagcctggagccgccgccggcgggtcaggcggggcggccgtcggctgcagcgccgcgcccggcagatccgctgcgcagggcgtcgtctgacgcggcgcaagctacgatcgccgacctggaggggcagctggtcatggctcgcagcatggtggccaagctgaccaagcacctgaaggccgcggacgcgcagatcagggaccacgtcaccgagatcgtgcgtggttgaggggtggtcgcgcttggctccaacgcgggaaaatgggtctggaggctggtgacttgcactccttctgcacggccggcatgnnnnnnnnnncttgcgcttggctcccatgcgggaaaatgggtctgagggctggggacttgcactccttctgcacggccggcatggcgattgcatgctgcaggaccagtttgctggcttgccatgtccagaatccacggccaggcactccatcccgaccgacggtgacagtcccccaccgcacgctgccttgcagagcgagctggcgcagcaggaggccgagaactttgcctaccgcaaccggctgcagcagagggaggcggagctggagcagagggaggcagagctggagcagagggaggcggaggtgcaggagaagcaggcggggctgcaacagggcgtccaggtgactgcccaagggcatgaggccagcgaggcgcggctgaaggagcgggaggcggcgctgatcgagatagaggcgcgcgtgcgcgcccgtactgcccgcctgcatgactggtcgacccagctgacccagagccggtccgacctgctggggcggctggcggccatccaagactgggagcggtccaccacacgctggggcgccgcctccctggccgccagggagaactgggtcgttgcgtgcgtgggcatcctcaccaagcgcgaggacgacgtgagtaggcaggagaggggggtgggcaagcaacttgcaggggtggaagtgggaggggggccagttgagacggccatggtgtgcgggaggggcaggcatggatccaggagggcaggctccgggggaatgattgcagcgcaaggtcccagccagccagtcgcacacgannnnnnnnnngtcctcaccaagcgcgaggacgacgtgagtacgcaggagagggggggtgggcaagcaacttgcaggggtggtagtgggaggggtcccagttgggacggccatggtgtgcgggaggggcaggcatggatcaaggagggcaggcttcggggggatgcttgcagtgcaaggtcccagccagccagtcgcacacgagtgggcgtggatccatgacgaccagagcgtcgggagcacctgctgagcctggcgctgtggcaccccagccgcctgcccagctggagcccctgccgtcgccccacgcgaccccaggcctcgcagcccacagccccgtgcctccctgtaccccctcaggccaaggccctgctggaatcgctgaccaacctggcgagcatgctggagagggaggtggcgagttccgatgcggtgaacccgcaggtgctggcatccctgcgcaccacctgcgtcctcctcgagcaggtgcgcctgcggtggagttcatggggcgcaggcaccgagatgcaaagcatgcaggggcagccagctctgcactgccatgcgaatggcttcgtgaggaggatggagggcagtcgaggtcggagttacgccccgttcactaccggggccgcatgcatgcgcgacgcacctggcctcgtgtgccggctcttgtacggagatgaggtgacgagacgtgcccccacccccacaccctgtccgccctcgcagctgcnnnnnnnnnntctgcggtggagtggatggggcgcaggcaccgagatgcagagcatgcaggggcagccagctctgcactgccatgcgaatggctccgtgaggaggatggagggcactcgaggttggggtggcgccccgttcaccaccgggcccgcatgcatgcgcggcgcacctggcctcgtgtgccggctctcgtacggaggcgaggtgacgagacgtgcccctgcccccacaccctgtccgccctcgcagctgcatcgcggggccaagccctcggtcatacaccccccgccccctcccggcatctgnnnnnnnnnnccggggggccaagccctctgccatacaccccccgccccctcccggcatctgacgccggcgagcggggccggcagtcgtctggtggggacggtcggatcatgcacctgcaccgcccgcgctccgacaggtggaacagcgaagcgtgtggtgttgacacacgcagcaaactctttgccggaatggcacgagccgattgaaaccgaggcactgcataatgatacaacagaggctgccagactacacagcactgtctcctgaatacaaggactctgtcttctgctgccagtacttcaaggccggctgtcgcatgcacctgcttgccctcccaaaacgaatcgacccctgagctcctgaatgcatcgtctgaggcactcgggtgcccaaccctcaacccggctgtcacaccgcgattcttgtaaacatatggatcctggcggggaaggatgcaccccttgccaccagatgtgcacaacggctcagcaacagcgtggcaggtgcccagggtcaccccagcgcgactggcgtggcctggtgcccgatggccagtgccgtgaccagcaggccgatgacgaggaagggctgggccgtcgcctggtacttgacatcgttggccacggggtcggggagaaagtagnnnnnnnnnnaatggccagtgccgtgaccagcaggccaatgacgaggaagggctgggccgtggcctgatacttgacgtcgttggccacggggtcggggagaaagtagcgcacctgagcgtacacctgcggatggattggggtgggtgggtggggagcagattggggagggggccgtcggggaggcatggactgcatgagagctctgagcgcggcccttcccaacttggacagcagtcgcattcacggtatgacggccagcctcatccctgcgcagacagggcccaacaaacgagctgcacactcctcccgggcaaggcctcacctggggcgccaggcaagcggcgatgcctgctgcgtagtagggctcgttgaggccccatgccaagtacgctgccacgccgagctgcgtgacgtcgatgctcgcggcacagatccacttggccttctcgatgccaaacgctacgggcaggctgttcaggcccagctcgcggtcgcctgaacggggaaggagggggaggtggggtggagcccagaaggtacgatgactggaggggcaggcatggtttggtgagtggggctgagcagcacgcagctcaagcgctttgggaacagcctgctgacaacacacaggtccatacagcggccgccgtctgctgattgcagggcgggagcgtgacacactcctcccctgcgaccctgcctttgatggacttgaagtcgttgacgatggcaatgcccaggnnnnnnnnnnttggggcccagaaggtacgatgactggaggagcaggcatgctttggtgagtggggcagagcagcacgcaattcaagcactttgggaacagcctgctgacaacacacagatccatacagcgcccgccctctgccgattgcagggcgggagcatgacatagtcctcccctgcgaccctgcctttgatggatttgaagtcgttgacgatggcaatgcccaggccggcaatggagtacagcatcgtcaggatggccacatccagtcgcagctggccgaagaggatctgtgggaggatgcaggcggaagctggctgtctcaaaacattctccgacccgaaaggcaaggtgtcaaggagcaggcaggttatgaggtagaggccacggaatctacacctgcccacggcccacacccagtgctggcggggtccaaaaacacacagacctcatcccattccccactttcctcccgagtcacacctgtccagcccaccagggcagcgcaatgtagctgctccccagggcatagttgccgatccagccagagcgcttgagcttgatccagggcaccgagtaggcaaaggagatgaagctgccgatcagcgccagccccgtgagttgcagattgtcgtgcgaggctgtgattatggaatggaagtgggaagaagtgtgtgtatgaatgtgattgggtccagagcttgccctgagacacagtgtttgatgcagggtcagcggcactgccttgctctgggcacaggtagacagaattgaacgctgcactcccggacttgcatacgatccaacacattaagggcacccacatccagacaggaggaccacatcacactcacnnnnnnnnnnggaggagttttcgagtagagaaagtagcttggcctgaggcgagcatgagtaccccttccaagccaacccagctaaaactcagcaacacagcnnnnnnnnnngtgatgcctgatccagcgtatatgccactgcaatgctggtgaagaagaggatccagatctgcgcgacaacatccccctcagggatggcgcctgttgggtgcagaggaggtttcgagtagaggaattggcttggcctgaggagcgcatgactaccctttccaggccaacccagctaaaactcagcaacacagcatgaggatctttgggaaccctccctcccggctcaggtaccgtaccagacgggatcgggcggttgggctcgttgatggcatccatctcgcgatcgtagtaatcgttcatggtctgtgtgaagcccgtgagcagagggccggacattagcatgcacagcgcgctcagcgcgcagtccctgaaggtccactcgaagtttccagaggcggcagcaccgcagatcacacctgcagagtcgtgtggttgtgtcgaggggatcatgcgagggaggatggcaggcatgcggagcgagggaaggatcgcctgcctcttgccactagccaggttcagagggcagcaggatacgagacaagtctcaccccagatgagtggaatccaggtcacaggcttggtgagctgcagccgaatcttccagatgtcggtctcaaccgctgcgccacggatgcctagcatctgagcgttccctttcactccgaggaagaaggcgcggttggggtcgtcctcggcggcactgcccttgctgggaggggcatcgggcaccacctctgcctctgtggttttgcccaccttctttgcatgcactgtgattgaaaagaaaaggaggttgcacaggcatggatgatgactcggggtgcgagcttgtattggtgcaagtgctggtgctcatgcaaatcctctcagcgactgcatggttgtcacacagctctcagcccacctgacacgaccctcttgagattcagggctcttgaccctggcacaaacgagatccttggtgccggcatggatgattgcaccctggatgcaacaccgacacatttcgtcgtcgggctcaaggtcgtagagaaccccatgacgaccatgggagcagcgcaggaatttattattccctggtttatataaatctaaaccgcctgagattccgctgtattccaatctgatgtactcgagcgcttgcatggggtttgctacctcatgatcgtgcggatggatcctggcaaggaaaggaggacagctcgagacaagaggctcgctcgacagaaagtgaaggacgtcaggtgcagacctggtctgatatccctgagcgcagtatcagcctgaaaacctaggaatatatggatatgaataactcgatgcgatgtaaggccagctgaggaaacggtgttggccggatggcacccacttcccggaatggtgatagccctgatgcttcggtaggttcgattatctgcaaaggtgtcatctcccgttgtccttcctgcatatttgacggttttaatggcaaacaaagggatctggatgtagccgcacccatccctcgcgggcacatctggctgatgagatnnnnnnnnnntggttttaatggaaaacaaagggatttggatgtagccgcacccttccctcgcgggcacatctggctgatgagattgcactccatcagaagtgctcaagctcatgtgccagcatggccaatccattctacaggaaagcaagactctccctccgacgtggacagaccgcatcctctccttcatgcccagctggacccattccagacgccgcgacatcctgtatgtggagcgctcggctcagcgccgcttcctcaacgagtaccgctcccagctgaagcagtatgagcctgtgctcagggctcgtggagaaatgtgaggatcatgtcctgctcttgctgtggcactgggggttgatggtgtctacatgcctctttcctggaggcaaaacctcgtggtatctgtatgtttgcccccagcactggcaccacaggcagctccaccaacccacgctgcagtgtggggaatgcgctgctgacaagcatcttcgagcagagcctgcacaaggatgggaccaaggcccccatatcctacacgggcgtcattgagtcctccctcgccgacacgtctctggccatgctgccgctaaagtccatgatggcgccgctggagccgctgctgcctcccatcctgacccccttcgtggagtgagtgtggcctgaagatgccgtgctggagatcgtggacacaagggtgtgtgatggagtgtttcttgctggaatcctctttcggtgctccctatctgaagacacgctgcggctgacctttggtcttctcatgcatgtgcacagggggttgaaggtcccaatacgcaaggtgagagctcctagtcatcatggccaaagcactgggaggtttcagagcctcgaggtgcctgctgtgtgccatgattgggctgcctggacaggcgcatgcactccaggcacgcatcacagctcaacaccccccaccctccccaatgccctgcagcaaatccaggagaaggagcgccaagtcatgctgctcctctccgtggtggcagtggggtgtgcgatcgggggctacggcctcggcagctttgtgagtcgacgcggaggcagggaggagcccaagtgattggcgactttaccagcccatcccttcgtccactccgagggcatttgctgaggaacgtnnnnnnnnnnccgacgcggaggcaggcaggagcccaaatgattggcgactttaccagcccaccccttcctccactccgagggcatttgctgaggaacgtactaatctcagttggggattttctgatgcggattacccctgctgctcggagtatctgccgtgaaacctcgattaccgaggcctgcattacaatatcatgcttgctttcttgcggaacgcaggattatgccagggaggtcacagtatggggcaatcgtcgtggggttgaggaggagcgcaggggtggtaaggcagcgcggcgcgtgcaccacaagctgtctgcgcccggtgcgaggcatccctcctgccgcacatgccaggccagcacgcccagccctgtgcctgagcaccctccgcgctgatccccagccactcaagcgcccttgtagtagcggttgggcannnnnnnnnnaaggaagggcgcaggggtggtaaggcagcgcggcgtgtgcaccacaagctggctgcgcccagtgcgaggcatccctcgtgccgcaaacgccaggccagcacgcccagccctgtgcctcagcaccctctgcgctgatccccagcccctcaagcgcccttgtagtagcggttgggcacaaagggcatcttggcgactacggcgtcgtagggcttgccgcgcaccaccaccttgagctccgtccccgccttgcccagcgctttctccacgtagcccattgccacgttcttcttcaggcaggggctgtgggcgccggaggagatctcgcccacggtgcgcccctccccgtccaggatggggctgtgctggcgggcgggggggcccgaggagagcaggcccacgcgacgctgcttgacgccgtcggccagctggcgcttgatcacctccccccccaggaaggagaagtcctcacgccgccgcttgccgatggtccaggtcaggcccgcctccacgggcgtcacgccctcgttcaggtcgttgccgtagaggcagaggcccgcctccaggcgcagcgaatcgcgcgggcccagtccgcacagccgcacgcggtcgtcggagacgaaggcggtggccaggtcgacggcgcggtcggcggggatggagagctcgaacccgtcctcgcccgtgtacccggagcgcgcgatgtagcacggcacgcccttgacctcggccttgagcagggagccgaagtaaagcttgctcaggtcctccttcaccagcggctgtgtgtgttggtgtgtgtggtgggggaggggggggaggagttgaagggaggagggggcgtcgcgggtgggaaatggaggaattgttgggaaagggggcaatggaccaggtaaggtatgctggagccacacaggcatatgaagccatctgattcaaatcggactacattccaggtgcaggatgggacctggcctgtttcacacacacctgctgctacatccctctgacaaagcggttcccgctgacacgcaaacaccgccaaccaacccgcctgcccagcccctcactcaaccacctaccccctcagtcaagcacccaccccctcagtcccatccgcacctgcaggacgtccacagcctgaggcccctgcagggccagcagggacttgtcatccatgacctcgagggtgaggtccccggagaagccgtccaggtgcttgcgcaggtgtgccaggtccttgtcacggcagccggcgttcagtaccaggtacagctcatcctctgcgatcctggtgacgatggtgtcgtcgatgatcccgccagattcgttggtgagcacggacagagtgccagtgccgtccttgagccccgcgatgtcgcccaccacgagcttctcgatccaggggatggcatccttgccctgcggaacagggacatgttccaagaggatcagcagggctggcataggggacatgagctactttaatggttcatgttcattgtgaggatgctggaagaaaggcatgcctgcgcatgtgacgccagcatcgccgagatgatgccggggcatcgcgtagtccctccaccactccctccgacccaccttgagggtcactccgcacatgtgggacacatcgaacagggaggcactgttccggcagtgcagggtggagtcgatgatgctgtccttatactggatcggcatggaccagcccgcgaagggcaccatcttgcctggatgcgtggtgagcagtgggtgtgggtgacatgcccgagacccagggcaggccgtgagcgcaggtacttgtgttcataaaaccaccccgggccccccgtacgcacctccatgctccacatggaagtcatagagaggggttttcttcagggaggcatcatcggcgaagaggcgggtggaggttgccaagcacgggaccgcggccttggtgccgacgcctgcagcactcgcacacctgagcaagctagaagctacctgtcgcctcataattgagagatcgcggacgtgcctttgaatcggggtttggtgggaggggcctgtgtgggccagataaacagataaccagtcttccgtcctttcgatccggtggctatcgatcgcggggagaggggcgcccggatgacaggcggacaggcctgcacccatgatacgatggggcatggagcgaatgtcccacacgatgatacccatggaaagatgctgtcagcatgcatgggcgacccgtggcctcgtccggggaccacgggccggacctaatggactgtcgctgcccaggctatctccccgaacccatgcccgacctgcagccagcaagcgacctgggcccaccaaagacgaggtgcgcgccatggctggggcccaggtgtgggaatttgtgtttgattccctgccgatcttctgctcatggcaagagcatgggccggtgaacatttgtcttttgggaccgtctgcacgtcctgataccaccctacaatgacaaccagtcaacagcgacaccatgcagaccgacgttacttattccatcctcgtgcttgctcctcnnnnnnnnnncgggaatttgtgttggattctcttccgatctcctgctcatggcaagagcataggccggtgagcatttgtctttcggaaccgactgcacgtcctgataccaccttacaatgacaatcagtcagcagcgacaccatgcaggccgaccttacttattccatcctcgtgcttgctcctcaggagagggaggttcccttgggaaaggctggagggttgaagaaggtggcagtgacccgtccaatcggctcccccccccctgacgaggcggaggacaccagcaggctcgccgtcccccaggaggtcacagaccgcatgctgcgccgcatcctcacctttgcagggctgcccgtggctgtttccatcctcttcctccccctattctacttcctcaaggtatgtgccaagtgctcgggctgactcaccctcgccaccacatgcggctgggcatgcagggcctcgcctgcatgccggagtatcaccaacgccccgcaagactgtcgctgcactccgaacaggcctccccctcccgcctccatgtgcaacatgcatgcaggtgacacaaggcttcgaaattccgctgccggcggtctacttcatccagagcctgggctttggcggtggcctgtttggaatctcctacggcatcctgtcggccagctgggacccatcgcggccgggcagcaccctgggagccaacgagttccaggccaacctccccatcctcctggagtacctccgacggaagtgaccggctgattcggagatgtgctgtcccttgtttgcccaggcgaaatctggctcgtgaagccagtcactgctgagctcggaggcggcgtttgttacagagactcatgctgcggcttctcctctggcttgcgcgtcccgtcgctcaggagacgatcaaaacccctcctcagccgactttcgattcagaaccagacgtnnnnnnnnnntcagctgattcggggatttgctgtcccttgtttgcccaggcgagatctggctcgcgaagccagtcactgctgagctcggaggcggcggttgttacagggactcatgctgcggcttctcctctggcctgcacgtcccgtcgctcaggagacgatcgaaaccccttttcagccgactttcgattcagaaccagacgtcgcgctggtaccgcccctcccgcgtcataccgtccagcacctgcctggcctcctgcggggtcctggcagagtgctgggcgatgacgccgagcagcgcctcctccacctgcccggccatggcggccgcgtccccgcacacgtagaagtggccgccggcttgcagcgcggcccacaccatggcccccgcctccaccagccgctgctggacgtacacctttttttccggctgcacagggagtgaatggggtttggaggtgcagtgactcttgcatggaatcaaggggcacggaaaaacaagtgctgtaacaccaccgtgcaaagtcagtgcgaggcacatggcctcaggcacatccgcaccaccaccggcctccctcacatcttcacgggagaaggcagtgaagagctggatgctgccctcctgagcccaggcctccagctgggaaccatacagatagtcctggtcccgcctccggcacccgaagaagagcagcgcctcgcccagggcgccgacagagggcttggccaacaaccgtcgctcctggcacaggtacaggagggtgaggctttgagctttgaacatggggcggcagggacaagggttactggggcatggggcagctcaggaggcccagcctaggtgggtttgttgcccggcaggcgatggcgggcgaggcactgtggccggcccaactgcaaccacctgctcaatatccgagcgcaccatgaggaaagagcggaagggcgcgagccctgtgccgggccccaccatcacgatgggcttggatgggtcggagggcaacctgggcagaggacggggggtggtatactttgttggtgctagaggggggctgcatggtttttaacgaggtcgattcttgcaagacaaggagtgcatgtgcccctcccaagcctcgaactccttgactcagcaacaaccccattgcaggtggcagaattgccccggtcaaagttatgcacccttctcttacgacccttgtccagaagaggcagaaacaatccccatccgcccgcagtcccgtccactgtggtccatcccctcaatcacacgccccgccccccgcctccggcccccctccacactaacctgaagtcggggttggtgtggatgtagatgggcagggccgcgcccgggcccagccgctccgccaaatccgtggaggccacacccaggcgctctgcgcccagcgactcgtaccgcaccacggccacggtggcctgcacccccgccgcgccctccagctgggaggaggagatggagtagaggcggggcgccagctggcgcagcgtgcccaacacgtcggccggctgggggcgggccgggcggaagtcggcgagcacgtcgatgacgtggcggggggccaggtaggcctctgcccgcnnnnnnnnnncgggggcgggccgggcggaagtcgacgagcacgtcggtgacatggcggggggccaggtaggcctctgcccgctcagcgtcgcccaggaaaccggccagcagctgcaggatgtcgaggagggatgctttagggaaggagcgaggggcgggtcctcgcaggggggtgtactgggcgccgaggcaggctgcagtccttgagggtccagcatggccagggtcgtgacgcggcatcccagagtcttacaaaccacccgcatcacccggccctctcacgtcgagcttnnnnnnnnnnagaggggcgggtcctcgcagggggatgtactgggcgacgaggcatgctgcagtcattgagggtccagcatggccagggtcgtaacgcggcatcccagagtcttacataccacacgcatcacccggccctctcacgtcgagcttgtcggccaggcaccctactacgcaggcagccgcgtcgtcagctgcatcccctccgcagctgctgccgtcggtgccgcagcccggtttgccctgcagcgaatccctcagcagcgcaaacagctccgtcctcggctgcctgctcgtgggtgtgaaggagacatgtggctcaggacacgtgcagctctgagcagggaagctgacgggacgcttactgctgtgtgaaaactagcaggcatacggcaagagtcctttgggttgctgttacgagtgcatccgaaaatgcctggaacacagctctaccccaccaggaccccgtgctacctgaggtcatagcagcgggtgagggcatcccgcagcgtcatggatgtggcaccttctgggagccgggggtcggtgtagtgccacttgggcacctggacgagcaggtccccctttccacccagcgccacgaccagatcctccactgcctgcggcaggggagggaggagagaggtgggagggaggtgtgcaccacagaagatcgcgatggcccacatcatacaatcgccgcgcgatgccaagcaatagccgtggcggccagcccctgccggccaagtactacacaaaatcgcccagctgctgcacgcccgctgagcaaactaccagccccgtcagcacgcgcctgcgggtcgttggagggccacacgcccaaggcgtctccaggcaggtactgcaggcccgactcccccaggctgatctcgacacggactgggagggagggcggggtggctgtgagtcgcaccgacgcggccgtgccacacaagcatcctgaaacctcggaaccgcagccagcaatgaatccctgggcannnnnnnnnntgcaccgacgcggccttgccccacaagcatcctgaaacctcagaaccgcagccagcaatgaatccctgggcagatcccacctgcacaacaatctcatcaccagcaccttttcaaagcttcacacattacctgtgttcttgtcatccgggccccggagcgcgcacaaaccctccacagccgagactgtggccaggtacggcctgttcctgctccaccctttcctcttggtctgcccactccccagctcggggctgaggaaggccagggcgtctgcacggtcgtcatggaggagcgcgggggctgtggaggcagcttggagagcactgtgagggcacaggccctgcaatccgtcactacatgcatcccttgcgcgccccctggccctccagccgctggcgcccagccgccgatggctcaggagccaggacagtggagcctctaccatacacgccctccagagtgccacccaccgcttccttccagctcctccaccgtccgcaggtcgagagtgcccagcgaggaaatcacggcatcgatccaggcatccaccgccgcatagtcctcccgattgatctcggcgcggggggcgaagcgcgttccccctgccgactccagccaagcgtcaatggaccgcccgcagcgacagaagtgggtgtaggtgctgtcaagatgaagggggaaattggtctcagctggaggtcattgggacaaggctgcgctccacacacaatcaaggcacctactctgcgaaacaatgcaacgcaaagctgcgtccctggtcggcacagaaaggtggaaaacctgaactgggcggtctttgccacaccctgcccctctccaccggtccgtccatgtctctgtctcctgcaatccccacctgccctcagtgaagccctccccgagacccgtgcccacattttcaacccacccccggatgaccccaccaggggtcccagccacaaagctcacgtgtcgcccagggcgcagacggagaagggaacccctttgaattcggcggcctccagggacgccagccatgcgcagaagccgcgcgcctctgccggcggcacgccgtctccctgcgtcgagcagaccaccgccagtgcctgctgcttggtcagcgggggcacgccctcggcgtggtctgccatgtccagcaccaccggcctgcgaggaagggtttgcagggcggcctcgagccacaaggagcacctcacactgggacatgttacttctcgtcgatcgaaatcatggagggtcaaggtgcatcccccttgagtccctcatgcgctcaccagtacccctcgcccgcttcccgaagcctgtcagccagccgctctgcgatctccttggaaaagccgtactctgtgccaaacacgatggtgacgggccgggcggtgggcggtgcgctctctgcctcgccagatgcgctgccggcctcagcatggtcctgagacttgaaggcggcagctcgcaggtacgcctcgaagctggtctcttcaaaggtttgtggggcggggaccccatgggtgggcacccccacgctcaggtcacggaggtaggcgccgaagccggtctcctccggcccagccactggggggcgcgcggggcgtgtcaggtagtacaacagtgcccctgcgcccagtccagcaccagccatggatgcataatggtcagatagacccatgctggggcgtggcgcctgctccaactcctgaccactcctcgtgggctacccccaggcgaacacctgccgtgctcgactcgaggcctgagtgggccaccgagtccctaccacatgcaatgactgtgatctcagaatgtttccctgcactcatgtaggcataccggattgaaaacattggtcgcagcgccttgcgcccgaaattcagacttcgtgctttgcatgcggtgggaggtgttgatcgagagtacgtcaaatatgttacacaagagcttcctggattgtnnnnnnnnnntttcagacttcgtgctttgcgtgcggtgggaggtgttgatcgagagtgcgtcgaatatgttacacaagagcttcctggattgttctgcctctccgctcgacctgatacagtgggaagcagggtaaataaccaggaccgtaatcccattggcagccccatcatgcaagcagcgccacagcagcacaaatcccagcgagtgagaactctccaacgagcactcctggtgatcgaaagccctgcagaggggggagatggcaacttgatgttactgtggaagccatgatgctgctaaatgcttcacacactaggtgaaaggcgatgtctatctcctcacccaatcccacacgccactccactctgcctccctcccagcctacccagagtgggagcatctctacgtgcagccaggactgcaccgctcctcccaccagcgtccccagcaagagtccggcccccgtgatggccactgccctgcccaggcccactttcttcctgtctcgcagaatgtatatggcagagccagtgccaagggccagctgcagcccaggaatggagttggcagcagccagggcgttgggttcagtgaggccctgaagaaggtggcaggagttggagctgggatgctgttggggccagggcgagcgcagctggcaggcgcgatttgccaatctgagagtcccagctgtggcctcggcgagccgtcgcactgcagagcagggccnnnnnnnnnncgtcaccctcgcacctggagcaggctccatgcgcccagggcgacaaagacgccaaccacagacgccgtctgggtgtcactcaatgtgctgacggtcgcaaacccaccaggcagttgctgtggcttgctctgcggcatgttgaagtgatcaagtacaatgagtaggagagcgaggcacaggtatactgccaagtccacttgnnnnnnnnnncagaaatggagatcgccaggcgacagtgccctgccccgcttcttgccttccccannnnnnnnnnagaaatggacatcgccaagcgaaagtgccctgccccgcttcttgccttccccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgcggcttgctctgcggcatgttgaagcgatcaaggaggatgactaggagagtgaggcacaggtatactgccaagtccacttggaaggaagggagtgtttccacaatacatgcgtttgcataacatccctcggccatgcctcccactcacccgctccttggacttgggcttgggacgagggcgcacgtcggcatacttgaccttgtttggcacggcagtgtcccccgccaggcgggtcctcatcaggtgcatgaacagggaatcataggcgccctccacgcgcatggcccctgcagatcctggtgcgtgctttgcaagcaagcgattcttcgatctattttgcagattcaagggttgggaaggcgcgtgatgaggtcgcaagatcagaactccatgccgtccacctcggaagatcatgtgctatgcttacgccaaggggccgagtccgcccgactcttgggggaccagcgatgtcgcaagagcccctctactttacaccatgggttccagaaaccccacttgaatcccatatcaagaagacttaccgtacaacttcctcgaaggttgctcccgtcgccagtccgagcaccatgtaggcctcgtcagggctgaggctggtcgatggggcttctggggactccccattgctcgcatgaaccaggccaaggcgtatcttacgacctgatgatgctctcgttacatgcgtgctgtcgaattgcaccccagatctgaagagccatccgtccctgtgaggtccacgggcatgcagggctccatgcgaaagcgtgacccggcatgcagaggcctggatcaaggtctggcatcgggaggtcaacccctgtgtcgccatcatctggaggatagaaagatcatgcacaatgtccatcggctttcttggcaccgatgatgtcggattgaatgggaggactgccccgacacacgcagcgagagagctaccatcggcagtaccctcccgggccccgaccatccgaatttcgaagtgaatgcctgggccagtcgccgggtctgagatattgccgccattcccggctcgtcttaggttattttatggcataatgtcgggcttgggtctcaagatcccgcgcctggacctgagtagcgcctcctccgcccgctctgacgccagcccccgcccctccaacgacgcctcggcccggggcaatggcagctctgctcgatcacggctgcatgccatcacggagcgggtgctctctggatccacaggcgacaaaacccctcgcctgagcgcgaggggctccggtatcagtcggctctctgtccgtgccagcagcacgcagctcacggacgcaccgcccacctctcgccgtgagggcaacacctcccgccgcagcaagggtaaggcccggctgcactcgatgctggggatcgggggtgtccctgagaaattgtctgggccgtcgttctgcaaagtactgctttgatgtgccattgcgactgtgcgcctccgtgttgctgcctcatgggaacaagaagcacccactgccgtcccattnnnnnnnnnntatcgtgactgtgcgcctccgtatcgttgcctcataggaacaagaagcacccactgccgtcccattccctcccacaccccgattcccagcggaggacagcctcaccacgggcagcggcagcgtcatgcagcgcgccaccttcctggacgccctcatcacggcccggagggccagcggcggcgtgcccaccccccgttcttcaaatgctggccccgccgccacggccccgctggtcacgcccctgcccccgcggctcgcggtggcccacctcacctcaacccccggcagcctgacctcccgcccaccccgcctcgagaccgggccccgcgccacaccgcgtggggctggcagcgccctcacctcccgcggcgtggcaggcggnnnnnnnnnngccgcaccccgcgccacaccgcgtggggctggcgccgccctcacctcccgcggcgtggcaggcggctcgttcagggcgggcgtcgcgcccggccccgcccccgccgccgcggtgtcggtgggccagctggccgagctggcggccagaaggcgcgccgcggcggcacaagcgctggagctgcaggcggcggccgccgcggcgcgctccgcgtccgccgcccggaaggccgacctggccgacatgggtgagggggagtttgacgcgctgtgagagggagtgggtcttggtctgggggcatggcagccgcggtaggtgctgttccaagggccgggctcgaccgcgctgcgatgttgcgcctctgggcgaaccaacgggggcagtggtgcgcccatccacacagaattgccgtgccgcagttgccctcgctccatctgccaccctgcaaaaccacccgcccctggtcccttccgcaacagaggtggcacacaccgctctggctgctgagctggccagtctgcgctgcagcgctggggagaaaagcgccacggtgtttgctgcacgcaaggcccttttggagacaatgaaggtgacgcaaggaatgcttttgggggggggccctgggggagtgttgcctgatgtctgcggaaagtcagcaacacgcttatgcatgggaattctcatggagagaaatagaatggcatgggtataacttggcagagcagccggcaggcccaaacaaaccaggctcaacctccctccacctccccctccctaccatcactctgccaggcggcggcggcgctgctgcagcttggggacgtgcaggcggcgctggccggggtcgcgctggaggcgcccccgaccgccagccccaccggcactcccttggccaacgggcagcgggccagcttccgcgcgggttccagcgggcccggactcagccccggcgccctgcacagcctgacatccctgggcagcaagctgagcgcggcggagtcgctgctgctcggnnnnnnnnnngaaagcgccgcggtgtttgctgcgcgcaaggccctcttggagacaatgaaggtgacgcagggaacgttccctggggggggcccgggggagtgttgcctgatgtctgcggcatgtcagcaacacgctaatgcatggaaattctcatggagagaggtagaatggcatggacataacttggcagagcagccggcaggcccaannnnnnnnnntggcgaggaggtggatagtgcggagtgcaggctgcaggcgctgccggagagggcggaggtggcggcggtgatcgcgccgagtgccgtgcaaggatgggagccacggcaggaggatctcgagcgcgcggggcccgggcgggcagccgagcaggcgacccaagctcctgatccgacgccagcggcatcgacctgagcgcacatcgctcctgatttctgaccattcgtagattgttcacgacgcacgatgcaaacgcccctttgctggtggtgtgcagtctgcggtggcacgcctgcaacccagtgctcggcccgccatccctttttccacccaaccacccctttgcatcgcggcggcacgcctgtaatctagctctgcccttggccacccatcaattaccatggagggggcccttagcacgggaacacagcaggagctcgggtctgcagcgaaccgccgcccaccgtctggaggctccgaccgcgccgtcagcatggcgctcagcggggcagctgggcgagggccggtgttgcaccacccccnnnnnnnnnncctagctctgccctcggccacctatcaattatcatggagggggccctcagcacgggaacatcgcaggagctcgggtctgcagcgaaccgccggccaccgtctggaggctcccaccgcgccgtcagcgtggcgctcagcggggcaactgggcgagggccggtgttgcaccacccccgcgggacgtgccgtcgagcagcgcccccggcagcttcccggcccgcgccagggcgcagaagcccgcggcgttgtccggcacgccgtccaggtcggcttctacatccggcgcgatgcccacgcggttgatgtctcgccccgccggcgtctggtaccgcgccacggtgaccgccagggcggagccgtcggacagcggcgtcagcgtctgcacaacgccctttccaaaggtgcgcgccccggccagcctgccccgccccgagtcctggaccgcgccggccagaacctgggcacaaaagtggaggggaggaaagggggagtgtggggatgaggaggggggtggcgacgccgtggtcccctgccgtcctgcacccggcgacgtgctcttcatgttccgagcagtggcgatctggccgtcggcagatctggagacctgggcgggcacgcgcatgggcacggaaaacaccggcgatcttgtccccacccctccccaaagcgccctcgctccacgcgcctcggcggcgctggccgtccgcgagttgaccaggacgatgagtggaaccttctcgtccagcatcgcgccgccctccgcctcataccgctcgcgcacgccttcgctgtgggggtggcaccatgtgtgtgtgtgtgtgtgtgtgtgttcagcatcagtgagcaggtgtccagcattgcaggcggagtgcggcgcctacccccccccttcccccctccccatggcacagagactgatattccagcaatgctgtttgaccaggagagcaaaatcccttccctttgcagaatacatccacacccacatgcatgcacctgtcggcgatcaggacgacctcggtgccctcggccaggagctgctgcgccaccgccacgccctgcgcaaagacccccccgccgttgttcctcaggtccatcaccagcagggaaggggagccggccgccagcttggtgagcgcttcaccgctctgcggtgtgggcagagggggattctggggtctggaggactgcaggcgccgcggcgcaggcgcactggtttgtgaccttggcgctcaacaatgtaggcgaccttcttcctcacgcattcagaaaccctcagnnnnnnnnnncgtgaccttggcgcccaacgatgtaggcaatcttcttcctcacgcattcagaaaccctcagactgcgctcggggacccccaccacctaccccgccatccttgcacctgcttgccggtctgctggttgaaggcggcgatgcggaggtaggcgacgccccgctcgccgccgcacgcctggtattggaccggggtgaccaccagcctctcccgctgcaggctcagcacgcgacgcccacgcgaggtctggacctccgcctccacgccgctccccgtctcgccctgcagcagggcgcctgtggggatggcatgggaagaaagggcgaaattgaggggtctctggtgcatgacagcgcggtgcaggccccgtcagaccagtcgtgggatgggccagcgccacgataaactcctcccttttgtgcacaacagcagcagtcccttaccgatggagtaaagagacaggccccccgtctccctgccatcgatgnnnnnnnnnnacctgtgggggtggcatgggaagaaagggcggaaatgaggggtctcaggtgcatgacaccgcggtgcaggccccgtcagaccagtcgcgggatcggccagcgccacgatgaactcctcccacttgtgcaccacagcagtagtcccttaccgatggagtaaagggacaggccccccgtctccctgccatcgatgctcatgatggtgtcccccgctgccacgccggcccggtcggcgggcccgccaggcacgacgctgagcacctcggcgcggctggtggccgaccccggatcgctgcggagccccacctccaccccgatgccggacagctggccgctggaggcccgtctgcaggtagggggggtcgggtggaatgaggggaaagtcttaacatgtcgagcagcgcccaggttgggcactcatgctcaatcctgtccgagcttggggtcgagttatgaacatcctccctgatgggcacactgtggaacttcccatcctccacacacnnnnnnnnnnccctccaccacacacccccatgaccttcctgtcacctcaccttgtaccagttctggccattgnnnnnnnnnnccatgccaacaggcttgcacgccgcatacttgagtgcttcatactggtcagggccgaggtggcgcgtgaaggggtcccccagggtgcccagcagcttccggatggcggcatacgcctgctccctgtcaccaaaagactctgactgcaggagcgactccctaatctgttggacgtgcatgccgatgggggggatggactccgggaatgcggatctctaggcagcgcgatgctcgagtcgatgnnnnnnnnnntatcacgctttgatattgtttggcaatgatcaagtagaatgccaggcttacgtgcgcatgctacatgtttttgaaatcgacttnnnnnnnnnntcctccaccacgaccccccacgaccttcctggcacctcaccttgtaccagttctggccattgaatgtcttgtcaacgtaggcgcgatccacggccttccatgcctccaggtagaggagctggttcttgttcacggcatgtgcagggctggcaccgctcagcaggatgacgctggccaggcctgcgatgcccagcatgcctcgctgcaatgctcggtgaacgctactgagcaggatctgtcccgacgactcatcacgctttggtattatttggcaatgatcaggtagaatgccaggcttacgcgcgcatgctacatgtttttgaaatcgacttcgtacccaccccagggcctgtgcatgggcgtatgtacatcgcggaatgggagatgcgggtcccggcacgacacaagggtgcatgcctggactgccaggcattgaaacctctgtgtcacatgagaggatgtagggcgaacagggatgccgcggacatccccaggccactgatctggttcactgtggtttgttgcgcgcgcattgagaagattgactcggattggattctgcgaatgatgaacgagccggagcgtctgccgggataacagagacagcaaagaaacccatacagggcgtccattcccacgagaccaatttcatcgtgctaatccatcgccaagtggttcatcggagagatggtggccgtcggcatccatgctcatgtcgttcgcaccctgccctcccctggatgtaagcgctcggagcatcgcagaccctgcatgcatgcacatgatcatgcacataataaatcaggttattgcgagcgcgtccagctgaactctcacacatgccagcgcaggcgggatggagggacggcctgcatgggccagatcacccctggggaactcgtgcaccccccgcgtgacgccgtccacgctgaagaggagtgtctcgcgtcaggcgggcgggctcgagatggagaacgcgcagaaacgctgggagaaccaggtctgtcgaatgattgatcgactgccaatgtccccagctggtgctgccacatgttccctgtcggagctgcactgcttgccatgcagcaggggtgcacactccttccccctgtccctcctccactgcaggttcgcgacggcagggtccggaatgtgcgtgccaaggaggtccccggtctcctgaaggacggctggaccctcctggacgtccgaccatccnnnnnnnnnnaatcgactgccaaggtgcccagctggttctgccacatgttccttgtcggagctgcactgcttgccatgcagcagggatgcacaccccttccccctgtccctcctccacggcaggttcgcgacggcagggttcggaatgtgcgtgccaaggaggtcccgggtctcctgaaggaaggctggaccctcctggacgtccgaccatccagtgagctggacaaggtgcgtgctggagcaggctggtgtgggtgggagaaggaccagtggaggatcactgctggctgcgccatttctgtgatgaatgtgtctcgcaggcattgaaagccatactccagtcaccatgaatgaagaagatgaagtttggggccccctccagctcatgcatgctgcgcaccccctctccccacgcccaggcccgtatcaagggggcggtggaggtgcccttgtttgtcgtggacgatgatatgagccctgcgggactcctgaagcaggtgggtcctgcccaggtcctggagccgtgagctttcattcgttcaccgccctcaccagcaccatgttccaccgtccccactcgcacccatccaccccgcaggcgagcgcctttggcatgnnnnnnnnnngcagcaccattttccaccgcccccacttgcacccctccaccccgcaggcgagcgcctttggcatgggcggctggtggctgggcggcaagcacatgaagccgtacccaactttcctggaggaggtggaggccaaggtgcccaaggacgcctccatcattgtggcctgccagaagggattgaggtgaggtgcagtgtggatggtgggttgcttgtggatgtgacacaaccccctgcaacccttgccagcacccacgatgaggtcggcctttgcgcacnnnnnnnnnnaatggtgggttgcttgtggacgtgacacaaccccccgcaacccttcccggcacccacgatgaggtcggcctttgcgcacaggagcgcgcccatgccttgcggcgctccctcgcagacttcctgttgtcccccgcccgcgaccctctcaccccctgttgccaacctccagtcgcaactccaaccaccctcattttcctgctaccaaggtcgctggcggcatgcgaggtgctgagccgagcggggtaccgcnnnnnnnnnncgtcgcaaccccaaccaccctcattttcctgccaccaaggtcgctggcggcgtgcgaggtgctgagccgagcggggtaccgcagcctggcctggatcaacggcggctacgacacggcgcagcccggggagttgccggtggagggcgacgtggacgtgcggctggcaggcatcggcggcctgtcgagcgtgctgggctggaccgagccgcagcgggagggccagggcggcggcttcgcgggcgggttccagaacatcctcaagggtgtggcggtgatcctgctgctggacgtcctgctgttcggctgggagctgatccaggccagcaagcagtgatgctcgggtggaggggaaggacgggggggagggagggcaagttccagcctgcattgcctgcatctctgtgccggggcggcccatcgnnnnnnnnnnagggagggcaatttccagcatgcgttacctgcatctctgtgccggggcggcccatcggcatgtgcaattttgtgagttggggggggcgccgatgtacatctgcattctcccatcggtctcgtaaatgcatcgatccaggccagacaggggagagaagctctcattcgtgtttacctttgatcccctgatgagcgtgcgtttcnnnnnnnnnnagtccaggccagacaggggagagaagctctgattcatgcaaacctttgatcccctgatgagcgtgcgtttctgccctttactgcggggagctctgattgaatccgggggaggaaacgggggacaatatcctggggagcagggtgcaacattcaaacttcgagcttgaggaccgagagccatcgcataagcgccgctgttcccaccacccccgtacttcgcgcaagcatgcagtccgctcatgcaacctcactcggcctgagggccaccggcgcaccgggccgatcgtcccagggcctccccacccggtcggctgccagtatgcgggtgcacgcagcagctcggcagggatcatgggcaccaaagcccatgcaccgccctcgatcacacatcggcttcgttacccaggcatcgtatggctccgggaactacggcccagtgggtggcgacgccaggatcaaggtcatcggtgtgggcggtggcggtggcaacgccgtgaatcgcatgatctccagcggcctgcaggtgcgagggatgcggtggatgtcccagtggcatgctgagattgggagggatgacacctggcgtgtgttttgggcctggagatcgagctgggctgttgtgagcccctcatggccggcaggccttgcactgaggccgcgcgatgcagtcgacctcatccccgccatgaccctcagggcgtggagttctgggctgtcaacacggacgcccaggccctggagagccatcaggcgctcaacaagctgcagatcgggaccaccctgacccgtggcctgggtgggttggggggatgtttggaggttggccctgcttctgggggtctctggcaccctagttcagctgaaaggctgggcttgtgacatgaacgcgtcccccaacaaatcacgcaggtacgggtggcaagcccgagctgggggaggaggcggcgcaggagtctcaccaggagctggcctcggccgtccagggcgcagacatggtgggcttcaatatggaatgggttggaaattgtgaacaatgctggctcctgcacaatcaggaaacgacatggtccttgcagctccatgcatgcctcctgacgggccaaacgcaaactcacttttcaataccaatctcccacccaggtcttcatcactgnnnnnnnnnnagcttcaatatgaaatgggttggaaattgtgaccaatgttggatcctgcaccatcagcaaacaacatggtccttgcagctccatgcatgcctcctgatgggccaagcacaaactcacttttcaaaaccaatctcccacccaggtcttcatcactgccggcatggggggtggcactggaactggagctgccccagtggttgcacggcttagcaaggacctgggggtgctcactgtgggcgtcgtcaccttccccttcacctttgaggggcggcgccgggccgggcaggtgaggggcatggggctgttgttgtggttcttgttgtttgggggggtgggatgggggtctacagccaggcaaaccttgtcagtggatggccatgcccagtattctttgattctcagcctgcaatgctttctggaccccagtggtccctttgaggctgccccccttgtccccaggggggccctaaccccatggtgtaccctctttcccccacccccccaggcaactgatggcatcgacaccctgcgcaagaacgtggacaccctcattgtcatccccaacgaccgtctgcttgatgttgtgggcgactccaccccactgcaggacgccttcctgctggccgacgacgtcctgcgccaggtgggcgacaaggaggcgagacggtattgcccgaccgtaccttcttttatcgactctcgccaggagattgggacgtcaggggggccctgggctggcctcatagcgcagttcaatgcagcgtctcatgttgccatgnnnnnnnnnngaggaggcgaggcggtattgcctgaccgtcccttctttcattgactccagccaggagattggggcgtcaggcgggccctgggctggcctcacagcacagttcaatgcagcgtctcatgttgccatgcccatggtatcagatttggatgactcatttcaaaagcatgaacccccttcccgcagggcgtgcaaggcatctctgacatcattaccattcccggcctggtcaatgtcgactttgccgacnnnnnnnnnncaaggccatcatgtgcaactccgggaccgccatgctgggtgtgggcgtgtcctctgggaagaaccgtgcagaggaggctgccatggtgagtggagtggcttggggagtgggttttggggggacctggagtctgctggcaccacatgcgctgggtttccactgcaagcgctgcctttgatggtatgaaatgcctgatcttggtgaaccctcaccttcccctttccccccttcccaatccccccaactccactgcaggccgccacctcggcccccctcatcgagcgcagcatcgagcgcgccacggggatcgtgtacaacatcacgggcgggcgggacctgacgctgcaggaggtcaaccgcgtcagtgaggtggtcacctcgctcgccgacccctccgccaacgtcatcttcggcgcggtcatcgacgacgcgtatgagggcgagatccacgtcaccatcattgccacggggttcaaccagacctttgaggaccagctgctcagcgggcgcagcgtgctggtgagaatgttggtgaagcgggggtgctgtgtccttggggtggcatgtctaatctgtcagggtttgagggggccaggtgggtctttgggggatgaggattgaagtgcgggtatcagcggagattatgaggggtcaatgtggcgaggggagcagcaatggatgcgggatcgccctaggccatgtcctctcgggccagaccaccttccagcaacatcccccctctgctcctcacccacatccctccccgcccctacaccattccattctgcagcctgctcaacccgacctctcccgcgcatccaacgccaaatccggcaacggacctgcgtcgcgccaggcggccaacgggcacgcatccagcctcggcggcggcggcggcggcttcctgggccgcacctggtgagctgacagaccatggggccagggctcggcgttcacgaacacccacggaagtgtggtattgccgttccagtccctaccccggccccagtcgcagccctcgtcctgtactttagctcgctgttctgttccccctgctgctggaaaccgctgtgccctgcctgccccgtactctccccgtcaacccccttcgacctgcattaagaaatctgcgttaagtggccgccgcgggggcgcagaggcagccgggagggggaaggagannnnnnnnnncatgaaacccgcgttaagtggccgccgcgggtgcgcagaggcagccgggagggggaaggagacgctacaggtctggtcaacagcattgcaccctcgagagtggaggggacgatacgcaatggagcggaaagtgtttggtcgaggaaactacccacaatacaaaatgatgcctagcgaggtgcggaagcaccgcagacctgccactccatcagcggcgccctccccgcagcagcccgacccgccaggcctgcaggctgaccagcagcatgtgcagcagggccagcgcggctgccgccaggaggcgcaggtgggacgcgcgggggacgagcgcccgggcccggccggcgccgcgccgccccccgccgcgccgtcaggcggcgacccaaggtgcgggcgtgagatcccagggcgtgcgccgcacggccgcgtagtggctgggccagtagcatgcgcgnnnnnnnnnnnnnnnnnnnnnnnnnnnnnnnnnnnnnnnnnnnnnnnnnnnggtgagctccccgcgcgcgccgtcgtagacgagcatggggcgccagtcggctgcggggcggccgcggcgccgctgctcggccgggtaccccaagggccactgcacgtagcgcacgccgtccagctcagcgtcccagctgaagtgggtgtggccaaagacgtgggcggcggggcgcaggcgtgcgatgcgcgcggccagggggtcgctgcccaccgccttggccaggttggggtggtgcagcatgcgcttctccggcagcaggcgctggtccggcaggaagtgggagaaggtgatgagcgggggccgcacgccggacacggcctccgccgcgtccagcgccgccagcacgcgcgccgtgccggggtcgttgagcgagtccatgtgccgcgcgatggagtcgtcggccgggctcagaccaggcaccgaggaccacgtgcaggcgtggaagtccatcatgatctgggaaaggaggaaggggggggcgcaagggggggttggggg

SEQ ID NO: 44996 - DNA, 61 bp, Chlorella protothecoides
cggtgcccatggcggtgtcggtctccagggggccacgcctctcggtcttcatggaggcgtc

SEQ ID NO: 44997 - DNA, 61 bp, Chlorella protothecoides
tcaggtgatcaatatggtgggtgcttcgggggtgctgcacctgtccaacacaactctgcct

SEQ ID NO: 44998 - DNA, 21546 bp, Chlorella protothecoides
  modified_base (167)..(176): a, c, t, g, unknown or other
  modified_base (1149)..(1158): a, c, t, g, unknown or other
  modified_base (1820)..(1829): a, c, t, g, unknown or other
  modified_base (2301)..(2310): a, c, t, g, unknown or other
  modified_base (2942)..(2951): a, c, t, g, unknown or other
  modified_base (3305)..(3314): a, c, t, g, unknown or other
  modified_base (3586)..(3595): a, c, t, g, unknown or other
  modified_base (3786)..(3795): a, c, t, g, unknown or other
  modified_base (4213)..(4222): a, c, t, g, unknown or other
  modified_base (4868)..(4877): a, c, t, g, unknown or other
  modified_base (5286)..(5295): a, c, t, g, unknown or other
  modified_base (6430)..(6439): a, c, t, g, unknown or other
  modified_base (7136)..(7145): a, c, t, g, unknown or other
  modified_base (7941)..(7950): a, c, t, g, unknown or other
  modified_base (8165)..(8174): a, c, t, g, unknown or other
  modified_base (8654)..(8663): a, c, t, g, unknown or other
  modified_base (8735)..(8744): a, c, t, g, unknown or other
  modified_base (8989)..(8998): a, c, t, g, unknown or other
  modified_base (9846)..(10036): a, c, t, g, unknown or other
  modified_base (10529)..(10538): a, c, t, g, unknown or other
  modified_base (10695)..(10704): a, c, t, g, unknown or other
  modified_base (10767)..(10776): a, c, t, g, unknown or other
  modified_base (11277)..(11286): a, c, t, g, unknown or other
  modified_base (11918)..(11927): a, c, t, g, unknown or other
  modified_base (14312)..(14321): a, c, t, g, unknown or other
  modified_base (14699)..(14708): a, c, t, g, unknown or other
  modified_base (15134)..(15143): a, c, t, g, unknown or other
  modified_base (15749)..(15758): a, c, t, g, unknown or other
  modified_base (17689)..(17698): a, c, t, g, unknown or other
  modified_base (18016)..(18025): a, c, t, g, unknown or other
  modified_base (18271)..(18280): a, c, t, g, unknown or other
  modified_base (18842)..(18889): a, c, t, g, unknown or other
  modified_base (19023)..(19032): a, c, t, g, unknown or other
  modified_base (19493)..(19502): a, c, t, g, unknown or other
  modified_base (19594)..(19603): a, c, t, g, unknown or other
  modified_base (19745)..(19754): a, c, t, g, unknown or other
  modified_base (20502)..(20511): a, c, t, g, unknown or other
  modified_base (20633)..(20642): a, c, t, g, unknown or other
  modified_base (20982)..(20991): a, c, t, g, unknown or other
  modified_base (21072)..(21081): a, c, t, g, unknown or other
  modified_base (21309)..(21318): a, c, t, g, unknown or other
tgacggcaggcggctgcagcgccgaggcgtccagcgccagctccgcgcgggcgagggtcagcgcctcggcggccgcggaggctgagccgaggacccgcccgccctccccgtcgttgcatgcctgacgcggcgggatcagcgcgcgcagcgtgccgtccagcaggatnnnnnnnnnntcgccgtccccgtcgttgcatgtctgacgcggcgggagcagcgcgcgcagcgtgccgtccagcaggatcagcgcggaggcgggcccgccgccggccgcctgctcgaacgcggcggctgctgccaccatggcggcgctctgccaggtgagcacggcgccgccctttccagtgatggacgaaagatgagcctgagtagagcgggagagactttgtcagtgattgctcgtcaaagaatcgagtgcacgacgcttactatgtactgaggtacagcgcagcacgcaggaagcgcccacaggtactgggccccaaacttccatggtagacatagatccggccatgaatccacagcctgttcatttccttcccccctcccccccttcctcccatcacaggtacaagcacctgaaatcccttgcgtgcggcaatgagggcaggggcccccagcgcgtctgccccggggtccgcagcgagggcgaccccccccccgctgcccagccaggccagcgtgcgaagcgtggaggggtggcaaccccccgccggcagcgacagccccggcccgggcctcgccccactctccagccgggcagcggccagtgccaggggggcgaggggggcgccggggtctgtcagccggccgtggctcgcgctggataggcatgccagggccaccttccgcgccgcctgataagagtggtgggaggggggtactccttggtgccttgcttccaagaagaaatcaaatctgtccgagcaccatgttatgaagcccatccagggttcatcggcctgtcaacctgttgcaccccctctcccccttcaggcctaatttctcaaagtgtcatgaccccggggaaagggagcacgcacccaaatcccacccttgcacccaccttgacgttaccagctgcccactccaggtggaagtaggtctcccagaggtccaggtcttccctgcgcgccgccagaagttccnnnnnnnnnncaatttctcaaagtgtcatgaccctggggaaaggaagcactcaccccaaccccacccttgcacccaccttgatgttaccagcggcccactccaggtggaagtaggcctcccagaggtcgaggtcttccctgcgcgccgccagaagttccttggccattgcacgcgcggcctgtacgcccctctcttccctcgtcagatgcaatagggcggcggcagcgtgccggcggcacgcggcggggtccttgagctccaccagctgccgcagcaggcgcagcacaaagtcgcggcgggtggggtggcaggcgtaccaggcctgcagcccgcgatcagttgtggcaccggagagaggtgccccttccgccacctgcagctcaggccaggacatgtcggccagtggttccagcgtctcggcaacctccgccaacgcccgcgccaccgggccctcgctcgccagcggcacgccttccagggaagtgcccagcagggtaaggcagcccagtaccacctcctcacgagccctgggggaggctggggtgggttgcaggggagggatcagggaattggcgcaactgagaatcataggctgctctgattggtttcattgtcattgcgtcctccctagatcccgccgccccagatctccctgcatcccatggcgaccnnnnnnnnnnctgtcattgcgtcccccctagatctcgccaccccagatctccctgcatcccatggcgaccacccacgccctcacccaggggcagggccaggtgggagacccggccccaggcgacggcgcgctggccgtcgcaccctgggtcggcctcgccgccggggtccagggcgagcacgcgcagggggtgccactgggcagcagacctggactcctcgctctccagccaggaggaaagcaccgcatctgtcatggtctccccagactccagcgccgcctccagctccaggcccagcctggggtgcagtgggtgttggaggttgagagaaaccatgaagggaagggggtgcttgacacctgagtttcggatgcatgatccactgccaggacctgctgttggaccgcagaagatgctgccctgccacccctcacctggccatgagggcttcctcgctctcctcctcctcctcctcttcctnnnnnnnnnncccaggctcttccatagcctgctcctgctcgtccgcctcgctcccgtcaccttggtcaccttccacctcaacccggtcgtcacttggctccggcttggcctcctggagaccatcgccctgagggccgccaacatccagcccgtgcccaaagcgccgccggatggcgggccccagctcctcccacccggtccaaactccggcagttgcgccgctctcacctttctcctcgggagccgccgcggcagccgcgggctcgcgccttggcaccgtggcagacacaggggcgggcgcggcctgccagcctgccagccatgccgcccaacccctggaccctggctcgcccaggagcggactccgtcccgcccagtagtcagggaacatgtctggcaaggcatcctctggccaatctggggggttggaaggaggcgggccaggaaatgagtggggtaggactctgcgctaggttctggtcgcatcgaggggccaagcacagcgcagaggccaggcttccctgtgcacaagggcacgtggtccaagacccagtgtggccaactgtgggcctcggctgctcacatccttactccttcccctcccctactatccccccccccccagatctcatcccaaaaggnnnnnnnnnncccttactccttcccctccccctactatccccccccaaagatctcatcccaaaagggcacgcaccgtcggggcggcacagggtgtactccagcaggagctggatgctgcccacaaaggcctcagtgtgcccgctctggcgcatcagcagcacgccctgcagcgccagccccgccagctggcgctcccacgcctccagttccgccaggtcggcgccccgcgcgcggcgcagggccagcgctcccgccacggagcgtaccgccgcggcgtactgtgcctccacctccattgcgttgaagcaagagaaggcgcgaagccgggagtgcaggaaggcgcgccagagggcggggctgtcnnnnnnnnnncgcctccacctccatggcgttgaagcaagagaaggcgcggagccgggagtacaggaaggcgcgccagagggcggggctgtcggggtgggcctccagcactgcgcgccaccgccttgccatttccgcctcgtcgcagatcaccttggcctgtgatatatggcggtggtggggtggggggtgggttgaaggaatgtgacattttggtatcgagcatcaaggcaggtgtcagtgttttggcaggggcattgtgaggcatgtgccctggagaaatnnnnnnnnnnttgaaggaatgtgacgttttggtattgagcatcaaggcaggtgtcagtgtattggcagaggcattgtgaggcatgtgccctggagaaattgcccacacatgatgcagctcatgtcctcgtatatgtcttcaagggggatgtcgatgtgaaatcctgaaccaatccaactcacggcttccagcagggccagnnnnnnnnnncccatgatgcagcccatgtcctcgtgtatgccttcaagtgggatgtcgatgtgaaatcctgaactaatccaactcacggcttccagcagggccaggaggagtcgctcggaccctgggtggtggtgcagggccctctccaggatggcaatcttcttctccgtggctgcacgctccaccccctttcctcctcgagccatggagcgcgccacctcgtcctgtcggcaagaggagcgagggatgggcttgtggtatcccactggccgtaagtgagaccagggagtcatgccgactgaatgtgagtcaccctgcttaaacttctagctgccaaaatgatcgtggtagacgcgagcctcactgtgaacagtcctcaagatcaatatgaccccaccacgtgtcccttacttgcctgtaaggcagnnnnnnnnnngcttcttgctgccaaaatgatcgtggtagttgcgagcctcactgtgaacagtccacaagatcaatatgacccacccacgtgtcccttacttgcctgtaaggcagcaaagtcgagccaggtctgcaggtcctgcggacgctcccgcgtggcggcactgaatgccgcggtcttggcaaaggtctcgtcgagggtcgtcaggccttgggtctctgcctcaacagtcgctggcgcttgcccgtgtcctccctcggcaacccctgtctccagaggaatgaaagagggagctggcaggaagctcgccttgggggcaggggcgtctgctgtggccggagagcgtgcagggggcttccagcgtcgcattcgggtgctcctctccaaacgccagagcgcaggcgagaagtaccgtggcagggcaggtgattgctcggacccgccctgagtaggtctgtgaatgggaaggaggggggttgtagtgccaggctcttgttggagtaattccagcaggtcacatgaaggtccgtcaaccaaagaaaaacactgcagccaccacggccgcggttttcgatgctctacaatatctcagcattaggactcagcccaccgccagcctgccctctcaccccgcctgccgcggaagccttctggnnnnnnnnnngcaaccaaagaaaaatactgcagcctccacggccgcggtttccaatgctctacgatatctcagccttaggactcagcccaccgccagcccgcccactcaccccgcctgccgcggaagccttctggcagcaaaaccgctccgatctgcacggcgatacagggggatgtcgcgccggtacaggccctcaaaggccaggttggaagcgtcctgactgcacgtttaaattgaggacaagggcaggcgtcagaactcagaaaagggaagaagcgtctgacatcacataagaaagccacatcgcccttcgccgcccttcagccaaagatgacatccacgcgtcgatcatatgccgcccctggtccctcgtctgcatcacgagcacccagtctggcaatgcgattgcagcaggccnnnnnnnnnngaaaaggaagaagcgtttgacatcacacaaggaagccacgtcgcccttcgccgccctacagccaaacatgacatccacgcgtcgatcatgtgccgcccctggtcccttatctgcatcacgagcccccagtctggcaatgcgattgcagcaggcccgattgggcacatacccggtgtcaaagtagtagagggggccctggacatcgtgaccctgacgaggggcccagcgagacacctgagacgcacgtgcatccacacctgctgctctttcgagcttggattttaactgcagaggggtggcattgtgggaaatgggttgttgagatatgactccaaccgtagggctgcactctgggcgatcaaccccatctcaacctttgggtttaaaatgtcaccctgcacccttctgcagctcatgccctccgaggcttgtcacctcgatctcctcatcgcgggaggacctcctcttgtgcttcttcttgtgcttcaacctatcctcctccctcctccgccgccgagacttgggcgccggctgtgccctggcgtcgtgggcgctggagcgtggagatgcaggtcctgggctgtcattgccttgctcatcctcaccactgctggaagcagcaagggcctccgcagctctttgaaagcttgcatctgacgcatcaggtgttgaagggtgattacaggtgaattaccactccgtacatctgcagggctgccgtgatcagccacccatgctcaccctgggcagcagtgctggccttcagggcctcctcttgcttctgacggaagccggcagcatcgaagcttgatcccacagtcagccaatccattcgtggtccattcgacatctcgtccattactccttgctccgcatcggaacacgaggcgcagaaaatacaaactcacttcaccgtaccatgtacacgcatgggcgagtaatgggatccaaaaaactgctcaatgcgtaccttccatgatttataatctgatgaggcggtggtcgttgacgcgatttgacaggaacaatgttgccgatggagacctccccgacatgagtcgcgcgcgctgcacaaatcggagaaaacgcattttggcgggaagtatggcccagcaccaggaggttcctcactttnnnnnnnnnncagacgcacgggcgagtcatgggatccaagaaattgctcaatgcgtaccttccatgacttataatctgatgaggcggtggtcgttgacgcgattcgacaggaacaatgttgccgatggagacgtccccgacatgaatcgcgcgcgctgcacaaatcggagaacacgcattttggcgggaagaatggcccagcaccaggaggttcctcactttctactacggaacgagagggagaggcggcaactcttgggggaccgctcctccagcctcgccctcttcgaagttgtaggtacctcccgacgagccgcctcacccgtcaccatgggtgcgtggggtgctggtggcagcagcaggaccctgggatgcctgagcggcggtggcactgccgggagcccatgcacctgggccggagctggagacgccgattgcctccaaccgaatcatttggtgtgttattgactgctgctcagatagcccgtcacccttccctccctcccctattgtctctgcaggtcgcgtgcgcaccaagaccgtgaagaagggtgagcgggccattctggagttggcccacgttgattatggcgcctgcatactgatgatgggatatctcgaaggctgccagatccgcttcctcggcttatcacccgttcctgcatagcgtgggaatgggcgggggtgtcgcaccagccctgccgcannnnnnnnnngatgacgcctgcatactgatgatgggatatcgcgaaggctgccagatccgctttctcggctcaacacccgttcctgcatagcgtgggaaagggcgggggtgtcgcaccagccctgccgcaggcttcactgccgacacaccaccgcccaggatggccacagatgcatggctcctttccccccccttgcacgaagctgactcccctctccctctctacactcaatgtccctccctgcagccagccgagtcatcatcgagaagtactacaaccgcctgaccctggactttgacaccaacaagcgcatcgcggaggaggtggccatcatccagtccaagcgcctgcgcaacaagatcgcgggcttcaccacccacctgatgaagcgcatccagcgcggtccagtgcgcggcatctccctcaagctgcaggaggaagagcgtgagcgccgcatggacttcatccccgacgagtcggcgctgaacaccgccgccatcgaggtcgacgccgacaccgctgacatgctcaaggagattggcctggggtccctgcccggcatctccatcgccaaggtggggtgggcggtcgctggacactgggcatggttggggacggggttgtcgggagccactgctggggctcctggctaggctggttgttgtgggcgggattcaacgctgtgttgggacgaggctccagctgtaacgcgattcatatttgctgccgtcctgccgagctcgacgcaaaggacggctgcggatgaggctcattgcattgggtgccgactccggccatgcaggcnnnnnnnnnntcccagctgcagcgcgattcgtacttgctcgcgtcagggcaagctcgacccaaggacggctgcggatgaggctcatggcattgggtgccgactccggccatgcaggccacccttggtcgccgccccccctgcacacgcgcaaggatctgcttgtgcgtcacccctctccttcctccatcccactatgcgcaggaggcccgccaagacttccagcnnnnnnnnnntcgcaaggatccgcttcatgcgtcacccctctcctttctccatcccaccatgcgcaggaggcccgccaagacttccagcagagggcgccccgccactgattgcgcgccggctcgtgcatgtctgcgtgcctgccacggaccctgtaggattacctggaacggaagacctggctgaggcacagcggtcaggatcgcagtgggactttcgagctcctttgcctgtctccaagtgccaagtctagcagtggtgatgggggtaacagcgtggcctgctggggacacggcctgctgtcatgaatgcccagacgggtgcatgcagcgctgggaggcgcgaccccggtagaagggcctcggggtgccagcagactgtgagtcacagctgatgggagcagcgcagaggaagaagggggggggggggaggatgcaggtaccatgcattacctttggccaccaactcaggcgccgcccctgaggccggcnnnnnnnnnnggggggggaaaggatgcaggtaccatgcattaccttcagataccaactcaggcgccgcccctgaggccggcnnnnnnnnnngtggccttgcaggacggccatcaggacgctgttcagcacctcgtgcgcagcgttcctcacccccgccgcctccttcatcagcgcgccgcgcacggcggcgggcgccgccaggcccgcgccgccgccccaccgccgtctgagcggcttgtgcgaggtctccctggccgccacgacggccgcgcaggccgccgggcccacgcactcaagccagcggcgcgtcgcagccagggtggcggcctcgccgnnnnnnnnnngcgacggccgcgcaggccgccgggcccacacactcgagccagcgccgcgtcgcagccagggtggcggcctcgccggcggaggacgggacgggccggaacttcccggcgtcaggagtgggcgtggcccgggtcaggaggggcacggatctggcggcggcggcgagcgcctcgcgggacttccgtgcctcggcgcccaaccaggctcgcaggcctggagcggcgccgttgttgcccggccccgcgccgtcgccgtccccggcaggtggcagccagccggggacggcagcgttcggaggttccagcatcgccgcacctggccagcccacctcctcggccgtgaaggcctcctctgcagggagagagggtgggcgacggcgtgggcagcgtgccggcagttgcatcagggtgtccgcctcctagcaaagcagtgacatgctgtgccggtgtggtacggcgcgtcctgtgctggcccagattcgttcttccctcgtcaagcctccagcccttggcgctgcagcttcgcacaaactcctttccccacatcacccccacctcgcagctggagccagatgccgtccccctcgcggtacaccgggcacccccagcgcagcttcttggcccgggcggcatcgcgcagctggtccagctgcgcgggcgcgccaagcatcgaccccggcacgcccagcgcctgccagtagccctcctcgggggggatcaggcgcggcccgcccggcggcggcagcggcggcgggctggcggaggacgcgccgtacgcgtccacgtgccggggagcggcggggacgtccagcaggcccagtccgccgtttccgccgccggcgccgccctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcccagctccgcgggctgtcggcgccgctctcctcgcccagcgcaaaggcggggggcggcagggtgtgcacccaggcgccgagcgcggcgtactcgctcgcgtgcgcgcggcgcgggtcgacgacgcgccgccctgccgcggggctgtagggcagggcgcagggcgcctcgccttcctcgcacaccagctccgactcggggacggagtggcgccacgcctcgcccgtgaagggcggggccgcgctcgtccccggcagcggctgggaagtatgggggtgatgaaggccgtcggcgattgctcaagggagcaggaaggcagctggctatcatgcactgtcccgagggaaggggaggctggagcccgacctcttctacatgcacgaccacacaagggaacccgtgcatgtgaccgtggctgttttgaggcaccaacgatgcgcaaccccccaccccccaacgccctcttccccgatgcagcttgccccacactnnnnnnnnnnaattgctcaagggagcaggaaggcagctcgctatcatgcactgtcccgaagtaaggggaggctggagcccgacctcttctaaatgcacgaccacacaagggaacacgtgcatgtgaccgtggctattttgaggcatcaacaatgcgcacaccccccnnnnnnnnnntccccccccccccaaaaaaaataaaaataattcacacccaccttgaccacgagccccgcggcnnnnnnnnnnccccccctcccccccccccaaaaaaaaaataatacacacccaccttgaccacgagccccgcggcgaggagcagcgcctggcactcctcctcctgcgcatcccagctctccgcggcactctgctccgccaggcgctcattcagcacgaggagcatggacgccagctgcgccgccggggcgcgggcatactccagcccctgcccttggcacagcttcttcaggctggggtggatgtgcaggggacgggcatgagtgaaggaagggtgctgatgatgtggtgtgtgaaggaagggtgcctcgtcaaccagtgctgcacctgagaaccgtcaattgtggccctgggctgcctcagacagcagagggctgcccaaggcgcaatcaagcctctccatgtcctgccgcctggagctgtcaagccccatggcatgccatcatggcgcagtaggccacggcaatacatgtacccagccatccatgtacccagccatccatgtcacctgtnnnnnnnnnnctgcctcggacagcagagggctgcccgagccgcgatcaagcccccccatgaccggccgcctggagctgtcgagccccatggcatgccatcatggcgcagcaggccacggccatccatgtacccagccgtccatgtacccagccatccatgtcacctgttgtccacacgaggggagggcggtgcgaggagcgccgaagtcgccctggacatctcctcacccggatgcctggggtgcccagagtaggctgctgcattgggcccccattcccgcagaggtctggcgctcgggggagaggggccctccgccgcttcattctcggcgcgcggcaacgggggcaggaacacggggtcttcgggggaagcatgcctggccgggggggcggcacgatcccgccgcggctcctctggccgcagcgccggctcccctcgatctgcccggtgggggcctgcccggcgctccactgcggcagggtctcggtgcacaatcgtcggcgcccgtgccagcagcctgtctgcgccacgggaaaccgaggagtgttcgcgaggagccgaggcctggttttgcgcctcgaccctgtctggccgcctgtccggggaccggtctcgatgcccccggtcccgcccagacgagnnnnnnnnnnacaaccgaagagcgttcgcgaggagccgaggcctggttctgcgactcggccctgtctggccgcctgtccggggacctatctcgatgcccccggtcccgcccagacgagggctcccgctgccgccgtgcagggggcacgtcgccgcgccgtcgggagggtgccgggtcgtcgcgccgccggccctcgctgcggccaccgctgcgcgaccgattcctcttgggcgtgctccgacgatggtacgggctcctgctgcgagaccgcgacctgcgagtagccagggctctaacctttgtgagggttcatggaaggtgcatgtggagcccaggccggctggtgcaactcggcccaaggcacgtcctgccagaacctcccggccccaagttctgggtactgccttctagcttatggtgcctctgagcgtgtggcaaggcaggtggccatagatgacagtgccagccagcgccaaccctccaagcctcgcccattcctcggcacccaccgcatctggctggacctgccgtagcggtcgcctcgctcgctcctgccccgctcgctgctcctcctgggcgacgggcgtcgttcgcacccccgacgatcgggggagcgcgagcgaccactgtgccgacgctgatcgggggatcgcgatggatcctggtccccccccccgccagagtctctgcgtcggtcatcgcggctcctgctgcggtcgcggctccgcgccgcctccaattggctcctgtccatggagcatgacctcgaccctcccacaggcgaccggctcccgctgcgacggctggagcgcgggagccccgagtcgacttgcgcgggccgagcgccgtccctagcaggggccatgccgggtgggaggctgggagggcccgtgtctggggcggcggccgacgcgcgggcaggcgccgacctggccgccgaggactggctcacgcattcccagccgggcgggaagccgggtggggtcaccgagtcccgagctgcatcgggccgcgccggcgcagtccggggcagcccggttgctgcgggctgcgtcggctggggctggggcggcggggttgctgcgggctgggcgacgcttgcaggtgcaggaggttcgactccactcggctgggccggcgccgaggggaggtccatacctgcagctgacgcctgcgccgctgctcgggcagggacggcatctgaaggcttcctggcgctcctggatcacatgcgaggacagaatcggggatgtgggggcctgcgatggcgcccagtccagcgtcaaaaggcaaggagggtgcccgaagggcggagcgccaaccccatcatgcacaccgagctcaccctttctgaggagtcttctgcctgatggggatgttgagcttaaatccgcccttttttatcacttgaggcttggtgggggagacgtgcgtctctgggagggacgacggtgtcttccctgggcggggaggctgtggttccatgggccaccctcaccgcctcaagcagcctgccgcgggatccccgcaggccctccccaggcagggacagcaggcagcgtcacctgtggagcataatcgagccgggggggtaattgtaatagaggtcccaaggcctgcatccctgggaacggtccctggcctggcccctcaccggctataacgcgatggtagccgatgcacggtccgcatgctctggcagcgatgcagcgggccacaattataaacctctaaatctatgacgcccaacttgcttgcatctagcaggccagaggaaggtcgagaccgcccgacccctcagataggaatgggcacctcacggacctccaaccactccttgagttgtatatgtaggcgtgatcacatcagtggcatcatgactttggcgtgcggaattggcctgaggagcatctccttgcgaaaaggaccaagccagcgcgctcgatgagcgattttctgcattggccggccccccgggggggtggatccagtgccggcatgtcgccccacatcattacagtccgaggtgcctgccgcgcgtgcagctcccctcggcaaggctctgcgcaccacacgcatcactgctgcttcttcctgggacccatgggggtcctggaccggtgcaggccccccttctccggcaccaggggggcagggaacatcgcccgcgccatcctttctatcgtccccgccgccaggtaggccaggccgcccagcaccagcagctggccctgcatctctgcggggatggccaccagggagaaccaggtcctcagccctgcgtgcatgtgcatgggtggggttgacgggggagttgataccctccaatggctcatccagccagggtctcctttcatcttgatgctgtgggaaagtggccctgcattgggcctgnnnnnnnnnncgccagggtctcctttgatcttgatactgtgggaaagtggccctgcattgggcctgcggacgcgccaccccatgtgtcatacacgcgcttgcaacctgctcacccctcggcaggtccagcaccagcaggacataggccagcgtgctccagttgaccgacagggcgaagaaacgattctcctggagtggcgtgttgaagggcgcgcccacgtagttgactgcaaaggtcattgtctgcaggggcgaggacagcggggacgtgatgggttgggtgcaactttgcaatctgggccttcataacgctctgccccgccagactccatcttgatcagagcccagagcagcaatcatgggcacccgcctggatggagaagttgannnnnnnnnncgtctgcaggggtgggacggcggggacgtgatggggtgggtgcaactttgcaatctgggcctcataacgctctgccctgccagactccatcttgatcagagaccagagcagcaaccatgggcacccgcctggatggagaagttgaccaggaagcagatggtgttgatcaggttgggcttgaactccgagtctggctcctgcctctcctcctgtgtggtgtcaacaagggagatctctgcctggcatgtgggatatgcaagtctgtgggaccctcgataccctggctcaaccattggaccccacccggccatgcgccgatggtcccaaacctgcctcattcacgttccccgctccgcaaacgacactctttccgactgccctgtgcaaccccagcttccattccccgccccactcactcacccgcgnnnnnnnnnnacgccgatggtcccaaacctgcctcattcgcgttccccgctcctcaaacgacactcttcctaactgcctcgtgcaaccccagcctccattccccgccccactcactcacccgcggcatcatggcgtgcgccgtcctctgcatgaacatgaggaaggagatatgcaccgcgaactggcccagcaggctcaccagggtgtaggcgctgaagacgcgcgcgtgcgggcgctggcgcgacagcgtcgccagaggcttggcgtgggaaatgaagaagaacatgcccgccgtcagcacgcctgccagcgtggcctggcgggtggggtgagtgcagggtgttggaagacaaggcgagcatgcaggagaagacgatggacgaggagtgacgagaggcgcattcatttataggacccctggcacggcccctgagggcagagcttctgccgtactgagccgcggccaaaggttctctgaacctcgctgaccccccatgcacacagccacactgatcatcaacaacacacacacattttggcaacttcgagggacgtctacgtactcttgagcccacaaaaacaaccaaccctcaaccacccacctgcatgtcgccnnnnnnnnnntcgcgggcaaaggttctctgaacctcgctaaccccccacgcacacagccacactgcccatcaacaacacacacatttggcaacttcgagggacgtttacgtacctctgagccctcaaaaacaatcaaccctcaaccacccacctgcatgtcgcccagcttaatgccgtccatgtacatgacggagagggagtaggcggaggagaggcagagcaggcccaggatcttgaacatctgcatggtggtcaccagggtgcaccgcccctggcgcaggatgtccaggcagggcgccacgctgccctgcttggcggtgaagggcgaggccatgctcgcgtcccccggcttcaccatggccacctcgtcccccgccccggcctgcgcagccgccatgtcgtccatggctttcgccatgcggcgcatgaagggcgtgataggccgccccttcttcgccatgtcctccagcatcttggcccccgggccgggcggcggcgcgggggcgatgggtggagatggtgcacccggcgcggctggtgcggcgaccggacccgacgatggagcccccgccgttgctgccaaggccctgctccccttcttgtcctcgccccgcttcttgtcgtcgccccgcttcttctcatcgccccgcttcttcttcttttccggcggcgccagcaaggccacgcccacgtgcgcaccgcgaagcgcccctacgtcgttggtcccatcgccgcacatgagcacgcccaggccagcgccacgcaggatcttgacaaccagctccttctggtcgggcgtcacgcgcgcgaagacggaggtcagggggacgtaggcgggcgcggcgcccgtggccgccagtgccgccagcgcgtcgccggtcagacacagatcgtggtcggccgccagcgccgcggcggcccccagagcggggtcaaaaggcaggcgcagagactcgtcggggctgacccactccaggggcggcgtggcgagcagggcggagtcggcggcgtcgccgccggccgcgggacccccctcgccacccttgcgcccccgtcccgtgcccggcgccggcgcctggagcaccagggcagggcgcaccacgatgtgtacggccgccgccacgtggcaggccgtcagtggcgcgtcccccgtgatcatgaccagctggtggcccgaggcgcgcagcgcgcccagcgtcggctcgctctccggcttcagtgggctgcggaacactgcgaagccggcaaagtccagcccggcctcggcgcgctcccgcggcagcgcacgcaggtcggccgccgccaggccggcgggcaggcggcggcaggccagcgccagcacacgcgcgccctgcgccgcgaagcggcggtgcgtcgcgtcgtactgcggtggcactgcagccaggtcgccgcggatgacctcgggcgcgcccttggtcagcacccagtggctgcacgacaggggtgtgttggtagtaggtatttttaggtttgggatgcacaggggggggtgggagctcgaaacaggcaggacaatctgcttgtatgttaatgaacacatgcagacgtagagtttcacagttcccatgaccgtgaacaaggagtgggcgatggcgttgcagggaaaccctgtcccagccggccatttgcctatcgacatgtcaggcagccaatccccatccttgaaccccatccaaaacaaatcaagctcacctcttggtcgcggtggcgccctcgggctcgacggccacaagggtgctcatgcgcttgagggtgctggagaaagcgtaccgatgcacgatctcgaccgtctccctgggtcccccgtccttggaccgcacgccctgctggcccagcgtggtccagccttcggtggttggggacgagttgagatggcaagggagactgatcgatgagattatgcacaatgaatgtgccannnnnnnnnnagctggcccagcgtggtccagcctgcggtggttgggggcgagttgggatggcaagggagactggtcgatgagattatgcacaatgaatgtgccagagacgccaaggtggcagggatagcacatcggcacatggcgcagagatttggcaatgcaggtgccggccaacagttccgactcaccaactgcctccagggcgaccttctccagcgggtcgccgatggtctccttgtccacctgcggcaaggcacggcagggttggtgcctgagctgggctgggctggccaggaggcacaggagggtaagcatgcatgcccaccnnnnnnnnnntggcaaggcacggcagggttggtgcctgagcatggctgggctgggctggccgggagggcacaggagggtaagcatgcatgcccacccatgcagggtgcttcttgctggcaacctgttgggcaaaaaactcctcgatctcagcttgaaaggccatggggatattggatgtcaacccgtccctcgttcagactttcccaaataacccattctccaccccctcacctgcaccagggactggcaggctgnnnnnnnnnnctcctcaatctcagcttgaaaggccatggggatattgaatgtcaacccgtccctcgttcagagtttcctaaatatcccattctccactccctcacctgcaccagggactggcaggctgccagtatgcgggcggtggccctgggcagggacttggcatcttggagcgcgcctgcctccggctcggggcccccctcgggcgcgccgcagccgacgactccctccagcacaaagtggtcgctggtcagggtccccgtcttgtcgaagcagcaggtggtgaccttgcccgccaacgggatgcggaagggctcggtgcagaagatgcgcagccgtgacagcgccagcagcgaggcgttcactgcgatgggaggggggtggatgggaggaaggaggggatcaagcgagctcaggtgtgagctttgggccctagaaaaaagacacggctgggcgttcttggggaccggaagaccacaagagcagttgctcacacacgcgtttccgtgcttcaaatgcccaatttccttctgttgttccaacatttgcagcccagccccccccccccctnnnnnnnnnnnnnnnnnnnnnnnnnnnnnnnnnnnnnnnnnnnnnnnncggggggcaccaccgaggtcaggatcatgatgcagttcaggaccagcttgaaccgatcccggttggggtcctgtgcgtgtcagtgcaggggcttgggggtatgttggtgtacgccggtgggagaagctgatcannnnnnnnnngctcagtgcaggggtttgggtgtatattggtgtacgccggtgggagaagctgatcaccaagaggcccctatgagattgccctgcactcacatcacccagcctcagcaccccatcaacaatcaagcgccacagcagtgcgcaccgccaggccgtagtacaggacgtagccggaggcggcgatggcccagacgaggaggaaggcgatgaagaggaaggtctccacattgttggccgacaccttctcggtggagtacaggatcgtgcgcatcagccggcctatgtgggaggagagtgggaccggtgaaagggtggggaagcatctccagtgctgcatatttgggacgctgaagcaatcctgcccatgaggcgtgccaggcagccagactggcagcacttcccctccctcaccaactgccagttctctaagctacacgcaccctgggcggtgccaaagccggttnnnnnnnnnncgccaggcagccagactggcagtagttcccctcccacaccaactgccatttctctaaactgcacgcaccctgggcggtgccaaagccggttnnnnnnnnnntccaccccctttgcgccctgctccttgccgatctgggacttggggtctgagcacgccgcgctccttcccccgccaatctcacgcgtgcgcacacacacacacacacacacgcacacgcaccccaggccggcgtgccgcgctnnnnnnnnnncgccaatctcacgcgctcacacacacacacacacgcaccccaggccggcgtgccgcgctacgctttctccttccgcaagctgcgcttcgtgcacagcgcagacaccggcgccttcaccaagctcaagtacccctctcatgacacggtgggcgcctacctcgccgccacgggcctgggcagcgaggccgccacggccgccgcgctggagcggtggggcgacaaccgcttcgaggtgcccgtgcccagcttcgcggcgctgctggccgaccagctcatggcccccttcttctgcttccaagtcttctgtgtgggcctctgggccctggacgagtactggtcagtgcggggctggggtcggtggggccgagggggggagggactgtgcttcgccgcggcccgcaggggttcacagggtgcccgtcgccatcggatcatgcactgcatcgccaccgtcgctgctccccgcaggtactactccctgttcaccctcttcatgctggtgacctttgagtgcaccgtggtcgtgcagcggctgaagaacctgaatgacgtccgggccctgcagacacccaaggaggtgggggaggggagggccagtggggatggagtggaacgagatgacctcgtgatctcgtcgcatgggagaccgcgctggtgttgggcttgctgaggactgctgagccacgaggggacctgaggacagcaagtttgagcatccgtgctggctgtagtgctccgcgcatcgctnnnnnnnnnnagatctcgtcgcatgggaggccgcgctggtgtcgggcttgccgaggactgctgagccaggaggggacctgaggacagccagtttgagcattcgtgctggctgtagtgctccgcgcatcgctnnnnnnnnnncggagcacgacggccaggcagccgttgtcgggcgtcttcagcctggcggcccgctcgcccgtggtctgcaggaccttggtcccgccgaacaacacgtgcgccttgtcccgcttgatggacagcctttggcggtgagaaaaggggggacatgatgtgggactgggaggttggggctggggtaagcgccaaacttcgtggcaggtgctataataccagtactgcctgagcatcacatgcaggatccactctcccttcagactccaccacaccagaatatttcatcatcccccccacacacaaccacactgggccctcaccgagcctcggcgcctccctcgtnnnnnnnnnngcacccagaatttctcatcatccccccccccccacacacaaccacactgagccctcaccgagcctcggcgcctccctcgtnnnnnnnnnncccctcccaggcgctcagcgtgtaccgagggggcaagtgggccaagatcccgggggacagcctgctccccggcgacgtggtttccatgctgcgggacggtgggtcggcagctacgaggcagctggtgctgcgtgcggtgaccgtcaaacttgatgtgagaaagcctagggtaagcatgaatatcttccccccttcccccctctgcgtgccctgcagacagcgggaacnnnnnnnnnncgttctcatcgatggcgctcttccactgcggcgtgctctccccggtgagaaccgcctcgtccacgatgcagcttccggccagcagcagcatgtcggcctgcaccaccaggtcgttcccgctgtctgcagggcacgcagagggcggaagggggaaagatgttcatgcttaccctaggcattctcacatcaagtttgacagtcaccgcacgcagcaccagctgcctcgta

SEQ ID NO: 44999 - DNA, 61 bp, Chlorella protothecoides
ccccgcaaggagtctgctggtgggcccgggggaaggggggggggggtattactttacactg

SEQ ID NO: 45000 - DNA, 827 bp, Chlorella protothecoides
  modified_base (110)..(119): a, c, t, g, unknown or other
ggtgcgagccacccgacggccttttcttctgcttggggtttgtgatcgtgggtgaaggggttggggtgtgcttgagccaccaagaagcaaggcaggggggggggggcttnnnnnnnnnnccgacggccttttcttctgtttggggtttgtgatcgtgggtgaaagggttggggtgtgcttgagccaccgagaagcaaggcatgggggggggcgtacccgtgcagatcactcacggctgcacgaatgttccctcgcatcccccatgcctgcacccgccaccctgcccccctcaaaaacacaaacacgcaccgtcaccggctcctgcgccagcgccagcagcgcgtccagcaggacgccctggttggccgggctcacgcggctgagcagcgcgcccagcgtgcgcaggtgcgcatgcatcagcgccacgctcagcgacaggggctgcgggtaccacaccccaaggtcgtcgcccgcgcctggatgggtttgtgctgctccgccggagcgccccttggccgcgccgcgggggctgccgtcgccggggcgggcgacttccatcgccacgtccaggcatgggatggcgccgcgcaggccgagctcccaggccgtcgcctgtggcgcgccggccgccccgatgaatgcgtccccgctgtcttcatcctccagcacgtcgtcaaaggggtcgagccagggcgccaggacggcggcctccagcgtcgaggagcccggcccgccgccgccgccggccgcggcggccgcgacgacagagcgcaggccgcgcaggcacagcgtgctcagcgcctcctgggccgagggcggcaggtctg

SEQ ID NO: 45001 - DNA, 61 bp, Chlorella protothecoides
tgtgggcacgctcaagtgagagtgggagggggaggagttggagctgcaccccttgtcccag

SEQ ID NO: 45002 - DNA, 61 bp, Chlorella protothecoides
aaggccagccccagcccctcgcccaaggccggccccagcccctcgcccaaggccagcccca

SEQ ID NO: 45003 - DNA, 61 bp, Chlorella protothecoides
caagcacgtcagccactcggtagctgggggggccgcctggctcattgctttacttgcatcc

SEQ ID NO: 45004 - DNA, 75 bp, Chlorella protothecoides
atataagctatattgcaaagcttgttttggatgaatactaccatctgttataatttctaagataagatattcaaa

SEQ ID NO: 45005 - DNA, 61 bp, Chlorella protothecoides
tcttgacctcaagacagtgggtcgtctcaggaccaaccctttggatgggagacactgggcc

SEQ ID NO: 45006 - DNA, 61 bp, Chlorella protothecoides
ctggattggcggacgctggagcatggcgacccccctgggcacgagtcgcatgcaggttctt

SEQ ID NO: 45007 - DNA, 61 bp, Chlorella protothecoides
ggtaggatgaggatgttccatttggccagccccctaagccagtccaatctcacacttcagt

SEQ ID NO: 45008 - DNA, 61 bp, Chlorella protothecoides
tccttcagcctgcttgtgttgggggggggggggggtttctgtatgcgtgtgtgtgagatgg

SEQ ID NO: 45009 - DNA, 61 bp, Chlorella protothecoides
gatcgactccttccactgtggaaggaggggggtagaaggggaggggaggcctgagcatgaa

SEQ ID NO: 45010 - DNA, 61 bp, Chlorella protothecoides
aagtgccacaaatgcacacaaatggcggcggaaccctctgagcaggtatcaggctgcatag

SEQ ID NO: 45011 - DNA, 61 bp, Chlorella protothecoides
gaaggcacaagttcgctcgtggcgggatggggggatctcggcatgtgagatctcgggacct

SEQ ID NO: 45012 - DNA, 61 bp, Chlorella protothecoides
aacaccagtggggttggtgggtcgaggccgcccgcttaggcggaggtgaacttggtcacgg

SEQ ID NO: 45013 - DNA, 61 bp, Chlorella protothecoides
aatattttttttgatatttcatggcaagggagggtttggcaattatcaaacaagcatcatt

SEQ ID NO: 45014 - DNA, 61 bp, Chlorella protothecoides
tgccggctggctggtcccacgcctgaggggggccacaggcaacggaggatacctgcagtac

SEQ ID NO: 45015 - DNA, 61 bp, Chlorella protothecoides
actttacctcttctttctcagtggtgaggggggggatcaggctgtcattcatcaactggac

SEQ ID NO: 45016 - DNA, 61 bp, Chlorella protothecoides
agtgacaggggtcggaggccggggcgggggggccattcagaaccgtgctccagggctgcct

SEQ ID NO: 45017 - DNA, 61 bp, Chlorella protothecoides
ctgcctcctagaggccagctgctgcctgctccctcgccggcagcgccacctagccatggtc

SEQ ID NO: 45018 - DNA, 76 bp, Chlorella protothecoides
cgggtcccgcctcgcctcgccgcccagccttgcctccagctcgccgcggcgcctcgccagcaggccggcctcctcg

SEQ ID NO: 45019 - DNA, 61 bp, Chlorella protothecoides
ggacgtcaatagtcacacagtccttgacgggataataaccaccatcatggcgaccatccaa

SEQ ID NO: 45020 - DNA, 61 bp, Chlorella protothecoides
gaggcacgctggagggcggagtcttggggggggggctggggctggccttgggcgatgggct

SEQ ID NO: 45021 - DNA, 61 bp, Chlorella protothecoides
cgtgcttgataagtgccggcgactgggggggggtacttccgggaggagggagtatggtact

SEQ ID NO: 45022 - DNA, 4026 bp, Chlorella protothecoides
  modified_base (97)..(290): a, c, t, g, unknown or other
  modified_base (1630)..(1639): a, c, t, g, unknown or other
  modified_base (3646)..(3655): a, c, t, g, unknown or other
ctcggggccccaatcgcccagccagcgccggatccagcggcgccgggcgcgctgcgccgacgcgtacggcgccggcggggcgggggccgggccgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcatgcagtgctgctgcatcggatgccctctctaccgccaacagtgcgcattccctccccaactcccccaaaacgcccgagtcacacccacctttgagccaggcgccccaggcctcagagtgggcccgcggccggccccggacctccctcctcgccccggggaagagggccagtaagatgcccgaccaggcattcagccacctctgccatgtgatgatccagccccggacgacagcctgcggagttgggcatgtgggtcgacagggtccgcgtgaagtgatctggcacgcaggcgcaagcctggcccatcgaacagcgccccacatccgtaccttggtgatctcctcccacaggctggtccagggtccgacaatgttgtcgctgatccaggctcccacgatggtgtacagggcttgcaaattcagaaggagacggaccagcctcccccgccgtcccacccgcgacggcattccctcgacaccagctcagagtgtaattcttatgaaatgccacaaggggtgagctcctgccaagtcgatcagcgtacgcgttgctaatcgttggtgacttactggggcgcgcgcggaggtgaacgcttcatggaaactgcgtgcaagctccatggggcccatcctcccaccctgtgactgaatcacccatctttgggtaataattgaaattctgggattgtgggagggatcgcagcggcgtacaagcagtcttgtgactcgaacaggtgccctctgaattcattgtacccgaaggccacgtgcgcagctgctgctgcatgcaccgttcctgtcccccgtccgcctagtctgcaccattacttgatacagctgtacattactgactcaaagcgtcacccggatcgctctgtctcggccttgcacctgaccttgcaacccttgtggcagcgcgctcgtccctcccccgtccttcttgaatcggcgaacgggagctcgcactctgcctgtccgtggatgcacgttgcatcctgtagaccatgtgtaccaacacctggcccctcgagtcggagctgcctgcatcccagcgctccgcggcgtgtggtgcgcgcccgagccggggcccggcccacaagagtggacgcggatctgccggccttggaaagcaagcatgaaataaatggcaccggtaccggtgtgcacgatgctcacaagaatggtggggacccggaggccccgctggcaggcacggggcacgggcctacaagacccccaaccccctcgtcacaacctagcctccccagctggctgttgaaccccaacgaccccgccatcctggagttgacgcttcccgccctgctgacactggtggnnnnnnnnnngaccccaaccccctcgtcgcggcctagcctccctggctggctggtgaaccccaacgaccccgccatcctggagctgacgcttcccgccctgctgacactggtggcggaccccatgctgtccatggccacctctgtgtttgtgggccagaccgggcccaccccgctggccgcgctgggcatcaacacctccctcttcgccctctgcttctccctgttcaacttcctggccaccgccaccaccccgctggtggccaccgcgctgcaggccggcaacggcgagcaggtgatgggctttgagtgcggcggtcatggggagggctgtgggactccatccctcccacccgctgcaccctctgacaccaaggcacctgctcccccgatcccactctccaaggcagggcgcacggtgctgcagggcctggcgctggccgtcgtgctgggcttgggcctggccctggccctcaccgccggctctgatgcggcgctgggcgtcatgggcgtcgcgcccgaggccggcgacctcttcctccagtcgcgggactacctgaccgttcgcgcgctggccgccccggcagtactcctggaaagcgtggcgcagggggcgctgtacggcatgcgggacatgcggacgccgctgtacgtcaccgcgggcgccaacgcactcaacctggtacgagtgaaatgaggaaggcccttggagtgtttcagggaatagggaggagtgcctatgtgtaggggtgctgtctgaatcagtgcctgaggaagcaagccgcgcggatggtgcatacgtgttaatcgccagatccgcaaaccttccccccacacctcattgcagggcctgggctggctcttggtcctgcacctgggctggggagtgaaaggcgccgcgctggccacagccgcggccgagggggcatcggcggtggcgtacctcacggtactgcacggccggcggggtatgttgggcgacctggcccctcgcctgctgctggcgcccccgccctccgcgggccccaacggcacgccccccccccaggagctgctccccgccggcgcgtcgctgctgacgcgcacggcgctgctcctgggcagcaagacagcggcggcggccgccgcggcgcggctgggcgccgcccccgccgccgcgcaccacatcgtgctccaggtctggctgctggacagcttcctcaccgatgcgctggcggtggcggggcagaccctggtggcctcgcacctgggggcgggggggagcgtcggcctgcggagcgcgcgtgccgtgtcggaccgcctgctccaactcggcgtgggcggcagcgccgtcctcgccctggccctggccgcgctgggcccggccttccccgccgccttcacctccgatccgggcgtgctgaccggggtgcatgccatctggggcctggccctggccctgctgccgctgaatggcgcggtctacgtcctggacggcgtgctggcaggcgcctccgactttgattttctggcccaggccatggtcctgtctgcactgtgcaccgtggcagggctggagctgagcgggcacttggaggcggggctgctgggggtgtggtgggcgctggccgcactcatggcctccaggctggccacgctgagttggcgatacgccgcgccggcggggcccctgggtgcaaaaagggggcctggcgcagagtcctgagccgctggttgtgttgtgagcgcccatcggcactcgctcctacaaccctgtcacctacccgccgtgcgttgcaccaaacacagcatggctattcgcctcaacgctcaaccccctgtgctttgaatcccacataccctgaagaatcccttcaccctctcaattctttgtatctatcgtgtacattctctgcggcccagcaccagggagcacaccaactgctgcattctgaaaagaagtttaatctttcacattcattcacggggcgccaccgccccagccacatccctaaatcgcggggctggcccggggcaccnnnnnnnnnnagcccagcaccaggaagcacaccaacttgcatttttaaaagaaggtaatcgttaacattcattcacgaggcgccaccgccccagccacatcccctaaatcgcggggctggcccggggcaccagacggactgaccccggcgctccgccgccccggccctccccggcctcgcccgtcagcacgtccgcgccgtgcgtggcgcgcagcacgaactgcgccacatcggggctagcccagtagatgaagtgcgccgacagtgccgacaggtactggctggacagcgtggactcctgcagcgcaaagtccagccgcccgcggcccacgcgcgcgccggccatcggctcgccccccgccaccgccgcgacgcgcgcgc

SEQ ID NO: 45023 - DNA, 61 bp, Chlorella protothecoides
agtggcccccctggagccccccttccaaaggggcacaccaagtcctcacacaccttcccgt

SEQ ID NO: 45024 - DNA, 94 bp, Chlorella protothecoides
cggccgcgcgcggcgcgccccgccagaaggagatgaccaaggccgagcggcgcgcgctgcaggaggcgcagcgtgccgcgaaggccgcgtccaa

SEQ ID NO: 45025 - DNA, 121 bp, Chlorella protothecoides
agaattgagagggggagggaggggttggggggtgggcgaggtgccgccgtgccgcgggagtggggtggggaggctgcacgtggacgctttaaaagggagggtgcatgcgtgcgggtgacag

SEQ ID NO: 45026 - DNA, 61 bp, Chlorella protothecoides
aaacaaaaaggtctggtgccagtgatgatgcacaactctctccacagcaggcgcagcacgc

SEQ ID NO: 45027 - DNA, 61 bp, Chlorella protothecoides
gtcaggccaacgaaatcatggctgctctgggccctgtttccacttcacatggaggagctca

SEQ ID NO: 45028 - DNA, 61 bp, Chlorella protothecoides
gcctaagaaatgggatatggcaacggctgggtcgttgagctgcaagacagaattggaggct

SEQ ID NO: 45029 - DNA, 61 bp, Chlorella protothecoides
ggcgggtgaccgcgctggtggtggcggggggcgccaccgactactgcgtcctttacacggt

SEQ ID NO: 45030 - DNA, 61 bp, Chlorella protothecoides
agacggcatacgagatcactgtgtgactggcgttcagacgtgtgctcttccgatctgctgg

SEQ ID NO: 45031 - DNA, 61 bp, Chlorella protothecoides
catccttgaaccaaaataacggcagctgcggctttctgagccctgtcatcgagcatctgca

SEQ ID NO: 45032 - DNA, 64 bp, Chlorella protothecoides
ctgagacgacccactgtcttgaggtcaagaagtaagccgtccgtccccaggcgaaggaagggcg

SEQ ID NO: 45033 - DNA, 61 bp, Chlorella protothecoides
aaggaagcacaggctcgcatgccaaacgcccccttggtccagatgaagatgctgccgctgc

SEQ ID NO: 45034 - DNA, 61 bp, Chlorella protothecoides
ttgaatgctgtctccagtgtctgtggagggggggacggtgtaagggttcgcaggcggcagc

SEQ ID NO: 45035 - DNA, 61 bp, Chlorella protothecoides
gtggccctcagcctcgatggctggctcgggggcatgcatgctgggccgctcgaacctccca

SEQ ID NO: 45036 - DNA, 61 bp, Chlorella protothecoides
atgctactcctccctcccatccttggcaggggccctcccacgagctcgagagctttatcca

SEQ ID NO: 45037 - DNA, 128 bp, Chlorella protothecoides
ggtcgacgtgggcgcgctcctggcctccattgcccggggcggggagctggacctgatggccgtctgccgcgcgccctccagccagcgcgacgcccccacctcccgccgcggcagcctgctgggccgcg

SEQ ID NO: 45038 - DNA, 61 bp, Chlorella protothecoides
cgcagtggctgtcaaggtgagctgggggggggagggcagggcatctgaatggtggacttgg

SEQ ID NO: 45039 - DNA, 61 bp, Chlorella protothecoides
gattgggcgggaatagtactgcggtgggtggccacgtgggaagtccccgtgacgaactgtt

SEQ ID NO: 45040 - DNA, 62 bp, Chlorella protothecoides
cccccagaccctgggtccacggagcatcgcaagacgatcctacagtgtattgcccccccccc

SEQ ID NO: 45041 - DNA, 61 bp, Chlorella protothecoides
gccagggacggtggcggcgacggcggggggggccctgctcccggcgctgctcgccagcctg

SEQ ID NO: 45042 - DNA, 61 bp, Chlorella protothecoides
aggaggaggacaggagcgtgcacaggcgggggacggcggcgtcgatgccggcccctacccc

SEQ ID NO: 45043 - DNA, 61 bp, Chlorella protothecoides
gcagagagcaggtgtgggcctagggggggggggctgtcttctgtagctgctgctgtgtaaa

SEQ ID NO: 45044 - DNA, 61 bp, Chlorella protothecoides
ttcagtttatgtagggagggtatgggggggggggaaggggcaccaatcgttgtggacctgc

SEQ ID NO: 45045 - DNA, 2188 bp, Chlorella protothecoides
  modified_base (97)..(106): a, c, t, g, unknown or other
  modified_base (976)..(985): a, c, t, g, unknown or other
  modified_base (1340)..(1349): a, c, t, g, unknown or other
  modified_base (1605)..(1614): a, c, t, g, unknown or other
gggaggggggtgaggcggagggctgtggaggggaggggggtggggggattccatgcctcagcacccgggcgcgcgcgctccgctccaccgccccggnnnnnnnnnnggcggagggatgtgagggggaagggggtgggattccatgcctcagcacctgggcgcgcgcgctccgctccaccgccccggcctcgcctgatgcgggagtcgttggaggtgatgaggaggtgcgagggggagcgggggaggaaggtgaggcccgtgatcttcttcccgcgcgcgtgctggcccctcgtgttcttcacgtctgtggaggatgggttgggtggaggaaggatgggccctcgtgcgcagcgggcaccatgcacagacggcaccaccaggcactgcgccatgcgctccagatcacgacacctcggccgctgcaccaggctctggggccgcgcctcacgccgccgtccctcccacccacgcacccagctgcgcctcgtactccaggctgctgtcctggatggcgtagaacctgcgcgcgcagggcgtgggcgcggtactgagcggcgcacgcccagcgcgactctgggccatggagacaccctgcacgcccacatcccagccgcgctccccccccgacgcaccgaggcccccatccccgcgcccgccgcaccaccagcccccacctcctccacccctgccaccgtgcggaccccggcgcccacctgcacttgcccttcatggtccccaccaccactcgcagcccgctgggggagtaggaggcggcggtgaccatctcgtgaacgtcctgccaggacaccaccttctggtccgggatgctccacagccgcagctgcatgcccgagggggaggggcatgtttgcagggatcgtgctcggaggagcgcgaggctgcgccgcctgccgccgcccaccatgtgcctggaggactggcatgacagccacaaccccaggtaccagtccacacnnnnnnnnnnatgctcggaggagcgcgaggctgcgccgccagccgctgctcaccatgtgcctggaggactggcaaaacagccacaaccccaggtaccagtccacaccttgccgtcgatggagccggagatgaaggtccggtcgtcggagggatggaagtctatggccgtcacgaaatcggagtgcctgcatgtcggggaagtgtgattgggaagggatcgcagcgggaaaggaggcacacccatcccagccggggaaggtataccaagttctcccctcatgctgcaggaccccggctgtccctccagtggtcggaatccctgccaactttctcacccccttgtcaccaaaccccatctcacgccnnnnnnnnnntgggctgtccctccagtggtcggaatcccagccaactttctcagcccccttgtcaccaaaccccatctcacgccacgcacttgaacacgcggaggcactcgtccattgagacatgccagaggcgcaccgtcttatccatcgaggccgacagcaggaactgtatggtggagttgtgggggggacaacttgttgaaaaggtgggagagcacatggaaaggaagaacagcaggatatctgggtacgagctgcgccctcnnnnnnnnnngcaacctgttgaaaaggtgggagagcacacgggaaggaagaacggcaggatatctgggtacgagctgcgccctccccggctactatatgtccctgccactggcctccccaggcgtgagcccccccccccacccacccacctgggttttagaccaagtcaggtccagcacatcctgcttgtgcccggtgtacacccggtgcggcgtgggtgagaggaggagcgccggggcctgcgccgccccggcccccaggcggctgacggcaggcgaccccgtgccacgcgcctcgccatcggccgccggctgtgcggcagacagcacctgccacaccctcaccacaaagtcctggccagctgcggggcgagttggaaagcaaggagggggaggggttgttaccagtggagataacactggctggcaggccgacgatggcggcgcccatagccagacgggcggagaagggcgcaggggcggcggcacttgacacaccaggcaccggctaggcctgctctcgaatttcactccagagctgcataaacctactcacaccgcaccgcccattcctcccttctgaaa

SEQ ID NO: 45046 - DNA, 61 bp, Chlorella protothecoides
atcgcagggcgcgaggggggttgggggggggagggcctgctgatctgcattcttcctacac

SEQ ID NO: 45047 - DNA, 61 bp, Chlorella protothecoides
cgctgacgaccagccaccggtctgcgggggggggcacgatcgcactcggcctgaccgctga

SEQ ID NO: 45048 - DNA, 61 bp, Chlorella protothecoides
tggaagggaagggaggtttgcaatggcggggctgccggagggacgctcctctcctgtagct

SEQ ID NO: 45049 - DNA, 132 bp, Chlorella protothecoides
ggggaatctggtgggggagggggcttttctggaggagggggggaacttggtggaggaggggggctttccagaggaggcgggtttggtggaggaggggaactcggtgggggaggggcgttttctggaggaggg

SEQ ID NO: 45050 - DNA, 61 bp, Chlorella protothecoides
gtgacaggggctggaggcttcattgcgaggggcgctgtgagcacaccggcgttgcccaatg

SEQ ID NO: 45051 - DNA, 61 bp, Chlorella protothecoides
gacaggaaggcgcctcagtacaggcccaggcccttccaccatgcccctccgaccacgccaa

SEQ ID NO: 45052 - DNA, 61 bp, Chlorella protothecoides
caacaggcgcccagccctagcccgcaggagactccctctccgagccctgaggagtcgccct

SEQ ID NO: 45053 - DNA, 61 bp, Chlorella protothecoides
gctgcagttggggggtggagcggatggagggggggcaggggaggccttgatttgaggctgt

SEQ ID NO: 45054 - DNA, 61 bp, Chlorella protothecoides
ccattggagcaggcagcactcgcagatgagatcctccaatggattaccatgaagtcgcgct

SEQ ID NO: 45055 - DNA, 544 bp, Chlorella protothecoides
  modified_base (103)..(112): a, c, t, g, unknown or other
gagaggggagggagggcgtggcaacatcgcgccggcctttgacacaaggcctgagcctgctccgccccggcaaccccggacaccccacctcacggtggggggnnnnnnnnnnccgccgcgggcggcgtgctcgcatccaccagcagcgcgggcgggccggcgtagcgcgccgccgccacctccgcgaccagcgccagcgcctgcggtcgggtctcatgggcgtgtgagaggggagggagggcgtggcaacatcgcaccggcctttgacacaaggcccgagcctgctccgccccagcaaccccgtaccccccacctcatggtggggggcagaccctaccccccctcgccccattctctttcctccccccctccatcccaagaccccctgccaccaaaacaacaatctaccttggggtcatgggccacgacggcgacgcgcagtcccgcgcgccgcgcgacgtccagggcccgggccagcaggcccagcttggcgctggaggcgaggagggccgcggggtcgtggcggcgcgccgccgcggccgcg

SEQ ID NO: 45056 - DNA, 61 bp, Chlorella protothecoides
ataaggggtggcaatgtgacagtggctagggaacattgactagcttagagcttgccactca

SEQ ID NO: 45057 - DNA, 61 bp, Chlorella protothecoides
gtgaggtgggggatgagggattgggctgggaacagggctcggtgactaattgcaggacatg

SEQ ID NO: 45058 - DNA, 444 bp, Chlorella protothecoides
  modified_base (141)..(295): a, c, t, g, unknown or other
ccggcgaccacgccagctttgcggcgggggcgccgggctggaccccgggcgcgcatgtcggcctgggctcgcgcggcgcggagctggcgcgcggctctcagctgggctcggccctggtcagccagcagccgtcgtacgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgcccatgtatggctgggggcctatgcccggcgcgccggggccgggcggcatgatgcccgggccgccctgcttcccgccggacgccgccggcggcgagggcgaggcggcgcgcggcctggccgcgcagcaacaggcgctgtacatg

SEQ ID NO: 45059 - DNA, 61 bp, Chlorella protothecoides
acacggcttggacgcgtgaggcaggggggggggatgtggacatctccagccaggctgtagc

SEQ ID NO: 45060 - DNA, 61 bp, Chlorella protothecoides
ccaaggtttgctgggctggcaggggaggggggtcgatggggaggctgtgctggcgttggcc

SEQ ID NO: 45061 - DNA, 61 bp, Chlorella protothecoides
gcgccaccacctgggttggaggggcgggggggtgtgtgtgtgtgtgtgtgtgtaaaaatat

SEQ ID NO: 45062 - DNA, 61 bp, Chlorella protothecoides
aaagcacggcattacattatcactggttggggcagcaagctgcggaaggctgttgtataat

SEQ ID NO: 45063 - DNA, 61 bp, Chlorella protothecoides
cgcggttctccgcgaccagcagccgagaagctcattaaaccctcccacttagaggaaggag

SEQ ID NO: 45064 - DNA, 61 bp, Chlorella protothecoides
atgcatataggccaacgtgtcggctggcgggcagggcgcgagtgcgtgggtttaatcgaaa

SEQ ID NO: 45065 - DNA, 396 bp, Chlorella protothecoides
  modified_base (157)..(296): a, c, t, g, unknown or other
ctccccgcctccgagagcggcagcacccccagcgctttggccagggggtcctgtggcgcggccagcaggtagtacagcagggccaggaagagcgtggcctgcagcgcagccttgaccacgcccaggcccaggcgcagcacgcccaggccgcccatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccgaccccgccgccaggcgggccagcgcgcccagcggggccagcgcggcggaggccaggcgcggcagcgcggccgagtcggcggtggcggccgcacg

SEQ ID NO: 45066 - DNA, 61 bp, Chlorella protothecoides
gaccgcagtggctgggtcctgggccctggccccgcgcaaatcagctacggctttgtctacc

SEQ ID NO: 45067 - DNA, 92 bp, Chlorella protothecoides
gcggtgacaaccaggaagcttggttggtcgtttggctggaaggtgttgaggatgtagggtcagcttcacactgctctttgagtccaaacctg

SEQ ID NO: 45068 - DNA, 61 bp, Chlorella protothecoides
gggtgaagcgtgtgggtgagggggggggggggcaggagacgcggcgctgctagcatgctgg

SEQ ID NO: 45069 - DNA, 61 bp, Chlorella protothecoides
ggaggtgggcttgaggtgaacggccggcgggcttccttcctcccttgaggtgcaggcttgc

SEQ ID NO: 45070 - DNA, 61 bp, Chlorella protothecoides
tggcgcgtgtctctggcgctggcggctgcccttgccctcgtcctgggcgtcggctccatcg

SEQ ID NO: 45071 - DNA, 61 bp, Chlorella protothecoides
acgtgcacctggataaagtgatgcggcgggggctggcgctgccctcccctgagcctgtgga

SEQ ID NO: 45072 - DNA, 61 bp, Chlorella protothecoides
cgaactgggagtgtgaattgaaggggggggggagaggggtgtatgggagaggactctgggc

SEQ ID NO: 45073 - DNA, 61 bp, Chlorella protothecoides
ccgggccatactagtactggatgcatctgcgggatatcgcggccgcgtcttcagaggggga

SEQ ID NO: 45074 - DNA, 61 bp, Chlorella protothecoides
cagagtcactgcgatctgggtgcccgagggggaaaggtgtgcttgggacacgtggacctct

SEQ ID NO: 45075 - DNA, 61 bp, Chlorella protothecoides
ggccgcacgcgcgctacaatgatgcggtcagcgagcccagccttggccgacaggcccgggt

SEQ ID NO: 45076 - DNA, 76 bp, Chlorella protothecoides
cagcgtgggcttcttgttcacgcgggacagctgggaggcctgggtggcgatcttgtcgaactggtccacgatgaac

SEQ ID NO: 45077 - DNA, 61 bp, Chlorella protothecoides
gaatcgaagctgggtcctgccacggcttggccctccgcctccaccatgtcgacgctccgcc

SEQ ID NO: 45078 - DNA, 61 bp, Chlorella protothecoides
acagccgtcgcaatggccgccagcggcagggggatggccaggcagagcacacctgtgcttg

SEQ ID NO: 45079 - DNA, 61 bp, Chlorella protothecoides
tgcatgccatcacgtgggccatcggcagggggttgccctggcatcgccaggggcgccaggc

SEQ ID NO: 45080 - DNA, 61 bp, Chlorella protothecoides
cagcagctcgatggagtgggagacggagggggacggggaggacctgggcgggcagggggtg

SEQ ID NO: 45081 - DNA, 61 bp, Chlorella protothecoides
gtcggcgggtgcatgaagacgccagctggggggctgcttttgaagcattgtatccttgtgc

SEQ ID NO: 45082 - DNA, 61 bp, Chlorella protothecoides
ataaaaagcggtcgaacacgcgtgccggggggagaacgtgaggtggcccccccctcgcccc

SEQ ID NO: 45083 - DNA, 610 bp, Chlorella protothecoides
  modified_base (99)..(132): a, c, t, g, unknown or other
tggggtcgcgcgggggaggggggtggcggggcgggggggaggcgagggagggtagagcgggcagagctagaggcccagatgcggctggcccagggcatnnnnnnnnnnnnnnnnnnnnnnnnnnnnnnnnnnggcagagctcgaggcccagatgcggctggccaggggcatcggaccgagcgcaggacggtcgagagggaggacaggccagacttgcacgcaactggcgccatcgaccgccggcttcgctggtgctcgcgggatgggaagcttcccagggggagcatgactgggacgcagttgggtccggcctcccccacacacacccctcccgcagggtgcatgacacacgaacgacgccctttccccccctccccctccgtccagctggcgatctgcctcgcggctgcatggacggcggcggggcgccccaaccccgaccgcaccctggaggtgctctgctccctacccctcggggccaggcaggtcgaggcggttggggccctgctgcgcgccggcgccgccccctcccgctcggcggcggcgctggtcgtccgggccctgggcgccggccaggcgccagacctggcggccgccgcgacggccgcgc

SEQ ID NO: 45084 - DNA, 1403 bp, Chlorella protothecoides
  modified_base (139)..(258): a, c, t, g, unknown or other
  modified_base (368)..(377): a, c, t, g, unknown or other
  modified_base (505)..(514): a, c, t, g, unknown or other
  modified_base (825)..(834): a, c, t, g, unknown or other
  modified_base (1063)..(1072): a, c, t, g, unknown or other
  modified_base (1334)..(1343): a, c, t, g, unknown or other
agcgggccaccgccgcggccgtggacctgctgctggaccccgccgcctgcgacgaggcggcagccctggccgcgctgccctgggtcctggcgcggggctgggagccggggctgcggctgctgacgcggcgggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgctgccggagggcgggcgggtgcgctggcgcttcctgcgccacctggtgcactgcgggagcgaggcggcgggcgaagaaagcgtccacaccgcgctcgccctggagnnnnnnnnnntgtggtgtcagcaggagcggtggctgacggccaggagatcgaggagggcagcgtcgcgggaaaggaagggacagagctgggagagcccgacgaggcggagctggaggaggtggccgccgcgctgagtnnnnnnnnnnggtggtggcagcaggagcggtggctgacggccaggaggttgaggagggcagcgtcgcgggaaaggaaggggcagagctgggagagcccgacgaggctgagctggaggaggtggccgccgcgctgagtcagcacctgggccagtccacgctgtgcgacccccggcgcgtgctgcatgccctgcagggcctggggctggaccgggaggaggtggccatgcaccgcctggtgcgctgaagggggaagggagtcgagatcacgtttttagtagtgagggggagacatcggcagcaggtgcagtgctcgtctgtgnnnnnnnnnntgagatcacgttttcagtggggagggggagccatcggcagcaggtgcagtgctcgtctgtggggcctcgatctgccgcacagcgtcccatgcagcttgtaccggctgccggcagggagaccttctcttgtccctctgtccatgcctcaccacaccctatgccccaccacatcttccccccaatacacactctctccctcaccgcaggccggaaaccacatggaggcgcnnnnnnnnnntcacccgcatcctccccccaatacacactctctcccccaccgcaggccggaaaccacatggaggcgctgcgccttctgtgcgtccggctgcgcgatgtgcccgccgcggcggcctacgcgcggcgccacctcccgcgcgaccttcaccccgacctgctgggcgtggtcctggccggcggcgcgcccacgcgccaccgcgacgcggcgcgcctcgtggccgcgctgggcctagacccgctgggcctggtggccgcgctgccgnnnnnnnnnngctgtgcgtccggctgcgcgatgtgcccggcgcggcggcctacgcgcggcgccacctccc

SEQ ID NO: 45085 - DNA, 61 bp, Chlorella protothecoides
taccaaggaggtgaggagtgtggggggggggggaaggggactgggggctggaagtggaggg

SEQ ID NO: 45086 - DNA, 61 bp, Chlorella protothecoides
cactgcagggtgtcattgtcgtggctggaggacgggatggtgtggtggaagatgagggact

SEQ ID NO: 45087 - DNA, 61 bp, Chlorella protothecoides
gagtacgcccaagcatgaacgtggctcggggttggcagaattcacccccgggcgagggggt

SEQ ID NO: 45088 - DNA, 366 bp, Chlorella protothecoides
  modified_base (101)..(289): a, c, t, g, unknown or other
gcggcgggccctgcaccgccgcgcgcagctcgtagaccagggcgccggggggcagcagggccgcggcggcagccagctcggggccggcgcggcccagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccgcgcccgcctcgcggagcgcacggaggaggctagccatgcccgcgatctgacagggatgttgttttttttttg

SEQ ID NO: 45089 - DNA, 61 bp, Chlorella protothecoides
tagagcgtgccatacagacagttcggctgggacagggtaccattgcaaatccacccaggtg

SEQ ID NO: 45090 - DNA, 61 bp, Chlorella protothecoides
cgtgtgcgcagggcggagagtcgtggagggggctgtcaacgctggcatttacttgactatt

SEQ ID NO: 45091 - DNA, 61 bp, Chlorella protothecoides
agcatgagcatgagtttctattttgaaaggagcctccagcccatcacgtgacagctgcggc

SEQ ID NO: 45092 - DNA, 61 bp, Chlorella protothecoides
ccaagttctgcataaagtgtataaaaatctctcttagtatttttgtttttaacactttttg

SEQ ID NO: 45093 - DNA, 61 bp, Chlorella protothecoides
catccgggctgcgggagaagctcgcccgggggggggtgcaggtgcgcagggcccgggcgca

SEQ ID NO: 45094 - DNA, 61 bp, Chlorella protothecoides
gttgcccctgcaatgggccatggaggggggggcaccatttgttgctgtcggcatgtcgctg

SEQ ID NO: 45095 - DNA, 61 bp, Chlorella protothecoides
gttcgttgaccccgccgttctctgcggcgggggccgccttgtccagcttctccaggtacag

SEQ ID NO: 45096 - DNA, 61 bp, Chlorella protothecoides
gggggggaggggggggttgcagggtcggggggtcgggcatggaggcatggacgagcgcgat

SEQ ID NO: 45097 - DNA, 61 bp, Chlorella protothecoides
gagccctccatcgtggacaggctgcgcgaggatgtcatggccaatggacacccccagcagg

SEQ ID NO: 45098 - DNA, 61 bp, Chlorella protothecoides
cctcatgaacctgagacggcggggcgaggggcggcgcataccttcgcagaggcgcacaggc

SEQ ID NO: 45099 - DNA, 61 bp, Chlorella protothecoides
ggtcgaagggtgggggggttgggagagtgcggaaggagagcgggggggaaaggggtgctgg

SEQ ID NO: 45100 - DNA, 61 bp, Chlorella protothecoides
catcagaagtgttgtgccagagtggcagccctctggcccctgcacgcagcgtagccctggg

SEQ ID NO: 45101 - DNA, 61 bp, Chlorella protothecoides
cccgatctggatcttcaggggctcgtcgccctcccgccctcctaggttgaaggagggtact

SEQ ID NO: 45102 - DNA, 61 bp, Chlorella protothecoides
tggagggactcaacactgcatgaccgccccaccggcggcagccagacctcagcgcatttgt

SEQ ID NO: 45103 - DNA, 78 bp, Chlorella protothecoides
cctgatcctgagctgcagggcctggggatgacgtgcggctgcacaaccgcccccagccgccgcaggcggcggcgcacg

SEQ ID NO: 45104 - DNA, 61 bp, Chlorella protothecoides
gcggcctcggcgggcggggggaagaggcgggcgtccacctttcgcacaaagggctccagcc

SEQ ID NO: 45105 - DNA, 61 bp, Chlorella protothecoides
tgtgttgtgatcgagagaatgcgaatgggggttacggtcgcgtgccccttccgtaaacatg

SEQ ID NO: 45106 - DNA, 61 bp, Chlorella protothecoides
ttgcagaaaaactgcgcctgcagcggctgggggaggagtcagactaccagaatgccatgga

SEQ ID NO: 45107 - DNA, 61 bp, Chlorella protothecoides
aaacaagtgaataagcatcgtacgtggggggggggattgtgtgagccatgatgcgggggac

SEQ ID NO: 45108 - DNA, 61 bp, Chlorella protothecoides
ccgtgtgcgagtatggcggcctcgacgaggggcgcgacttggccacccacccaatcacgat

SEQ ID NO: 45109 - DNA, 61 bp, Chlorella protothecoides
aatccgcgcacaggcctcttggaggcggggggcaccgacttcctccggctgggtcccctga

SEQ ID NO: 45110 - DNA, 61 bp, Chlorella protothecoides
atcggcagcggatgcgtgtagaaccaggggggctgtgcgaaggttggggagatggaggagg

SEQ ID NO: 45111 - DNA, 61 bp, Chlorella protothecoides
aggccgcagggctggatgccggggatgggggggatgtggggctagatgccggggatgggga

SEQ ID NO: 45112 - DNA, 61 bp, Chlorella protothecoides
cgcatgctggagagactcgtgcacgggggggtgagtcaactgccctgctggcaataaaaag

SEQ ID NO: 45113 - DNA, 61 bp, Chlorella protothecoides
cttatccaaaggccggagtctaacaagctgagcccctccaattgccatggcctttttcagg

SEQ ID NO: 45114 - DNA, 61 bp, Chlorella protothecoides
cggctcagacatccagcaaatcatggcgggggggggctgacgggcagctcgacgacctgaa

SEQ ID NO: 45115 - DNA, 61 bp, Chlorella protothecoides
tctgggccctgcacacgccggcagggggaggtttcgaggccctgcacgcaaagtacgagcg

SEQ ID NO: 45116 - DNA, 61 bp, Chlorella protothecoides
ggggggtggcggtgtgggtgggaaggggggggtttgtgtgtgtttgagtgggtctgattgg

SEQ ID NO: 45117 - DNA, 61 bp, Chlorella protothecoides
aggctactcacggcggcttgtatacactggggccagaatctcacattatgtggagctggca

SEQ ID NO: 45118 - DNA, 61 bp, Chlorella protothecoides
ttcaggcaaaggggcgatggcaggggctgggggatgtctggcctgcctggatttcctacca

SEQ ID NO: 45119 - DNA, 61 bp, Chlorella protothecoides
gaggcttcccgacggtcggcgacagcccgccccccgccgcgctatcactgttccgaatgtt

SEQ ID NO: 45120 - DNA, 61 bp, Chlorella protothecoides
cgatagtaaaataaacaacgtgtattaagggttataaccccaaacgagaacatttttttgt

SEQ ID NO: 45121 - DNA, 61 bp, Chlorella protothecoides
atcgtagtcgtggtgtttactttactcaagcctgggtatcattaccaggtgtaatgacagt

SEQ ID NO: 45122 - DNA, 61 bp, Chlorella protothecoides
ctcgtctcggccccgttctcgaaatggcgggggccatgagccacgacgccgcgtcatgcct

SEQ ID NO: 45123 - DNA, 61 bp, Chlorella protothecoides
cgggaggcggccgacgacaagctggtctcccccagccgcgtcattggcaaggtccggtcca

SEQ ID NO: 45124 - DNA, 98 bp, Chlorella protothecoides
tacaatttttacataactttattatgtaaagctatctaaaacataggcaatatatacaaaaattatatgttagacggagcaaaattaatcggagcagg

SEQ ID NO: 45125 - DNA, 78 bp, Chlorella protothecoides
atccacgaattttacaaaataaagaaatgttccacatggtggttaatagagatgttcaaaatcatataattaaaaaaa

SEQ ID NO: 45126 - DNA, 70 bp, Chlorella protothecoides
cttcagcaacatccggaactggatgcggaatatcgaggctcacgccagcgagcatgtggtcaaggccctg

SEQ ID NO: 45127 - DNA, 75 bp, Chlorella protothecoides
aaaaaaacagatttccctcttactaattgtaagtaatcttctaaactttcccaaatggcttgttctctttcttct

SEQ ID NO: 45128 - DNA, 61 bp, Chlorella protothecoides
tgtttaaaaatatttattatttataaatattctagttataaataataaatatttttaaaca

SEQ ID NO: 45129 - DNA, 107 bp, Chlorella protothecoides
taatctacaaaacagttgtttatttaaaacgatttgaattttatgaagttttggtttagaaataaacaaatagacataaatttcatttattttacttggttttaact

SEQ ID NO: 45130 - DNA, 72 bp, Chlorella protothecoides
gtttgaaatgaacttgcacccataccccatgcagcttcttctaaaccatgatcaaattcttgtaataccggt

SEQ ID NO: 45131 - DNA, 84 bp, Chlorella protothecoides
ttttttatggatcttatgtaggattaggttcatcattgtaaaattaaattagaagttaatttgtttttatactattgcaaattc

SEQ ID NO: 45132 - DNA, 61 bp, Chlorella protothecoides
taatacggcagaagaaattaaatgtaaaactccagatacaaagtacggataagtatctaaa

SEQ ID NO: 45133 - DNA, 74 bp, Chlorella protothecoides
gctaatgccatagtaattgctgcagttaatgttgttttaccatgatccacatgaccaatagtaccaatattaac

SEQ ID NO: 45134 - DNA, 158 bp, Chlorella protothecoides
tacttgtcttataaaggactttgttctttaaaaaagttctataattttataaattaatgagccaagcaggactcgaacctacaactgcgttgttatgagcaacgtgttctaccaattgaactataagctcatataaaaataatacagctataataaat

SEQ ID NO: 45135 - DNA, 66 bp, Chlorella protothecoides
tcaaataaatagactttatacttttattatagcaacaataaattcgatttattttacttctttcgt

SEQ ID NO: 45136 - DNA, 128 bp, Chlorella protothecoides
aaataaacttgaaaaatcaataaactttgtttttacttcgtttttacttcgtacaacgaagtattttaagttgaaggaatagtccgaacttaattgaaaaattaagagtacaatgagagcaatattat

SEQ ID NO: 45137 - DNA, 61 bp, Chlorella protothecoides
acgtgaatagtaaaagcatgaatatgatgcactaaaaaatcagctgtacctaatggaattg

SEQ ID NO: 45138 - DNA, 62 bp, Chlorella protothecoides
aaaaaaaattaaaaaccaaaatttaccacaccaaattcgtaaaaaatctaacaaaaacagta

SEQ ID NO: 45139 - DNA, 82 bp, Chlorella protothecoides
aagcaacaatacccattactgaaatagcacctaagctgtaagaaaggtacgcttcaccagaccatacaaaagctctacgtgc

SEQ ID NO: 45140 - DNA, 68 bp, Chlorella protothecoides
aacattaatgttatcagatgatgctcaagaaatattagtcaaagagcaaaataaaatgggtgttttcg

SEQ ID NO: 45141 - DNA, 66 bp, Chlorella protothecoides
ctttttgtgttgtcatttatttttaattttgttaatgtaacttagcacgcgtttgtttattaagaa

SEQ ID NO: 45142 - DNA, 77 bp, Chlorella protothecoides
ttaaaactttctctgtaaattttaataacataaatacatgaaatacacagggctttaaccttctatggcgtgttatt

SEQ ID NO: 45143 - DNA, 67 bp, Chlorella protothecoides
ggaccccgacatggagtggaactccttggatgagcaggatgtcatgttggcgtgttcgtccaccgcg

SEQ ID NO: 45144 - DNA, 62 bp, Chlorella protothecoides
tccgtttctgggagcgactgcgggtgtgctacttaccagcagcgaagtgcgccaccctacgc

SEQ ID NO: 45145 - DNA, 81 bp, Chlorella protothecoides
aaaatccagcttgaattatattgctgtttaagacgtaatgatatttgttgatggatttcaccaagagtaacttcattttga

SEQ ID NO: 45146 - DNA, 73 bp, Chlorella protothecoides
gagtatgaagataaaatacaacactgacgcacagacagtcagcaggggattggttcttcatgaaatgagatgg

SEQ ID NO: 45147 - DNA, 68 bp, Chlorella protothecoides
ccgagcctaccattctcctcagcttcccattcacatccagatacctgtccagcatcaggaactttgaa

SEQ ID NO: 45148 - DNA, 123 bp, Chlorella protothecoides
tacacaccatataatttattattcccaaataactgatatttatttcaagctatggacaataagatattatactaaaataaattatccttataattctttaatatatctagctacaatcaaaga

SEQ ID NO: 45149 - DNA, 95 bp, Chlorella protothecoides
gcaacggcaaagccactccacagcgctgatcaggggtccagcaaaagcaaaacacttcgtcacgaggacttcccacgtggtcacccaccgcagta

SEQ ID NO: 45150 - DNA, 103 bp, Chlorella protothecoides
agttaataatattttgttaagatgctgctaaccggacttgaaccggtatagatttctctgtaactttttgaaagttatgtgtctaccatttcaccatagcagc

SEQ ID NO: 45151 - DNA, 80 bp, Chlorella protothecoides
gccgcgccagtgcagtggagactgctgcgcgtatcgtgaagctgtcatgccttacattcggcaggccatgccctgacccg

SEQ ID NO: 45152 - DNA, 61 bp, Chlorella protothecoides
taaatttgaatttttgacgactggactttcaccatctatggtgcaggattcagctgcttcg

SEQ ID NO: 45153 - DNA, 73 bp, Chlorella protothecoides
gagaaggaagggggttagcctgccattccccgagtcttgatagtttggacttctgctgttgactgagctgtct

SEQ ID NO: 45154 - DNA, 103 bp, Chlorella protothecoides
cagctgggaggttgacatgacgctgagggttttgacagcggagggtgcaaggcattaagaaaatattcatgcttgcccctctcatagcaactgcgaccttctg

SEQ ID NO: 45155 - DNA, 136 bp, Chlorella protothecoides
ccccccaggccctaataatgttatacgtcttttatgtgtgatttctgctaaaggatttgtttcatctaaatattgtgataaagttcctcccaaaaagaaacttcgccaagctcttgtaacatattttgataaaata

SEQ ID NO: 45156 - DNA, 75 bp, Chlorella protothecoides
gcagtgccctgatggagaggcatgatcagagggtgacgtgtaaatctggtagattgtgacagtggatcatacagt

SEQ ID NO: 45157 - DNA, 90 bp, Chlorella protothecoides
attatgtaaaaaacatgattactggtgctgctcaaatggatggtgctattcttgttgtatctggtgctgatggccctatgccacaaacta

SEQ ID NO: 45158 - DNA, 61 bp, Chlorella protothecoides
accatctcaacatatagcttcagttagttgggatggggaattatcccttagtttgaaaatt

SEQ ID NO: 45159 - DNA, 85 bp, Chlorella protothecoides
cctatatgttaaaactagttcacatggttgatgataaaattcatgcacgggcaacaggaccttattccgctttaactcaacaacc

SEQ ID NO: 45160 - DNA, 99 bp, Chlorella protothecoides
catcaagtgttaggtgcagtctcctcaggtccttatgtacaaagaaacaagtactgccaggaccaaggtcagcagtgcaagcaggagtgccaagatgtg

SEQ ID NO: 45161 - DNA, 78 bp, Chlorella protothecoides
aaaaaatcatcatcaacaagtgaatcaaaataaataatttcatgagcaaaattaaattcttttaatgcacgctttttt

SEQ ID NO: 45162 - DNA, 94 bp, Chlorella protothecoides
acaattattgcctggtgtagaagtattagctattgaagaatatagaatatcgcgctatcaacttattgtatctgttcaatctttattaatttta

SEQ ID NO: 45163 - DNA, 117 bp, Chlorella protothecoides
aaacaactactcttttacagcctcagcgttcacagcttctggcacatgcacatcttcttctgtgtccatgctcacgtccagggatccatcagagatctgcacaacatagtggctggg

SEQ ID NO: 45164 - DNA, 90 bp, Chlorella protothecoides
aacaacagcgtactgtagcaacagctataaaaagaggacgtatgagtggattactgccatttgttaatcgttatttagtagaaaattaaa

SEQ ID NO: 45165 - DNA, 67 bp, Chlorella protothecoides
gggaagccacaacattggcaataacaacaagggcaacgccaacatctgcaatggcctggctggcgcc

SEQ ID NO: 45166 - DNA, 73 bp, Chlorella protothecoides
aggccagggaagatcctggcctgcgtttcttgggccacagcctccctgcaaaggtgtgaagcttgtggacatc

SEQ ID NO: 45167 - DNA, 61 bp, Chlorella protothecoides
aatacatgcttgaaccaaataaaagagactaccgtcctttattacgaaaattaactcctaa

SEQ ID NO: 45168 - DNA, 65 bp, Chlorella protothecoides
tataatttaatctttactaaatatattctttaactatttatgtcacgtcgacgtacagcaaaaaa

SEQ ID NO: 45169 - DNA, 61 bp, Chlorella protothecoides
actagtgcctatggctttaaaaacaaaacttccatgagcttccataaatccagataaccag

SEQ ID NO: 45170 - DNA, 102 bp, Chlorella protothecoides
caactggatgcaaatatttaattgcctttggtcggactcgaaccgacacgtcaaagacatcagttcctaaaactgacacgtataccatttcgtcacaaaggc

SEQ ID NO: 45171 - DNA, 92 bp, Chlorella protothecoides
tactatatggaaataacataatttctggcgctgtagtaccaacttcaaacgcaattggtttacatttttacccaatctgggaagctgcttct

SEQ ID NO: 45172 - DNA, 64 bp, Chlorella protothecoides
catttttacccaatctgggaagctgcttctcttgacgaatggttatataatggtggaccttacc

SEQ ID NO: 45173 - DNA, 61 bp, Chlorella protothecoides
agagggctgccgcagcctggtggccgcggtggggggctggggcctccagggctgctgggag

SEQ ID NO: 45174 - DNA, 84 bp, Chlorella protothecoides
tttttcatattgtgcagaaataccctttaactgtacattactcgttttaccaactaaataatccccttctttaacccatgttcc

SEQ ID NO: 45175 - DNA, 66 bp, Chlorella protothecoides
aaaaaatctggtttgggttggtttgggaatgataaaaaatgtaaattagttgcaactaatttacat

SEQ ID NO: 45176 - DNA, 68 bp, Chlorella protothecoides
acatcgcatgaccctcttccgcccatcaccacccccctgcaccacccaggctacagcagcatggagga

SEQ ID NO: 45177 - DNA, 76 bp, Chlorella protothecoides
atttacgacgcatattaactgattatggatttcaaggacaccctcttcgtaaagattttcctttaagtggttatgt

SEQ ID NO: 45178 - DNA, 110 bp, Chlorella protothecoides
taatgatcatattgttaaaccacttaccaataaataaattttatttattttacatggtacggagaatataagcaaaataagtatactttttaaggtggtgtgataaaaaa

SEQ ID NO: 45179 - DNA, 61 bp, Chlorella protothecoides
gaacactacttttaaactaaaccaaaatataccaggaatccagtaaaatattgcaaaatca

SEQ ID NO: 45180 - DNA, 72 bp, Chlorella protothecoides
caaatcaactgtttgcctgccaatgtttgttaaaaagattttaagttgttgaagtatcttccgagcagtagc

SEQ ID NO: 45181 - DNA, 92 bp, Chlorella protothecoides
ttggcaaatcgccctttctgacatgacctcgcccaaacgcattgtattacaccaccaagcaaaccacaagattctttggaaagtaaagaaac

SEQ ID NO: 45182 - DNA, 122 bp, Chlorella protothecoides
tagcgaaacgaaaagctatatacaattgtcgtaatacaagatgatatagatctccatagaggaaactcaattataaattttacctagtgaattgaaacatcttagtaactagaggaaaaaaa

SEQ ID NO: 45183 - DNA, 84 bp, Chlorella protothecoides
atatatatattgcttcacagttcatgtaaaataaatgaaatttattaaatgaaattaaaactttctctgtaaattttaataaca

SEQ ID NO: 45184 - DNA, 64 bp, Chlorella protothecoides
gggcggcggcaacgacgagcgcgagcagacgctgaaccagctgctgacggagatggacggcttc

SEQ ID NO: 45185 - DNA, 67 bp, Chlorella protothecoides
ttcatcgatcccagggtggcgcggtccacttgcatagatctggaacattcagagatggagatgattc

SEQ ID NO: 45186 - DNA, 189 bp, Chlorella protothecoides
agaatttaatattatttttcaattttcgtactgtgcgtgcatttccatgtgttctttggcctctaacaggtaaaccttgaatatgtctatatcctctaaaactatgtatatttactaatcgttgtatgttttgtcttgtaaatcgtctaacatcactacctgtatcatagttttgagttataatttgtg

SEQ ID NO: 45187 - DNA, 82 bp, Chlorella protothecoides
cacaacagtcaacatcgtctctgtgatggtattgtgaactataccaagtatgctggagacaatctggaatgagagcacggat

SEQ ID NO: 45188 - DNA, 64 bp, Chlorella protothecoides
ttttcttttggtaagtgtatataagaacctaaataaaaactctcccgtttgaaagctttttttc

SEQ ID NO: 45189 - DNA, 87 bp, Chlorella protothecoides
aataaaaagatttgtcaagttatttaattatacccaaaaacacgtttaaaggcttcacgtactttatccccagaatctatagattct

SEQ ID NO: 45190 - DNA, 61 bp, Chlorella protothecoides
ttgtgatggtcctggacgtggtggtacttgtgatatttcagcttgggatgctttctatctt

SEQ ID NO: 45191 - DNA, 72 bp, Chlorella protothecoides
cacccacaaggtagtcactcccgacactgccggagcagcgaggatccatactgaccggagggacagggcttc

SEQ ID NO: 45192 - DNA, 61 bp, Chlorella protothecoides
tttttttttagcggggcaacccgctaaaaaaataaaaaattaaaagaattaaatttttttt

SEQ ID NO: 45193 - DNA, 61 bp, Chlorella protothecoides
gaccgagacttcgtggcggagaccatcttcaccgccagcctgcacctggtgcacctctcac

SEQ ID NO: 45194 - DNA, 470 bp, Chlorella protothecoides
  modified_base (105)..(251): a, c, t, g, unknown or other
atgtgctgttcaaggcagaacagctgcctccttcgatccagaggtcccctccaatgaggaaatcgctgctgatcggcggaggggactccgatgcagtgagtagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctttcgtgtatttgaaacttttgcttgcgcaattggttgatctcaagctgttcgtgtcagcaagtcacaagggcattggaatgggcagggtgatcgaggagcgattcatgaacatctggaaaaggactatctgcggaagactgcgtgtcgttccgaagttgaggcagtcgacgaatgtcttctagtttggggtcccaggattcgtgggctagtgtgta

SEQ ID NO: 45195 - DNA, 61 bp, Chlorella protothecoides
cgtgagcataaatgtgcctctcggtggcgctcctgctcacagtgcgcagggcgtgccaccc

SEQ ID NO: 45196 - DNA, 127 bp, Chlorella protothecoides
aaaactgtaagtgaatgcaccaatcctgcattttgaccttcaggtgtttctattgggcaaagtctcccatagtaagtcgggtgaattcctctaatttttattgtagtttgtttactatttacccccc

SEQ ID NO: 45197 - DNA, 61 bp, Chlorella protothecoides
gaacctgattcagagtctgtgatcccgcccacctccgccgcacctgtccaggacgtcatgc

SEQ ID NO: 45198 - DNA, 75 bp, Chlorella protothecoides
ccaagaacttacaaatgttgttccagttaaccaaccacctaatgctaaatatgcagtagggaataataatagacc

SEQ ID NO: 45199 - DNA, 84 bp, Chlorella protothecoides
attaaatcaaaataattttccttgcaatttaaatttacaaaaacaatggggatctttaatttttaaatctgataaatcgaaatt

SEQ ID NO: 45200 - DNA, 61 bp, Chlorella protothecoides
cctgaggccctttgggtgtcacggcggggggggggtgggcaccgctggtcggtgcaggagc

SEQ ID NO: 45201 - DNA, 62 bp, Chlorella protothecoides
atttttaaaaatagttggagagaaattttagaaaaagcattagatcctattgcaatttcggc

SEQ ID NO: 45202 - DNA, 61 bp, Chlorella protothecoides
atgttttgtagcccaaggactgcatcggaatggatcaggctgcgatcccgactgtcggagg

SEQ ID NO: 45203 - DNA, 77 bp, Chlorella protothecoides
ttttttaaaccgtctactccaggaagtcgtcacggttcagtattaaattttgatgagatttcatcaaaaaaacccga

SEQ ID NO: 45204 - DNA, 70 bp, Chlorella protothecoides
gtgggaccagcaagtcttgtctgcaaaaagtaagaccatgcacagcttctgcttgctcagatgcaagaag

SEQ ID NO: 45205 - DNA, 152 bp, Chlorella protothecoides
ttttcggctctaaattgacagattttttactttttacttctaaacttgaccagtctttcacacgtgtagaaacaatagatatatatttttctaaaaatctatacattgtttcacctcgcaaactagctttacaacctaatatttgattttgt

SEQ ID NO: 45206 - DNA, 61 bp, Chlorella protothecoides
tgtaatcgtttggattgggacttgtacaactgaaattattaaaatggatttagaagggatg

SEQ ID NO: 45207 - DNA, 70 bp, Chlorella protothecoides
gatattgatctaaataaattttatttatttctacctacacctaatttataaaatataaataatatttaaa

SEQ ID NO: 45208 - DNA, 106 bp, Chlorella protothecoides
taaaaaagaatataaatttattatttccaatacaagattttctttttgagtgtaataaacatgtaaataaatcaacaggttcaaggtcaagagaatatttggaaat

SEQ ID NO: 45209 - DNA, 61 bp, Chlorella protothecoides
gcaattgctgaaacaattattttatatcaacaagctccaacaaaagaattagggcttcttg

SEQ ID NO: 45210 - DNA, 36006 bp, Chlorella protothecoides
  modified_base (606)..(615): a, c, t, g, unknown or other
  modified_base (918)..(927): a, c, t, g, unknown or other
  modified_base (1368)..(1377): a, c, t, g, unknown or other
  modified_base (1694)..(1703): a, c, t, g, unknown or other
  modified_base (2709)..(2718): a, c, t, g, unknown or other
  modified_base (3349)..(3358): a, c, t, g, unknown or other
  modified_base (4168)..(4177): a, c, t, g, unknown or other
  modified_base (4666)..(4675): a, c, t, g, unknown or other
  modified_base (4977)..(4986): a, c, t, g, unknown or other
  modified_base (5085)..(5094): a, c, t, g, unknown or other
  modified_base (5234)..(5243): a, c, t, g, unknown or other
  modified_base (5963)..(5972): a, c, t, g, unknown or other
  modified_base (7099)..(7108): a, c, t, g, unknown or other
  modified_base (7555)..(7564): a, c, t, g, unknown or other
  modified_base (7628)..(7637): a, c, t, g, unknown or other
  modified_base (7968)..(7977): a, c, t, g, unknown or other
  modified_base (8977)..(8986): a, c, t, g, unknown or other
  modified_base (9235)..(9244): a, c, t, g, unknown or other
  modified_base (9816)..(9937): a, c, t, g, unknown or other
  modified_base (9996)..(10005): a, c, t, g, unknown or other
  modified_base (10064)..(10073): a, c, t, g, unknown or other
  modified_base (10222)..(10278): a, c, t, g, unknown or other
  modified_base (11475)..(11484): a, c, t, g, unknown or other
  modified_base (13760)..(13769): a, c, t, g, unknown or other
  modified_base (13971)..(13980): a, c, t, g, unknown or other
  modified_base (15638)..(15647): a, c, t, g, unknown or other
  modified_base (15920)..(15929): a, c, t, g, unknown or other
  modified_base (16340)..(16349): a, c, t, g, unknown or other
  modified_base (16591)..(16600): a, c, t, g, unknown or other
  modified_base (17126)..(17135): a, c, t, g, unknown or other
  modified_base (17999)..(18008): a, c, t, g, unknown or other
  modified_base (19180)..(19189): a, c, t, g, unknown or other
  modified_base (19506)..(19515): a, c, t, g, unknown or other
  modified_base (20310)..(20319): a, c, t, g, unknown or other
  modified_base (20662)..(20671): a, c, t, g, unknown or other
  modified_base (20817)..(20826): a, c, t, g, unknown or other
  modified_base (20905)..(20914): a, c, t, g, unknown or other
  modified_base (22010)..(22019): a, c, t, g, unknown or other
  modified_base (22478)..(22487): a, c, t, g, unknown or other
  modified_base (23078)..(23132): a, c, t, g, unknown or other
  modified_base (23930)..(23939): a, c, t, g, unknown or other
  modified_base (25137)..(25146): a, c, t, g, unknown or other
  modified_base (27847)..(27856): a, c, t, g, unknown or other
  modified_base (28618)..(28627): a, c, t, g, unknown or other
  modified_base (29951)..(29960): a, c, t, g, unknown or other
  modified_base (30918)..(30929): a, c, t, g, unknown or other
  modified_base (31014)..(31023): a, c, t, g, unknown or other
  modified_base (32185)..(32194): a, c, t, g, unknown or other
  modified_base (32321)..(32330): a, c, t, g, unknown or other
  modified_base (32383)..(32490): a, c, t, g, unknown or other
  modified_base (32561)..(32570): a, c, t, g, unknown or other
  modified_base (32712)..(32721): a, c, t, g, unknown or other
  modified_base (33558)..(33567): a, c, t, g, unknown or other
  modified_base (34037)..(34046): a, c, t, g, unknown or other
  modified_base (34632)..(34641): a, c, t, g, unknown or other
  modified_base (35344)..(35353): a, c, t, g, unknown or other
  modified_base (35935)..(35944): a, c, t, g, unknown or other
gtgagcggcggcgcggcctcccccggcgggaaggcggcctccaactcggcggccaggctggcgcgcagggcggcggggattgggagcgccgactcccggagccagcgcgcggcctgggcgggctcgtgcagctcgggaagcaggacctcgaatacgtaaaggtggagcagcgcggcgtattgccggcgcgaccagggcgaggagcccgccggcgaccgcgtggccagcaggtccagggtcacctgctgcgcctccagccggcggtcggcaaagtccagggccagggagaggtagaggagcagggaggcggcgggggtggaggtgagccgcccaaacagggcctgaagctccgacttgaccgagccaaacctgggcgtgcatgggtgtgtgtgttggggtgggtgggtgggtgggtactgaatggtcagcagcagccatgccaagccaagccaaggctgctgccttggctcagggtctgcctaccaaactgcaaaagggtgtgaggatgcgtcccctcaccccgcatggctcaggcagcagctactgagtgatcaactggcacccccatcacattgttcacctctttgtctcgtacagggcctggannnnnnnnnnactaccaaactgcaaaagggtgtgaggatggatcccctcaccctgcatggctcaggcagcagctactgagtgaccaactggcaccccatcacattattcacctctttgtctcgtacagggcctggataagcaccacggcagctctatcctccgcatctcctgaccgcgtaagacatgacagcatgtaagacgtcacgaggtgctgctgcccagcgacttgacgcacgtgcacttcctggacatacaccagagatgcaccccccgggacccggaggcttgccagtcgcctcacctggattgtannnnnnnnnnatgtacgacatgacagcatggaagacgtcacgaggtgctgctgcccagcgacttagagcacgtgcacttcctggacatacaccagaaacgcaacccttcggacccgtaggcttgccagtcgcctcacctggattgtacatagtgcgctgcagcacctctctagagagtctctcggcttcagagaactcattgagaatgaggtgccgctcgcaacggcccagcaactcctccaatggttccgggtccaccatcggcccagactccgggacggaactgcccaccattggggtgtggcaacacggttcacgtgtttgacgacatatttttagatcctaagcgtctggcttgtttcaattgagtgccgcattatacaaggaagcgtgtcgtagacgcaccccgagacgaggcagcgcgcgcgcaccccgccctctccagtcaaannnnnnnnnncaaggaagcgtgtcgtaggcgcaccccgagacgaggaatcgcgcgcgcaccccgccctctccagtcaaagtcatcatcaagctgaagattctctcggccaaaaatccagagataaacaaggaagaatcggcaataaaatgcattattgagtgctgcattgagagtaatgaaggctgagcatgcaaaactcagggctgccctgagatgtgcaggctctccctggagggcgagcgctgcgggatagagtgtgccagcagcagcaaggtgtgcagggccgtcgcctcgatctcctcgctccacacgacctccagcagcgnnnnnnnnnnatccctggagggtgagcgcttcgggatagagtgtgccagcatcagcaaggtgtgcagggccgtcgcctcgctctcctcgctccacacgacctccagcagcgccagcttgatctgaggggaggggcacaggaagggttcatcacgagctgggaccacggcgtcggcaacttggaggcagctggtcaaggcctctgccccctggctgtccactcaccagcggatctgccgcccaagccgcctccgcctgtgctcgggacacgaagacgacctctgcgccgtcgggaccgaccaccagcctggcgccctttagcccagcctgtgcgggtgtttcctggcccggtgggaggccttctgaacctgtgaatgagaagaggaaggccaaggttggcaggcaggcagtttgggggggggacttgcgatgggaaccgggcactcaaacctatggcagggtcccggcctctgacactccatcaaccagccggcctctcaccctgcaggatgcgccaggctcccacgacgccgccttctcggtgctccgccagcctccagccgccgcctgggtcccgcagcgatgccagcgtttcccacgccctggcaaagcctgactgaaaaattgagccgtgacgcgggtcgcagggtccagcctcctgctgtcctggcttgtcagggctctccaggcagccattcagcggtgatgtggccggggtgccggcttggggccttgggatccggagcttctccggagagcccatcggcttcccctccacagcagctgcgcggtccgtggcggctgagacccccagcgccctcaagcctggggcgggggaaggcgagaacgacgcgcagctggactgcgtgagcagggttgtgctggtcagggggtccaggagggcgctgactgggcctggggtcgcagcgagcccacatggccgtggtgacgggctgggcgtcgtcagacctagggagcgcccctcggcgtcgggggtgttgcaggcgccagcattgnnnnnnnnnntgtcgtcagacccagggagagcccctcagcgtcgggggtgttgcaggcgccagcattgctgccgtgtggaggtgtgcaggcgccagcattgctgccgtgtggaggtgtgcaggcgccagcattgctgccatgtggaggtgtgcaggcgccagcatcgacagcattgggaggtgtgcaggcgccgtcgtgactctcgttgggtcgccagaccaccgtcagactgccgcgcagcacaagcacgaggccgggctggctgccctcccccaccgcagcatgactcactgggtcgacgcccgcgccaggctgcaggcggtgcaccagagcgtcgggcgtcagcagggcctggagcggcgagaaagggtgggcgccgtcccgctcggcgggacctgggccactgcccctcgcccaggggtgctgcagcaccgagtcaagcgtccagcgccgcgcagggtcctgcgaagggagggcagggcggacatgatgcctgcacaggggcactcttctcgcttgcattgcatggccgggcttccagaccatcggtacacctcccctctcctttccccaagcacgctccccccctcgatccccctcctgacaccgtctgtcacccctcaccctctccatgcagccnnnnnnnnnnaagggcagggcggacatgaatcctgcacaggggcactcttctctcttgcattgcatggccgggctcccagaccatcggtgtacctcccctctcctcccccaaagcatgctccccccttcaatccccctcctgacaccatctgtcacccctcaccctctccatgcagccgtgcagcagctggcgcacgccctcgcccagcgcgggttcactggggatgatcaggtcctgggtgtgcagcgcctcgtacagctcggcgatggaggtggcagggaaggggatggtgccgaagaggagtgtgaagaggctggcacccaaggagtagacgtcggaggccggcgtgcttgagcagagattgagggggttaagtgcggggagggttgattggcggtggagagtcgcatgggtggcagcgacgagtgctgtgaagcggccctcgtcactctggggcgccgttgtgtgcatcacacagggttccttcccactcattctggcagccagcccgacagccctcctcccacatgcacaccgaccccacaacacacgcccaccagggtccggcctcggcgcaggccagctccggcgcgaggaaagcgggcgtgccccggggcctgtggatccccacgccgccgccctcccagccggagcagccaaagtcggtgagcatcacccgggaccccagcagcacgttctccggcttcagatcgccgtgcacaatgcccaagcggtgcagctccgccagaccctgtgtggaaaggagggaaatggggcgcaattccttgacccaggtcgaggcccagccggcacggcgannnnnnnnnnaaaaggagggaaggggggcgcaattccttcacccaggtcgaggcccagccggcacggcgacaccaggcctgggagctgcaggcccagtcccatagcaccgggtccttgattggcgatttggagacgcaggcctcgctcctgaccagcctctgctctacctggtgcaaaactcgccaccgcccgactgatcccttcctcgaacccatcctgtgtgagtgttccccttccatcagacaacgcgcaccttggccatgccgtggaaggcggcgcgggcctcggcctccggcagcctcctgcccgcctcgagggacgcacgcgtcagcacgggtcccccctccgccagcgtcatgaccagcaggatcttggtgtgccccgggtcgtcaatcacctggggtgcgggatgggtgagaggcacgtcgcagggtccagggcggggaaggaggtggggggcacggagaagaaggcaagggggcgcatcgtcgctgcgannnnnnnnnngcgtcgcagggtccagggcggggaaggagggggggtgctcggaggagaaggcaagggggcgcatcgtcgctgcgacggcgccgcatcacccctcgcgatcctttcccgagccccgtggccacacagagcgccaccgcctcccgatggaatgccacgaaaccttcccccccccgtgggatcccacctcgtacagccggggcaggtttgggtggtgcaggcgcgccatgacctcgatctcccgcgccaggtcagcggccgggtctctgcgccggcccgagcgcgacaggccgccgcccggcggnnnnnnnnnnaagcgccaccgcctcccgatgaaatgcagcaaaaccttcccccaccgtgggatcccacctcgtacagtcggggcaggtttgggtggtgcaggcgcgccnnnnnnnnnnctgagtcagcacgtccatgaccaggaacacgcgcccagacacgccgcgacccaggaagcggaccatagcgtactggttgaggagtacagtgcccgggaggtgcatcatctccagggtcgctgtccgacggatggcggtgnnnnnnnnnnggcgtactggttgaggagtacagtgccctggaggtgcgtcatgtccagggtcgctgtccgacggatggcggtggccgcgcccgccggcggattggtgagtggggcgttcaggcgtgagttggtggaagtcttggggtccagcctcactcccgcgaggtccggccgggaggccaaggggaggacattgtctgcggccgaaattggcaaacccttggccgccgtgggtaatgtgacagaggcacatgggggagcgccatcctcgctactgctgctgctgctgctgctgaaactgccatcaagattgcaactgggcgtcctgaggggagaggggtggggaggtgcgctgtcaggctcttggagagcgcttcgtaagggcgcgagtgggggcgaaccatcggttgtgagtacctgcgggctgcagccatgtgtcagggaagcgcaacggcatcagtgctccatgtgttccacataccccctggttgaacagggatattcccagccgggcccctgtgcacagatcagagacccgcaccgacctctctgcttcagggaccgcagatccaggacggctctctgggaggggccgatcacagctcacacacgcccccatcccctgcgccaacagggagcagggtgctgcgcttgacatggcatgctcagtcaatcttgatccctctgactacaggtgccggcgcagcccaccatctctgaggcccaaannnnnnnnnncctccctgtgcacagatcagagacccgcacccgacctctctgcttcagggaccgcggatccaggacggctctccgggaggggccgatcacagcttacacacgcccccatcccctgcgccaacagggagcagggtgctgtgcttgacatggcatgcccagtcaaccttgacccccctgactacaggtgtcggcgcagcccaccatctctgaggcccaaaatacgccttctgcgtggtaacgtgaaggagcacagcatccaccacttcccccacctgcagcactgaggcgtgtcaggacggtacggcatcaggagtgcgcagcatgtaaacccctgtggcaggcactggggtggcagcagtctctggatcagagcgccctacttcaagttgcagcagcccagggggtgcctctcaggctgcgtgcatggtcgggtggctttgatctgtgcgcgatccaaagaatgcgatggtggaatggtcgctgatgggtgaaatactgtaaaatagtgcagccttgcaattacgatccatttgagcccgcaaattgaactggcaatgcggaatcgtgaatcaccccgctgcgcagtgcgagcgggccatgcggagcacacccggcactgggtatgagaagtacggcaccggtggcgcgcagtctcgtcttcaccattttaggcatattcgatctgcctgagctgcacttcagctcggcatgattccaagatgatgagatccatacgcaaaaccaaggggcagacgggggtcccggtcgcccgggccgggctaggaattctggccatttccatcatcctgttcgcttatcaccaaggcaaactgtacaccggtcccgccgtcatcgtctacccttctgccgtgggcttggagggctccaccttccaactgtacaaggggtttccatacctgacgaccgccgatgttgtggtctctggtgtctcccatcatgcggtgagaggcttttcttgatgctgagttctcatcgcatttgttcgagccaaagctaagggatccgaggcatacctcatgcgtcaccctgtatcccgtacgacctggtaggtggcccctcgagactgcgcggctatatgcgagaccacccccacgtgcacctggttnnnnnnnnnncatcccgtacgacctggttaggtggcccctcgagactgcgcggccaaatgcgagaccacccccacgtgcacctggttccagtactgcgcctccaccgatcggtgctcgccacgctcagcgagtggggaggtgggcagagaggggaagggttgtcgtgaggctggggtggggattgccacggctatgccggctgctgcaggggggtttgaaaagcccagccccatcttgcacctccaccctctgaaaactgccgcagtgctggctgatggcaggcaacaccgacaaacttccacgaaaacgcttcaaaggtctgtgtgccacggggcgcgggccttgaaaccgctgggacgtgccggtgactacgttgggtcctggaggacggtgtgatctgagaacccccgcacactctgggcaccctgcagaggacgggtggctgaacgggatcgnnnnnnnnnntgttgtcgtgaggccggggtggggattgccacagctatgccggctgctgcagggaggtttgaannnnnnnnnntggtgtgatctgagaaatcccgcacaccccggtcactctgcagaggacgggtggctgaacgggatcgccatctccaccaagcagcacacggagacgcccaaggcaaaggctgcctcagcgaactccgacaccaagaccaaggcggagacgagcagtggcggtgccgccaaggcagcggaggtggtgcagtcctcggaagcagccaggagcgacgctgttgcgggtccgggtgccactgccaagcccgaggaggtcgcggcgggtgcgggggtggggcctgacgagaccgcaacgccccctgtcaagcctgccgaggccgcgggcggcaccnnnnnnnnnnaggcctggcgagaccgcagcgccccccgtcaagcctgccgaggccgcgggcggcaccgaggcgcagcaggggacttcggcggccgatgtcaccagccctgcgaccccggccgcagccaccgaccccgcggtcgccggcgtcggcgtgcggcccgagaaggtgccggagaacaccatggcgcaggagcagcccgcggccggcgatgcagcgggccccatcgccaaccagtcgatcatcatgcccgagtacgaggcgctgcgcaacaacgccaccctccccctggtcttcctggacgtcgcgatcaagggcgcgcccatcggacgcatggagatcgtgcttttcagcgacgttgccccgcgccacgccgagaacatgaggtgagcagggtccagcgggcggtgctaagggaggccgagtgtccagccattggtggtccagcgccctccccgtcgtgtgcctatcatgtctgagaccgcacgctgcctccccgcatctccaccatgcccaggctgctttgctcgggggagaagggggccgtgcccaagccacgcgaagacgggcacaaggtgtaccacctgaaggtgcgcgcgctgtgctctgcgggacatgccggggcttgtatatcttgaccctgatcagggtcgatgccgctgccgccggcacccgggaccgctgcgaccctgcatgctgtgcagtggcgcagcggcagcaggctctgctcgctgcccatttgccgctgccaagccacttcatggatgctcctctctcccccctcccaccactgctcgcccgcaccatcacacagggcgggacgttctaccgcatcgtcaagggctggatcaaccagggcggcgcgaatgtagagtcggcctttgggggcacctttgcggacgaccccggcggcctggcgctcaagcatgatcacaaggtgcaggagggtggtgcctggcatgttaaagggaggtggggaaagctccatggggtacactgtgcaggagcnnnnnnnnnnggggtggtgcctggcatggcaaagggaggtgggaaaagctccatggggtacactgtgcaggagcttgtgtatggtaaccgctggtcgaggtggccgtgataacctcagaccgcgcgcagggcttatactacgaccagcctatcgtccagcatgacaacctttccggattcttcccctccaacaagagccctcccccaactcctccccccctcttttgcagggcctgctgagctccgccaacatgggtcnnnnnnnnnntgcagggcttatattacggccagcctatcgcccagcatgacaacctttccgatttcttcccctccaacaagagccctccccccacccctccccccctctttgttagggcctgctgagctccgccaacatgggtcccaacaccaacgagggccacttctccatcatgatgggcccctctccccacctgaacggcgggtacaccatctttggccaggtggtggcgggctgggaggtgagcgaggccatcaacgccgtgtcccatggccagccagaggacacagcgcacggcgacgccggcgtcgtgatcgtggacgcggggcagctgcgcaagggaaccattgtgcccgacctgcgcctcggcctgcctgccaacgccacggggtacaattactaattgccggagcactgaggaccttagagggcgggggaagagttgacggttggggagggtagggaaagctagagagaaagaggctggggggtatgggagggtccataagggtagcttgacagccaaagcactcaggttgaagcgctaccgtcactcctcggcggccaggccgagctcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccgaacagagcgcaggcgtggtcgaggaggccgccgccgccctcgccctgacgcgcgnnnnnnnnnncccgaacagggcgcaggcgtgggccagcaggccgccgccgccctcgccctgacgcgcgnnnnnnnnnngagggtagcttgacagccagagcactcaggttgaagctcactcctcggcggccaggccgagctcgaggcgccggctggcccggcctcgccgcaccgcagcctgcagcgccccgaccagcctgccctccagctcagcctcccgacagccnnnnnnnnnnnnnnnnnnnnnnnnnnnnnnnnnnnnnnnnnnnnnnnnnnnnnnnnnaggtccacaagggcgccggccaggcagggcagcgcccgcgccagcgactgctcgcgccgcgagcgcagccgggctggatccgccgccttgagctccagcagggctctcgtcgttgccgcgcgcatcagcatcgcctggagggagcgggtgaggggaaattttctggggggggtgggacttccctgcgctgctgcgtctagcgggccagaatcggcggagtcatacagtctttgaggtctcacccagggactcgcagcatatcaacacaatcaaggcgccggcccacgcaacgacaggcgcggcgccgacctgagccctcggcgcaagaggcttgggggcttggcctgtggtcctggcggatgccaggtgcaggacgatgacgcagctgcggagcgggcctggcatccccgtctcgtcgtgcagcgtcggcactggccctgaggcatcatgccgtagcccaaactctgcccagtccaggccggcgagtgcgtcgtgcgcggcctggctgggatcggtcgcctcgtgctccaggtaggcatggatgtccaccctggcagctgggccggcctgctgcccggtggggcctgcgccatgcctgaggaccacgcccgcataggcgtgccaccgtgcggctcgggaagcagcgtggccgacgccaatcccggggggcgcagcctgggtggcggggctggtggtcgaaagagaggcccattgagtgagacctgttgatggtgaaacaggtgacggcgtgagggcgtggatggtggctagacttcttggtagttgcgctcccacctgttggccaagtggtcgagcaatgcaccacatccaacagcaatctctagatctttgcccagcaagatgatggaatccacatcgaggtatgcccgtgtgctcccaggcattgcctgacctgcacgaagggcctcctgggccgatgtcacatccttgttttcaaatggcgacacccatctccgtagaggttcatccggttgctcaaaagaaaacttgaacatcgctcgcggggtgatcgcggctgtgagcaccacatagcccttcagcctctgactcaggtcttgaacgactggacaagagggtgcacagagggtgagtgtgatgcgggaatgcagacctcatgtcaccaggctcgcaatgcctgtctaggagcaggccaccaaggtaccttgcctgtcgagnnnnnnnnnnaggaatgcagacctcatgtcaccatgcttgcaatgcctttctaggggcaggccaccaaggtaccttgcctgtcgaggcgcccagcgatgctcaggctgacatctgtcccagaaaatgcctggtgtttaggtgccagctctggtccgatggttggataccaaattccagctaatctctctctttgataggtggcgatcacactctggttgcaagctgcttgcacggggtgggactggcaatgttaagggtccgacggatcatattaagatggcacacaggcccccttgtaatcagcccacactccagagtgaaagcacgtactcgtcgaccggagcttcaatttataagtcgtttgactcccatcctccagagcggaggtcagactggccatcagatgcgtcatggagtctggggcttctggcatgcccgggccgtcgtccgcaactgcgacatggggacagccgtcgaatgggcaactgactgggagtctaagttgatgcctatgagtccgtaaaaacaatgctcatccatgttacctcggaatacggtgcaatctggattggttgagcatgtaacatccactcgaatcgttcgttgagccggcctcggatctcgggagcatgctcgtgccgcaccccccaggatcctactcactgcagcgaagactgccttcccatcgacatgtacatccatgatgaaggggttgtgaagtcgcaggatgctactcggggtgtaaaagggggaaggcgttgctcgacatcaggttcatgagagtgtgttcattgttaatcccgcgctctccgtttctattatggccactgattagaatcccggactgctgtcatgtcgcctccatgacgtacagctcaccggctttgcagcttgaagtattctgtattacaagaccacggcgtcaatattatcatgacggggcagaggcctggagatgagggcccatcgatgcgtgcaccaggtcaggccgcctcacgagtcgcctcgcccccccttcccttggatgcaacccccctcagcagcccatgggccggggcgtgtacatctctgccaggtacaggaggtggtcggcgacggaggagcacagccccaggtggcacaccgagttgtggcagcggatgtcctccccagtagcatcgcagatgcccaccagcgtggccgcccccgcctggtccagcacccatacctcgcgcgccagatgccagaagcccatgtagggcggcgccacggagggcactatgtcgcggttgtgcgtgaatcgccagtgctccggcaccacgcgttgcagccaggcggcgaacaccgcgttgccgacgcgcgggctgccaaaggtggtcagccgcacgtcgtgcaggccgtgcagcgcgcgcagctccatggcgcatatggtggccagcgcaccgcccagcgagtgccccgtggcgtgcaccgggtgcgggccgtggcggcgctgcagcgccgctgccgcgcgcgtcaccgagcgggacagggaggagccgctccaggaggtgaggaagccgccgtgcaccaacgcattggcgggcgcgccgggcgtagtcaggttgaggtcggtgcgccaggtgcgcatgttggtcaccctggagcgtgatgtagaggggggaggggaatttgggtggtgacaggaaagaaatcttgggtggtgagggtagtgtggacgggggtcggggtggaggcgacccaatgtggaagccttgaagcggctggctgggaaagtagaacgcccagatgtgtggcgcatcttgacatgtcgggggaaaggggtcacagactcatctgcggggtacaggcaacaattgcccgacatctcccccacataatcccccctccccctctcccccctcaccagttataaatagaccgggagtcggtcccacgaaaggcgatgaccgtggcctgcagcgagttgctccagcccacaaacccgagcaggtcccaggccgcatcccacgccagcgtttccagctcaaactccggcccgctcgattgatcatcctcagaggaggggtcgccgcagcgggtgcagttccacgccgcaatgttggaggtgttgcagtacgacgctgccacgtactcggcgaggcggcgggccaccacccagtccagtccctcgcccctgcgcgccgcctggtcggcgtccagcatccaggccttgtcctgggggacaaagggggttagagcgctcatgttatacgcgacatccggcccactgctgggggcgccgggcccggggccgccgcgtcgcnnnnnnnnnngcagggtgcggcggggggtgtcatagtctggcgggtgcggagaccatggccagcgtggccaccaggaggggggggcatgccaggtcagcgcgtggccgggcagccaatccagtgcgcctggcaggacaggggtgtggatgctgcagtgagaatgcaagggcttgggggggacagtccaagggtggccacccccagaagtcannnnnnnnnncgggggacaaagggggtcagggcgctcatgttaaacgcgacatccggcccactgcttggggcgccgggcccggggccgccgcgtcgcggtggccgacgtgcgccagaactgcgcgccggcaccaggcgcggctcggcgtccagctggcgctgactcagctccagttccacggggctggccaggctgccgtcgggccacatcgggtgcaccagggtgcggcggggggtgtcgtagcctggcgggtgcggagaccatagccagcgtggccaccaggaggcgggggcatgccaggtcagcgcatggccgggtagccaatccagtgcgcctggcaggacaggggtgtgtggatgctacagtgagaatgcaagggcttaggggggcagtccaagggtggccacccccagaagtcatagctcagctgtggcaccagtcgtttcacaaagctggtcttccttgtaatctgtttccccatttccgaccgcagcctcccttgtcagtaactccttcccaatccgtaccgtggcatcccggaggtttcacccacacggcaccagcgaggagcaggagacaagacagcagggcacgcgggccgcgaaaggatgtcatcgcggttcgcacatgactaattcttcggagttgcagaggcgtgggtatggggaggcctgatgaggagtcgacgttcgaacctagcgggagtgatccagacgtggccaggcgataggcattgctgctgtcgcggggcttggcatcatgggagacacaacattgaaggtcagaagctaacggatcagcttgcgcctttgatcaccatacgggacctggagggttgtgggaaagggggatattccgaaagctggcgttgagcgcgcattgcatgtgtggggataacatgagttgaagtgtccatcagctgcccgggtccccgcgacagcattacaccggcacatattgtatctctcataaagctatacgacctgcaaaactggtcatcgggaggtgccaaccggcaacagggcacgatgtttgggtggggaaccccccctcccgcggccaacgaggtggcccagctggccgcaaagtcgtcgttgaaatcgaagaagaagggcgataagaaggtcggcaagaagccggcgggtgataatccgctggtgcgcaagattaggccgaccgggcggcccctgccccctccccacgagcccttccagcccgggaagtacgagcatgaggaccgcatgatggtggactacgtccgcttcatgacggccgagaatgtctggtattacaggtatgcgttggctgggcggtcaatgtggaggggccggtccatgcgcagagcatgcctcctccctcgctggcaatgctcacactgttaccctcttacacccattgcacggacacagggaccgcatgagcgtgccacgtggaccttgctccctccccgtcctgcgcgaggcctgggtgcatggggtggtggatgagaacacgctggtgtggggccagggcctggcggactggcttcccatccgcaatgtgcggacactggtccctcagatccgcaccgtggaaggtaagaggagaagtggtggggtgatagggggtcaaggcgtgggtatgggcttattatctagcatgggaatggataatgagcaaccggaatnnnnnnnnnnccagatccgcaccgtggaaggtaagaggtggagtggggggggttatagggggtcaaggagtgggtgtgggcttattatctggcatgggaatggataatgagcaaccggaatggatgagacattgaaaacatttggatgcctgcctgcttcaaactactccattgctgagtgaatcaagggcagatatctcctgttcccactcaccccaatccctccccccatacaaccacgtgcagtacaaataggcacatggttcaagaagaactttgcccnnnnnnnnnncactccattgctgagtcaatcaagggcagatatcttctgttcccactcaccccaaaccctcccccatacaaccacgtgcagtacaactaggcacatggttcaagaagaactttgccctgcggcccgccctggaccgcatgcggagggcgagggtagatgcgcggagccccgacaagagcacccaggtggagaacatgtactgagctggcgacgtcgggattgttccgggcgcgtctcggcaccgagcagcgcaccatcggtcggcgccgaggctctaattgctcctcctccctaccagtgcaccttccctggtctcacgcgcatgcccctgtgcagggaggcagggcccttatcccgccccatgcactcctgtacggtgttgccgcggtggtctcccgacatgtcatcagnnnnnnnnnngctaccagtgcaccttccctggtctcacgtgcatgtccctgtgcagggaggcagggcccttcccccgccccatgcactcctgtacggtggtgccgcggtggtctcccgacatgtcatcagacgaccccagcacccccttccccccttgctcctcctgctcgttgcaacctcacattcaatcctaggtggggcctcgtggcaggcaggcagactggcatccaggcgggcggggggggggggcnnnnnnnnnnccccccttgctcctcctactcgttgcaattccacattcaatcctaggtggggcctcatggcaggcaggcagactggcatccaggcggaggggggggcacaccagggcgcgccacccccttgcgctaccggctgcgcaccttcatcaggtcatggaacacgtcggtgggcacctccaccgaccccagctgtcgcatccgctttttcccctccttctgcttctccagcagcttgcgcttgcgcgacacgtccccgccgtagcacttggccagcacgttcttgcgcagcgcgcggatggtatcccgagccacgacgcgcccccccgccgccgcctgcacggccacctggaactgctgctggggcagggcccccgccagcgccgcgcacagtcgccgccccagcggctccgcgcggtcgcggtgcacgatgcgcgccagcgcatccacgggctcgccgttgagcaggatgtccaggcgctgcatgggcgcgcgccgcggttcgccctcctcatagtccaggctggcgtannnnnnnnnngtccacgggctcgccgttgaggaggatgtccaggcgctgcatgggtgcgcgccgcgcttcgccctcctcatagtccaggctggcgtagccggaggacgccgacttgagctcgtcgtagaaatcgccgcccagctctgccagcggcagcgtgtacctttcaagacagggaggaagggggagttttttggtggtgggcgagggggggggggaatttgatgtgtgtagagaggaggggtcgtgacgtggggtgcaggcaggttcggaagggagcctttgggaagcggctaggtgttgagcatcagtggcgaggcgtgcagtgggggcaggagatggatggctcccatgcagcaaggatgctagcaaaaggccgccacctcagctgcaaggtatcacaggtccccccctgctctgcgcactgtccccgcccccctttttataccccatccattcccccctcgcctcacttgagcatggtgcgcccggggtcgaggaccacgtggtcgagcagctccccccgcgcggcggtgcacagctgcatcagcgcccccacgtactcctccggggtcacgaccgtggcgcgcacagtgggctcccacaccgcctccacccgcacgtcggtggggaagtcggcggggttgctcagctcgatgctctcgcccccttgcagcacctatggttgggtttggggagatggtggagttgggtcgaggatgcctttgctcaaccagggcagagggagtcacccaggagccgtgcccctgaacagatatgggcccaaagttggcccctccacagcatcaccacatccacacacacaccccactaccctctcggaaccttccccccacccacccaaaagacaannnnnnnnnnacaccacatccccccccccccctaccctctcagaaccttccccccacccacccaaaagacaaggaacgcatccaacccccccagaacgcaccacccgacagggcacggtgggggcggtgaccagcacgtcggcgccatgctcctgctccaggcgctgccggaagacatccaggtggagcaggcccaggaagccgcagcggaagcccgcgcccagggcgttggagttctcgcggcgcaccgccacgctggcgtcggtcagcgccaggcgggccatcgcggcggccaggcgctcgtgcccgtcggcggagacggggaagatgccggcgaacaccatgctctgtgcgggcttgaagccagggaaagccggcacgggcgcgcgtgcggcgtgccaggtgtcgcccacccgcgcctgacgcgtgtccttcatccctgccagcacgtacccgacctgccccgcgcgcaggctgggcgtgggcaccggctccggcgccagcaggcccacctccaccacgtcgtagctctggccggccgctgcggccgtgacgcggtcgccgcgcgccacggcgccgtcggccaccgccagcaggcacaccacgccgcggtactcgtcgtggtaggcgtcaaacagcagcgcgcgcagcggggcggccaggtcgccacgcgggggggggacgcgctcgaccacggcggggagcacccggtccagccccgccccggtcttggccgagattgccagcaccgcggcagggtccaggtcaaaggcctccgccagttgggcggtgacccgcgccggctccgccccgggggcgtcgatcttgttcagcacggggatgatggccaggtcctgctcaaaggccagccagaagttggccaccgtttgggcctgaaggtgtggcggtcggtcaagaggggacggtgcagggaagagaggggttgggcggggtgctgatgaatggcgccgccctggagcaggaccaacaggatcgccgtctggcaacccatccgccttccagccagtcaccccaggtcacccagcacacgcgcgcgcacctgcacgccctggctggcgtccaccagcaagatggcgccctggcaggccgccagcgagcgtgagacctcatacgagaaatcgacatggcctggggtgtcgatcaggttcagcaggtactgcnnnnnnnnnnggagcgcgagacctcgtacgagaaatcgacgtggcccggggtgtcgatcaggttcagcaggtactgctcgcccttgtgtttgaacaccagactcgccgtctgggccttgaccgtgatgccccgctccttctccacctgatgtgggcaggggtacaagtgggaggcagacgaggtgagtggagtgggccggaaggccactgcagaagagcggatactccagcacacaccacagtcggcagcgctgcggggtgcagaggtgacggccgtgccgcaggcctcccacactaccccccaaccacccacacgctcctcacctnnnnnnnnnntggggtgcaggggtgacggccgttccgcaggcctccccctcaaccccccaaccacccacacgctcctcacctggagcttgtcgaggtactgcttggcgccggggttgatggcccctgtcagctccagcaggcggtccgccagggtggacttgccgtggtccacgtgtgcgatgatggagaagttcctgatgtgggagggtgggaagtcctccacagagtggccccccgccaggaagccacggggagaggcctcgccctgcggagcctccctctcaggagccttggcctcggtgctggtgcagcgggccgggggcggaggctggcgccagctccatgccggcagcactggccatgcacaggccagacttgccgacgacaccacgggggagtctgcgcgcagccatgcgcctgcagacctgatcaggccctgcataccgcgtgcaggtgcgattgaggatgcggaacggctgacaccgtcgccgacctagcaatcctccggggtctgagtgtctggcatgtcgccactccctgacgggattcaggcaatgcttgaagctgccctgagcggtcgcttcaaggaatcaatatacagataatatcattatgtacgccaatcctcaaagcaagggcgtatggtagtgtggtgaggagatgcccttgcaagttgtcgtatcagcaggctgtgtgaagccgagtctatacaggtcaatatttaaggaaacttccgcagatctatagttgattaatcaagtgcttgccaagtgtgcaatggagatgtcagccagtctcggccannnnnnnnnngggaatcaatatacagataatatcatgatttacgccaatcctcaagcaagggcgtatggtagtgtagtgaggagatgctcttgcacgttgtcgtatcagcaggctgtgtgaagccgagtctatacatgtcaatacttaaggaaacttccgcagatctatagttaattaatgaagtgcttgccaagtctgcaatggagatgtcagccagtctcggccaaacgtacgatgagggaaagggaggtcggaactccccttccattctatattctgcgttattggcattgttcaacatctgaagtacgaagtcgtgcaaacccgggttcaattcccggaagtgacattnnnnnnnnnncgcatgtctgtggcagctgaggcttgaaggctgacagtgtatgtcttgcgccggagacacagctacaggggggggcatgtgaaaaacacagtaacactttgacaggtgctggccggtggcacgccttcctcgctcacatgctgacnnnnnnnnnntaggtgtgcctgggcgccctgatccaaaggtctttcaatttcccgctttccctttgaattcaaaaggggagtgaggggnnnnnnnnnncaggtgtgcctgggcgccctgatctacaggtcttccaatttaccgcgatccctttgaattcaaaaggggagtgagggggcaaagcagacacatggatacatgtctgtggcagctgagtcttggaggctgacactatatgtcttgtgccggagacgcagcgacagggggcgtccatgtgaaaaacacagtaacactttgaaaggtgctggcctgtggcacgccttcctcgctcacatgctgactgccgcgggcgggtccaggaactcaaagtaggtggtgtagtgctcatcgatgatctggccaatggggacgaggaggtactgcgagtccaggcccttcagcaccctagaccccagagggtattggggcgctgcgggcgccagcaggtggatgctgggggacgcgtcggctttgtccccggccgacgcgcccagcaggcacaggtttccaggctcactgcaggcggcgacggtgaacacagagggcgaaactccggcgccggcgcctgccaccacggtcaggctgccgtcgtgctgctgacgcaggcgctgccccggatgagccatgggctccaggctcacacacctgcccggggtcaagaggggcccgccctccacgccctggctgccgtcgctgcacgccccatcagcaccaggaaccaggcggaaggtggcatccatggccgcggcgcgagagggggactgcgggtgcgggaccgccagcagcgtggcgttggccgcgtggcgggtgaggaggatgggaccctcattctgcataccgcgctccagggtgaaaggcctgagggacaccaggtcggcgctggacggcatgctcagcagggtgtcgatggatctcgggtcggcggtgatgttgcgtttgccatccgtgacacctgatgcgggtcggcggagggtgcagaggaggatgaagatatgaggggtgtgggtcccgcgtgagactcggcggggcgcgcaagtgattgagagcatcaatagatcatgggctcaggatgaaatgcactttgtatggtctacgaccccaatcttgccggatgcatccccccatctgatcaatcaagcgtttgggcaccggacannnnnnnnnnatcgtcggagggtgcagaggaggatgaagatatgaaggggtgcggggtccgcgtgagactcggcggggcgtgcaagtgattgatagcatcaatagatcatgggcttaggatgaaatgcactttgtatggtctacgaacccaatcctgccggatgcatccacccacctgatcaatcaagcgtttgggcaccggacacgtaggttgtacctgccccaacaaccaccgcttagccctgctcacctgccatgacccagggcccaaccaagacggccttgaggcgggagttctccgggcgctggtcattgatgctctccacacgtgacttgaaggggaagaacgactcgactgtagggtgggcggatgggattgggaggggtgccgcagttgaaaatttgtttgggcctggttgggacacgtgcagagcctcacagaggagattcaatcacatgctgcaaggcnnnnnnnnnntagtttgaaatttgtttgggcctggttgggacatgtgcagagcctcgcagaggagattcaatcacatgctgcaaggcacgagctcatagtgacgacctgagagcccaccaagccctcctccccacgccctccactcacccacgtcgccactcttccattcggggcccaggtcacagtaaaaggcctgggcaccggagtccgcgacgccttccactggggccggcggcacgcagctcgcattcctgccgtccaccttgaccagcgcggcggccgggtcggtccaggcggggatgcgccacttgagcacaaagtgcgcggtgccggcctcatcggcggtcgtgatgacgaggcgggcgcgagccgccgactctggcccatacatgtctgcagggggcggagaggtggcagatcagagcggtggggtggatgtggagcacccgcaacacacacgacctcatgtctggccccggccccagccccagtccttgcctgcagtctggttcaccacgacgccctgctgcttccactcgaggctgctggtcaccagctggttgacaaagagctccgggggagcatcggcggcgggccccnnnnnnnnnnnnnnnnnnnnnnnnnnnnnnnnnnnnnnnnnnnnnnnnnnnnnnnccgacgcgttgaccgtcctgcagcaaggccggccgattcaggtctcatgtggtcatgtgagagcagtgcattccattataagagcacttggtgcacatgcgatctgagaatcttcaatgcgcttcccaacacccaagaacccctctcaaataacaagcatgcctgtggaagtagatggaatctgccagtttggaaaaagactcgaccccgctgccatagcagcaccagaatgcgttgtaagggtcgccccatcctgtccaggaatgcccgcgctcgcccttccactcgccggcgactgaagggttgcaggggggtgtggggggcgagccggcgtcatcatgaaggatgcacaggcagcgagacagggtattgggtgcgggccagtgcacctcgcaagtcttttgattgaacgctaaacaatcaggccgatgcaagcagaaacctatgcaagggcaggccggcctgggagcccctgcccaagagggccaagccagttttgggtgacccttcaccgctgcgcactcagcccctcgctccacccagtataaccaacaacccccattccttgctctctactcacattgggggaggtagtagatcatcacacccgggccggcagcattggttgccaggcctgtgctgctctgcagcatggcgccagggtcttgcggccatgaaaccacctgtcgaggtatgggggggcggggtgaagatgtgtggctggcacggaggggcacttaaaagaggtggcagcgtgatttttccggaggatggccctctgggagtcggaatgatccnnnnnnnnnnatatgggggggggcggagtgaagatgtgtggctggcacggaggggcattcaaacgagatggcagcgtgatttttacgaaggatggccctctgggagtcggaatgatccagtccatgtcacctaccattgcccagctcccacacaataccctcctcccctgggcctgcatgcctgatggtctgctggccgcggctgggtctcgtacacggctgtcatagcggcagtcaggctgtctgacgatgcagggcgaccctgctccggcacctcctgcacctgctcccgccccagtcccaggtggtgctggtgctggcgctggtgctgatgcgcatggtgctgatggtgctcgtgcagatggtcatgctggtcgtcatgcgagtgtggcttgcgctggatgcccagcacgccgttctgcatggccagctcatagtagtccgccatggctgcgggccgcaaggtgggtgacgcggaggggggatgtccaatgcaaggcatggtgcacaatgtggtccccaatcagagctggcaggagggcaatgtgcggccatttcttctagcacaccagtgcgtcagtaagccaagacatttctgaatccgtctccttcctccaaagaccaagcactgttcacctggactgccggaccaggtgaacatcctcctcgcgatcttcagcatgttgtactgggtgcaggactcttgggacactgcccccgagtctggctgctagcaggtttgagtgtgtgtaggcgtgaaggactgatgctctgtctgggcagcgaaacagctacaacttgtggaacagcactagtgcagctcaaatagccccattgtgtgagctgaaatcacagagcggcttgatccctgttctagtgctcagccctttatcggtccgacacccatcacttttccttacgtcattgattgcgtctgccaccgtggactcgttgaaccaaaattcgcgccagttggagccccccgttgcaaagctgtggtactgcgagtgggtgcaggtgcgagaacacaggttgggaaatgggaaagctctgcgtgtgtgctgtcagcagtgccgtatgcatttgctcagcattccgatattcagctgtacactgcccatggaggcgaaggcacccctaggaccctacattgtcctataccttttcgagaagggcgaagaaattgtggacggcagtcgccccggccnnnnnnnnnnatgtgttctgtcagcagtgccgtatgcacttgctcagcattccaatattcagctgtacactgcccatggaggcagaaggcacccctaggaccctacactgtcctgtaccttctcgagaagggcaaagaaattgtggacggcagtcgccccggccttgtctcccatcgagtcgtaccgggccgcaaatccgttcacctgcggtgcaaaaggatgcagtcaaggcgacttgacctcgcatgcacagcaacccactgtattgtcacgcgttgcacaaccccttcacgccgagaagagcacctgggccaggtgggtgttggcatgtagaccgggcagggggtctcgtccctggagcaggggctccagaaaggcgggcttgtcgaagcggcgcgcacagtcagcatattcgcgccgacccgtctcggagaagaggttgtagagcacctgctcaaggtgggggggacattgtggcggtcagacatgtggatagagagtcggattttgcgctcaaggctggtgccgaatttgctgccgacctgaaaatgaaagcagtggtggactactgggacccctgccaagccacaaacagatcatcaccagaaccactcgcttgcctcattcatgccgccaaactcggtgttcagcgtgaggagccagtagtcctcgccacgagactctaccactcgctcaaccctggaaacggtggaggtaagatgggattgcatggttggcgaattaagaagtcgtctgcaagggcagagcatcttgcgtgagctcctgttgttcccggatggcctatcccattgtcgtcttccagagaacatggcgaggaatctcaagaggccaagatgataactcgacacacctattacagaagtactttgccatgtcttccaccatccccagagcgagcggattggcaaccatggtgtgctgatcaagaagtccctgcatgatcttgtggatctgcgtggtagagcgtggcagaagggaggaagacgggtggtaatcctttgccgattgtgcatgcagaggctccatgtgcctcaactagagcccttctacaattctcaagcctgccagagctagcaaacatggcaacccccagcgtaccacatagtatggtgcccagaccggcttcagactctccaaacgatcaaaatgttcctgaggaaaagcagacaggtagccgttgccgtgtgcatcctgcgccttcttcagctcatctaccatcagcagaccacgctgtgccaggtcctcacggcctgcgatgattttggagcgttctggtggaccaagagctactagcgcatgagtaggtagcaacctcttgtgatggaaggcccctcaagaatatcaaatgcaatgcaggcaccaaatccaaacccatatacatctttgccatacctgtgttgagagtagcaaaggccagggccgagaggtagtgacccatgaactgaccgcgaacctccacggtgggggcctcccagccgccatagggctttccaggggtgctgaggtttgcctcgaccctgtgtgtatccgagaaggaggtatgtatcgcatgccatgctcaaggtactggcacccatagcgagaggctggtgaaaggtacatgattcactcgtgtgcggctaggtatgcaaggttcaaatgacaggtcaaccgagaggaatttccctgcatcaatagcgtccactatccctgttcctgacctgtatgtgtacaggaggctgtcgggctccagcaacagcaagtactgattattcagttcaaaacccgttttgaagtcaggatcatcttctcaaccatgaaaaagagtggtgagggagggggaatctgtgtacaactcagagcgttagtctatgacaggagtaatgccctccgtgtagtgggagaacaaatgatgatggagtcacagggtggcgcccctcatgctggtcaaccacggcatcaccatcaggcgggcagcctcccacatccgacaggcatcgcctcaccaccgaggcgaacactggagagaggaaaaggctggatagatgcagatgctgagacgagggctagccacatacacaagactagggcgctgccgagccccgcgcaacaacgggccatggtcgtccggcctgcgatccagcgcagagcatcaaataacatccatggcacgcgcaatcacagcaggattgacgctatggcagaattcacattcacccacacttacgagatctggtcgccagtggttgtgtgcgaggaaaacccctccgtttctcgctggctagcagcgctgtgggtgggtcgtctagagctgttcgccctgtacgagagtcgtctgactcactgctcacacggtactaagtgaagcctgacaatacatacaaacagtttctctttttcagtcaagtggtgcgggcgtaggtagctgggtgtggtgtttcggaggacctctccattccccgacacgggtctaggatcagcccgaggtgcttcccccgacggcgcgcgattttgttgcgcgctcaggtacataggccccgaaggcgtacccgtgcaaagcactttgcggggccaacgccaaagaagcatatgcattgatcataataacgtgtacagggctgcatgccttcaagggagcgtgccggggggcgttaattgttccggccctctgtaggggtccgggctggcacgatggatgtgggtatcggcnnnnnnnnnntagggctgcatgccttcaagggagcgtgccaggggacgttaattgttccggccctctgtaggggttcgggctggcacgatggatgtgggtatcggcaggacgcaccccttgctggacacccttgcccaagtcagggacacctcaagctccgtccatcccctagagcgcctgctggagggcgtgtctgagccggcgcaggcagatggcctgctacagggcttggcagggcggcaccatgcttggtcacccctcctacgactctgggaccagcaattcctggcaagttgtgtactgatagatggtatgaatccagaaaataacaccttcatcctgtctgggagcccattctttgagcagtgccgctgaagtccaccactctgaggttctgcagacccgggaggcacagaccagcatcctgctgttcagcatcacagccagcgtgctccgagccagcggctccagccacaagcagtatgcagagagcgccaaggaactggccctgaccctgatgaagcaccgcatgaagctcgtttacttccacctgtcctcgggcgacagccgcaaggtgtgaaacgtgtgtggaattccagcaagatattaatttgcttcagacctgagccatgggattgagttgatgccactcaaacaaccagccgcccctttaaagaacgttaattggccctcacgctgtgcgctattttccccactgcctcagattcgggcggccctatcgctgctgacctctgtggccagcctgtcgcnnnnnnnnnnacccctttgaagaacgttacttggccctcacgctgtgcgctatttcccccactgcctcagattcgggcggccctagcgctgctgacctctgtggccagcctgtcgccaggcatcgtggaggagctggtccgagtgtttgacttctcgctttccagcctacccggcatagcccggccctccaggtgagcgaggccctgggatggctgtgctggcacagtcttggggaagtgcctgttggaagaagaggcagctgggaggtcatgtctgctgccttctaacagttacgtgcactcccacaccccaaaagccctgaggatggtgctattatcatctcaatgcccgtcagattcatatccagaccctagctcacccgctcatccatgcatgcccccctccaaaggtttaagtcgagcaggaagagggaccgcgccggggcgccccgccggagcacctccacccgcgtcgccttcctggactgggtcctggccatgctgcgccgggcagatgctcttcgtgtccagcagctgctggggattccagtcatctgcgccaacctgctggcggggctggaggatgacgtgcccgacctccagctcagggtgaggcggtgctggtttgaaggctggatggagtctgtcactctttaatgttgtgatgagtcatgtcatcagttggccgctgcgcctgcagtacattctggggaatccctcaggcccttcgctcatgatcaaacccctcttccctggtcctgcatgctccctgcatcaccctctggttcctccccgagtccaccaggtgctgcggaccgtccggcgacgcgtcatgcccactggggtcccgccgcgtctccaggccggggtcttcaacgaggccgggatgggctcgctggcctcgctggccctggcggccgaggccagcgccacccccgccggcaccctggccgccgaggtcctggagcgcctgctggtggacccggcgcatggcgtgacgatagacccagcgagggcggccaagttcacgctcgccagctttgagcccctatctgcaggcatggaagggtttattggttgagggggagggttgtccgtgtggtgtggatcgtagagttgttgtttgccaactacatgttgtcgttcaggtaaaccccaggtgatgcagccccaaggactcccttagctgaagctctccctgctgtgcaccgtacagcacccatcctcctgccaatcgatttgcatggtatggtcaacgccccctacccgaaacaattacaaccccgtgccattctatttccacaggtcagaagaggctgctgcgctggctggcnnnnnnnnnncaacaacaaccccgtgccattctatttccataggtcagaagaggctgctgcgctggctggcgaccctccgccccaccgccagctctacacaccgccggctcctgctcggctgcaccgccgcagacccgcgccttgcggccgagctcctggcttccgtgacctggtccctggagcccgcggcctccgcggactggctggccagcgccggcctggtcaccgcgctgcaggaccacctgcggcgcagcgccacacttcctctggtggccgagccaaaccccccgatcgccgcgctggctcggcgcgtcgtccccggcatcctcccccgcgccctgctctccaggggcgtgcagcacccagaccgcctggtgcgcttcgccacgctgcgcatgctccgcggcgcgctgggcgcgctgtcggcgctcctggcctcgcaggcgcccgggtgggcggcggcagcgtccctgcgccgcgccaccgccgccctcctccccgacctgcagacggttctgtctgccgtgtccaagaccggcccggcgcgcgacgacgcggcgcgggaggccgcgctgcgcacgctgggtgcctgggttgaggccctgcccggcgcctgggcagaggcgcgggtagacctgggccggctggtgccggccgacctggcggggctggaggccccgcacagggcggccgtgctggagctggtggacgccgcgctttcctctgcagataattattactgcggcgagggaggcccagtcaaccgccgcacggcggccagcctgacgcccgtgggcagcggcgccggcgcgcgcatgccgccaagcggcgtcctggccccgttgctggcgctgctcgcagtgcaggggtcggtcgccccccgcgcgctggcgctgcgcctgctcctgcccaccggcctgttcgacgcctggccagacgaggccgacgtctggctgggctgcctggnnnnnnnnnnnnctacgcccggggacgaagcccctgccgcccccgccttcagcctcctggcgctggccgtggcgcaggccgccgccaaggtgcaggnnnnnnnnnncctgaacgactgcgtggtgggcgcgctgcgccggccggacgacctctatgccgcgctcgccagcgttatgcccggggacgaagcccccgccgcccccgccttcagcctcctggcgctgtccgtggcgcaggccgccgccaaggtgcaggccagcgtcaagatcccggcggccgaccgcgaggcggtcggcgcgtatgcggcccgcgcgctggcgctggtgtgggacctggccggattggatggccgccagggcgcctggctggcggcagcgctttccaatgcactgcccgccactggcatggatccaggcacgcccctgggccggctggcggcggcgctgggggcgggcggccatgctgcgccaagccctgccctgctggccgagctgtgggtggctgcgccgagcgctggcgctcctcagaacgtgagctgtgtccacgccgaggccctgctgctgtgcgcccccggcgacgccggcccccggctcgcagccctgcgcgccacgctggcagcgctggcggctgcaccccgcccgctcccggactgcggtgtgctgggcgcgatgcgaggcgcactggcggttttctcggaggacccgcatcgcgggtcgacaggcgcggcgtggggcgccgcggcgcgcctggccctggaggccgcgctggggctgggcgccgagagcgttggcacgttgcacgccacgctgggcctgctgacgtccaccgcacagggctggctggccgccggcgcggcgctgccctttgccggcgccgtgtgcctgctcgcctttgacgcggcgccgcaggacgcggcgccctggcagcgcgccgtgctggagagctcgaggggcgagctggccgaggcgctggcggcgcgcgccttgcacgacgcgctgccgctgctggccgccctggcgcggtggccgctgccgcccggcccgcggtcggccgtcatggatgccctgcgcgaggcggggtcgctccctggtgtggcctgggacctgctgcgccaggacgagtcgtgtggcgccgctgccgaccgcgccgtggccgactcggtgtggacggtgtgcgggctgggggcggtgaacggtgccacggagcccacagccaacgccccggggcccttcgccagtgccctgccgcccggcgcgctgacgccacgnnnnnnnnnngcgcgccgtggccgactcggtgtggtcggtgtgcgggctggggccggtgagcggcgccacagagcccacagccgacggcccggggcccttcgccgatgccctgccgcccggcgcgctgacgccacgnnnnnnnnnngtgaatgccctgcgtgaggcgcggtcgctccctggtgtggcctgggacctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcgccctggtcaggactgcaggcctttccctgtcggccccccaccttttgaaggccctggccgcggcgnnnnnnnnnncctctgggagagggcggtggcctgcctggccaatgaggcggcgcgccgcctccaggccctgtcaggggcggacgtgaagggcgacgatgcaatcgcaagggcagtgcaggccgcgtgggcggcctgcaggggcccggcagcnnnnnnnnnngcgtgaagggcgacgatgatgcaatcgcaagggcagtgcaggacgcgtgggcggcctgcaggggcccggcagcaaagctcatgcccgctctggcctgcgcggctgccagcgccctggtcaggactgcaggcctttctctgtccgcgccccaccttttgaaggccctggccgcggcgcgcaccgccgagcagctggcgccgctcctggcgccagcgctggagggcatgcggggcgcggcatcggaccctgctgcgtcacgccgccgcgtcgccgagctcacgtgcgcggccttcatgggcggccagggcgcgagagtggccgagctgggcggccagctgggcgacctggcctgcgtgagcctgctgccctgcctccgccttgccgtgcggctgggaggtccagctgccgagcaggcgcaggcgctgctagacgccctggccgcgcagcccggcggcctggtggcagagatacctgccgctgacaagcccgccggaaccccaccgctgcgcggcctgcggctgcggatggacatggcggcggtggtggtcggcgacgccacgctgccctgcgccgtcctgacctccgccctgcatctcttcacggacgccctgcgccggctgttcaagtgggttggcggttgtagggggtgggagtgtgcaagcagcgtgttgtgcgtaggaggagagggtgggtcacggccggtcattctcgcaagcactcggtgcgacgcatcacagcaagcgtgccgagtatcgtgacagggcgccgccacgccggaacgcaccaccaccctttctcaatgcacaacccatccatccgcactgccagggccggcannnnnnnnnnctgtgcgtgggaggggagggtggcccaaggccggtcattctcgcaagcactcggtgcgacgcatcactgcaaccgtgccaagtattgtgacaaggcgctgccacgctagaacgcaccaccacccgttctcaacacacgacccatccatccgcactgccagggccggcaaggggggctcgcccccggaggccgcgctgctggcttgcctggatgctgacatcagcgacgccgtcgccgccctgcctgcctcgcagcggtcgggccaggtgggggcagatggagggagcgatcagatccaggggtcatctccgtgtagttgaggatgtgaaacggcaggcacagtcacctcctcgcctcgcccaccgacaccgttgctgcaccacgctttcaggcttttggggagttggctgaggaggtatgcagatttggtgccactttactcaagcggcggatggggcacgagccgacgnnnnnnnnnnggatgaagggagtgattagatctaggagttatcatagtgttgttgagaatgtaaaacggcatgcacagtcacctcctcgcctcacctactggcaccattgcggcaccacgatttcaggctttcggggagttggctgaggaggtatgtagatttggtgccaccgtgctcaagcggcggatggggcacgagccgacgctgcgcacgctgcgccgcctcgccgccggcctgctgcctgatgggggagaaggcgtgcctcgcggtggctgtgccgccgccagccgggctgctgacgggctgctgcagcgcctgctcttccaccctgcactcctggagatcctgcagaccccgggggcggcgccgctgcccgccgccgccgcccgcatcccgcagcccctggcctccatcgtgcctttggtcgacatcgatgacttcggagaggagactggtggtggggagaacggggacggggcggagcccagcacgggcgctggcgctgacgaccatgcggcagcaggccccagcgacggcgaggcccgcagcacgtcgcacatcggtcccccgacgcccccagcgacgacggcgcagnnnnnnnnnnaggcggagcccagcacgggcgctggcgctgatgaccatgcggctccaggccccagcaacggcgatgcccacagcacatcgcacatcggccccccgacgcccccagcgacgacggcgcagggcatcaagaaggaggtgtgcgagctgctggagacgctgctggacgtggctgggcagtatggtgtcgggcggtacacgccgcccgacagcctgccggccctgctgcccctgctgatgggtgggtatggcgcgaccctctccccagccgaccgcgcgctctggagcctggcgcagtccctgaacgcggtgctggccggcggggtggacggcggaggcagcgaccaggacaataccagggatgccggcgatgaggacgccctggcgctgcagcggctgctggacggacccctcgcgcggcagacggggtgcgcgggtgtgttctgtggtggtgcatgccgcggggatgagtggctgtggtgttctgatggtggagagggagggtgcaggggagggtgcaccgctcaagggtacccaaggcactctgtgccgagctgtgctgcgcaaggttcaagcgccccatggcaccatgcatgcatgccccttggcgtgctcccactcgatgctcagcacgcctgcccttgccaacctatgccccatccccgtactcctccccaggctcgcatggggcgtggcggctgtgggcnnnnnnnnnnggggtgcagagaatgctgcaccgctcaagggtacccaaggcatcctgtgctgagctgtgctgcgcaaggttcaagtgccccatggcaccatgcatgcatgccccttggcatgcttccactcgatgctcagcatgcctgcccttgccaacctacgccccatccccgtactcctcccaaggctcgcatggggcgtggcggctgtgggcgcggtggccgccagcgaggaccaccagctgacgcgccagatcctggagcagcacctgaccatcgatcccctgcgctgcggcctgagcgccgtgcacttcccagagtggcgccgcctgctgggcgactcccgcccggaggaatctgacaccgccgcccccacctgtgacgggtggggcgccgaggtgcccgacgccaggccgacgccagcctccccacccccgctgccagacctgccgcacgcacgctccggccacgaccccgccttcctcctgctgttcgccacgcacgcgctgcgcaacggcgcgctgaccccgcgccgcgcggccgccgtcggcgtgctccccctcgcgctgcgcgcgctggcggcggccgacnnnnnnnnnntgccacgcacgcgctgcgcagcggcgcgctgaccccgcgccgtgcggccgccgtcggcgtgc

SEQ ID NO: 45211 - DNA, 76 bp, Chlorella protothecoides
aaaactaaattgattattttcaagtaaacgggtagctttcggagtttttattactggatattgcaataaatctaac

SEQ ID NO: 45212 - DNA, 8103 bp, Chlorella protothecoides
  modified_base (184)..(193): a, c, t, g, unknown or other
  modified_base (273)..(282): a, c, t, g, unknown or other
  modified_base (899)..(908): a, c, t, g, unknown or other
  modified_base (2240)..(2249): a, c, t, g, unknown or other
  modified_base (2318)..(2327): a, c, t, g, unknown or other
  modified_base (2918)..(2927): a, c, t, g, unknown or other
  modified_base (3482)..(3592): a, c, t, g, unknown or other
  modified_base (3764)..(3773): a, c, t, g, unknown or other
  modified_base (3928)..(3989): a, c, t, g, unknown or other
  modified_base (4044)..(4053): a, c, t, g, unknown or other
  modified_base (5119)..(5128): a, c, t, g, unknown or other
  modified_base (5291)..(5300): a, c, t, g, unknown or other
  modified_base (5460)..(5469): a, c, t, g, unknown or other
  modified_base (6187)..(6196): a, c, t, g, unknown or other
  modified_base (6330)..(6339): a, c, t, g, unknown or other
  modified_base (6402)..(6411): a, c, t, g, unknown or other
  modified_base (7527)..(7536): a, c, t, g, unknown or other
cgggggcaggcacgggcggatggagcgctggtggggtcccccgtgcccatcaacgcgaccgcggtgtcagaggcggcggccaagaccgcagccgaagtggtggcgcgcgccaggacctctgtggagacctccattaaggacagccacgccgaggtgtgtgtgtgtgtgtgtgtggggggggggnnnnnnnnnnaggtggtgctcgaagtgggatttgggttggaaaccccgaccatccttgtagtgctttgcctagggacccggaaactgctnnnnnnnnnntgggatttgggttggaaaccccgaccacccttgcagtgctttgcctagggacccggaaactgctgccctcacttctgctccccaggcaagacatacacgcactcacacactcacacactcacacacacactcccccgcaggatgccaagcgggccatcgagatcgccaagaccatcgcggaggggggcgcggccaccggcgagaagggggagggcgaacatgggcacacaagtgtgatccagcacgccgccgagcaccacggcaacaccactgcgccggtggcgaagcgcgtgccctccccgtccactccagagaagatgcaaggctgaaaagccgctttcaccatgagcgcatgtagcaccccgcaggggcggacagtctgaagaaggcgtcactctgttaccattgacctgtcatcagttctggagtctttactggcattcattggagtgatttggcattgtcggtcccaacatcttgggagatttggcacagaatcagatacgaaagggggggcacagacctttagttccccggttgcattcgaagtgctcggcacagcttggttcgaaaaccttttgtgtccttcgaaacgtggtcctttgcctgtagcaatnnnnnnnnnnaggttcgaaaatctcttgtgtctttcgaaacgtggtcctttgcctgtagcgattcaactcccaacaacacacgcaaatctacaagatggccaaccatttgaagctttccagcttctacgggtccaatatcgcccggccgtacattgtgttcgacccacagggtgcagaagtctcggcacgggtcgaccgaccccgtgtcaacgacgcccttatcggtgagctgccagtatttgggcagcttcatggctatggtatgggaaaggatagtgcatgaggaaggctcggcctcttggagcaaacatcatgcccgctaacccctcccgcccctcctgctcaccagcctgggggagcaaggttccggtcagtgccgggggcctccttgagaaaccccactgggagggagaggagcctccaaccctggtcaagcccttgaatgacttccagctcttcatcaaggtgcactcggtggtggggatgaggattgggcttcagccttgtggcactggcatggatgagtgcctggagggggcagaggagctcgtgcagcaccttgacccccagcattgcaccgctcctcaggagaagaggttgtacatcctggctgtaaattcccatctgatggtggagccagaccagccggccttcatggcaagcgcagccgttttttggaaagagcggctgagtgaggaggaacgccaggcttaccagacccgtgcccgaggtgtgtgagtcttgggtgcaccctgctggctcctgccttggtcaagcatgcccccagcatggcccccgtgctgccgccgctcgacagagatgcgggcgcagtacaagactgacctggcagctctggagcagagtaatcctcgatacaagactttcagagagcacttgaaggtgggtgtggtacagaggtgtgtcctgggggctgctcttgggttgtggggtagggccagcaatatccagatctgtttgtcttgctccacatttgaggagtgccttgactggtctcctacatgcatgcattcagcgttctgttctcacaaccggctcggctttcgctgacaacctctgcatgcccacccccgaactcacaaccgcagcgctacaagcagtctgtgtccggcatcgtcagcgcggcgagggagcaggcaggcccgctgtggaaggtgcaacgccggctgatgggcaaggggaggtactccaagatgggggaaccggcggcgaggtgggcgtcgccggcgcgggtgaacaggcgcgccggcaccgacgggcccccagccaacacgacgcgctccgcctcccctagcaccgactccgactccgactctgactccnnnnnnnnnntcgcattcagcgtcctgtcctgacgaccggctcggcggtcgctgacaacctctgcatgcccacccccgnnnnnnnnnnacgcccccagccagcacgacgcgctccgccccccccagcaccgactccgactccgactctgactccgacggcaggagcgagctcgaggcctcgccccccgccagaaacgcggcacgccctcgctgggccacccgcgctcccaacggcgggcaggcccctgcgcccgggcagggggtgcacctgctgcaccaggacgtcctttcctcccccgccgccgccgcacgggcaaggaaccggggccgcagcgcgcagagcgcggcgcccgcccccaccgggcgggccttggccccggcgcgaccgcgaggagagcaggggagggaaggcaggagcgccacaccccggggctcgtggcgagggctgcacgacgagccctcccagtccgaggaaggggagccctcccaggccgtgcctggtgaggtggtggtgtgtttggctcctgcctgaccagcaggagcaggggccggccgtgcgagggcctccctgctttcctctgccatggggatgggaaggggcaggggcatgcttggtcggtgtgcggttcctggaggtcccccaagacagtgccctggctggtcaccagtccctcgcccnnnnnnnnnncggtggtgtgtttggctcctgcatgaccagcaggagcaggggctggccgtgcgaggacctccctgctttcctctgtcatggggatgggaaggggcaggggcatggttggtcgttgtgcggttcctggaggtcccccgaggcggtgccctggctggtcaccagtccctcgccccaccgagatccccagccaccacgcgcgcagaaactccgggggcgacgcaggatcccacctcccggcccctgccccgacggggagcgagggagtcccagcagcaggcagacccggcggcggccctcaacctgcaggacctcgaccttgcctcgcccgccaagcgctcgcgccgtgtccgtccctgagggagaatggattcagagctccatccttgcctgcagccagcccctgcatcggtcccggatgacgtttgctgggacggtatgcttcaccaagactggcccactgactcaccttgtgcattgagcaatcagcctgtccgagcaccacttttctggccctcacttgaatcataacatgttgacaatcaagtaaagacaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagctgctgccatggtatcctgggaatggatttgcaaggtttgcatgatgtcagaggatcagggttgtgtaccccagcagtcaaccgaaatgaagacgatgggaacatcacagttggcaatcagtcagcccagcaagtcatatacaatacttgtgctcacctcaacatgcnnnnnnnnnnaaaacctgacgaaagctggcaggtactatgggaaagaatgaaagtctacagtcaagtctccagtagtgcagatgtctgagccgatctgccagcttagtcaggcccctccctccgctattgctgctgctgctgctgctgctgctggaatcgcttcnnnnnnnnnnnnnnnnnnnnnnnnnnnnnnnnnnnnnnnnnnnnnnnnnnnnnnnnnnnnnnaagccaggtcaaaatcccaggtcaggccgatgagcggagcaacacacttcttctnnnnnnnnnnaggttgtgtaccccagcagtcaacccaaatgaagacgatggggacatcacagtcggcgaccagtcagcccagcaagtcctatacaatacttgtgctcacctcaacatgcatcaggacctcctttgcgaggtgcaaagactctaccatcccttgttctgcgctgacgactccattggtctgacagcggatcaggatctcagacaggttgggatgctcctttgtgtagctcgacagctgtacatgggggctgcaacggcagagaggatggagtgcgttatggtgaaaagctatgacatccagacggccatgtgacatggtgtgatctcaaaatgtgagccaggtcaagatcccaggtctggccgatgagcggagcaacacacttcttctgggcatagcgagtcccacacgacactggtgactcactgcatccacatgacctctctgaggacattcccaaaagtatggtctgtgtgttgtgcaagagaggaggggctgaggcaacagtgctgcttgcccaaaaaggcatgactgccccaatccgacagttatagcatacatcccagtccttcagcatccgctgaaagttgtagtgaggccaaactcaccttctccttcgagcttgaccagcagattactgccaggctgcagtgcctccgattctgtgccggtgggtgccggaagagcacagtgacgttatggccgcagaggactagtctcagcaacgcatgcaaggattatcctccattgtgcccacctgaatcttccatttctttgacgagaagctttgcaggcgcctcaaaagacctattcgatgtgcacagtgggtgctggggctcgactgcggtcctcgacaagggtctcgggcagttgtgtgttgtggccaaagccttgagctccacaacagatacaatttaggtgatatgcgcatatcgtgctaccgcccatgcattcaccttcacgcatctgcagagctcgaagacgacgcgcgagcgcgcgagcaattccggcagtgcagcaacccctcatcccaaaggtgcatgtccctgtgaaaaagaatgccaaccannnnnnnnnnaatacaatttaggtgatatgcgcagatcgtgttatcgctcatgcgttcaccttcacgcatttgcagagctcgaagacgacgcgcgagcgcgcgagcgcttccggcagtgcagcacccccccatctcacaggcgcatgtccctgtgaaaaagaatgccaaccannnnnnnnnnccaactcgataaaaatcattacaatggcctcagagcaccaggttacagagcctccgcaattgtccagagggtatgcatgtgcaggaagaagctcccacacagcaccccccccccccccccgcctcagcccgcctgccgtgcctcccaggctgccatggcnnnnnnnnnntcaactcgattaaaatcattacaagggcctcagagcaccaggttacagagcctcccgcaattgtccagagggtatgcatgtgcaggaaaatgctcccacacaacactgcccccccctgggcctcagctcgcctgccgtgcctcccaggctgccatggcggagcccatgccctcgcccaccacccccaccaggtccttgagaagctccaggctctgcgccagcccctgctccccgctcacccccgcccccgcccgtgtctggacccgcaggttgacatggttgtaccccgggtgctcctgactgtaccccgccgcctccaccgcagggtgcgcccaggccacgtcccggaaggcattgcccagcgtgtggctctcgccatcgatcaccgccgccacggtccgaggcccggccacaatgggcttacggcgcgcgatgccggagacgccgcggcggtaggggtcagagaccctgccctgggccaccccagccagccagaacctgccgtcggggcggtcagtgcggtccggcagctcgctcgcctggacccgggcgaaggagggctggaaccggccgtgcatggtggcggggccggatgtctgggcgggcaggtactcggcgcggtggccgtagatgctggcagactggcgaggcgcggcgccgcccctcaggcccacgcgctccgccctgtgtgtggtttttggagggggggggggggggnnnnnnnnnngatgggcttacggcgcgcgatgccggtgacgccgcggcggtaggggtcggagaccctgccctgggccacaccagccagccaaaacctgccgtcggggcggtcggtgcggtccggcagctcgctcgcctggaccnnnnnnnnnncttggtcgcgggctcaacagcacccaagagtcggcagcacgctggctctgacaatgcgctgtnnnnnnnnnnatccttggtcgcgggctcaagagcgcccaagagttggcagcacgctggctctgacaatgcgctgtgccctgcacagcctggagggcctcaatctacaagcgctcgagcatgtcagagagggttcccaccagaggggcagctccgcgcgctcgtggaggggcttgtcctcccgagtggcgtcagggggcccgtccagctcggggaagtggtactgcagaggggaaaaggggaaagggggtgggtgcagggctcgcgggtgaagcggcgtgggagcactggtggggtgatgttcgcattgcagagtcagagtggtgcaggcatggcgagcagatcgtcaactcccgctggccacacaacacttgggggatccaggttctccacatgcatgtcaaagcaagtgctgcccctcccagagagccctctccccgggtcccttgcctcgccaacacctcgggtcccctccttcccctgctcccctccaccaactcactccatcagagagccacaggggctgctgcccactcgaccgccccaccgatttgtaccaccagctgtcggtgtcggtgtgccagttggggtgtctggactggaagtccagctggttggctagggtggttccatacttggccatccactgctcctccgtcatttgccgcaggtccgcctgcagagaaacacccaaagagcataagtgatgtaatgcaggcacctccactcactcgcacctcgatgcaggggccaggacgcggccagtcgcggaccttggcaccctttcccagccctccactcaccggggcctctgaaggcagaatcgaatccgaaccagcatcatccaccttcattgctaccgcagggtcaatacctggacctctgctcattctttatcgtgttgcgagctcagcgagtgacgccgcgcctccagccctgaaggtggctctggcagacctacaccttccgtcactccgaaaatcacgccagcaagctcacatgtattatatgtatgtcgcaagaggggtattttggaagatttacagtttacaaatggggcattcagctcatagtatcgcgagaaggtcgtgctcccgcattcagcgcgccagccacccccgctccgcnnnnnnnnnncatatttatgtcgcaagaggggtattttggaaggtttacaatttacaaatggggcattcagctcgtagtatcgcgagaaggtcgtgctcccacattcagcgcgccagccacccccgctccgcgccctggcgttgtgcccggggcgtgtccgcatcgatccaaagttgctcgcctttgaaaggttgcacggctacggttgtccacagcggcatacaaccaaactctttccctaagactgcagcatgaggtccccaactgtgggttagattgtacccaaacaccgcagtagaaggggccaactgtgtgcattgatcctgagccatcgaggcagtcaccggtatctattcaattccacggctatcatcgctcattttcactgttctcctgtgatccagtcccctccactgggcggctagagggcgcgacgttgccacctgccctagaccctgctgaccgcttggcctgcccaccaactcctgccctgctggtgacccttaccgatgtgtcctgacagattccttccatttgacctgtctttgtatctaaaaatgtttgccgcagtggcgt

SEQ ID NO: 45213 - DNA, 86 bp, Chlorella protothecoides
attgttttaaaggaatatatccataaaacatttttagtttcttaacacataaaagaatttccaaatattctcttgaccttgaacct

SEQ ID NO: 45214 - DNA, 81 bp, Chlorella protothecoides
aaaaaaggaaaagattcttctaatgtttcaggtccaattaatgcatgatatattcccccaaatcctaatacggcagaagaa

SEQ ID NO: 45215 - DNA, 97 bp, Chlorella protothecoides
caaggtgtgtacactttcctggttgcactataaatcagggtcgttgcattctgggccaagagggaccactttctggattcggggtcattcggcctga

SEQ ID NO: 45216 - DNA, 80 bp, Chlorella protothecoides
ttttttgtgctaggagggagttgaacccccgactccatggttcgtagccatgtgctctagtccactgagctacaagcacg

SEQ ID NO: 45217 - DNA, 63 bp, Chlorella protothecoides
taaaatgaaatttcattttatattttaagccattatctttataatataattctgtataaaatt

SEQ ID NO: 45218 - DNA, 61 bp, Chlorella protothecoides
ccaagttctgcataaagtgtataaaaatctttcttagtatttttgtttttaacactttttg

SEQ ID NO: 45219 - DNA, 73 bp, Chlorella protothecoides
attgcggtaatatattttttaaaaaatctaaattatattattaaattaattaaataagagattttttaatttt

SEQ ID NO: 45220 - DNA, 73 bp, Chlorella protothecoides
gtaaaaaacttcataataacaataatttacacgaatctaatcttgttaatgggtctattactcttgcaaaaaa

SEQ ID NO: 45221 - DNA, 102 bp, Chlorella protothecoides
cttacataccaactaatgttatatctatcactgatggtcaaattttcttatcagcagatatctttaatgctaatgtaagacctgcgattaatgttggaattt

SEQ ID NO: 45222 - DNA, 84 bp, Chlorella protothecoides
aagtcggcgattttatccgtcttggtatttctattcaagaatctggaaaacaacgtgtacaaccttttgaaggaacagtaattg

SEQ ID NO: 45223 - DNA, 122 bp, Chlorella protothecoides
tatatatatatatgatcgaattatatagatagatttgctaataaaacaaagttgaaaccaattccaactcgttgctatttttatgtataaatttatatatataagagcattgtaaggtttta

SEQ ID NO: 45224 - DNA, 68 bp, Chlorella protothecoides
tctccctgtcaggttctcaaagcctgtgctgcacgtgtgagcttgcagccatgcagcagtcaactcat

SEQ ID NO: 45225 - DNA, 63 bp, Chlorella protothecoides
ttctttatttactaacaacaggctaaaataaacaaaaatttataaaataaacaaagtttatta

SEQ ID NO: 45226 - DNA, 61 bp, Chlorella protothecoides
gtaggggagggagtagtagtcgtagggaaggttcttcaccgacatgatcttgttcaccttg

SEQ ID NO: 45227 - DNA, 95 bp, Chlorella protothecoides
aagaagacttacggaaggctcctaaaatgaatcctttaccagaagattttaaaattttatatccttcgtggggtttaaattcagacaaacctaca

SEQ ID NO: 45228 - DNA, 76 bp, Chlorella protothecoides
tcgtggggtttaaattcagacaaacctacaattcgttgggttgatattgctgcaattcttaatccagatagtgtag

SEQ ID NO: 45229 - DNA, 61 bp, Chlorella protothecoides
gtatttatttatgtgtttttctttttttatagtctagaaacaaatataattatatttgttt

SEQ ID NO: 45230 - DNA, 78 bp, Chlorella protothecoides
ctgcacggtgtggcgggacgaagagttgtcggcagagagagcaataccggtgcagggagtgcagggtcttggtttgac

SEQ ID NO: 45231 - DNA, 61 bp, Chlorella protothecoides
gacgctgctcagcatttgtgggagacctggccgtggagggggaatcaggccattcagggtg

SEQ ID NO: 45232 - DNA, 61 bp, Chlorella protothecoides
gttttaatacaaatataattgaaaccaatgtattaaatttagctgtagtattagctgttgt

SEQ ID NO: 45233 - DNA, 116 bp, Chlorella protothecoides
aatcaaatcctcgcggtactcgagtttttgggccagtagcccgagaattacgtgatggtaattttacaaaaattatatcattagcaccagaagttttataaattttattttttttt

SEQ ID NO: 45234 - DNA, 61 bp, Chlorella protothecoides
gtatactttttaaggtggtgtgataaaaaatgtatacctagaaatgcttttatattatatt

SEQ ID NO: 45235 - DNA, 158 bp, Chlorella protothecoides
agataaatctagagctggagttcctaacttaggtttggatagaaaaaatattaattttttaaatctttttcaaggacctaatatgcttttagctggtatggatttaaatcaattacccgctatttggaaagctctaaattcaataccacatctgtttt

SEQ ID NO: 45236 - DNA, 61 bp, Chlorella protothecoides
gggacctccgccacgctcccctcccgggaactgacagtcaaggagtacatggcccagctca

SEQ ID NO: 45237 - DNA, 72 bp, Chlorella protothecoides
tttcaattaaataatatttttacgtaaaaaaatattacgctaataaatcaaattgatttatataagtatcat

SEQ ID NO: 45238 - DNA, 73 bp, Chlorella protothecoides
caaaatatgtctttatcttttatgccagcattacaaaaagatcattttgagactgatcaaaaattatataata

SEQ ID NO: 45239 - DNA, 63 bp, Chlorella protothecoides
tacaagatcggtacgtgctccgtaacaacggaggtggcgggaagtgtcttttgagtccttggc

SEQ ID NO: 45240 - DNA, 61 bp, Chlorella protothecoides
agcagcgggtgcccggccagacaggtgcgcactccagtcgccactcatacctggcacgggt

SEQ ID NO: 45241 - DNA, 67 bp, Chlorella protothecoides
ggatgtggtagccgtttctcaggctccctctccggaatcgaaccctgatcctccgtcacccgtgaac

SEQ ID NO: 45242 - DNA, 75 bp, Chlorella protothecoides
aatttcgatggtagatttgccgttaggggctacagaagatcgtgtttgtggtacaatcgatattgaaaaagcttt

SEQ ID NO: 45243 - DNA, 73 bp, Chlorella protothecoides
ccatatgtgagatggcagcaggggagttgcggtctggatcagaggatctggtccttcaggcacctcggactct

SEQ ID NO: 45244 - DNA, 85 bp, Chlorella protothecoides
cattacaactccctctgcgcacacccagccatcctcctcatacccgtgtgaggtaggtgcctcaccccagctccatcgctgtgtt

SEQ ID NO: 45245 - DNA, 75 bp, Chlorella protothecoides
aatcagagcgggttttaccacaagaaactccattgatattttatcgtcttgaattaaacaataagatgaaaaaaa

SEQ ID NO: 45246 - DNA, 140 bp, Chlorella protothecoides
cgttactaaataagtaacgtttaagattgcattaaattacaaatgaatttaaaatacctacagcaaatacaagtattaaccaaaccccaagacctgaaaaaacaagacgtttgttttcaccccagccatctggtaaagct

SEQ ID NO: 45247 - DNA, 61 bp, Chlorella protothecoides
agcacgctcaaagactgtgaaaggatggtcaccgcttctacacacgctgtcacacacccac

SEQ ID NO: 45248 - DNA, 32377 bp, Chlorella protothecoides
  modified_base (1643)..(1652): a, c, t, g, unknown or other
  modified_base (1885)..(1894): a, c, t, g, unknown or other
  modified_base (2615)..(2624): a, c, t, g, unknown or other
  modified_base (3049)..(3058): a, c, t, g, unknown or other
  modified_base (3137)..(3146): a, c, t, g, unknown or other
  modified_base (3862)..(3871): a, c, t, g, unknown or other
  modified_base (4441)..(4450): a, c, t, g, unknown or other
  modified_base (5094)..(5158): a, c, t, g, unknown or other
  modified_base (5314)..(5323): a, c, t, g, unknown or other
  modified_base (5404)..(5413): a, c, t, g, unknown or other
  modified_base (8319)..(8328): a, c, t, g, unknown or other
  modified_base (8563)..(8572): a, c, t, g, unknown or other
  modified_base (8749)..(8758): a, c, t, g, unknown or other
  modified_base (8865)..(8874): a, c, t, g, unknown or other
  modified_base (9350)..(9359): a, c, t, g, unknown or other
  modified_base (10492)..(10501): a, c, t, g, unknown or other
  modified_base (11014)..(11023): a, c, t, g, unknown or other
  modified_base (11479)..(11488): a, c, t, g, unknown or other
  modified_base (11961)..(11970): a, c, t, g, unknown or other
  modified_base (12090)..(12099): a, c, t, g, unknown or other
  modified_base (12420)..(12429): a, c, t, g, unknown or other
  modified_base (12927)..(12936): a, c, t, g, unknown or other
  modified_base (13664)..(13673): a, c, t, g, unknown or other
  modified_base (14453)..(14462): a, c, t, g, unknown or other
  modified_base (15127)..(15136): a, c, t, g, unknown or other
  modified_base (15958)..(15967): a, c, t, g, unknown or other
  modified_base (16048)..(16170): a, c, t, g, unknown or other
  modified_base (17119)..(17128): a, c, t, g, unknown or other
  modified_base (17581)..(17590): a, c, t, g, unknown or other
  modified_base (17819)..(17889): a, c, t, g, unknown or other
  modified_base (19550)..(19559): a, c, t, g, unknown or other
  modified_base (20044)..(20053): a, c, t, g, unknown or other
  modified_base (20964)..(20973): a, c, t, g, unknown or other
  modified_base (22514)..(22523): a, c, t, g, unknown or other
  modified_base (23650)..(23659): a, c, t, g, unknown or other
  modified_base (23881)..(23890): a, c, t, g, unknown or other
  modified_base (24282)..(24329): a, c, t, g, unknown or other
  modified_base (25044)..(25053): a, c, t, g, unknown or other
  modified_base (26325)..(26439): a, c, t, g, unknown or other
  modified_base (27938)..(27947): a, c, t, g, unknown or other
  modified_base (28145)..(28154): a, c, t, g, unknown or other
  modified_base (28406)..(28415): a, c, t, g, unknown or other
  modified_base (28761)..(28770): a, c, t, g, unknown or other
  modified_base (28829)..(28838): a, c, t, g, unknown or other
  modified_base (28939)..(28948): a, c, t, g, unknown or other
  modified_base (29137)..(29146): a, c, t, g, unknown or other
  modified_base (29216)..(29225): a, c, t, g, unknown or other
  modified_base (30158)..(30167): a, c, t, g, unknown or other
  modified_base (30613)..(30622): a, c, t, g, unknown or other
  modified_base (30981)..(30990): a, c, t, g, unknown or other
  modified_base (31378)..(31387): a, c, t, g, unknown or other
  modified_base (31577)..(31586): a, c, t, g, unknown or other
  modified_base (32301)..(32310): a, c, t, g, unknown or other
cggggaggaggtcggggggcgtgcggccgcgcgcgtcgcgcgcgcccaggcgcgcgcccgcgcccagcaggcacgccgcgcaggccaggtcggcgcggtacagggcgtggtgcaagggggtccagccggactccagatcggccacctccacgtcagcgcccgcagagagcagcgcctgcaccgcctccacctcgccgcgccagacctggagtgagaagagggtgggaaaggattgacacgagagttgacggcaggatggccacccttgggatgggatggggtgggtgggccttggcacaaccttggaagtgccatcccagtgctgcgccatgccctacacgcaaccacccatcgtgtgcagcacagctatcatggtgatgcaaggtggcaactcccaacgcatcaacttctctgtcgagagggtaacccactggcattcagggcaaggtcagatacacctgcaacaatcctcatctccgggtaacaacacctcgtaccgcgtggtgaagcgccgttccccctccagtggtgatcctgaggcacagggggttggcagattagaagaccatcagggcccctgcctcgcaggctggatagaatgtgcccacccaccccggcctggctgtcgtcggaatgttccgggcgcacctgtcgatctcgtcccggcatcgctgggagtccagcacccgctccaatatgggtagggagcccgacctcacggccgcgagcaagccctcagccatgggcgcgggacatgcggggccttgcaagtcccagccgggagcgttggaggacccgactcgggggagtttcacgagatcgggagtgacccacgacgggcactaacaatgctgacacgccatgttttcgtcgtcccggtttgccgctgggtgtgggtatgaagggcggtttgaaaggatgggcctgccccccagctctggcgcattttttggttggagggagcttcgtcttaggagaacgcggtgacttaacattggaacgactttcctaggaatataccggcgatatttttcaaaattaatcatcgttaggaaataccacaaatcaaaccgatatcagcggagctgtgcacacggctgcgtgagaagtcgtacacaggatggccccagaaccgcgggtgcggggtgctgatatcacggccgcgggatgaggcacttgcatggtcactgatcagagctcattccagatttccctctcactccccctttgtcaggccgttcgcgagctgggcctgctctcctcccccgcttcccgtccctcggttgaccaggccaactccgagctgaaagccctgcagtttcgggcggtgacggactacaaccgactacgagacggggtggctcgcctgggcagcgatgccgacacggtgcgcgcgcggcagcagctcagcagcttttcacagagcttcagagacttggccgtggagttcaagcagaaggtggcctcccacccggctcgggacgctgcctccacccagaagctcatccgggattttcaggtgcgcaggggtccgggacgacaaggggaggggaggggactggtggagcgtggaggactcagcatatgtgcatgcctctgagtggggtcctgctcggaggatgcatgtcaacgagcattcattnnnnnnnnnnccaggtgcgcaggggtccgggaacgacaaggggaggggggggactggtggagcatggaggactcagcatctgtgcatgcctcggagtggggtcctgttcggaggatgcatgtcaacgagcattcattcaacatggggttgtgcatgtgacctgtttggcggcatcaccatccctcgaaatgagggaatgcgaagcaggaagggtgcatgcaccaattccatcgcgcatggagnnnnnnnnnnctgtgacctgtttggtggcatcaccattcctcgaaatgagggaatgcgaagcaggaagtgtgcatgcaccaattccatcgcgcatggaggccttcctgggactggcacatttcagactgcccgatacgatgaggctcataccgcccctcctctcatcccatcccccctcgccttccattgcccagaccctgctgaagggctcagagaagctgatgagcatcgcgcgggagcgggaggcggcgagcctgccggtggcggccgccccaccccgtggcgcgcagcgcgaccgtgccgcggcgggcgcctcccccgccgcggcgaccgcggcgcaggagcagaagcaggcgctgctggcgaccgagaacgcgctggtgttcaacgaggccctgatcgaggagcgcgacgcggcggtgcgcgccatcggcggccagatcggggaggtgcaccagatcttccaggacctggcggtgctggtgtcggaccagggcgcggcgctggacgacatcgaggccaacatctcgcgcgccgcggcgcacacgggggaggccaacgtgcagctggtgcaggcggagcgcagccagcgcgcggcgcggggctcctggtgtgtgttgctggccgccgccgccgccatcctgctggtcctcatcctgatcatcgccgcgtgacgccggggaggtgggtgccaggggcgttacctagccatctccttttgggggggagnnnnnnnnnngtcctgctggtcctcatcctgatcattgccgcgtgacggcggggtgggtgggtgccaggggtgttacctagccatctccttttgggggggaggggtgcagacttgtaccgaatgtaggactgggcagcgtgtgcaggcacggggttgggaccaggcaagggggagggtttgggggtgtcaggttccgagctggtgggaatcaaagaagggcgagtgagagcacgcccgccgatgcaaaaaaacagtcaagctgagcgctcgccgccctctggaggccctgccaacagggctggggcggcctcggccacgcctccctttctttggcgccggcgccgccgccggcgcggcgcggcttcacccgctccactctcgccggccccgccctcgccggccccgtcctcgtcggggtcaggccccgacacggnnnnnnnnnnatgggtccctgcgggggtatgatttggtagagggctgacatgatagaaatgggagcaggggctttggagaggtgcagannnnnnnnnnccaggtccaggaggccctcggggggctcgatgcgcatgaccccggcagccaggtcgacgacggggaccagctcccgtgcaaagggcagcatgtaggtggggcggcccggcacctcgatctgcagcacatcgtgggtccctgcgggggtatggttttgtagagggctgacacgatagacatgggagcaggggctttggagaggtgcagatgaaagcctgagtagctccgatcctgggcacaggcacactatcaactacccccactcaaacaggtgcctcccaccaacatgaaacaccagacgcacctgtgccgtcaaagatgtcggtcacggtacccgccggcgacccgtcggcgtgcatgagcactcgcaggcccaccagatcctgtacgtagaactcgtcctcgtcctccaacggcggccgctccgaggaggggaccaagaggcggtggccacgcagctcatcgacagcctccggcgagtcatacccctgcagcttcaccagccagcatggattgccctagaagggggaaggggggagatattgcagggaggggttcggtaaggcgatgacgcgcggttcctggggattggaataggcgagaggaaagcatttcacttgtgatggagtgacaaggaacaacaatcccctgctggcaggacagcaggttaaaaaagaaaccagtcctctgggatcccccgcgcatcaccttgtacnnnnnnnnnnagtcacttgtgatagggtgacaaggaacgacaatcctctgctggcaggacaacaggttgaaaaagaaactaaatctctgggatcccccgcgcatcaccttgtacaggacctcccttcctctctccagggtgacctcctgtggagcgcccaccgcacgccgcatcttggtctcgggaggtgccagccacctaaagaggagaggctggcaatctcagacatctgctgtcacagacttatcttgacagcccgaagcacagagtctaatgatacaagctgttgaaaaccgtgcgccccaaagcccgtcacctgatgccaggtgtgcccagcctgtcgtctgggaagtcggtgctgggggaaacgcgcatgtcgccatgcacgccatgcggtatggtcagcttgccaatttcgacccagtcgccatcggtagtgtttgagtttgctacgttggcttgcgtggggtggagcgctacactcctcccggatggtctttggcgagcagagaccgctgcacggaatggctggggaaggggacgacagctagccgctgatagtaagcttgacatcataaannnnnnnnnnggcgagcagagaccgcagcacggaatggctggggaagcggacgacagcaagccgctgatagtaagcttgacatcataaaatcgacatgtatatcatcagggtcattttaattaccgttgagtagtcctccgtctgctaggtagtcggaactgcatggcccacccctcaccctaacccgtcccggtcgtgctttgcgtgacggcgcctgcgtggagacgcgaccggcacagtgcatttgcccatcgaaatagtatctgaaggtccaggatcgaagtacacatactgcatgctttgagttttggccagagttaatacacatttctacttggaagggatgtgcaccacgcaatgaccagcgaagtggcagcagggccccgtcgggcgcccctccgagtcatcgttcgggaagggtcgagcattgtgagacacttggactgcaaagttgaccctggtaagaccaacaagccgcaaaatctcaccgtgtctgtggcgggcattccggcagacctcactgagggcgggctgctggagctctttggcaggtttggggaggtgcagaggatagcgctgcacggcacccgcacctctgctgccgtgctgtatacaagcgttgatggacctcgaaagatatggaagcagagggnnnnnnnnnnnnnnnnnnnnnnnnnnnnnnnnnnnnnnnnnnnnnnnnnnnnnnnnnnnnnnnnngccttcaatggcatggacacagtgcatgcatttgtaatgctctagcacagagcccggagcctgataaccctctttgacttccaccatcttatggtgctgtcccactcccggaagccacttccctctgcctgcaggctgggtggaggagcacaaggnnnnnnnnnncaaacgaggagcccatcatgctgcaccaggctttgccagagacacccttcggcctgaaaggtacctttgctggcaggcagnnnnnnnnnnttgataaccatctttgacttccaccatcttgtgttgctgtcccactcccggaagccacttccctttgcctgcaggctgggtggaggagcacaaggctggccggccagggaatgccaagcttcaggcgcagttggatgcctggacggaagcgtttgaggcggccgaggaggctaaggcagcggccgcaagagcggctgcacaggcagacgacggctggaccctggtgcagcggcacaaggtacgattaacaggtcatcaaacctcactatgttggctgaaaggcgactggggatgggtgtggagtgttctgccatgtgcttgcactccgttagtactgctcactctaacgttcgcacgcttatctcccatcagggccggaagaagggcgtggacgaggctggcgtcgtgggaggcggagtggcagcccgtgcggcctcttctgccgcgcgccgcgccaatgctgaggtacacgccaacttctaccgctcccagctgcgcgcctcaaggcagtcgggtaagtgtgtggattggtatccagattgtggtttggaacacactgcttaccgggtggcagagtgttgagatcagtaatgatagagtaaaaggagatggcgtgatggaagggaatgggctgggcctcgggagctgaaggtcgtggcatgaagactgataacacaatggccggcctcaaccaccacctgcccaaccattccgcacttacagagatcttgacgctcagagacaagtttgaggaggacaagaagcgaatggcggccctgagagcaacgcgcaggttccaaccctactgatatcgaaaacctgtgctggtgctcaggcgagactggcctgcacatgctcggtatgcctgcagctgtccagtgtctttgatggagtactctacgtgtctgcagcattccataatccttggggctccctttcctgtaacataagactctgacaggacaaatccgagatttgcaatgtagctcttgaacatgccgccgctggccacaacctgcgctttcctggggacggcgctgcgaattcaaagtcggatactcccctgcagctgggagtcggaggcaggcgccatccagcacattatatcctcttatagacgttgctacaaccaaactcccggcatttgactttggcacccgatagatactgtgcgagcgattctgaaagagctgagacgaacccttcccccgactcccaactccatgaccgctctcatcgacgtcacttccggaggatgcccgagaacatgccactcaatgccatgcacaatcggttacaccggccctgctcccgtgagcgactacttcaggccgaggaggacgggtgagtggagggagggaatcatgctgttgggctaaatgtggactcagtgcaccatcatgcgcgtcgaaattgagggacctattccctctgccatcggcattcgaacccagcagacactgagctgaaagcctgctttcgagggagggagctcacaggtgaggcggtggtagggttgtgctgcaccctgccagcgggcgcccgcctgtcatagccccagcggcgaacccactaagagtacctgaccatgctcctgccctttcaattaccacaggctgggagactgaactgcctgcagggtacaccggcagcatattggtacctgcagacagccattcccatccccaggggtgcagctgggttttgcaacatgagttcaagtcgctgactcgatggacgcatggcagcttcgtgggggtggagaatggtaccacgcgcatgctagagtgggccaagctggcctcattcgtgcatgcgcccgtcatgccagtctgggcagaggatgcggttgtcaagccagaggggtctcccacccagtgagatcatccagacttgatatcctgtgcctagcttgtccaatgacccttgaaaatttgacctccaaattgttagggcgttgaccatgggtgacatgtggcaagttcaagtattgcgcgcaaaagtctcagggcctgatccgtaatgcatgggacgtctgcatacgcccgactccagcgtgcttcaaggccgaacatctaggtcacacatgcagacattcgacatgatctacgtcgcgtcgtctgctgcatcacttcttagagggggtcaggggagcgtcacccccggacccgcaacctccgcacatgctccccagctcacatccctgaggcgctacgcccggttttgcgatttcacgccctttctgccacatggccggtgtcaacagcggggtgggcgggcaccccgcgcggagtccgtgagcctggtgtcggaccgggaccctctgtacctggacgacgccatcgttccccaggccgaccaggaggagctactgtccaagtaccagttctttcccatggtgagagctggtgatggccgggctggtgggggctctagttgtctaccgggtctagtcatccatgcatggcacccctggcagggaggaggtatcatggaccacatgcctctttgccctggcactcccaccacaagttgcctcactcataaccacaaatcctggtccctgcaggattcttatgtcttccaggtcccaaaggacgaggagggccgactggacctggcaggcacggtcatgctgcaccgcggcacgggtgagaagggctcccccgaggtgctgggccgcctgcccgaggcccccacccgcttccgggacctgccctgggactcggagttcctgggcaacaagctggagaagcaggcgccgcaaacctgggtctgggccacctacctcgtcggctttgccgcgagggatgcccccgggctggatctggggtgcgtgtaccgcctggacggcatgcgcggccgcatcgagcagtgccgggtgcagcgctttgccgctccggacnnnnnnnnnngcaggtattgtgcgtggggggtttgtccagcctgtcggcttttgggtgcccatgcgctaaagtcttgatgatgagggatgggctgggggggattcctgaaaggggtcgcgccctctgaccggggtgcctgcccgcacacggggcgcgctcccactcccagccatgccgctcgccctcctcggcgcccacacactgcccgccccactgcacccctccgcagggacggggcggtgannnnnnnnnngaggtcttgatgatgagggaggggctggcggggattcctgaaaggggtcgcgctctctgaccgggatgcctgcctgcacgcggggcgcgctcccacccccagccatgccgctcgccctccacggcgcccacacactgcccacccctctgcacccctccgcagggacggggcggtgannnnnnnnnnagcctggcggccgccatggtgagcggggctgatggggggcgcaacatcacctcggggtctgtggcctgcccggggagcaggtcgctctctggggttggcgaatgggnnnnnnnnnntcctggacaccaaggtcagcgcgcccacgcccgtggagatcgtggaggctcacctggcggggctggtcatgcccagccgtctggaggtgatgcacggcggggtgcccgtgtccgagacctggttcgaccccggcctggcggccgccatggtgagcggggctgctggggggcgcaacatcacctcgggttctgtggcctgcccggggggcaggtcgctctctggggttggcgaatgggaatccggcctgcaagaggtcggcaaaccccctcccccgaccatccctgccatgcttcccagactctacaccctcacccccccactgcacaggctgagatggaggacaccgacccgtctctgaaggatcacatcgtccctggggagaaccccgagtacgacgacgacagcatgcgtgacttcatgacggagtttgatgacgagatggatgacgacgtggacgactttgattccccggccnnnnnnnnnntgacgacagcatgcgagacttcatgacggagtttgacgacgagatggacgacgacgtggacgactttgattccccggccatcgacatgtgatgcgcgctggcagcggcggtctagggtgtcacacggcggcagtgtacaggagatgctgatgggtgcacaacagaacgagccgaggcgagcatgctcgcccatgtccccccgcctggagtgtgctccagccagacgagcaggcccggtctcgaaggctgctagctcttcacttgtcgtcggggaacccgacctccggcttccgggtgtcatggtcgtcggacgacaccttggccttggcgacctcggtcatgtcacggactctctcgttggcgggctccatcccactcttgtgcttgttttccccggtgttgacgtcgctcacagtgccctcggtgtgatgcttgtcctgcagaggaaagggtcgtgctgtacacttgagatgtgcggcgaacaccccaagaggttgcaagtgtcgagaggagattgaacacgtcgtcccagcagcaattctctcctgcccaaaccctccgcaccagggcggcctcgaagcgctctgcgacggccttgtcgacctgtacagtcacagctccccggcctcccggaccctcctgtggtttacagcattggggtgcttcataaaaatcgcttcaaaccatagaataacgaccctgcctggcgcctcggtcacccacccgcccggcactcacaggatcagaagacatcatgcgatgagtgacgttgatatgacgtttatgagtttgaggcgtgttgtgggcagcaaagactttgaaactggagagtttgcgctccgggtatacgttgccatgtaaaacgtcacggtggaagtcgccgtgtagctgccttgcggatcccccctacaatggtaacccacgtcttttgccgacctctccagtgtatctctgaggtgtttctgtctggtatctatttacagattggcacatgaaactctggtctgtaacacatagtgtactttctctggtattgcacgcttgcgtaaccagatacatcaagaaataggggtgaagcatcagtgtgcagcaaaattctagatgcctttgggtcaccatcagtcacgaatgtnnnnnnnnnncctctgaggtgattctgtctggtatgtatttacagattgtaacatgaaactctggtctgtaacacataatgtactttctctggtattgcacgcttgcgtgaccagatacatcaagaaataggggtgcagtatcagcgtgcagtaaaattctaggtgcctttgggtcaccatcagtcacgaatgtgctgggttttggacatgatggtcgctggcggaattctacctcgggtgccagaagtacgggggcaagcaggcagtcatctccggtgttataagagtgcaaaagtgactgttacagtggccctcacctccgtgacacctgtctcgatctgagagaccgcactcgcctgatacccttgcgcacctgcgcattgtaatggaggcgtcgctgctctgcccgacacagtcatcggcttgcactgccatttgttccagtgtgcgccaccttaccctacactcgaaagccgctgcacccattcccgctcaccacagctggtcacattccccgcgtcnnnnnnnnnntggcttgcactgtcatttgttccagtgtgcgccaccctaccccacactcgaaagccgctgcacccattccctctcaccacagctggtcacattccccgcgtctggaaacccgttgttgctgtcgacaatggacactggcgcgccaagtttgaccccagcagccgacgccaggagttgtgccgtcgccagcgcgtcagcgaccgccgcccgccgtgcctgggccatggcctccttcttggcatcggaggagatggacaaggtgaccccattgatccggagggcgtcgcctgcctttcccaccgctgtgtcaatcacgctcgacatgaggccggatagaagaccagccactgagatctagatggcatggcgagggaattggatgcctgagtccaacacacctgccagagaatgtgacagatgcacgttgctcccatgctgcccccgcgtcttgaaagnnnnnnnnnnggatggcatggcgaggggagtggatgcctgagtccaacacagctgccagagaatgtgacagatgcacgctgctcccatgctgcccccgcgtcttgaaaggcaaatccagcactggctctccataaatagtaccttgaccgtctcggagaaggtgtaacccacgacggtttccttgccgtccgctgtgcggttctgcgttggtagtctccccggagggtggacgcgttggcaacaatgcgagcagctcagggccccaatcctgacacccatctaggcaaaacaatgttcccatgcctcacgatttcgggtgcgaaggtgatggtgagcgtcttaatgtcacgcgtcgtatcgatgccaggcaggttggtcacggcgtccacggtgctcctgatgagccctgccgcgccgtcccgggcgatggccgccgtggtgccggtattagaaattgtcatggataatgttgagaggctggnnnnnnnnnnatgctcaccgagccctgcccgttcactgtcaaggtcgaggctccggacggggcagccaggcccatcaggaggagacccaacaacagtgccattcgacacaaggccatcgcgtgaagggtnnnnnnnnnntcatcaggaggaggccgaccaacagtgtcattcgacacaaggccatcgcgtgaagggtcttcatataattattcgttcgtagtattgtgcagggtgtgtgccacccccacggctcgaagcctggcgtcatgtcgatgggtctttctgtacgcccccctcgcttccaatgtcgagaatcaccatttcccacaccgcaccgcaagtccacacacctgttttcagttcctctcgcatgtgcgggctgtttactgttcaatctttgttgccaagactcgactgaaaagggcgttcatatggacattccacacattcaaatgcttnnnnnnnnnntaaggctggcgtcatgtcgataggtctttctgtacgtccccttcgcttccaatgtcaagaatcaccatttcccccaccgcactgcaagtccacacacctgttttcagttcctctcgcatgtgcgggctgtttactgtacaatctctgttgccaagacttgactgaaaagggtttccatatggacattccacacattcaaatgcttggatctattttcactcgggacacacccttgtgatgtgtctgtcgatcagagctccacatgctccgccccggcgtcgccggccagctgcgccagcgcgagcgccagcacgtgcacgcccctctcaatgtcctcgggtgacgcgtactcgtccgggcggtgggagtagccgtgccggcaggggatgaagaccatggccgtgggtgcgatctgcaggtgtggcaggtggagcggtaggatgttgtttggggaagcagagggggggtgggtgaagcctgaggctttccagcggcaannnnnnnnnncgtggcaggtggagaggtagggtgttgtttggggaagcagagggggtttgggtgaagcctgaggctttccagcggcaatattcacgcataccaggtatgacatcgtgatgccaaaccccagatgagtgtgcattggcagctgcggcgaccgcgtctttcgcccctgtgacaaccgcacagcgctctgcccgtccctggagccccctcactctttgccgaaagacacagccgccccttgccgcccacccccctccccacctgtgccatgaagagcgagtcatggtaggcgcgcgacaccatgcgtctgctggtcaggcccaggtgctccaccgccgcggccagggccgccagcggcgcctcgccgctggcggccggtgggtcctggctgaccacgcgggtctcgaggcgcacgcgccgcgcctcggcgatgcgcgcagcctccgccagcacctcggccaccaccccgtcgcgccggtcggcgtcgacgtcgcgtacgtccacctccagcgccgcctcacgcggcacggagttgaccgcgttgggcgagacctcccaccgccccaccgtccccaccgtgtcctccgaccctgtgaatgtgcggagagaaagggtgtggggtgcggtggatgaagtgctcgtgtacagatggagtccagggtgttgtagctcgcagggtgcaccccccttcccctctctcaggtcccccctcacccgtggccagcactatnnnnnnnnnntgtgtcctccgaccctgtaaatgtgcggagaaagggtgtgggctggggtggatgaagtgctcgcgtacagatggagtccagggtgttgttgcttgcagggtgcaccccccctcccctctcttaggtcccccctcacccgtggccagcactatcctctccaccgccagcgcgaactcggcggccgccaggctggcgtcgttgcgcaggtgcataaggtgcgcccccgcgtggcccccgtcgccggagaagcgcacggccagggcggcgggcgcggcgatggcggtgaccaggcccacctgcagcccctccgcctccagcgcagggccctgctcgatgtgcagctccaggaaggcgcccaggtcggcgcgcgtgcgccgcgcgccggccagcatggcgtccaggctggccgcgccgtaccccgcgccgcgggcggcttccaggtagctgctgccgttgacgtcgcgcagggtggccaggtagtcgccttccagcgcgccggccatggcgcggctgccgctgcagctcaggccgaagcgggtgggctcctcggaggtgaacatgaccacctccagcggggcgcgggggcggaagccgacgtctcgcagcgcgcccagcgcggcgatgccgccgatgacgcctgtgtgggagggaaggaggggaggcgaggaggactgggttggggccggcttcgagtagctgggccagagggcggatgcatgtggggcttgcgaggtggagcattgattcctagggttgcgcaggatgcacacagtacctcannnnnnnnnnaaaggaggggaggcgagcagggatggattgggccggcttcgagtagctgggccagagggtggatgcatgtgggggttgcgaggtggagcatcgattcccagggttgcgcaggatgcacacagtacctcatgaatatgttatgcgggggctgtttgacacaagacctgtgcagggcgggggagtgtgcactccgccgtgccacagcgtgtgcccgggctgagcttggaagagggtgttgccagcttcagacccatcccacctccctgatcagccccccatcccctcggcggctcgccggctcccaagaaccctacagcgcgtcgcagcgcaccaagagttccgtcgaaagcccccgccagggggatggcgtcgcagtggctgccggtgcccacggcgggggcagtggggtcagaaccctccaacacgccatacacgttgccgatggtgtcctcgcggacgatcagccctgcctcggtcatgagctgcttcacataggcccgtgcattcaggtcctggtctgcagtttcacaaagtggtacctgaacgagaagctgcttggcctctggaatgtcgccagagacggtcggcagggcttacggagcgaatgccgatcaaagatccaaatcgaaaagcttgtgcctccacactccacctgtgaataggannnnnnnnnnttgcagggcttacggagcgaatgccgatcaaacatccaaatcgaaaagcctgtgcctccacactccacctgtgaataggatgcgagtcacggcgggatttaggtcgtcgctgaaggttgccaggtggagaagctggtcgaacacaagttgcccactgatgtcgagctttggcagtgtcatgccattcatagactgaagagtcatgagcacaatgcatacacttgccgctacaggcatgcgacttgacatggttgccgctacgagtcgaaaggaaatactgctagggcttgcacctgccaggtattgctggtcgacccagaattgctgtgggaagagttctgcctgggtttcgagcccattcaaccttgttgacaaaacggttaatgcatcttgcgttccagcgattgattcttgtcctagggcaagccggtgcaggcgaaacgtgcgggggtgggggtgatcattctccgtcatgcatgctgcgcctgctgcatctatttcaatgtggttgtgccaggccgagaaatgctcccgatcgcaaggtcgcaaatgccgacgaaactgaggctgttggtcagcgaaacatccgtgggatatatgcatcatttttgtcctgcaagcgacgggaagcctgtatacttcctgcccatgaagaccctcgtccgaccctgacccgattggcaacgacagtactccataccggcaacgaaacccacacttcggtctcccaggtccagaacttcacgcaaataggttccttttcgagttagactccctggaatagagcaccctggcgtctccctgtcctgagctggggccaannnnnnnnnnagggatatatgcatcaactttgtcctgcaagcgacgggaagccggtatatttcctgcccatgaagaccctcgtccgacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaggttccttttcaagttaaaccccctggaatagagcaccgtggcgtctccctgtcctgagctggggccaacctcttggcaacctgccattgatggcatgacctgcagcagcatggaggaagcacagatcccagggctggacgccagcttcggcgcctttcagacccgtgtacaggcagtgctggaccatgacaaggtacacattctggttgccaggaagggaacttcgaatggcacccagtccaaggattgcaggagatcgatgtcttactcgagtttccatgccttccccatcgcgcgcacacagatcagcgctggcagccggcgtgcaatcgggtcggccctggaggacctgcgcgccgacctgcacgagctcgccgctaagcgtaccccagaggcggcccagcgcgcggctctgctccatggcctggctggcatctgtcgccggtatgctgacatcctccctccaagcacccgccccgactttccccaggcatgcaacgaggctgatctagtccttgagagtcttccagacgaccatcttatcgatcatggtctggttgagtccccagccgggggtgcaccccctatgaccttggaggaccaggtacgggagcttgcaagggaggtgctccaactggagatggaaagggacgcggtactggacctgctgagcgcacaggtgcgtgaccccgggcaggggtgtcggaggggtggatgagggaggcctggggaccactctgtgtcgcagcggtggcgtgcgatccgctccccactcagcacatgcgagtgcctctcctgcgggatgtggagatcaacacgctcacatggccagcatgcaacctgccctattcgaccttctggctcccaacaaccactctcgcacaggctggcgtgcccagtccttgcgactctcggtcacacagccctcgcatcgctgcccaccgnnnnnnnnnncatcttctggctcccaacaaccaccctcgcacaggctggcgtgccaagtccttgcgaatctcagtcacacagccctcgcatcgctgcccaccgtccggaagcggagggcggcgaggaatgccgcgtcggcagccagacagaggtcgcagaggacggggcagcggagggcgacgctcctcccatactggtgagacacactcgaagtcccctgcctgattgcttgtgatctgcaatacactgcttgtgatctccaatacattggacatgggggaagtttttcacttgtagcagagtaaacgcatgccgaatgccacgcccctgcctccctctggctcatttggatccacacaccacctccacaccccacccaggacacgccacgccgagacagccctctgccaggcgcaccattcctggaggagtccctgctggaagcgcagggaaagatcgccnnnnnnnnnnacaccttcacaccccacccaggacacgccacgccgaaacagccctctgccaggcgcaccatccctggaggattccctgctggaagcgcagggaaagatcgccgcgttacagggcgaggtgctcaggctgcagggcctcctggaggcggcagccaccccccgcggccgtgccgccaggttgcacctcggcgacccagctggcgccacgtcgccgccacgagcccttaccnnnnnnnnnnnnnnnnnnnnnnnnnnnnnnnnnnnnnnnnnnnnnnnnnnnnnnnnnnnnnnnnnnnnnnnccctggacactgctgacatgggtggtgcaggggacagctggcgccttgctccgagccggggtggcgctggacaccctgctcctcctcgccgcctccctcctccaggccgccggcctgcgccatgtggcgatgctggtgtcagtgggcctggggggcgtgctccagctggcctggatcctggccggcatcgccgcctggccatcccacgtcgacacccctgcagcctggcactgaggcaggcaccgattcctacctttcctcttcccaaatgatccagacgggaacagcgcctgttcccccattgacccccccccctcctccatcctgacgtgctatcttttgccggcccaatgctggccgtggtgcttgccgacgaggtgaggccaggcaaccccctcctgcaagcacatgtactgttacagccgatgaatggtacaggtgatacctattgaagtgcgacgagcagttctgggttcatgatgaagccattgcaatgcacagatgggttatacacagcgctgaggggtgtggtctgggccctctccgaggtagctgtacagtgaccctcagcgtccctcgccgtggcgcggcatggccgcgctctgatacaggttgtccaccaccaagagagggtcggcctcgttgaagtccacacccgtccccagcccaggggttcggtcctggaccttgtccgcgctgggagcgggtcgtatccatttctgcatcaggggattgtatggagaaattagtgagggcagaaatggatgacgggctggctggaattgggggggttgacatgtctcagcatgatggtcgccgccggggatcaattttgatgacaactccttgcttgccctttgcatggccagctaccctgcctactcaacccccacccatcctctgtcacaggacccctacctgggtcacgaggatgaggagtggggacgtgagggtgagcagggccaccgtggtccacatgatggggccccggcactccccgccaccgagcgaggggctcggagctgtggcttgagcatgtgcgagcaggctccgtccggccgacacgtcgctgcactgcccattgtcagggcagaagcggtccagcaggtagccggagagcatgcctggacgggagttgtgggcgggtgggggtagcggcatgaggctgggcccaggggcactcctgtgtgatgcctcagcggggaagtctgtcgccatggggtgtgctcgatcctgaggacagcaaacgatcaaccatcgtcgccagagccactccaatccccaccctcccgtaccggtggggagcatggcggcgaagaggggcgccgacgccagcgcggtgaacatgccctcctttccatccggcgccacgcccatggagtagtcgtaccagcgcgggctccacaccgcctcgccgagggacagggtcagcacaaacatggccgcagcccactcggcgggccagatgaccagccagaagggtgacagcgcagacaggtagctgccaaagtggatcatgtcaaagtgctggaagcctgtgggtgggggaggggagggtgggtggggaagaaaggtatgggagaagcgggtgtcagacattccaagcagcgcagggtggggcgggcaacagggctcggcaggggaggggctgggggtgggcnnnnnnnnnnaagagggcgttagacatcccaagcagcgcagggtggggcgggcaagagggctcggcagggcagggtctggggacgctcatggagccaatgtgcacaaaatacaatactcttatgcccagacctgcttccagtaggcaccacaacctgtcaaacccgggcacatctgctgcttcagtgcactttaacagaacccctgcagcccctattttatgctccccgggcccaaggtacctgtggtcatggccccaatgataggaaccaggaaaacaatggtgaagggattgatggagtatatcatgccaatgggagcgtcacacccaaaggccctgtgtgaatggggggggggacacggagaatcacgtcactgcaagcggcaagagggcacctttctgagataaaaagcaaggccggggtcaacgatccaagccagagcacttacggcaagtccccattccatgcctcaccgcagctgatacttgggtagnnnnnnnnnnaggggagaatcacgtcactgcaagtcgcaagagggcacctttctgaagtaaaaagcaaggccgggggcaacgatccaagccagaacacttacggcaagtccccatttcatgcctcaccgcagctgatacttgggtagcatggcgtccaggtacttgaagaccgacttgaggttcacctggagcggatgtgggcaaggagaagggccatgggtgagaggaggttctgtgctgtgccaggaggaaaggatgcaagaagtaaaccacccctgtcgcccgcgagagaatttaatgtcccttgcaggccatcctatcgcggactattcccgggaaacacagggcatcggccttttccccttcctcccggcatcgtgacgcatactcactgtgatgacacacatgacaatgtacttgatgaactccctggacaatgccacgttctgcaaggggtgagaggattgagaggcagagtaagagcatgcaggggccggccgtaatcctgctgtagggaatcaagccaatgcaccaaccccacagccatgaaccgcaaaccccctccactgtctcacccctgcagctgtcaccagcttctgccacttggactctgacagcgcagacggcgcatccttggcagccggctcgacgctgcgagggcgctcgccaggcccagcctgtgccaggccagcctccgcctcgagcacagctggtacccgggcgtacaccgccgcgtcgtcatccgcagccgggtccgacaacaggaaggtgagccagagccccaccattgaggttacgcaccctgacagatttgattttggaggggtggtgctgaagagcccaaaggtgaacatgatgaagttatggcgcaaagggatggtgatcacttaatacgagagcttctcaaaggtcagtactcnnnnnnnnnngaaatgtggacatgatgaagtcatggcgcaaagggatggtgatcactgaatacgagagcttctcaaaggtcagtactcacaaacgatagagcaacgatgaatgggcagggcaatttgtgctccaggcgtcacctcgcggtctgccgttggccgaaactctcatgtcaccagccccagggcacctcacatagcttccacctgcaagaacccaccggatgcaaggaagagcctgttgccgctgttcagcagggaacgatccgcaaacgccggcacgtcaaacccgtgcttccacctgatgcggaaaaagtccatgagcacaccctgttcatgcgcaagggaggggtgcgaactgccgacttgcagcgcagcggagtagatcggaggtctgcctgaagctcaggcaccaggcccagggtggtagcagtcagcccatcagacgagcacgctgtacccaggcccccccccgcacctgtgtcagcgccgccacgttcatcagcgtgtagaagagggagaacgcgaagccgcggttgccggagtgggtgtagcgcttcacgccgatggtcatcaccggcacgcccagcgaccccgccaccgtgtttgggcccagcagagccattagcaacaccaagcgggacgacgtggaggccatgaccagacggctggtgatgttgaggacgaagcacaggacgagggagcgcttgacgcctggggtcggggcatggatgaggcggggacgagtgctgtgaaggtcaagagcagctagaccagcactggtctggtagaaagcctctcctcaggcacagcggttgctagggaggcgccaggaccaccatctctgacaacccgagatccccatcccatcaccatttgctgttcacgaccaggcctagcctcacccaggaagtcgatagccccacccaggatgaagccgtagaggaccaggagggtgccccacagcccatacagggtcccagctgtcaggtcatccaccccaaagttctcggtgagatacagcacaaagatgcgcgacagggagaagtagttgtagctctccagcaccttgagcacgaagatgatgaacagatccctgtgcggccatggcagcaattggtgagggcgaatcatgagtacaccaacatgggtgtagcggcctcgcgtgtcagctcgaaaagcccttctaccctccgcggacctagggctgcctttcagggaggagaagccgctcgccacctgatctcggaccgattctaatgctctcatgaccccgatcaaatgagaggatcgagcgaggccaggcgtagcgaccgcaggctggcccctgggggtggcggatgtcttgttccggatagcccttgttcgacaggatgggtgtcgtagaccacaataaagatctcaggtgttgatgcgatagaatttctgtaatctgagaccatcattccttggaggcttgccgcttgttgttcggtcaaatcagggtatgccacaacacccatcctctacattacgatctttccagccaggactccaggtcatatcaatannnnnnnnnngggcccctgttcggcaggatgggtgtcgtagaccacaataaatatctcaggtgttgatgcgataaaatttctgtgctctgagaccatcataccttggaggcttgccgcttgttgttcggtcaaatcggagtatgccacaacacccatcctctgcatcgcaatcattccagccaggactccaggtcatatcaataaaaactgtgggacagagcacgccagcgtcagaatccaagtgcttagtatgcaatgtacaaggaacaacattcattcaggcaactgcccgcagcactcagagccagctacagatacagttcctgctgctgcttcaggaactggaagagggcaatgccttcgctgtgctgcaggttcctcaagcaaaatccttccagcgcagggcaggacaggaggagtcctgggtgatgagagatgagaggtcgtaacagggccgcaaagaggcgaacgagacgtgggtgctgcgagctcaagctctgcaagtgtgggagggtggtgaggggcagagataagatcgttgcgggggagacatctcaatgtcatcccagactgcagagccgacatagtgggactccctatgcggatgatcccggaaactcgacgagtcattcctgcgacgcaccctcgcaaccctataggcacaccatgccacccgccactcacctcctgctcctcctcctccaagcaaagaatggcatggttgacgaaaccggaggccaagtccaggctgagcttgcggcagctcacctggctgtgcatgacctccagcgcccccacggtcagcgggctgtcgcacagtgctgcgatgcactcatcatacatgtcgacgagcagggtggatgccgaggaaggttcgtcacgccctcctgacggctcgtcacgccctcctgccacgccttgcgcagccagggcgtccagcaggtgagcggcagctgtctggtcccgctgcaccatggccatgaagtccgagggggtcacacaggaggagtcataaaacccaatgtcgcctgcttctatcttgacgaggcggaagtttactttggggaacagccacggcatttcagctgcgtgggtgtgggggagggcgattgactgcatggtgaatggccccgagnnnnnnnnnnttcatcaaacccaatctcgcctgcttctatcttgaataggcggaagtttactttggggaacagccacggcatctcagctgcgtgggtgtgggggagtgcgattgattgcatggtgaatggccccgggacacaccgaggtggctctttccggtgaccaaacaatgggccactgcaattgaaggcgaatccctttcactacagtgcagtttacctgggaggatnnnnnnnnnngacaatgggccgctgcaattgaaggcgaatcatgttcactacagtgcagtttacctgggaggatgggcatgagccccggcaagtcctggctcgacatgcgcgcacctccgacagccaccctcgagtagccggactacatgccttcagggtgtatcgtatccataagacatggcggagattatatatttcgacactgccacgcttgagtatgcatcttgctgaagaaggcctcgtagctctgcattcctccgtacccatggggattcccgggattttccttgtcagctgcgccctactggccatgtgtagacacctccctatcatatggcattctgattttgctgcatatgcattgagtcggaagcggggggggggggggggggggggggggnnnnnnnnnnnnnnnnnnnnnnnnnnnnnnnnnnnnnnnnnnnnnnnnggggaacacaggttcagccgctggcgcagcaggaggccttcttcttggcctcgggcgtcgcctcggtcaccttgattgcagttccgctgctgggggcctgcacgatgcgtgtgagggtggggggaagggggtcggttcctgggtgcatctcacaggctacctctgagggccagcaccagcgcgttgttggcttgcaggctgagagggtggtgggaggtcaggtagtggggtggggcagcctgttacccactctcccacatgcttcccccaagaaacccttgctccctccaagccctcatcccacgcacctgcaccgcgtcctccgcggccagtgccttcttggagacgatgtggtagatctcggtgaggatgcgctggaaggcttgctccacgttggtggcctccagggcggaggtctcgatgaaggacaggttctcgcgctcgcagaaggacttggcatcctccgtctggacggagcgcaggtgccgcagatcgctcttgttccccaccagcatgatcacaatgttggcgtcggcgtggtcgcgcagctccttgagccaccgctccacattctcaaaggtcactgcatcttgggcagggcaaggggggagctaggtggctgcccctgcgtccaaggggtgcacgccgcaggcccattgaatggacgccgctgcagcatggcgtggcgacgtggggccgccccaccatgctccannnnnnnnnntcgcaggcccatcaaatggacgccactgcagtctggcgcggcgacgtggggccgccccaccatgctccaagccatgcattaagctctgcactgcctgggccggtctcccgaacgcttgcaagcaggcctggcaagcatccttgggagtccaggatgacgatttctgggatcctctggcacccccgacgccctacccaaagacatccccgcgcgcaccccgctgcctcaccctgcttggtgatgtcgtagaccaatagcgcccccaccgcgccacggtagtaggcgctggtgatggcgcggtagcgctcctggccggctgtgtcccagatctgtgccttgatggtcttgccgtccacctgacccatgggcgcgcgagaggtatgtgaggcgccagcttgcgtcaaatccatggtggatcacagtgccggagccgttgaggcggctgtcggacccacctggatgctgcgggtggcaaactccacgccgatcgtggacttgctctccagggagaactcgttgcgggtgaagcggctgaggagattggattttcctactccactgtctccgatcagcaccaccttaaacaggtagtcgtagctgcacgggaggggccgggagcgaggaggtcagttcgaagggttgcgaggggcagcgcccgagcgcggctggagtcgggaaagaggtgatcgccccacacgcccgtctcactcgtcatcgggctttgggaccatagtgccgggggccaactcgcggcaagcgagaggggtgcgcgaggtcgggtgagatcttctgccgagtcgctggtgtcagactgacctcctcactaacacggtcccgaaagctggtatcgcggtgatcctttgaaaggtgcgttgtgtccgcacgacgctgatcagacggtggaagcctgcttggccagggttggcgcgtcggaccacttccagttccgggctacactgacctgtacccgccaaaaaatcatgtcttacaggcttgaccgacaagaacacccagtgcggacccttgagagtggaagcacaggaagcaatacatgcacaacaaatcctgaatatacaccatgcctgggtggttcaaggagggctggtgtgaatccatgtgccccacagccgtgctagggggagtgtagtgtacaccgcaagttgctggacatcctgtgagcaatcatcggtccaccgccgactccggctcaaagagggtgatgcagccattgaagtcgactgcagggtgtgaggtttgcacgtgaggtcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgttttacctgttgtaagcatgggcagtgtcgggtgccatgagcaatctcggacagtggcgtcgtggccgcccctcctcctctgcagctgcgcgacagtggcccccgtcaacacatctgcaggagtgggaagggaggcaggttgtgggcttgatgtcagcagtgactcctgtgccatgacatttgatgagtgtgccacacagcgagactccccttgctgcccttcccaggtcatttcgcggcagcagctcctcagtcggtcacccaacgtccccttccttcctgccacccaccaaaaatccggacgatgccgtctgcgctgccggcgtagacgtatcgctggccggtggttgccatggggctccagtaggccctgatcagggtgttgagcacgtaatgcccccgaatgctggtcagggaggcgtccatggggtgcgtcaccaggcggtcgcgggcggggtactccatccacctgcagcaggcagggcgtgatgtggattgggtagggattgatgggttgggaaggatggcctgggccctgataccggtctgaggcacgatgagaggggtcacgtggcctcaacagcgggggccatcggaggccacagtccatccaggtggcgtgtccagcgcacatacagatgcaagctcccttcacacgaggtgagcccccagcaggtcagaccagactctgcggcctcaagttgccagcctctcctcgccacccatgaacacatccacccacccatcccgacccccccaccatctcatccacccacctatagtcccactggaaggtgggcacgccgccccgctcggcggtgaccacttcgctgctgggggacatgcgccgcgcgtcccaaaccttgatgctctggtccttgctgttgctgatgaggaaccgcccatcgccctgcgaggggacgcatgtgagaagagtctgggcgagtagaacacgcccaagggacactgcagccggggagggggggaggccctgtccgaagcagtctgcccagcgctggcctcgtggttccactgcccacccaccttgctgtctacgtgggtgacgccatccgtgtgcccgatgaacacgcccaccggcttggtccgggcgcgtgccctcagcatacgtcggtcccagacctgcaggatgtagaggggcgggggaagggcatggccagcagtcggtgagtgtgggctccaacgtgtgggtgcagacatgagacccgcccacccgtcgccaggcagccaccctccctccgtctccatcccaacccccgccctggttcccaccttgacatacttgtcgtccccaccggtgtagatcaggttgccggtgtcgtctgcatactccaccgcgttcacgtggtcgttgtggcccttgttttgcaccaccgttagaccctgggcgtgagtggcgagggggggtagggggccaaggaaaggaagggcgggagggagcatggtctggcactttgcatcgcggcaccacccgcccnnnnnnnnnncggccctgggcgtgaatggcgatggggttcagggggccaagcgaagggaggacaggaaggagcatggattggcactttgcatcgcggcaccacccgcccaggcacgacacgccagctcggccaggcgcctgagccggattcagacccacccaccctctccctgcaataagccctcaccgccgcgatgtcgtagatgtnnnnnnnnnntacgccagctcggccaggcgcctgggccgggttcacacccacccaccctctccaagcaacaagccctcaccgccgcgatgtcgtagatgtagaggctgcagtctgcggtccccgcggccacctcctcccccgaagggctccagcgcaggctccacacgcccgtggagtagtcgtcgacgtcgccccgcgccccggtcagctccagcgcctcgtgcaggtctgtcacgttgccgatggagcgcgcggcgtcgnnnnnnnnnntgtcgccccgcgcccccgtcagctccaacgcctcgtgcagatcggtcacgttgccgatggagcgcgcggcgtcggggccttgcccccgcgcgctgatgtccaccatgtgcaccgtggaggtgatggaggagtagaggaggaagcgggagtcaggggacagcgccgtgtcggtgatggtccagcgcagctggcgggcgtggatgtacttgagcaccgtgaagcaaggcgaggttgcgtcgtacaccttgatgcagccgccgccctggaagccggctgcggggtttggtggcaagggaggaggggcggggagttcagaggctgagagggattcatggctgggcagggnnnnnnnnnnaaaggcagggagagtggggagttttagaggctgagaggggttcgtggctgggcaggggnnnnnnnnnngggaggctgagattgttccaggctttcatgtcccagtcaccctccaggactatggcagccacgtgaaagagctcgcctgctgcggtgtggcacctgaggcnnnnnnnnnnaggaggctgagattatttcaggttttcatgtcccaatcaccctcttggactatggcagccacatgaaagggctcgcctgctgcggtgtggcacctgaggctggcgcgctccccgtgccatacccactcaggtccccccccacccttctcccaaaagccgcccaccgtagaagatgtccccggtctgtgnnnnnnnnnncctttgcctgcgctcgatgctgggtgaaatcagcagggctgggtcaacatgtcatgcgcgccaggacggnnnnnnnnnnagaatcggccggtgtagatgcgggagtgcatgcagtccaccatccgggcccacttcgtgggcaggcggtggcggcttgccaggtgggcctgtgtggcaggggagaagccggggcctccggacccgccctcccgcatcagcagcgcgtgcgctgggttgagcgtcgcgctgcgtggcgaccggtcggcgccctcgccttgctttgcctgcgctcgttgctgggtgaaatcagcagtgttgggtcaacatgtcatgcgcgccaggacggcaggggagagacctgcccaaacttcttggtgatggcagtgggtctggtctagtcgtcggaggaatctcagaaaccaagaaaatcgaggatgggagccggcaatggtgtcattgcttccccactcccaatatatgtagcaactgggcatgctctcccgtctggaacccagggcccagcatacagaatcatcaccttcagtgggtcgatgtgggacaggtcggcatatgtgctggccgccagctcgtgagccaggtcaccctccaggccccgtgggttgcactcggacaacagagggaactgttggacctgtgctcggggtgggaggggtgcattctggtcacggtgccggcctcaacctacatcatggagcagcggcggggtacatgacccctaggtccccattcattcccacactcgcccagaccgctgagcctcgacaacccaccaggccagcattgatgctgcggctcaggcccgcgatccggaggtggctgtccccatagtccgactcctcgtcgtcctctgcgttcaaggagaatgaggtgtggggtgggccatctgaggatcaacagcacccagctgctcatgaccagagcagatctggactgacacaggaggtcacccctgaacccaagtggacccgcctgaggccaatgatcttgcacnnnnnnnnnncaaaaggtctcccctgaacccaaatggacccgcctgaggccaatgatcttgcactcaccatcaacttctacctcccaatcatcctcctcatcatcgtaggcggcgtcctcgtcaccgtcgtcctcctcgaggtcttccatatcaatctccaccacggttactgcagcgtactccacatcatcattgtccctctccgatgcctcatccagatcttctctaaacggattcgagagcgactccgaggcgcggccatcctggcccatcgcctcctgcacagtgtcgcagggacggggttgcgacgtgctggaagtgagtggcctaggttggaaaccccatcccgccaccagattggtgggcagggcatgcctatcaccaggaatctcgctgcatcaagccccacctctgccgaaaaattggtggatgtgggctcagcggtggggatgggnnnnnnnnnncatcaccaggcatctcgctgcatccagccccacctctgccgaaatatcggtggatgtgggctcagcggtggggatgggggagcgaccggcatcgtttgccgtgcgtgtggatcgcctcggcatcctactgtaggacgctgcgacctctggacccactgcagatgcgtctcgactcggccaaaataccatgcatctgcatgcatggcgcgtgtgcaccccccacacacgcatggtcgtcccggaaatttgggaggtcatcacgtcatggttcagtggtgagtcatgtgaaccgacctcaaaagacctacttgtacactctcactgatcgtgcagggccatggtgtcacatctgttgcagnnnnnnnnnnatgagtcatgtgaaccgacctcaaagacctacttgtacaatctcactgatcatgcagggccatggtgtcacatctgttgcagattcgaagcaagcagctctttctgtcagacccgaggatgcctaggatgtctggagcagcttctcgacctcgtcctcggcagcgctcctctcccaccacccctgctgcagcctgtctatctcgtccagcctcgtgagctcctcctctatgcctgcagcacggggacgcaggagtctaggcttgaatatggacaaaggtgacccatgccatacacgcgggcacagtcgcccaacaagaggtaatccaacgcatcacctgaggacctggcctccagttcggagccctcctgaagctccacctctacctnnnnnnnnnngacaagaggtaatccagcgcatcacctgaggacctggcctccagcgcggagccctcctgaagctccacctctacctccaccatggcaagcaccctgaccgcagccctgagcagctccgtctgcttctgtgaacgcatgatggagaggcagaagaaggggagggatgggtctggtgcagaatccctgtgannnnnnnnnnttgcttctgtgaacgcatgatgcagaggcagaaggagggaagggatgggtctggtgcagaatccctgtgagctgctgcaccctccaggcacctgtgcatcccctgagccccaagcttgcctcaaaacggccccccctgcaccgacctcaagccgggactccagccactgcagggaggccttcaccctctccaggcgcgtggtgtaggtgccttccagccccgccatcttgctcctcaggtgatgcaacctggtgggcgacatgggttggggtagaaagggcggaccgcagggtgtgcagcgcagcggcaatctcactccgtgcggtcacaggctgccatgcttcctacgtcgcccagagcctgtgccaggcccctcaactcctccatacaacaacctcacctggcgcagctctgcacggtgtccgcggccgactccaggatggcggcgatcctcctttccagctcgaggtgctgcgccaacaggccctgccgcacctcctgcgcctgtgccgtggatgggaacgcatggcgtgggtccccgtctgcgctggggtgccatgcacggtttgccgcgccatgcatgggagttcagagtgcgctgcccccccgaccgccctcgcctgcccctccatgacgcgcgctccccccccgaccctccaggatgcccaccccccaggatgtcccccacacccgctcaccgccaggcccgagctgnnnnnnnnnnttgcccctccaggatgcccaccccccaggatgcccctccacacccgctcaccgccaggcccgagctg

SEQ ID NO: 45249 - DNA, 76 bp, Chlorella protothecoides
gtttgttgtataaataaaacgtatcgagaattttgtaaaatgctggcagttttagataactgtataagtttttttt

SEQ ID NO: 45250 - DNA, 61 bp, Chlorella protothecoides
agagcgagtggctgaccatcgttttggcggtgcagtgcatcctcctcctgttccggctcca

SEQ ID NO: 45251 - DNA, 68 bp, Chlorella protothecoides
cacccagccaccctgctgtcctgtactgacggcgcgtggagcgcactgcaggccacaccggtcccatc

SEQ ID NO: 45252 - DNA, 106 bp, Chlorella protothecoides
taaattataactaaaaaaatatgaattttgaagcaatcgaaacagaattatcgcatggtaatctaataaccctatttttaactactgtctattattggacaaaatt

SEQ ID NO: 45253 - DNA, 70 bp, Chlorella protothecoides
ttttttagattttttattttttaattattagtatcacatttaaaactattttgtgattctagaaaaataa

SEQ ID NO: 45254 - DNA, 67 bp, Chlorella protothecoides
gtatttgaggcagttgcaaaaataccttacgataaacaaattaaacaagttttagggaacggtaaaa

SEQ ID NO: 45255 - DNA, 2241 bp, Chlorella protothecoides
  modified_base (84)..(93): a, c, t, g, unknown or other
  modified_base (269)..(299): a, c, t, g, unknown or other
  modified_base (500)..(509): a, c, t, g, unknown or other
  modified_base (1073)..(1082): a, c, t, g, unknown or other
  modified_base (1307)..(1316): a, c, t, g, unknown or other
  modified_base (1620)..(1629): a, c, t, g, unknown or other
gcagcgtggcctgcatgcaggccgcctgtgtcgctgacagcggcacccccgcctgggaaatggtggctgccaatctgtgggacnnnnnnnnnncgctcggcggcggtggccccgccgcgcagcgaggctaggaggcgatgcgccagatcgggccccgcaccggaggccagcgcgtaggaccccagcgccgccaccgccatggtctgcgcgtcgggcgcggcgcagcgcaggcagtccagcagcgtggcctgcatgcaggccgcctgtgnnnnnnnnnnnnnnnnnnnnnnnnnnnnnnncattcaagacctatacagtgcaaccccgaggcccggatagcctgcacagagtgagcgtgtgctgaatttcgccacttcttttcgccatctcctcacccattcaatcccacaagctagtatgcctcaatggacggccctactccccctttcctctgccctcaaccccactcacctgcacagggcggtgcgcatcacctcgcnnnnnnnnnngattcaaggcctatacaatgcaaccccgaggctcggatagcctgcacagagtgagcgtgtgctgaatctcgctacttcctttcgccatctcctcacccattcaattccacaagctagtatgcctctatggactgccctactccccctttcttctgccctcaaccccacctacctgcacagggcggtgcgcatcacctcgccgccttttcctcggttcagcttggcggcatcgatgcgcggcaggatctgggccaggtcggcatggaagggcgtcagcgcctcgcgcggcagcgctgccaccagctcagcgacccccgccaccgccccgtggcggctctccaggtccgccgactctgtgagtgggagcagggtcggcagcgccgtgcccgccagccagtcagcatccacacgagttagatctgtgatattggagtgagagggtgattcgaggtgatgggtaagagagatgtcagggaggcgatcgtgtcctgggatcttaatggcggacaaccttcaaaggagcatacgccgtgccatcacagagagaagctcaccccaatactnnnnnnnnnngggcgatcgtgtcctgggatcttaaaggcggataaccttcagaggagcatacaccgtaccatcacagagagaagctcaccccaatactcttccctgaacatgagatgctgctctgccttcctcccccaccgactctcatcctatggcgcatacacacacacaccctcacatcacctgccagggccaggctggcaagctcgcgcagcgccttttcccagtgccgcnnnnnnnnnnagctctcatcctattgcgcatacacacacacaccctcgcatcacctgccagggccaggctggcgagctcgcgcagcgccttttcccagtgccgcagcttgacgtgcagcaggtggctggccagaggcaggaagtagccggggaaggtggccacctggaccgccacgcagcgataagcctgtttgggcaccagggcggaagaggaggagggtctagatgtcatggcaaggaatggaactgcacggaaaagccatgcaagcgatgcatggaaatccccccctacatggtgcggcatgccactgagnnnnnnnnnngacctggaccgccacgcagcgataagcctgcgtggggaccagggcggaagaggaggaagatccagatgtcatggcaaggaatggaactacacgcaaaagccatgcaagcgatgcatggaactcccccctacatggtgcggcatgccactgaggccaagcattgaccgccacgcctgcacaatcatgcgcgcacggcagacaagaggtgctgggactctcccaccgccaaactgtcagctaccacctcccccctcctttccgggtgcgcacgttgacgcgggaggagactgtgaagtagtctgcggcggtgaggatgtcgatgccgtgcggccactcccccaaccgccccaccagctcctggaaggcggcggcccctgccctccggcagttcacctcccggtccaggcatgccagggtgatgagggggggccccagctcccccaccaccgcgcccagctccgcgggcgtccaggcgcgcgccagcgcccaggcaacgtaggcggccgcgtcgcggacgtgcgcgcccacactgcacggcccgcggcgcaggtcgtagcgcagcgcggcgcgcagcgtgcgcagcgtggcacccgcctcgcgcgggtccagcag

SEQ ID NO: 45256 - DNA, 61 bp, Chlorella protothecoides
ttcaagaccggtactttcagccactcagtcacttatccccagttaaaataactgatattca

SEQ ID NO: 45257 - DNA, 69 bp, Chlorella protothecoides
ttccagccaactggaagaagagctggctctctcaccagcccccgcagggacgcgatgcagctggtgcgg

SEQ ID NO: 45258 - DNA, 96 bp, Chlorella protothecoides
ctcgtaatccgtgagataagagtctgcagcaccaggctgggactgctcataagcaccctcgaacagcgcgcagcgccctgcttgcgatccgagttt

SEQ ID NO: 45259 - DNA, 69 bp, Chlorella protothecoides
tgtgactctacgctgcgcacaggaaacagggccgctttgtctggccgggatgtcgtgttctttcaaacc

SEQ ID NO: 45260 - DNA, 61 bp, Chlorella protothecoides
tctggccgggatgtcgtgttctttcaaaccacgcccatcggtcctcattcgcgacgcacac

SEQ ID NO: 45261 - DNA, 61 bp, Chlorella protothecoides
caaagctgatcacagtcacccattcagggccattactgaagtatgagattggactggctta

SEQ ID NO: 45262 - DNA, 73 bp, Chlorella protothecoides
gcctgggagctgaagaggtgggtgctggggggtgaggtttgtgtattttgttttggagtgggaggaggggggg

SEQ ID NO: 45263 - DNA, 74 bp, Chlorella protothecoides
ggggggggtgaggtgtatgacttggcgggcacccctgccccaaatgtggggtggaagggtggcccagaaggcgg

SEQ ID NO: 45264 - DNA, 80 bp, Chlorella protothecoides
cgatgtagaacgagattaggcaccattcctgtgcagctaggcagtgcatttgtgtctcaggccaggcttgacgcctcaca

SEQ ID NO: 45265 - DNA, 71 bp, Chlorella protothecoides
acagcgcctcctcaactccccacccaacacacctctccccctctctcggccagacgcaagggcttggggcc

SEQ ID NO: 45266 - DNA, 61 bp, Chlorella protothecoides
ttgtttttaacactttttgtattttcgttaactttatcttgagtatttttttcaacacttt

SEQ ID NO: 45267 - DNA, 1413 bp, Chlorella protothecoides
  modified_base (126)..(135): a, c, t, g, unknown or other
  modified_base (696)..(705): a, c, t, g, unknown or other
  modified_base (791)..(896): a, c, t, g, unknown or other
  modified_base (1191)..(1200): a, c, t, g, unknown or other
cgctggactcggtgctcagcatgcctgccaggctcagcatgttgccgaggcacccgccgtcctccgccgccagtagcgcgcgggagaggtgcggtgtgaggggcagggccgccatccggcgcccgnnnnnnnnnngcgagcggcgccggcgccgagcctggagccccggccccgggccggctgggcggcctgccgctgggcgccggcccgggagcatcgcttgcgaggagctgctgaggcccgcgcccacccaggaatacgctggactcggtgctcagcatgcctgccacgctcagcatgtcgccgaggcacccgccgtcctccgccgccagcagcgcgcgggagagggacggcgtgaggggcagggccgccatccggcgcccgatgtctggatgagagagtgggtttggaggggattcggatgtgcaagtgtccagcggggactgggtgcgatcagagtgcccgcacctgatcttggctaaagcctcgccgcaagcgattggtggcttggcagggttataccttgtgacccctccgtcccctgcgcgcacccccccctcctaacactggaatgatgccagtacctttagcgctccttacctgtgatgacgccgtcgccgtcgatggcgtccagcacgtacaggctgcgcagcgctgcttccagggcgggcctctgtggggagatggagtgagcgnnnnnnnnnnatcccctgcgcacacacacacctcccaacactggaatgatgccagtaccttcagtgctccttacctgtgatgacgccgtcgccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgataccattgtcacgccgatggattgcacatcgacaagttccccaagccctccgagcaccaaacatgcccgccgccatggtcgcaccgctggcgggtccaggtactcaaaccccagcacgtcgatgttgagggggagggatttcaggtagagcaccacccctgccaggctggtcctctggatctccggggcggtctttggaggtgttggtggtgaaggaggggggcggtatgggtacaggatcaggggggccaaagctgagagaaggtacgaactggggtccctcctcccccgnnnnnnnnnngtggtggtgaaggaggggggcggtgagggtacaggatcagggtggccaaatctgagaaaaggtacgaactggggtccctcctcccccgctccatatcttgaagggcctgcggcgatccccagcgcgccgtatacttgccaccgccaaccttgccgagtgacgaggtgctctgccggtcccaaatgccccaaccaggaccgccccgccctcccc

SEQ ID NO: 45268 - DNA, 61 bp, Chlorella protothecoides
gaccccgaatgcagtgtgttgatcgggttttataggcgtcgcaaggaggcgtggactcggg

SEQ ID NO: 45269 - DNA, 98 bp, Chlorella protothecoides
tgggcggagccctgaggcagcatgggatgagacaccctcctttcagcatcgcatcccccctggttccggacaccccgcccaacctctcacctgatgag

SEQ ID NO: 45270 - DNA, 140 bp, Chlorella protothecoides
tagaatttttatttaaatttaaatttgaatttgttagtgaagccgaagatgttaaatagtaacatcccaataccatatcttgagcaggtaaaagcaaaggttgaccagatgatggtgctaaaagattgtttcttgcccag

SEQ ID NO: 45271 - DNA, 79 bp, Chlorella protothecoides
aaggccctcgccgcgtgagctgggcggtgtatttgtggggaggggttggggtggggtgggtgctgaggtcgtgcggaag

SEQ ID NO: 45272 - DNA, 64 bp, Chlorella protothecoides
ctactggaaaaaatctatatatataacaacataacaatgctacgttgttatatatatagatttt

SEQ ID NO: 45273 - DNA, 67 bp, Chlorella protothecoides
tggatgcaagaggtgttgcgctggaagggccttcctgcgcattgccacccatggagcaattcacgcg

SEQ ID NO: 45274 - DNA, 66 bp, Chlorella protothecoides
agttcaaaggtggcaattgcaactcagaggcggaaacatacatcccaccctgtgctttcttgcccc

SEQ ID NO: 45275 - DNA, 75 bp, Chlorella protothecoides
agtcagtgctgtcaggatgagtcctttcaaggtcatcaaggcccggtccactgacatcatagtcagcgttgagtg

SEQ ID NO: 45276 - DNA, 61 bp, Chlorella protothecoides
ccatgttttgcgagcccagccccgcccccgaaatccagtcgtcgtgctggtgctccgtcag

SEQ ID NO: 45277 - DNA, 68 bp, Chlorella protothecoides
gtggcggtgcagagccggcgcgagctggagttccgcggctccatccgcaaggcgcagctggacaacca

SEQ ID NO: 45278 - DNA, 62 bp, Chlorella protothecoides
tccttgtgtcgctggaggcctcaacggggggacgccccgggcacgaccaacagttgcaggca

SEQ ID NO: 45279 - DNA, 69 bp, Chlorella protothecoides
gcaggccaacatcaaggtcattccctgcaccacttcctccccaccctcctcgcatcatcaggagctgct

SEQ ID NO: 45280 - DNA, 61 bp, Chlorella protothecoides
cagctcccccttgagcaggtgagaggtcacgacctcgtccactgtgcacagactcctcagc

SEQ ID NO: 45281 - DNA, 76 bp, Chlorella protothecoides
cttatcatgagaacataggagtttccagatatttttgcagaaaaggccgagtgcagatttttgcaaacgacaagtc

SEQ ID NO: 45282 - DNA, 88 bp, Chlorella protothecoides
catctataaattcttgcgggtttataaatggttgaaatttattaggatcaactaatgcaattttcaaactaagggataattccccatc

SEQ ID NO: 45283 - DNA, 82 bp, Chlorella protothecoides
catggcgtaaaactccttggcgccgcaggcggtcgagttccggtgctcgtcaacggcagtaaacatggccacccgcccaggg

SEQ ID NO: 45284 - DNA, 61 bp, Chlorella protothecoides
atgaggagcggtaggcaacgcctgttgtgcactccgccaacatcttcgcaatggcccacag

SEQ ID NO: 45285 - DNA, 61 bp, Chlorella protothecoides
ggggtactggcggcgggtacgtgacaggagtgcgtctggacaagcatcatgtggcgagggg

SEQ ID NO: 45286 - DNA, 85 bp, Chlorella protothecoides
atgctagcctcaatgagaggtgtaggtttaggttcaagaatttcctacttggctatgagctatcggatacggcgcctgtccaagg

SEQ ID NO: 45287 - DNA, 86 bp, Chlorella protothecoides
tgggccgcttgccgaaaggcaagggctgagcttgggcatgcatgcaggccttgggatggcagtagaccctgagtcataccttgctt

SEQ ID NO: 45288 - DNA, 252 bp, Chlorella protothecoides
tgctataaattggttacgatgagtggtacggaattgttaccaaaatgtcttcatgcgagggaagaaatgataagggcctggatcccacaacctcttttcccttgcacagtgggagaaggttgacgcacagattaaggctctagacaagaccaagaagcacctttccaatcccgagttcaccaaggttcttgctgcatttcaagaggtaggccttgaaggaccgcatgggtgtggaatgcatcaagctgctga

SEQ ID NO: 45289 - DNA, 75 bp, Chlorella protothecoides
aaaaaactcttaatttctaattactaatagtataacttttttacaaaattaattcaattaaaagtattttttttt

SEQ ID NO: 45290 - DNA, 84 bp, Chlorella protothecoides
ttttttccctaatacattatatattaataataaatacccacaaaatcgaaaaatttcaataaaatttaaactcaatatttaatt

SEQ ID NO: 45291 - DNA, 77 bp, Chlorella protothecoides
gaatttttaaatcatctaatcctaatgaaataccagcttgggttgcttgagaaaatcctagatgttttagtttttcc

SEQ ID NO: 45292 - DNA, 71 bp, Chlorella protothecoides
ctgcggcattattgggtggtgcggaggacgcgtgcaacacaaccccctgcagatgaagactccgtggagtc

SEQ ID NO: 45293 - DNA, 73 bp, Chlorella protothecoides
accttggtgtcgaggagggttgcgggggggggtgatccttgcggcgcaagcacgtcgaggcgagtgcagccag

SEQ ID NO: 45294 - DNA, 61 bp, Chlorella protothecoides
tttgcaagaaggccttttagagcgtccccgacgtaaataaccacaacagctaatactacag

SEQ ID NO: 45295 - DNA, 61 bp, Chlorella protothecoides
ttcaaccatgcgcgcatgcagggtggggtcgagggacgcctccatcccggccctgctcata

SEQ ID NO: 45296 - DNA, 61 bp, Chlorella protothecoides
ctagactcgatctcacaaagcttttggtcaactcctgccgcagatgcccgtttctgaagcc

SEQ ID NO: 45297 - DNA, 79 bp, Chlorella protothecoides
tctcggatgccgcacccctggcgagagagggacgcagctaggcctgcaggaggccgccccgaggcaccccgcacggcga

SEQ ID NO: 45298 - DNA, 65 bp, Chlorella protothecoides
tccaattgccgtggcatgtgtgcaagcggggaagacatgctgtgtagtagatagttcggctggca

SEQ ID NO: 45299 - DNA, 128 bp, Chlorella protothecoides
tcttgaacgcatacttcctgagttctgacaggctgcagaagttcagtaccatccggatacccactgcattgttgcagcggagtctggaccccgcgttgttgtcaccccagttgtagttgcccttgttg

SEQ ID NO: 45300 - DNA, 61 bp, Chlorella protothecoides
tccgagcccaaacgacccacctcctgctcgacgctgattccttgctggacttcatccgggc

SEQ ID NO: 45301 - DNA, 61 bp, Chlorella protothecoides
aacatcccacccgcggtctccttcgtcaagacccatccacagccgaacccagattctactc

SEQ ID NO: 45302 - DNA, 73 bp, Chlorella protothecoides
gcgcgagacggggctgggcaacctgctggccgacgccatgcgtgtggccatgggctgccaggtcgcgttcttc

SEQ ID NO: 45303 - DNA, 61 bp, Chlorella protothecoides
catcagaaagccacagccagccccagcacccacctgcagccgcggcggggctctgagcaca

SEQ ID NO: 45304 - DNA, 75 bp, Chlorella protothecoides
cctacctggaagtttatgttcttggcgccaccgccctcaagtgcttgatcaaatacctgggtgtggataccggag

SEQ ID NO: 45305 - DNA, 61 bp, Chlorella protothecoides
tgatcaaatacctgggtgtggataccggagtataaggatgtagatcgaccatcactagaca

SEQ ID NO: 45306 - DNA, 61 bp, Chlorella protothecoides
tcttggcaatgggccatggggtgactggggttcacctttccacaacaagagactgatcaga

SEQ ID NO: 45307 - DNA, 61 bp, Chlorella protothecoides
ccacacaggctcgattgtcatgatatgagcaccttcgctgccacaacatctcaaggtatca

SEQ ID NO: 45308 - DNA, 75 bp, Chlorella protothecoides
cactgcgtgctcattgccgggtgctgctgcgtgacccccccccctccccccccctcaaaccacacatccgaccac

SEQ ID NO: 45309 - DNA, 73 bp, Chlorella protothecoides
ctcggctgtcttcacgggcaccgtggacttttccacaatgattttggaggacgtagacacggaggcgatcatg

SEQ ID NO: 45310 - DNA, 77 bp, Chlorella protothecoides
ctcagggtcgaatgtctcgtcctgtgtggaagaatgatctgagtttgcgggctgaggtgagggctcataggaaatca

SEQ ID NO: 45311 - DNA, 76 bp, Chlorella protothecoides
tgcctaactttgatgtttcatttttgtatctgtaggtgaaactcggtttggttcaaagttcctgatgctggacagg

SEQ ID NO: 45312 - DNA, 61 bp, Chlorella protothecoides
cccttctcattgccacaaggactccattgacggctattaaaacgtgaacacaggacggtct

SEQ ID NO: 45313 - DNA, 61 bp, Chlorella protothecoides
agagagatctgcaggaacgtcaatttgtggtggccgcaattctcagcagttgatctgcact

SEQ ID NO: 45314 - DNA, 822 bp, Chlorella protothecoides
  modified_base (87)..(251): a, c, t, g, unknown or other
  modified_base (411)..(588): a, c, t, g, unknown or other
aggaatcgcagcactgccttcctctccgccaatgctgcgcaggttctgctgcgtgagtagagagaggcgccagtcatgcaatgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcacaccctccgacttgtgagtggtgcatgctttccagccacgctcgccatgacatccacactggagcctgggaccctgacaggccttgcatgccttgtagcatgcatctgacaatttacactcatgccatcatctgtacctgccaccctggcatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtctgggtgaatgggatgaggagagctctcaagtctacatccgtgcatgtagcttattggtcaacctcctgcaaggagcgcgactgagcggcatgcgcggagcacaatgtgaggtgcaccaagcttcaccccttcttccccgcagacgatatggtcgaaggtctgaataaggcatacttggtgcgtacatgcacagcccatgccctcttccccagccaaggcctctgctcagg

SEQ ID NO: 45315 - DNA, 67 bp, Chlorella protothecoides
ccagattaagcgtcgcatgaaacctctgcatgctggacactagcagctggagacggagttattaggt

SEQ ID NO: 45316 - DNA, 91 bp, Chlorella protothecoides
tttttttgacattttggtaatccttataatatttgatataatatataatatataaaatttaatttttaaaaatattagaatatatatatat

SEQ ID NO: 45317 - DNA, 75 bp, Chlorella protothecoides
atcgtgaatgctgaaggcggcatcctgctggatgtccacgtgcaacagaaggagcgggtcaccgactaccgcacc

SEQ ID NO: 45318 - DNA, 72 bp, Chlorella protothecoides
cctccttcaaagaagtctcccccgccaccaaccaaggaatccccaccaactcccccaaccacaagtccctct

SEQ ID NO: 45319 - DNA, 6530 bp, Chlorella protothecoides
  modified_base (124)..(223): a, c, t, g, unknown or other
  modified_base (1223)..(1232): a, c, t, g, unknown or other
  modified_base (1602)..(1703): a, c, t, g, unknown or other
  modified_base (3360)..(3369): a, c, t, g, unknown or other
  modified_base (4622)..(4631): a, c, t, g, unknown or other
  modified_base (5383)..(5392): a, c, t, g, unknown or other
cgcctgtcccgcgagctggtggccctgtggtgcgacgagtacgcgccggcgctgggcctgctgcgccgcgctttcccgccaggcctggtgcgctacctgaaccagcggcgggcgggggcccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctggccgagacgtcgatggcggcggtttgaggggggccggtggcactgcagctggccgcggggtcggtggcggcgccagtgctgcggatggacaggcctctgcacagattgcgacgcggccggggggcggggagcaaggggtcccggcggccgccggcggggaacgggcgcagaccaggccgcccgccgatcagggcggcgcccagtccgccggcctcacgccagggtcgccagcaggcacaggcacccaagctcaagctgtgccagcccaggaaagcgcggccggcgcccgtgtcccaggggcacaggcggccgcagcgcggccagaggtccagccgccgcaacccacgagcaccacgccgccggagtacccgtcgccaccctcgcgccgcgccctggcgtcgcagctcaagcagcgtccaggtgagagggggtcctggtccaggatcatgattgcgcacgtcacgagggcagggaagtactcggatgtgctgctgcgcaggagggctgtcgtgggtgctggaactggtcatttcgatgcatgctggcgagcgcatcggcaccgaccaatgcctcggagagtaccagttggtggtgcgatggaattgagtgcaggcgacgtgagcgccatgcacccctgcacattcatgctggccggcttttaccttggtcaaatgatccaggccccgcatgcccctcccccatgcaggcaccctgcgtggaaactgggaggccttctggttgaacgtggacagggaccacgcccatgccgggctgatctggaatgccgccacgcgcacagagctgagggaggcccttcaggtgctggtggggtcttgaggaaccccagcggggaaggggtggtcggaatttatggttgagcgtggaagcggagtgtatgtattcccaagtggcaactttgatgagaaatgcggcccctgccgagttcccagggaaccgtgtaccttcgccctgtaccgctccacgacatgcatccnnnnnnnnnntgcccctgccaagtccccagggaaccgtgtaccctcgccctgtaccgctccacgacatgcatccatctcttacagccctggaacctgcactgctcaccccaacacacccgaccttttctcaatttcacaggccgaggtttctgtgctcaagctgggcaaggcccgggctgggaaccgggggatcagctggaaccacgaggaattccgtgcgcgcctgccctcgctgcagcgccagctcagcatcggcggcgtgtacgtccgcctcctcctggacggcgccgactcgggtgcgcctcgttctgtcttctgaggtggaacccagagctttggccggctcccagctttgccgcgctcaagacatgcccctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaactggctgcaccccgggacttcttcctggctgcctaccaccacttcctgtgcctgggagatgccgatgtgagcggggagagagggggttgggagtcgggtcctgcgcgacagactacttccgtgtacccttggcccagtgcagtgcgcaaatcccgtgcagagatcacccgcttccctctgaacgaacccaggagacatcctttcgcccctcaaaaagcgaccacctccctcctgccttcctcgtgcaggacgccggggcgcttgctgacgcggcgggcgccgccaccgcgctgccgcccgcgctggaacagcgcatcgtctgcgtgcgggccatggccgccgcctatgccgtgcatgccggcgcggtcggcccctttgacggcgtggagcatgtggcccgtgccgcggacgccaccgcctccaaggccctgcgcgccgcctgcctggccttcctggccacgctggtcgcgccggcggcgggcgtgggcgaggacggcacaggcgccgcacgccaggcggccaccgccaacgccgacgcgctgctgagggcaggcggggtgggcctactggtcgacgccctcgtcggtgcggggcggggttggatggggtccaatcgagggtttgcttggttggtggggcctgcgtcgcaggggtggggaggcacggcatgaacatgacccgctgagcatcgggtgatctggagctgaaggtgatgctggcttcctttgggtcaggttggcagcccttaccagcaacctggaatcctcctcccctgcacagccgggcatgaggacggcggcggcggcggcggggtggcagccctgcacggcaacctcatcgcgtccacctcggcgacgcaaccgctgcgcttgtggagggtgcacctgcctgatggcccggagaggtgagattgtttggggagagtgccagtgctgttctgcggcaggaagagccaactccaagaaatcccctggacctgagcacccgcgccgcgcctcctgcctggggaatgctggagggacgttgacctcgaagatccatgagcctcaccaattctgcggccacgaggtctctcttcacaagccctcagccctcttctcccctactccatcccaacaccaccagggcctgcacccggcaggagctccgccaggcctttgcgcggggcgaggtgatactggacaccctgctctcctgtcccgactggcgctcccccacaagtctaggctccgtgcgcgagctgcgctgggccctgggatccaacgcgggcggcccgccgcccgcggcggcgatcgcggcggccgcgctgagcacgctgggcgcgctgagcgcgctacggccggcgctggatgccgcgggcgagcgcgtggttcccgcgcccgccgcgctgcgcgcgctgggctctggcgagacgctgccgcacctggcgcaggccctgctgaccaacgacccggccctggtgtcgggcgcgtgcacgctcatgctgcgcacgctgtgtcatgacgaggcggcgctgggccagctgtaccgcacgggggccttcttcttcgcccttgcctactgcggcagcaaccagctggaggcagcccacctgctcaaggtgggtgggcagggggggaggtggggtggagtatccttcgatgagtgaaagnnnnnnnnnntgaggcggcgctgggccagctgtaccggacgggggccttcttcttcgccctggcctactgcggcagcaaccagctggaggccgcccacctgctcaaggtgggtgggcaggggcggagttggggtggagtatccttcgatgagtgaaagtgctgtatgcaggcaggaagtgagttttgtctgtttaatcagttctcctttcatctgagaatgcctgtggtgctctggtagcccctcaggcatctccatcgtccctgatgccctgcaactcatagaacccttatctcctgtttcaacacacacacttgcagctggcccatctggcccagcacagcaagggcgtgggcttcggcggccccgtccagtccctggcgcagcgcagcttcctgggcggcttgatcccgggtaggagctggttgtggaaggccgagcaatgaagttgccctctccaccccgggcttccagattgtgtcataaaagaaactgctgccccacccctccaccactcacccgtcccactcacagactccctgatctactgccttgaggaacggggccccgaggcctttgcggccgcgctggtcgaggacaacgacacgccggaactgatctggacgcacgccatgcgcctgcagcgcctggtcccacaggcgaggggaaaggcgatggatcagagagtgcgtggcgctgtgcagcggcatgccagagttggctgccgcgttctgctgaattgcctcatgctgtccttcccacacccagatgctgcgtcacctgggggacttccccgcccggctgcgggagcatgggcattcgctgtacgagtacaccccctgcccgcccgtgggctacccagagatcgaggtgggtggtttgttttattggggtggggtttcaggcgttggtggggatgctgatgatgtctttctctttcctatgtgatttattggctgaaagccatgcccaggtcaacacccaaagtctgcatgcaagagcccatacgctgacaggtgccctgccctatccccatccctcgacctgctcgaccaaattcgcagggggagctgtggtgccacaggtactatctgcgccacctggtcgatgaggtcaggttccctgactggcagatcacggatgccgtgccgttccttcaggtgcacataggttttatgactgtagaggggggaagagggtggggaggtgggcctgcaggggggtgaagtgcatgcgaaaaggatggcttgagatggtgggctcnnnnnnnnnncatgactgtagaggggggaagagggcggggaggtgggcctgcgggggggtgaggtgcaagcgaaaaggatggcttgagatggtgggctcgacgcgagaagtcaggggtgctgggacggctgtgaacaagactggtagcctcctactggcgtctggcatattgttgcaggcaacacacccttgtcagtgacgctgtgcagtggtccgcacagcaatttgccttcttccctaattgatgccctgcatcattaccccatcgctgatgaccctgggcgagtgcccacaaatcctaccgccccaccaacaatgtaacaccacccacatcatcaacctttcctcccagtccctgctggatgcctggcgcgtggagctggcccggcagccgctcagcatgacggagtcggatgcttgcgccgtgctgcaggtgcagcccgacggtaccgggcacgtgcccgaggactcgctcaaggccgcctaccgccggtgcactggggtcgaggttgagggggctgtcttgggttctatgagctgactgcgaggccttgagtggtgatttactctttggatcagcccttactgatgctggcagccttccaggggacggtggcaacccctggtgtggtttgtcctgtattgaggagctcaactggcatatgtctccatgtttctgagactttccgtccttcccagcgctctggcccgcctcaaacacacacgccccctgccccaagtcaccccgccaccggatctctnnnnnnnnnncatgtctccatgtttctgagactttcctaaaccttcccagcgctctggcccgcctaacccccccccctcccccttgccccaagtcaccccgccaccggatctctgcctcgctatcctagaaaaccccttccccaacccccaccacacacacacacttcaccaggctggcgcgagccttccaccccgacaagaacccagatggtcgtgaccgctttgaggccgtgcagcgggcctacgcgcggctgcaggccggcgcggcgggcggccagggcccccagccctggcgcctgctcctgctcatccaggcgcagtgcctggtgttccggcgctgcactgcggagctagcgccctacaagtacgcgggctacgcgctgctgctgcgggccttgacaccgcccgaccccggggccgatgcctctgaggcccagcagctgctgggcggcgaggcgctgcccctggtccgcgccgcggccgagctggcgtggctgacctgcgccgcctcgggcccaaacgcggaggagctgtgtcgcagcggcggcctggaggcgctgggcgcgctgtttgagcgctgcgtggccgtgacacacgccgacgcgtcgcccatgcgcccggaggtggctatcctgacgcattgcctccacgcctttgcggccatggcgtgccaccccgcgccgcgctcggccatggagcgccgccccggccttgctagcgacgtggtgcgctgcgccgggctggagagggcgcacgacgccgtggacgccgcgctgcgctgcgccgtccacatggccgcctccccggccctgcaggcggccctgctgcgcgccggcgcgctgggccgcgtcacgccgctcatcctgcgctacgacgctacggtgcccggcgccgacggcccggcggccgaggtggtaccggggatgtcgcccggggacaggtaccggccggggccccctgtggcggatgaggccgtgaaccatggattcaaatcaagcgggtcggatgggcccggcgccccagcgagagacccgggcaccgcggagtcggcgcggctgaacgccagcgccatgctcgccgtgcgcaccctggccggcctggccggctgggcgggcccccccggccccgaggcccccgccagcgcagc

SEQ ID NO: 45320 - DNA, 73 bp, Chlorella protothecoides
ggaccagggcaacaggcaggcagttcgactcacacatgctcgcacagctcctcgacggtggtgtcgtccagga

SEQ ID NO: 45321 - DNA, 106 bp, Chlorella protothecoides
attaacttctagaaggagaataattacatggatttattctcgatatgttcgtaatgggttccttgtgggactggtgttccaggagagcgtgtggctgtactgtgca

SEQ ID NO: 45322 - DNA, 76 bp, Chlorella protothecoides
atgatggaagccagtgtgggcaggggcgccgacgatgcccacagcatgaaattcagacttcccgaccccatgtaga

SEQ ID NO: 45323 - DNA, 61 bp, Chlorella protothecoides
tcacctgtcaggagttggctaccctgaaggtggaccttgccaatcccatccccaatcccag

SEQ ID NO: 45324 - DNA, 1642 bp, Chlorella protothecoides
  modified_base (1251)..(1260): a, c, t, g, unknown or other
  modified_base (1480)..(1489): a, c, t, g, unknown or other
ctccgcgccgtcgacgacgggtggcgaggcgggcgcccctgcaccaccgcccgccggcaccgccgcgcccagcctgatcgtgccctcctcgcagcccgacgtgccgcacccccagctgctggagtcccagggtgggagccaggccacggccggcggcgggccctttgcccccggcggcggcgatggccgccccggcgtgcccagcatcctgcccctgagcaacatggactttgccagcatgcaggcccaccccgagctgtttgccaacctgacctggatgtcccccgcccacttccccgtcccgcccagccaggaggagggcggcgccacgcccgaggcgccgccctccgggcgggtgcgcggcggcggcggcggcaagcccacccggcgcgggcccatggacgagatgcggcagctggtgcgcatcctggtcaagctgctgccgcagtcggtggggcacatcggggccagcgacgaggccgggggcggcaaccgcatcagcgaggagcagatcaagcactacctggacgccacgctgggcgccgcgccgcggcccacctggggcgtgcccacgggctggtacggctacgtggcgacgctgctgtcctgggcggccggccggccggtgagcgaggaggccgcgcgccgcgtggccaagcgcgagccgggccggtcctgggaggccatcgagcccgagctgcacgcgctgggcgtgcaccccaacgcctggcccctgcccgtgagcctggagggggttcaggccgccgaggccgaccccgtgccgcagcccgtgcccctgctgccgccggtcaggcgcgcctccgaggacggcgcgggcggagggggggtgagctcgagtttggtcggtggtggtggtgggggtgggcgagggtgcgacggcgatgcctcacggtcctgcatacatcgagcttgctcgcccacacccgactttctctcacatcgagggcttgccgtccctccctcctcgaccgttcattcaccgaccccccattactcatccccctcccattgctacaggcccgtcgtggccgcgtgtccacgggcgggtcgcaggccggcttcgacctggaccgcgccagcgagatggacgcctggcggcacctggtggaggtcctggccgcgctgccgggcaaggccgggtccacgccggcagagcagggcggcgcgctggccgcgctcaagtccgacgccaagatccggctggacggcatcgtggcgggggcggccgcnnnnnnnnnnaatcgggggtggggtgggcaagggtgcgccggtgatgcctcacggtcttgcatacatcgagcttgctcgcccacccccgactttctctcacgtcgagggcttgccgtccctcccctccttgacctttcattcaccgacccccaattactcatccccctcccattgttacaggcccgtcgtggccgcatctccacgggcgggtcgcaggccggcttcgacnnnnnnnnnnggcctgcagtacgtccccatcatgggcctggaggcggggggcccctccatgctggccctgctgggcggcatgggcggcatgcccgtcgccgcgctccagggtcatctggggggcggggatgccggcggcgcggggggcccggcgccgggcggg

SEQ ID NO: 45325 - DNA, 70 bp, Chlorella protothecoides
cagagcaggaccagggccgcaatgatggtggcggggcccgtgaccagctgctggacgtaggggtagaaga

SEQ ID NO: 45326 - DNA, 84 bp, Chlorella protothecoides
acccagggggcctacatggccctgtggcccagccaacgactttgagtctgtcctgcagagatctcccgtccaccgactcttagg

SEQ ID NO: 45327 - DNA, 78 bp, Chlorella protothecoides
catcagtaaagcccactaaccattgtttaaaatattgtttttctgataacatactactaaaattatagatttcactta

SEQ ID NO: 45328 - DNA, 73 bp, Chlorella protothecoides
gtccgtcagcttcgcaaaccctctggcgccaacagaggacccagtcgccgcgcccgccctgccacccgcagcc

SEQ ID NO: 45329 - DNA, 139 bp, Chlorella protothecoides
tttgggaagcgctcatacaggtgtggatccgtcttcctcttcctcattccctgaaatcaattcctctatagtatttttccaactccaaggctttgccttgtttctgttacgtatctgagcagttcctgctctgaaccct

SEQ ID NO: 45330 - DNA, 61 bp, Chlorella protothecoides
cgttggaaaccacgaaatggagccccagagtgatggtcgcaagtttgtgtcgtacagggtg

SEQ ID NO: 45331 - DNA, 64 bp, Chlorella protothecoides
tccgctgcgggatgggaaggacattgtttgggtcagaggcacgattgtatggtcaggcggcagg

SEQ ID NO: 45332 - DNA, 72 bp, Chlorella protothecoides
aaagcacttgctcaaaaaaataaaagcattatattataatgggtactttttcggtacatacagtatataata

SEQ ID NO: 45333 - DNA, 80 bp, Chlorella protothecoides
cctcacgccgacagaacgatgcacacttctgttttcacagccgccaaaccagcatccctgcatcgcattccggcaccttt

SEQ ID NO: 45334 - DNA, 61 bp, Chlorella protothecoides
aaagcactgccgtgcctgtacagtcaggaacttcgccggcagcatggcggacatccttccg

SEQ ID NO: 45335 - DNA, 61 bp, Chlorella protothecoides
gctcgtttaccgtacgcagaggcttggaggtaacctaggccggcagtctcgaccaatcgcg

SEQ ID NO: 45336 - DNA, 87 bp, Chlorella protothecoides
aagcacaagattgtcagattacaagaacagcggctgtgccacagtgctccaacatataggattgggtttctgaccctcccagtctgc

SEQ ID NO: 45337 - DNA, 75 bp, Chlorella protothecoides
acatgctctctccctccatccaagtaacaagttatccaaggattctcagcaaggcgcatgtgggttgtgatactc

SEQ ID NO: 45338 - DNA, 75 bp, Chlorella protothecoides
tcgacgcagaagatgcttgtcgcggaaatctggagggacccccccgtgccaacgacgaaacggagcccggtgaac

SEQ ID NO: 45339 - DNA, 92 bp, Chlorella protothecoides
ttaataattattaataaaaatatgttataataaaattatctgtagcctataaattaaaaactaatttttaaagttaacatgtatttaaaaat

SEQ ID NO: 45340 - DNA, 68 bp, Chlorella protothecoides
ctcaggtgcactgcgatgctgacaacgggctcacctgtggaccgagttgtcctggggcatcgctccgc

SEQ ID NO: 45341 - DNA, 61 bp, Chlorella protothecoides
tcgcagcagggatagatacagggacaggagcagggagcgtcgaagcagcccatccaggtgt

SEQ ID NO: 45342 - DNA, 76 bp, Chlorella protothecoides
gccaaaagtgttggcagcacaaggcctggcagctgctcctccgtcaccgagccccacattgccaaagaatgctgta

SEQ ID NO: 45343 - DNA, 61 bp, Chlorella protothecoides
gatgggcccctggtggcccaggggcctcccccctccttagcccttagaggggccagatacc

SEQ ID NO: 45344 - DNA, 127 bp, Chlorella protothecoides
aatagaatctttaaattatactagtgaaataaacgaagtttattaaaataactgaattttatttgatttatttccgagtagtaaatgctttttcaagcaaatttaatgtctcgtctttatttggata

SEQ ID NO: 45345 - DNA, 61 bp, Chlorella protothecoides
ccctcttgttgccttgaacctgcttgaaaaatgggtgcctcgcccagacgccaaggcctcc

SEQ ID NO: 45346 - DNA, 67 bp, Chlorella protothecoides
gggcaggagtgggcgcgggcacaggctgggtaggagacggcgcgggcgtgggctgggcaggagtggg

SEQ ID NO: 45347 - DNA, 91 bp, Chlorella protothecoides
aatggttgggttcctgtagcccgtgcctcttgaagacgaagtgcaggaggaccaggagtaagttctgagtgcacagccctccttgctgcat

SEQ ID NO: 45348 - DNA, 8210 bp, Chlorella protothecoides
  modified_base (842)..(851): a, c, t, g, unknown or other
  modified_base (2161)..(2170): a, c, t, g, unknown or other
  modified_base (2350)..(2359): a, c, t, g, unknown or other
  modified_base (2865)..(2874): a, c, t, g, unknown or other
  modified_base (3416)..(3425): a, c, t, g, unknown or other
  modified_base (4115)..(4124): a, c, t, g, unknown or other
  modified_base (4709)..(4718): a, c, t, g, unknown or other
  modified_base (4841)..(5001): a, c, t, g, unknown or other
  modified_base (6346)..(6355): a, c, t, g, unknown or other
  modified_base (6951)..(6960): a, c, t, g, unknown or other
  modified_base (7015)..(7024): a, c, t, g, unknown or other
  modified_base (7079)..(7088): a, c, t, g, unknown or other
  modified_base (7247)..(7281): a, c, t, g, unknown or other
tgcgcgcctccacgctgcgcctgctgtgctgctgccggcagccggtcctgggcgcgggcggcgagcccagcgacgcgctgccctcgctgctgggcatcgaggtgcgagggacgggagcgcagcgcgcacagcacggcggattgggccgcgaaggccaggtggcgatcggccggctgggcacgctgctggagcacggcgcgggcgtgccgggctggctggccgcgactctggcggccggcctgctgggcacgctgcgcgtccggtttgggccgctgtggaacggcgcggcaggggcgctgggccaggcgctgcggcgccacgcccccgaggtctggcccgtggccttggaggagctgcgccacacgcagcgcgagttcctggagggagggccgtcggaccgctgggcggcggccggcgcagcgacgacggccggagagacggcgcccgaaaccagcacgcccctgcgccgccgtttctcggcggcatgcgtgcccgaggacgcgccaggcaccgacgcggcgacgcgcctgacgcacatcctgcgagcgctggcggcgtcggagcacgcgctggtggaggcgcgcgcccgggactggctccccctcttcctcgccttctcctcggcgcctgtggtgctgcggcggcggggtggtgaggatgatccggcaggagaggcggaggttgctgaggagctggaggacgcggcggatgatgagccctcccacgaggaggcccgcgggggagaggacggcgactacgtgatggtagcacgcccccaggcagaggctccggcgtcccaagcgcaaaaagtggacgagagtggtcggtctgcaaacgggaannnnnnnnnngccccaggcagaggccccggcgtcccaagcgcaaaagacggacgagagtggtcggtctgcaaacgggaaagccggacacccggtggacgcggcggcgccggcgcctggcccccgccaggccatgagcgtcaaggagtggcgggccgggctgcgtgagtggctggccctgctgggcacgctgcgcggcatccgcggcctgcaccgcgccgacgacctgctgcagggcatcgtggtgcacgtccgcgactccgaccccgcagtccagcaggcggcgctgctctgcctcaaggtgagggagtgagagggggggcccagcaggcaagcgaggtgggcctggtgacgcatagaggctttttccagttggatgtagcaacaaggcattggcagccggcatgactgggcgacatcaagcctggcccccctcccctccttgactcggcaggctgattcccctcccctcctctcttcacaccccacaggcgtacaagccagtggccctggtcccctacatcgatcgcctggccgggctgaccaactccaggcgcctgaggacagacctgctcaaatttccactggcaggagggtgagtgttgagaggggctgttgcggatgaggttgcctgacagccagtgaggtgccgccccatgcccccggaatcctctacctcccatccttccttcgcccattcctgcttccctcaggaccaggagcgcccgtcaggacgacgacgagatcccgctgctgccggagcaccgcctggaggtggtgcccatgctcaccaccctgctgttcccccacatgcagaagcgcagtggagggaagggtgagtcggtgtttggtggagggagtctcctgccgttggtggccgatgctcgtccttcaggggctctccatccagcatacaattgcgttgcgccaatgccatcaccgtgccaaccgtgcagcctgttgtccgcgtttcagccaccagtgccagaatccacattgcatctgccaggctcgctccaacccatgtgcctgtttattcccctcgcgcgtcaccgctgaatgtctgccctctccatgcatgcagcgccacaacgtggcgccatcatcacctacttctctgggggccagccggaggagctggcgccgctcctggcgctgttcctggagccgctcgccccaacctttgcggccctccctcaccagccgccgccgtctggccacacgtatggaagggttgctagggtggggcctggatatcctgatcccatgctgcatcaaatgcatgcttctgggggctgtccctctgcaatcgcggtgtgcannnnnnnnnnggctagggtggggcctggatgccctgatcccatgctgcatcaaacgcatgcttcttggggctgtccctctgcaatcgcggtgtgcatcactcgctttccttgtgtggccccccaccctaaccctctctcccggcgacccatttcccgccctttccacgacatcctccaggcccctggcannnnnnnnnnattttcctcgtgtggccccccaccccaaccgtccctcccggcgacccctttcccgctctttccacgacatcctccaggcccctggcacccctgccagcctggacatgggccctgggccgcacgcctggcgccacctggctccagtcgctggatgtggccgccctggcccggcagcccatcagccggcgcctgggcgtgctcaacaccctcagcgacctcctgacgcggcttaagtaccagctcaaggtgacgggtgggacatggagagggtggaggtcatgcaccggtggatgaaggatggaggccgcagcgcagatgcgtggcatcgtctgatgtgccggccagcttgcgcgaacagcacgtcgtgtgctgatcaacctgtcactcgcggcggcgaacctgcctcgcctgcgccatcccaggcctcgcacctggatcctcacataatcatactcccccttgccccgttccttgcctctccagatgtacctgccggacttcatggnnnnnnnnnntgcacctggatcctcacaccatcatactcccccttgcccctttccttgtctctccagatgtacctgccggacttcatggtcctggccctgggcctgatggagaccgggctgcggtcgctgccgggcgcggccggcgacgcggcgccggccgcccccccggaagagagggcctcctccgaggagggcaggggagcgcgcacgctgcgaacccagggcatgcgcctgctggccgagatgatcgagctgagcgaggccggggcggggggcctggccttcctctggcctcgcctgatggcggcggcggagggctggctgccgcgcctggtgccggaggcagcggggcaggagccgcccgcgctgatggaactggctgcggttctggctcagcgtcccgacctggccgccctgctcgccgacgccgagtggagggcggaggggccgggggtggaggcggcaccggccgtggacgccgaggaccccgatgaccacactgttgacggcaagcatcactctcggcagaactcctacgtgctgaccccaannnnnnnnnntggaggggccgtggctggaggcggcgccggccgtggacgccgaggaccctgatgaccacactgttgacggcaagcatcaccctcggcagaactcctacgtgctgaccccaaggcccgaggcctgggcggcagacgcccacgtcggctcgcgcctgctggagcaggtggtcgcggcgctaggcagccccggctgctcccccgccggccgcgctgccgcgctgggcgtcgccgaggcgctggtcggcctgcccgactccgggctggcggtgctgctgacgcgccacctgggcccgctgctggccgggctgcaggccctcatcgtggccgtctggcagcagcagacggggcgggggggaaacccccacctgctctccggcgcgggcgccggcgtacgcgcgaagcgcgggtcccccggcggcgcggatccgcaggccctggccgcgcgggcgctggacctgctggtggtggtggggcaggaggccgcgaccccggcgctggcctgccagctcaccgccgcgctgctgcccatgctggcggcgcccggcgggaagctgaccgaggcgcagctgaggctggtggtccgcgcactggccgtgctggcagcgctctggcggcgctgcgccgcgacagcggacgccggggcctcggctgtcgcgccgaccgtcgcagagggctccgacttactacgcnnnnnnnnnncggcgctgcgccgtgacagcggacgccggggcctcggctgccgcgccaaccgtcgcagagggctccgacttactacgccgcgtgctggccgcgctgggcccgctggcggggcggcccgagcctacgctggcgcgggtgctggccgacgccgcggccgcctgcgcgggcgcgctgggctgtcccgcgcacatcgccgcggcccgcaccctggtggagctggcctcgctggaccccgcgggcgtggacgaccccgactacgaccgccgcctggccgccttcctgagcctcaaggcccgcgtctggcgcgagctggcggagggcgaaggtgtcgacgccgtgccggcctcgcttgtgctgcaccgcgcggcctcggacctgcgcaacgccgccgacctgggcctgcgcaccgccgcggccgagtgtctggaccagttcctcatcgccgtggtcgaggtggcgggtggcgatgcaaccgccgaggacaccgctggcgccaaggacacctgcaggaatgctgatgacacggccatcccatccatccccgcaccgccagcatcaacctcgccgcacccgctggtgctggcnnnnnnnnnntcctgcaggtgtggacgaccccgactacgaccgccgcttggccgcctttttgagcctcaaggcccgcgcctggcgcgagctggcggagggcaaaggtgtcgacgccgtgccggcctcgcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatgctgacgacacggccatcccatccatcctcgcaccgccaggatcaacctcgccgcacccgctggtgctggccgcgcagcgcgtgctcttcccctccttgaagcgggggttgacggccgtgtcgcaggcggtgcggtcggagcacctggcgctgatgcgcacgctggcgctggcgctgccacgccagtacccgggcctggccgcgctggccagccgggaggacccggaggtcgacttctggctcaatgccgcgcacatccagctgcaccggcgcgcgcgggggctggcgcgcctggcgcgcgcgctgcgcgaacccgacgcgctgtgcacgctgggcctgggcgtcatgctgggcgtgctggcgcccctcctccaggcgatggtcgtggagggcggcggctcgggcacggccatcatgctggccgcgggcgggcacgagcccaaggcgggcgacgtggcggtcaccgccaacgtgaccgacgcggcggttggcgcgctgggcgcgctgggcgcggccctgccctggaccgcgtactcgcaggtgctggggcaggcgctgcgcgcgctgcgcctccacgccgacggcccggccgccaagcccgtggtgcgcgccgtctgctgcctgctggacaacttccactttctgggtggggaggaggacgtgggggaagcaagcgacatggaggccatccaccgctacctggtcaagtgaggaggcaggggctttggaaggaggttagggattgggaaggagatacaggtgggtgctggggagggcaagggtggaagacgtgttcatatgcggcccacaccactgctcccccaggatgtggaatcaacatcgtctccgccttcctcttcacatcgacataaccaaccactttctcacaaccccctcctcccacacaccttacacccgcaaactcccacaggcaagtcatccccgacctgcgcaagcacctggtggtcaactccgagacggtgcgggccccggtggcgctggcggtggtcaaggttctgcgcctgctgccggaggacgcggcgcgcgccgagttgccgcgcgtgctgcagagtgtggcaaacctgctgtccaaaccgctgcagcgcatccgcgacgacgcgcgcgctgtgctggtctccatggcggtggagctggggcccgcctacctcccctttgtcattgacgtcatcacggtgagcagttcgaggggggggtgcccgagagggaacagaggtgatggaaatagtcgctctggcatgcgtcgccgcttgctgggttaccttgagttgctctatcagcccccaaaacactgtgaaaccaacaaactgcacaggtggcctnnnnnnnnnncgacgtcatcatggtgagcagtgcgaggggggggtgcctgagagggaacagaggtgatggaaatagtcgctctggcatgcgccgccgcttgctgggttaccttgagtagctcaatcagccccccaaacaatgtgaaaccaacaaactgcacaggtggcctgcccgctgcgaggatttgtggcgcacgtccgcggctacaccatccatgcggtggtggagggcctggcggcggcgggcgcccccgccggcagcctggacccctgcgtgcccatgctacttcccatcgtggaggcggacatgtggggcgagctggtggatgcgcgcgaggccacccacttcttgggcgcgtacaaggaggcaaagcgctgccgcgcgcaggagctgtacgcgctgatgtggcgcctggccggctttgaaacccatgcgggggagctgctggcgctggtacaccagcacctggacgacgccggcggcgccaagggccgcgctcgcatctccagcctgctggcggcgttggtccgcggcacgctggctaatgccggcgccgacgcgcgtgcgctgtgcgtctttgtctacgccacgctggaggcggggcnnnnnnnnnncgggtgcagctgccgggcatatcagcggcctggcgccgcctgcgcgcacccaccnnnnnnnnnnggggtgcagctgccgggcacaccggcggcctggcgccgcctgcgcgcacccaccnnnnnnnnnngggcgcgctggctaatgccggcgccgacgcgcgcgctgtgtgcatctttgtctacgccacgctggaggcggggctggagggcgaggagagcgcgcgcgccgcagccgaggccgccgcgggcgtgggcggggagggggcgatggaggaggcaggagatgnnnnnnnnnnnnnnnnnnnnnnnnnnnnnnnnnnnacctgccccacaccgagctcatcgtggaggcggcgctgggcgtgctggcgagcgcgctgcgccggggtaaggtggcggtgcgctcgcgcgagacggcgccgctgctggacccactgctgccgctgctggtgcgcgcgctgcgcagccggcacacgcctagtgtctcgctggcgctggccacgctgggcctgctgctgcagagcgcgctgccaggcatggaggccgcggtcccgaccgcgtatgaggtggggtggtggtgcttttctctggggatttgtatgccatccggggaggaggggggatctgcaaggtccacgggaggggtcaagcccctggcgagtgtgaaccctggctggccgggctggccggggtctgcgaggacatgctgatcagggttgagggctagaactccgccgcacgatggtcgcctggccgcagctcagacgcgtggcccgaccccttctcctccctccaccaaaactcaggaggtgacccgactgctgaacggctgccctgggaccgacacccccctggcccaggagtgcttccggctgctggcgggcctgctgcgcgccagctccaccttccagccgccacgcgccgacctgcagctgctgctgggcacccgcctgggcgacctggaggacagcgtgggcggcgccaccttcggcctgctcaaggccgtgctggcgcggcgcctggtggtgccccaggtctacgacgccatgcatcgcctggagcggctgatggtgcgcagccagggcgcgtcggtacgcgaggccagcgctgcctgcctcctgcagtacctcctggactacccgttgggcacgccgcgcctggacgcccacctgcaattcttgctgaccaacctcacctaccagcacgagacggggaggtgagagggtgtgagtgggggtggggggtggggg

SEQ ID NO: 45349 - DNA, 5135 bp, Chlorella protothecoides
  modified_base (170)..(179): a, c, t, g, unknown or other
  modified_base (235)..(244): a, c, t, g, unknown or other
  modified_base (318)..(327): a, c, t, g, unknown or other
  modified_base (1711)..(1720): a, c, t, g, unknown or other
  modified_base (2232)..(2241): a, c, t, g, unknown or other
  modified_base (2985)..(2994): a, c, t, g, unknown or other
  modified_base (3478)..(3487): a, c, t, g, unknown or other
  modified_base (3849)..(3858): a, c, t, g, unknown or other
  modified_base (3974)..(4036): a, c, t, g, unknown or other
  modified_base (4158)..(4167): a, c, t, g, unknown or other
  modified_base (4586)..(4595): a, c, t, g, unknown or other
  modified_base (4918)..(4927): a, c, t, g, unknown or other
ctctctgaggcagagtaaaacactcaattggcccagcacgttgcctcctcggccccctcccctcctcccccgtgcatgaagcgcctgatgtaatatagcccgaaaattttcgatttggcggggtttccagcttaaaaaatttcggagcataatcgaaattctccatcttnnnnnnnnnnttggcggggttttcagcttgaaaagtttcggagcataatcgaaattctccatcttnnnnnnnnnncagtcagtgccgattctcggctgtatccttgtaagcattgcaagccgccaattcacatgtgacaacctgagttnnnnnnnnnnccgttttcgtaaccctggccatggcagagaacacgtgttcatgccatctccgaagaatctcggtctacagtgctctcgtccacccctcgcccggcgaggagccccgcaccgtgtgcacttctctgcaatacaaaaggattcacgatgtagattgatctcccggacgtgcgtcgggtaaccagcaggatcgaaacaactcaggggccagcaagacgctcggttgcaccgtgaaccgcttccggtaggtaatgaaatagtattgcatggacgtgcacaagctatgatggtgggagtcagtgccgattgtcggctgtatccttgtaaggattgcaggccgccaattcacatgtgacaacctgagtttcccgcgcggatctgtccccctatgcggcaccatcttcccaaggccagtagattggcccagctatactgtaggatctgtttatgcggcggggggctacagccttgcgacatgagcagacctaagcttcattgtacaccgaccacaatgaggtacccctcctcatcagtgctctacaaattcgcctatcgcaggttcagggaacccagggtgggccgccacctgcacatgcctctccacaggcgtcagtctacactgaaacaggactgccagagtatcagcccattggtggctatgctggtgaaaccatcactcttcatgccgacgtgagcttctaccgtcggtccaatgcacggccatgatgtgatcctgctgcgctcaggtgggaggcctcacgcaaccctcccctgaaattgaagtgacacaacctgcccttgtgaccctgttgctccggttgctaccagatatcatgtcagtaacccaccgcatgagattcttactccccccaaagaggaaacagcaatgtctatgccttacacccgccccaacccccaacttatccctacacgcaggatgcgtggttaatacggcatgcatgaggagtggtttggaggttgtatctcctttctcacgatggctaattccgtgcggaagtatgttcttgtgagatggtacagcagtgtgccttgagtggcggatgtcggagatggaaaggatgcttgaacatggtgacactgcagcggagcacgctgaaggaggtcgagcagtgtggcagaaacacaaagcaccggattaacgtctgggcctgtggaaatctggaggggccagtcaacttgcagcccaaaccatgagatggccgtatggagtagtatactgtgagaccctgcgtctgctgagtgctcgccaccccgcaggtgatcactctgccataccctggagtgttgcccttgttgccagatgctgcacaaatcaagagagtgcagtatgtgcacgtatgagtgagcggccttatgtcaaccctannnnnnnnnngttgacgtctgggcctgtggagatctggaggggccagtctacttgcagcccaaaccatgagatggcagtatggagtagtatactgtgagcccctgcgtctgctgagtgctccccaccccgtaggtgatccctctgccataccctggagtgttgcccttgttgccagatgctgcacgattcaagagagtgcagaatgtgcatgtatgagtgagcggccttatgtcaaccctaccgagcacacagcagggcaataacccccagacgcaaggcagcaaaggtccagagaggccaaccaaccacgcattatgttccacagtctttcaccaacagatggacacggcccgtatacagctcgtaggaggcagttgcaggctgacagtatgagggttctcacctgaaaatgctccattttgccctggtctggacttggaggggctgttttagccctacaacaccccgaactcgcaaaaaaaatcaacagacattcaagtgcatgcatctgacgtccttgnnnnnnnnnnttggtcaggacttgaaggggctgttttagccctacaacaccccgacctcgcaaaaaaattccacaaacattcaagtgcatgcatctgacgtccttggcagcagactgcgcactttccccggcgaccccttcagagggatcgtcgagacaccaaggacgcgcgcacatactgtatgaggtatacgaaatccattcggcggcttttgacgacctgaaatgttgcatccatggtcaaagcgagttgcgtgtgttcgtggaagtcggtggcacagctcctgtgttcgtagaagtactgtcttaatttccgtcggggactctgaagcccattgatggacactgggaagccggactctcgagctcatgtggtgcctcaaattgtctcaagcagtgcaaggattcagtaggtgttctatcatgattttgcccaacatgggccctgagtaacgtcatcgtcttccactcgtgggtcacggggtcatactcgtgtatgcaccagtatgggagaatgcacgtgtatagcaatccgccccgcccgcccgccttggcagcgggaggtacgggacgcgcctcacctgttgcttcgaacgaaaagctgggcgtgtgtcagctgtgttgagtgtagcttcgtgttcggcgacaaatgcgttatgagttttacatcaacgcgatccgtcacgttttttatgcccctggtacgacgatggcggtagctgcttgccgtcacggatgtactctcatgacgggnnnnnnnnnnaatgcccctggtacgacaatggcggtagctgcttgccgtcacggacgtacgctcatgacgggtggatgcgacttcatctcatccatatttcttagagccggtcggagacaccatcaatggccattacaaaactgtagagtgtgagagctcaatgctttggtttcctcaaagagggtgccacaacgacgattcccaacgccttcgtacacttctcatgtatgacccatcatactcccatactcgacccatactgaatgtgccccagtatggcacacccgacctctatgggctcacaaactgtacaaaaaaggaggacaatgcatgtcaagcaagacagaacacaatcaatactgagaggagtcatccattccatacattgcatgccctttcccaatggctgttcttgtgcacgccttactactgatcctcatccctgctcttgccgccgcggaagtccgccctggtgagtacactacatgcatgnnnnnnnnnngccccatacacaccataccggaaggagccccagtatggcgacgaccacgttgacggggtggaaactgcatataagaggtgttgtgatcggtatcgtgcatgcttgtgcactggaacagggaagctggaataggagaaattgaggtgccagttgacatggctgtgcttgtgcacgccttcctgctgctgctcatccccgctctcgccgccgcggagatccgccctggtgagtgtgtccaatgcatcagggagagtaatgcacctgcgtaatgtcgtcaacgtgtgcaaaacacactattaccgctcgtcccctgcacaagtcgccatgcgctacacttgcagatgccgcccttcccgtgacgnnnnnnnnnncttttgccggaatatgctttatggaagggggttatgatccgacagccccatttgagtgcaagtcgttgcgggcatgtcggaaaattttccgtccgggttggctaccatgcgatctnnnnnnnnnnnnnnnnnnnnnnnnnnnnnnnnnnnnnnnnnnnnnnnnnnnnnnnnnnnnnnnatggttacccacgcatccaatcaattttaatgacatgtagagtgcagcctgatactcctagacgcctaaatgcattgccatgcgctacacttgcagatgccgctcttcccgtgacgacccgnnnnnnnnnnagtcaaagtgtgcaaaatacactattaccgctcgcaccctgcacaagtcgccatgcgctacacctgcagatgccgctcttcccgtgacgacccgcccccagtgggccaggtccctgcgcaccttcggtttcgatcactccagccagcagaccagcgatccagcctccagacagaacactgcaacagcgaaggcatccaccaacggagtcagtggcatggcctccagcgacggcacatcctccgtgtctgttcagggctctgacggttgggccaagagcgacgccactgttgcccccaccgccacgcccctggacctctccaccgcctcttcttcctctggccctcgcggcagctcctcatccatcgagtcctcttccggcagctctgtcagcaccagcaccgggggcgacggatgggcnnnnnnnnnntgcgaccagtggcccgccagctggaagaactgggagcacaagtggcccacagactggcactggagcaaacccacctcccccgccccagccccggtcgcctctccgccccgacccactcctaccccacctatccgccctcccggccccgcccccgtggattctcccagccccagctcaagcagccccccctacccggtcccagcaagccctccaaccccagcaccagccagtccccccattccaggccctgacaatccgtctgacccccagagaccagagcctgcaagcccattattgaacagtcccagaatagacattgatcnnnnnnnnnnggacacctgagcctgcaagcccaatattgaacagtcccagaatagacattgatccaaaaaacaccgatgggaacaacgaaattgccaatcaagagatgagcccaccagctgcctcagcgtctagcccttccattaaagccacccccagctcccctcctgaggactcccccagcccctaccccgaggactcccccagcccctctcccga

SEQ ID NO: 45350 - DNA, 117 bp, Chlorella protothecoides
ggctgcagactcttgaacccaaccccggtgcttgcctgctgcctggggatccacgggctccccaaccccgttcgcccaggcggcacctccccatacatgcccctggtgatgatgcgg

SEQ ID NO: 45351 - DNA, 65 bp, Chlorella protothecoides
ccactcagcacagctcctcaccttgcatcaaagatgattctgtgccggatcacctcgccgcaggt

SEQ ID NO: 45352 - DNA, 80 bp, Chlorella protothecoides
gggagcagggacatccagaacacaacggcacatgaatccaggtcggtcatggcactgggttctggtgctccctgcgacat

SEQ ID NO: 45353 - DNA, 61 bp, Chlorella protothecoides
agaaggtaccattactgtgcagcaaaggagattttcatattgcttgcacctcctgttggca

SEQ ID NO: 45354 - DNA, 86 bp, Chlorella protothecoides
ggcatggaactcccatcatcgaagcagcatgcaggcaacccggacccatgctcataccacccacatgcatgggcctggggtccgta

SEQ ID NO: 45355 - DNA, 61 bp, Chlorella protothecoides
tgctgatgcagctgcgcaagaactgcaatcaccccgacctcatcacggcggcatttgacgg

SEQ ID NO: 45356 - DNA, 215 bp, Chlorella protothecoides
tactcccacatgcttggattcagggcaatccctgtaaggacggctggcagcgggcacagcagcatggggttattgagagcccgccttcagctgcattgccagtccattcgtcatcaccaccagtgagcgaatctcgcagttgtcaaaactgcacgtattgcagggaagtgagagaagcatatctagcttgataattgtcagaatgttgtggcagc

SEQ ID NO: 45357 - DNA, 109 bp, Chlorella protothecoides
acagtgttggagatcagggccagagggcctgggccttggagcgtatggtggcagccgcagcgctgcacagccacaccaaagtcaccctcctcaacccatcaacattgac

SEQ ID NO: 45358 - DNA, 196 bp, Chlorella protothecoides
tagatgacaatgatgttggacttgacgtgcatagcagtgtacaaggaggcccagcaggttctttgcttaaggccatgtacattgcatgcccgatctgagtatgtccagcaatttcagcaaacttagtcatgcagattccctacactatggttactactgaacagtgattcaaaactacattcaactacttgagtgg

SEQ ID NO: 45359 - DNA, 99 bp, Chlorella protothecoides
tctgcatcccggtttgagcttcctcctctttcgtgagcacatcaatcatgcacaggtaacatcgctctcggtccaagtcaagctggtcaaccatgtatg

SEQ ID NO: 45360 - DNA, 61 bp, Chlorella protothecoides
tccttgcatgcgttgctgagactagtcctctcctgccataacgtcactgtgctcctccggc

SEQ ID NO: 45361 - DNA, 61 bp, Chlorella protothecoides
cgtcctctaataggtacgggccccacgtctacatgctggaggccagcagcgcggacaccct

SEQ ID NO: 45362 - DNA, 61 bp, Chlorella protothecoides
taatatagcagcaactctcgtcgaattgggttacggatgatacacccttggccacatggtg

SEQ ID NO: 45363 - DNA, 63 bp, Chlorella protothecoides
gcaaactggaacaggatgtgcgtggtggaggatatgggcgagtttcatttgcggcctgcctca

SEQ ID NO: 45364 - DNA, 14670 bp, Chlorella protothecoides
  modified_base (1173)..(1182): a, c, t, g, unknown or other
  modified_base (2227)..(2236): a, c, t, g, unknown or other
  modified_base (2439)..(2494): a, c, t, g, unknown or other
  modified_base (3022)..(3031): a, c, t, g, unknown or other
  modified_base (3223)..(3232): a, c, t, g, unknown or other
  modified_base (3647)..(3656): a, c, t, g, unknown or other
  modified_base (3739)..(3748): a, c, t, g, unknown or other
  modified_base (4170)..(4179): a, c, t, g, unknown or other
  modified_base (5216)..(5225): a, c, t, g, unknown or other
  modified_base (7666)..(7675): a, c, t, g, unknown or other
  modified_base (7889)..(7935): a, c, t, g, unknown or other
  modified_base (8061)..(8070): a, c, t, g, unknown or other
  modified_base (8926)..(8935): a, c, t, g, unknown or other
  modified_base (10240)..(10249): a, c, t, g, unknown or other
  modified_base (12853)..(12862): a, c, t, g, unknown or other
  modified_base (13277)..(13286): a, c, t, g, unknown or other
  modified_base (13481)..(13490): a, c, t, g, unknown or other
  modified_base (13542)..(13551): a, c, t, g, unknown or other
  modified_base (14128)..(14137): a, c, t, g, unknown or other
  modified_base (14438)..(14447): a, c, t, g, unknown or other
ggcgccgccgccgcccccacgccggcggcggggggcggccgccgcacatcgctggggcccacgccgcgttgcgagaagccgcggagcgaggcgccgctcaggccgccgaggaagaagcggtcggtgatgggggagggggtggccgccggcgccgggcgcaggggcaggagcaggccggcctcccccgccagggtcagggaagcggcgggccccaggggcagagcgacctgggcggcgcagcgctgcttgaagaacggtccgcgcgccgggccaccgctgtgcgttccgacctcgctggtggccgacacaccgtagcctggcgacaagtggatagggggaggggggaagcgtctgacagtgagtgagccgacggggagccatggccctgcgcggtggatccccactcctcatccctcacactcagaccgacgcagcccaccttccagggggaaggaggcctccccagaaaacgtggtgtggcggaacgtgtacttgattgcagaccggaccccttcaccaaactgctgctgcacggagcgggaggcgcggcgggccgggtcggccagccggtaccagccgatgccggcccccaccaggtggcgcccgtcctccctgcacgggacggtgggtggttgggggggggtcgtagagtgttgcagccgggtacggcgtacaaatttcgatggagaagggcgcacgctttgagtcacagaccgtcccaccccccaaacatcacccacaccatagcctcacgtcgacagggaggtctcggcacccctcagcaattccgtgaaggaggaccagcgctcaaaggaggagaactgctggtacagtcgggcggtggcgaggtacggcaggccccgcggccgcgcgcgagtcagcgccaggctgtaggtggtggtgctcctggagccccactccccgctcaggttcaggcgctccgcatggcccagaggattggtcagcgtcgcggacgcctccactgagcctggggagcatgagaaggagggagggtcgatgagacagagcagtctgggtcgctgcctgttttgcgcaggcgtgcagccgccactcctgccctgccgcgcacaagtcctgcacgggttctaggaacactctaacccccctctcccattgggcggacacatcaccctgtaccttcttggccttgcnnnnnnnnnnggtcctgcacggggtctcggaacactctacccccctctcccattgggcgtacacatcaccctgtaccttcttggccttgcacgtatgtgcctgtgtgtacttggatcggggacttttcggaaaacctcgctgtgatgctacatgcctccgggtgctgcgaatgggagaggagaacggtcatccacaaggagctgcagcacccatggaggggatgggccgacctgccgaaggccagcccacccggcagaggttccttcatactctgtatgccgcatcgctctcatgcatgatgacctatcaaagccctgagtgccactggagcatgcaggcccaccttgccatccagcccatcgatcacgatgtccacggcatcaaagatctccagcgccatgaggtcttggtaagcagccaccaccgcgtccttgatctcgtccagggtctgggcgttcttcacgcgcagcagctcacgcatcaccaggtgcttgttggtgcgcttgaggcccaggatggtcagccgagcggggaagcaggccgagtccttgagccgttcgaagctagactcgaagtcgtagtcggggacgaacccctcctcgctgccgcttgacgagggaaactcctccatactgaggacaatggatcaacgactttacaatgtgggctgtgcaagcacacagtacgggaccaaacccaatactagtgcgtctctccctgcgtgatccccagccgtgcaggcccgaggccagggggacgagggggaaggaccctttgaatgcgccctgatctggtatacaaacggaagactcatggtccgatttgcatgctgttgcacagcgcatcgatcatcgtggcgcttcacatgcggtgcgtgcggtggctcgtcgatcctccctctccacaattgtagaacaaagcaggtgtgccatcgaaatacagcaaccggggctggtgcagtgcttgtcaggtcggtttgtgatgtcatgggtcacgccaaagggttggggatgaggcgtccgtagctgaaagcggaccttgtcatgctatgcannnnnnnnnnagttggggatgaggcgttcgcagctgaaagcggaccttgtcatgctatgcacaggtccatgagatcaagcacagtctttatgcggtacgcctccatgtctgcctgtgtgaaggtcatggcctcccctcgaccctgtttatattggaggggcgggcaatgatctatcattgggctgtcaggtctgctgcagtatatcagggacnnnnnnnnnnnnnnnnnnnnnnnnnnnnnnnnnnnnnnnnnnnnnnnnnnnnnnnngggcctccaaatggagacacagcttccttccgatatgccagacccccttcctcgtcaattttcatatctgcatccctcgggcaccgaatcttcaccacccacacccacctcgaaatctgcaaactgcagcaagaacatgccgcagtcgtacccattgtactgctgcgggacggtcttcgggaactttctgggccacttgagcacatcggcacgctggacagcggtaggaggtatggggagagtaaactaatatcggacgctgcaccatgctctcccttccatggctcgcccagcgccaagcataggcacacactcacgaatacccactaacctcctcctttcttttgtccttgaactcatcgcgcagccattttgccagggcctcgaggcacccctcatcctcgccctgaggaggaatgggagggcgaggcagggtacagctgtgcttgggttattggtaagctctaagtccgaattctgagagccaagcgaggtgatgggaggcacagctgaccgcctcctgagcgnnnnnnnnnncgtaagctctgagtccgaattctgagcgccaagcgaggtggtgggaggcacagctgaccgcctcctgagcggaaataatatcccagctgattggctgctgcaggcaggcttgcgtccccgagcgaagccagcagcactcctcttcaccctcctcccttcccccctccgccctcccgctctccatggcccctnnnnnnnnnnccaggcttgcgtccccgagcaaagccagcagcgctcctcttcaccctcctcccttcctccctccgccctcccgctctccatggcccctgagggcatgtgcagggcgcacagcccgctcggcgcaccttgagggcatccaggtacctcagttcctggtttctcaggtccaccacggcgcacacccagtgcatgccctggtgaaccggcaccacgatgcgatcgcagtccaacaggcaggggctggcctgtcccgccgccgccagtcgcttgggggtcgtccagcggcgcacctggcgtgtttggagtggcattggtgagggcatgagcagggtgcatgctaaccaagcaagcgctggtcaggcatctgccgacaggaagttcaccagcccgcccacgaacgtgaggttcaggggcnnnnnnnnnngagaaggcccacatcactgaggagcaccaacctgtgcgtagctgtaccctccgtccttgtacagcttgttgcagaaaaaggtnnnnnnnnnnacatgctaaccaagcaagcgctggtcaggcacctgccgacaggaagttcagtagcccgcccacgaacgtgaggttcaggggcgggacacactgtcaggacccagccatggcgcgtgcccagcaagctcccgtcattcaagaaagcccgcatcactggggagcaccaacctgtgcgtaggtgtaccctctgtccttgtacagcttgttgcagaaaaaggtgctgaagaagtgggtcttcggccacgacttctgcgggtgaggcgaggcggcaagggtgttgacctggaggagcggcgagtgttccaaccccgccaggcacagcacttgccccacagcttcaaagcagttgcatgcagtgccctcaatgccccgcagcctgtatctgcccaccaaaggccgacctgggctttgcgggccgaggnnnnnnnnnngaagggtgttgacctggaggagcagcaagtattccaaccccgccaggcgcagcacttgccccacagcttcaaagcagttgcatgcagtgctctcagtgccccgcagcctgcatctgcccacaaaaggccgacctgggctttgcgggccgaggtgtccctctcttgcagcagcgtcattgtcaggttgatgacctcatcgttcagccaggcgccggggcccaaggtggccacgtcgtgcctcgtcagcgtaatgttgctcccagtatgctccaccagcttgtccgacgcggcgcctgcagggctcacggaatgtccagggtgggccatgcctagggccggaaagccggcatggccatggcaaccctgaggcttgcgtctggaggtgacacacgagtgcactcatgcctgcacgaccaccctgcaaccagcccactcaccgccctgcaccagggccttgtactttgctttggcgccgggggggagggaaatggacggcctgtgcacaggaggggtggcagcagttggggcctcctcaatgcttggccgtggtttacaatccacacggatccagagctgatctgggcaccaggccctcgagacactcaccgtacgctggtggaaggtttcggttccaatcgctgcagcacatgcagatgaggcgtgcagggtgctctgagagcacgcgacattgcagaaggcggtacaagcagctcatgcacatctcaagggcaactgaaacagtctgcgggtgggagctacggcatgcacatcactcgcaaggctcaccttgaggcgctcttgttctaggcgatccagttcctccttgatctgacccgggtgagacgatcatggtcagcaggagcaggaataagccgtcccactgccaaggcagggatgccaggagcccatccaccatcagattcgtcacaggaagttgccagatgcacaccgtctgtgattcccaggcccttgatccacctcaaaagacaaatccatgctgaggcactgctcaccctgagcatttctgagcgcaagtnnnnnnnnnncctgtgattcccaggcccttgatccaccccaaacgacaaatccatgctgaggcattgctcaccctgagcatttctgagcgcaagtcttgccatgaaggcttctccttggcttccaggatgctgtcagctttttcaagcagcgcctgcccggcctctgctgtctccttggccagccgactgctggccgagggttgtcgctcaggctcatcaacagcttcgtctgacctaggcgcgtgatgcttacgccctgctgcaggctggggctcatcgtctccagcctcagacagccattgccgcaggggcgccagcagggcatgccccgtggcgtggggcgcagacaatgtggccccggaggacgatgcggcggcatcaggctcaccccatggatccacgccgcgatggagccgctgcgcgtagcccggcttcccagcggccggcggcgaagggccggcctcatcctcgccggtgaggtcgatggtgaactgcggcgactgcacgtgcctagtctgcaagggttgaatgggggggacaggctcgatgtgtaccgctgaggtgagtctgcgtaccatatgacgcctcgccactgggcaatccgcgccgtcccatgcagctggggcgaggtgcatgccttggggcgccggctcaccatcctctccaccctctggtagagctcgacgcctcgtttgagaaggtctcgttcctgccggcccgtctcccagaatggaatgacgcggggcggtggttcagcaggacacactgagtctgggcctcgacctggctccagatcgtgttgcaatgaccagggtcctcgacgcttctgcaggagagtgggaggcgcatgcgaccttctgaccatgcaattgcaacctgggagccgcttaagaagtacttgctgccctcaaggtcgactgaacaccagggtttcttcctgcaacattctggccacagtgcccaacctgggagagtgtgtcggcagcagcaaacagctgccgggcagaggggcgatggtacctgctccgcaacagattacgtccagggaagggtgaaaatcctggcccgggagattgcgcccgttgggtgccgggggatgcagggatcagacgggcacgcttcgaggccacgacgtctttgctggcagtgaagggtcccgtcggctcgttggcaaagtccagtcgctgcacgggatctaagggcctcgaaggaccattggaggctcggcagggtgtatcctcagcgaaggccttacgcttcacgccagtggcgcctgcatccctcaggtattgcaccgtcttctccaggaagttcatggcagggcacgccggggcatctcagggcatctccaaccccttgacgttccatgcgttgtgtgatcatgggccgcagtgggtgccatgaaggctgggcgattgccagcctgctcccgcgactttaaaacctggcgaagaaaggccagcgcacgcgacgacacttttgcgacttgttaggaggtgtacgccggtatggcacagtgcatcaaggatttcacgcagtttaaagtgtatgtacacatatatctgaccagcagggctacctgcgggagttgagaaagttcaccactgccaaccttgcagatgtccaaccagccagaccgatacgagaagtttgtggttcctgatggagttaagaagtaagtggcgattttttggagtgcttcttgaaggtagatagctctgcagaaagatcactctgcctctacccaatgtattcctcgtccccagggttgcctttgagcgagacaccaagattgccaacgcggggaccttcactgtacaacgagaggaccacaccatcggtaacatgatccgaacgtgagtcttgcggaagtcaagggcctgcgctggccaccttgatccccccggaatatttccccgtgctctgagctccaactcgccttctctatgctaccaggcacctccacgaggacccacatgtcatcttctccggctataagattccccatccattggagtatcgcatgctcatcaaggtatgcttgagtgagaatgtcttgctgggagatcagagcatgctatctcatgggacaggagtgaggctgagatcacacccgcctccaccttgctcccgcaggtgcagacggatggtcgggaaacaccggtggccgccactcaaaaggcagtcgacaagctcgtggagaaggtccgatccatccgagaacaatttgtggtaggtagtggcggacgtctgcggaggaagacagtgaggaggatcagccatacatgcttgatatgcaccagacgctggataggttacattgccctgagtttcctcacacgtcgtgaattgcaccccatggagcaggcggaggtgagcaggcaagaccgaccgaacgacgggaggggctactgacagacctgagcagcaaataccaccattcacagccnnnnnnnnnnccgtgaattgcaccccacggagcaggcggaggtgagcaggcaagaccggccgaacgacgggaggggctactgacaggcctgagcagcaaataccaccattcacagcccaaggttcctgcaagggactttgtcctccagacggcgacgagctctacaggcacagcagtgtggacgcctgcggttgaacttgctctgcaaaggaccatgatgcagnnnnnnnnnnnnnnnnnnnnnnnnnnnnnnnnnnnnnnnnnnnnnnngtggccccacccctccctgctaagagggccaggactttggagagtccactctggaagcagcagtggctctgaacaacaggagaagctttttacacgcaccagccttgaattctcgtgtgacggggnnnnnnnnnnttggccccaccccgccctgccaagagggccaggactttggagattccactctgaatgcagcagtggctctgaacaataggagaagctttttacatgcaccagccttgaattctcgtgtgacggggatggtgcatgttcttctgcaagtctcagtgccatgcagcgaaacgagcgggcacccgtgccagcaaatgtggcttgcaggcttggcccttctttgtacagtgcgttatatgatgagcgaaagggaaaagcaagtaggagctccgttcttgcttcaagcagcatccatgagagcatgcgtcagcgccacaggggtcagcttgctcgcgctcagttcatgtgcggcaggtcccagctcgcctaccaacacatcaaactcgcgtttgatgtcacgcagggcacactggccgcgttttctcagtgactccagcaacttcaccatggacctgagggtgcgagaggtactggcgagtgaggtggcaagctgctgggtccctggaatcgttaccctatcaatagtggcgcacattatcaggagagccacagttcacaactacttcaattccccacggacctgagatcctggttttccttctccagctttgagagcttggacttgagacccgcaagctcggcgtctgcagcggatgctggtgctgatcagaggcgcggataggtaagcatttggtagtttcacacaatgccagcctcctattacgggcgaatggctcacatgaaaacccacagcctcatgtctttctcaaattccctcacatccccttcgtgccagacccaacccaccactgtcaggaggctttgaaattgacgaggcggtatgtgagtctcttagcannnnnnnnnngaacccctagcctcatgtctttctcaaattccctcccatccctttcgtgccagacccaacccaccactctcaggaggctttgaagttgacgaggcggtatgtgagtctcttagcagcccttctagtgcggccagactcaaatctgtccgcagggagcagaggggaggggcgctgagttccctaagcgcattcgaatgagaaggcggtgtggccccgaccgcaggcctctgagcaagcgtcagaccccttttcagcagagcgcaaagctccaatcagaaggcacaagctcaccggagccctggacatctatggcaacacgtctgcaactcggcgggatctgaccggagcttggaagctcatggaggccatacaaggtgagcctgcctacggagacgcccaacttttgtgagcaggccttcctcgccgcgatagtctcggtggctggcaagcagaacgccgaggaaatgacatcaaactggatggggcgggatgtcgtgggctggggcagatgtgcccccctgggacctcggtcgtcgaggagaccctgcagcctgagggagggcagaccaaatgagggtcgagccaggcactctggctgttcatccaggctcctgggtgtggattcgtaagacgagctgccagcgtcgctctctgactccgaggcactggcatctcgcagattgcccggctccccgtcttccgccatcatcgccggatctggggtgcggcctgtgaccggcctgctgcaaatttaaatgcaaagagcatgcaggtgcggtgccccgatctggtcctgggaggggggccgctgggaactgtgtcggacaaaactgaaatcttatggctggaaaccaggaaatgatcagattggagcctgctgactccctgcatggtacacgaggtcggcgatagatcacggaacagccccctagaaaagcgaaacattgatcactccgtttttcaacactgttttatgccatggcagctatgatggcgacatcgtcatgtgttggggcgacgcatgtggcctttgctgcccccatgcgcatgagcggccatgcacagaacccatactcgacccgagcccctgctgtgaagggatttgcgaggagctccacctaccctcgccgctgcattgcattgcaagccgtagcagcgcagaagtccaagtccaccgatgtgcagcagcgagctgctgacgccccaaccccagagaagattgtcgaggtactttttggttccgtgggccgctgtgctggcacatgaattttttggataggattatgcaaggaggagagcccttgnnnnnnnnnnatttggttcagtgggccgctgtgctggcacatgattttttgataggattatgcaaggaggagagcccttgcaggcactccaggccctctgccctcggtgcacacatctggcagtgcaggggaaaatcaaactgtactgtgcctctggccatccccgcttaccccaccccacccctcaaccgtgccagggcgattggtatgccctggtggccagcgcagagttcttcttccgtggcgcccagaatgaggccctcccagagcagctgcgggaactgaagcgctactacgacgaaaaggggagggggcaggacttttacatcgtgtcccagccgcattggctggatgccaaatttccaaacgaggcgaagaaagtgcggcggccggccgccgcgctcatcagcacagacaaggcctggatcacgtgagtctggctgggtgggtaagcacggccttctgtgttgtgtcgaaacacatgttgactcatggtgctagcgtccataccctggacggcatcctgaactgtcaggccttctgaatctgtcacttgcctcatgcgtcatgggtgctgggacgatgctcaaaaaagccagcaacccccttgctccgcccttctgagaccaggttcatgaagctgcggctggaccgtgtcctgcagatccacctgggccagatgcatgctgacgaggcctgtgcttccgacggcccagtgccagagttcaagatcaaggattcggagtggaccgccccctacaccccctatgcccccggctggtggcatgcgttcgagcacaaggcctgaagcaaggaactgtagctggatcctgcatgcaatgcgctgtgtcccaaagacatttgcatggctctggaccactgcctgggtctgtcctggccctgttgcgttccactgatgctctgcgcgtagcccataagactatttggagcaattaaaccttgttcagcgcaaaggagcagattctgagggggaggaggaagcgagatataggattgcaaagtcctcagcctggcttctcaggctggtgcatcttggctgtcgggcccctttggcagtgaaaccggctttgatgccccagacaagccctcctgtgacctgtcaaaggtcgcacccagtttctctgccactcgcacagcccacgcctgtgaagggagggcgcatgggggtggcatgctcaacaggccgacgcatctgcagctgtctgccatccgacgttcacgccgtcgcccatccgcaaggtctttcaccagggtgccccacagcccaaaagtgagcatgccaaaccatccccaggccctcaccttgtccaggctcgagaagccgcgctggcgattgctggccaggagcatgaccccctccctccccatcggctggatgagcaagctctggatattcggagggaggagcctcgcaaactcgattcgacctgagggcgggatggaaagagcgcctgagccggcagggtgtggccggcgtcgcgtttgccccggagccaatgctcctgcaaagccacgcaccgccaggcgcatgtcgcgagagcatgcagctgtgcggtggaggtccaaaccgaaccacattgatgcaaagaaggaggaggatggccacccctttctgtgacagggtcgcatttgcttgtggcaggcaccagtgcattgtcaatccagcaaggcttggagcatcctacctgggaagaggggaaggttggagatgctgttggccgtctcacgtgccatcgcatccgagagcagcggccccggcgccacagagacgtcaagctcctgcgccaccacgccctggatggccagccaccctccgcgccagagtgccacggtcttgacccggtctgttgccaagaatgcagcgcaggccctgcacagtgcagagaaggagcggcactcttgctggtggctggcatcgctgcgtgtggatgcttggcattcaaaccgaatgaatgagctcattccctgggcatgtgtcatcattcccagccatcttgcccagggactgcccatgtaaaaaacgattgcagaggctgccagggcacccaccattgcagctcatcaaggacaggcgtgggaacactggtgtcccagtgtgcgaaatcactgcggccgaccaagtccacggcctcgggctcccggggactgatgaccagccactgcacccccaccaccaggagcgtgatggagaggacgaggagcaggactccggtgcgcgactgggcagaagccgcactcaagctgggactgtcctgtggaggtcggaggggagtgtgcagggagcgtgccggcggctgcgtgcaaaatcactgcatttcatgcacacatacaagagcatgcacggaagccctcctctggcccctccactggcgcacggtgttcagtagcctgtccgcgacgatgctcatgaggcccaggctgccagctgctatcggcaggtatcgagctgcagggctggcctgtgtctagagaatttgcagccaccagatggtgatggtgcccgcactatcgggtgtgcatcacgtaaccctcacacaggtctcacatacctgcccattggcatgcgtagtgactctttccctccttgcatggnnnnnnnnnnggagaatttgcagccaacagatggtgatggtgcccgcattatcgggtgtgcatcacggaaccctcacacaggtctcacatacctgcccgttggcttgcgtagtgactctttccctccttgcatggaggacggagggcctcgcagagagtatgatgggtcgtacatggattggaagccaccgcccgagtggaattccatggccggaaaagactgctcgtggatgcaaaaaacgagcgtgtaccgccatctaaaccatttccagattgtgggtaacagtgagtgcctgcaccgggtgtgaatgatatgacatcccttccgctccgccggaacgcgacatctttacatgtgcccccgatcatacaccaacagcccccacgccctcccggcgatggatatgacaaaagtcgtgcagcannnnnnnnnnagtgcaaaaaaggagcgtgtatcgccatctaaaccatttctagattgtgggtagaagtgagtgcctgcaccgggtgtgtataatatgacatcccttccgctccgccggaacgcgacatcttcacatgggccccgatcatgcaccaacagcccccacgccctcctggcgatggatatgacaaaagtcgtgcagcannnnnnnnnnatatgataggtcgtgaacgggttggaagccaccgcccgagtggaattccatnnnnnnnnnncaatataatgatgcaacaaaaggagtgaacttgctgtgttacacattgactctctcacactcgggtgaggagacgggccagggaccttgttcccattccggatatccttgcccctcccggctgcagggccctctgacgacacccgaccatggtaagagcaatcatggactgacatgcgtctcgagcttcccatccgtatccgcgctgcggtgcctggggccgaattccgggctgctgcctacctccgagcagcctgcttctaccagtacaactgtaccaactatgcgcagcgggtgcggggcagaacctgatggttgtgtgcagggacggaaactcatgacagcgtggcggctgtgtggtgtgctgcacacctgggttccacagctggtgtcaggccatgaaagggtttggtggcacctttccttccaccatttccctccactcaggccaccccaccccacccaccacaacaacacacaggcccacctgcgcaacaagaccacggcgacatgggagtccctggagacacgcgtggctggcaaggatgaggactaccgcggcgtggtggtgctgcccnnnnnnnnnnctgggagtcccttgagacgcgcgtggctggcaaggacgaggactaccgcggcgtggtggtgctgcccttcatcgccaccgtggcgcgccagccacccgactcgcccagcgcccagctgatccaggagctcttcgacgacctcatcgaccgctccgtccagctcccgggcctggtgcgcagtgggcctttgattcctctgctgcgagtctgcttgccgaagggtgtcgcgagaggtcctcggttccaggtggtggtggtcgtggacagggccccccccacgccctgcgaccccatcaacccnnnnnnnnnntggttctaggtggtggtggtcgtccacagggcccccccacgccctgcgaccccatcaaccctggtcacccaccgcccccacccaggcccacggcgaggaggagctggtggtgggcagcctggacgtgaaccagggcctgagcctgccctccgaggacctggtggggcagctgccgcacgaccccggctgcggcgacgcggcggggcgcgccgccgccgcgcgc

SEQ ID NO: 45365 - DNA, 61 bp, Chlorella protothecoides
acagtccgattggttgtcagtgcggcacctgcagggcattccatattgttactccaactgt

SEQ ID NO: 45366 - DNA, 61 bp, Chlorella protothecoides
ccgccgtcgcgccgctggagaacaacgtggtccccgccgcacccaccgcggggtcggtgcc

SEQ ID NO: 45367 - DNA, 61 bp, Chlorella protothecoides
tcggtcatggccgccgtgtatggctgcaggtgagggctgctgtgaattcaagggagggaag

SEQ ID NO: 45368 - DNA, 83 bp, Chlorella protothecoides
gttgccagaaggttctgaagtgtcggccactgaactgctcgagagcatggatgtgtggctgcgcttgcatggagtgttgagct

SEQ ID NO: 45369 - DNA, 73 bp, Chlorella protothecoides
tgtctaaaatgtgtgtggcagcatgcaattcgagctatttgggaagcagggcgaaggtttggaatgggtttct

SEQ ID NO: 45370 - DNA, 142 bp, Chlorella protothecoides
atgatcttatgaccgcttccacatacctcccatccatttccgccacattgaaatgtcattccccgctaggcatctcggaaaatggagaacaccgaatgactgcatgcacctagttatcaagctgcccgccctcccactcacc

SEQ ID NO: 45371 - DNA, 70 bp, Chlorella protothecoides
gtgaaaatttaatataacaataaatagatcgagatatttgtttataatttgttaacgtaccaccaatcca

SEQ ID NO: 45372 - DNA, 61 bp, Chlorella protothecoides
gttaacagtcgggagaggagtggcattaacaccatccttcatgaacttaatccactgttca

SEQ ID NO: 45373 - DNA, 62 bp, Chlorella protothecoides
tgcttgaatgctctctttttgtccttggcgcacaggttgctggagatcccaggcgcccgaac

SEQ ID NO: 45374 - DNA, 61 bp, Chlorella protothecoides
ccttctcggagcgtcggtgtcccagaggggtgcgtagggttgagctgctgggttgcacaaa

SEQ ID NO: 45375 - DNA, 61 bp, Chlorella protothecoides
ggcatgctgtgggcttggagcctccgcagacgtcgaggcggtgccattggtggtgctggac

SEQ ID NO: 45376 - DNA, 61 bp, Chlorella protothecoides
tgcgcagcgcgtgagcgcatcattggctggtaccacaccggccccaggctgcgcgagtctg

SEQ ID NO: 45377 - DNA, 61 bp, Chlorella protothecoides
atgcacccctggacctgcccacctcttgggttcccatgacagatgcacacactcactctgt

SEQ ID NO: 45378 - DNA, 124 bp, Chlorella protothecoides
aatgaccttccggttcccagtcttgttgaagcagcgattgcccttgccaatgttgttgttgccccagttggcggggcccacgtctgagttacctgccagggcagcaagaactcatttctgagcc

SEQ ID NO: 45379 - DNA, 61 bp, Chlorella protothecoides
gtcgagtgccagacggtaggcccgtcagggtccagaagagcaggtacaagagggctatgca

SEQ ID NO: 45380 - DNA, 36059 bp, Chlorella protothecoides
  modified_base (669)..(678): a, c, t, g, unknown or other
  modified_base (1874)..(1883): a, c, t, g, unknown or other
  modified_base (2336)..(2345): a, c, t, g, unknown or other
  modified_base (2506)..(2515): a, c, t, g, unknown or other
  modified_base (3588)..(3597): a, c, t, g, unknown or other
  modified_base (4853)..(4862): a, c, t, g, unknown or other
  modified_base (5010)..(5019): a, c, t, g, unknown or other
  modified_base (5109)..(5118): a, c, t, g, unknown or other
  modified_base (6885)..(6926): a, c, t, g, unknown or other
  modified_base (7005)..(7014): a, c, t, g, unknown or other
  modified_base (7245)..(7254): a, c, t, g, unknown or other
  modified_base (7554)..(7563): a, c, t, g, unknown or other
  modified_base (8911)..(8920): a, c, t, g, unknown or other
  modified_base (9550)..(9559): a, c, t, g, unknown or other
  modified_base (10259)..(10268): a, c, t, g, unknown or other
  modified_base (11555)..(11564): a, c, t, g, unknown or other
  modified_base (11800)..(11809): a, c, t, g, unknown or other
  modified_base (12454)..(12463): a, c, t, g, unknown or other
  modified_base (13209)..(13218): a, c, t, g, unknown or other
  modified_base (13286)..(13295): a, c, t, g, unknown or other
  modified_base (13949)..(13958): a, c, t, g, unknown or other
  modified_base (14324)..(14377): a, c, t, g, unknown or other
  modified_base (14542)..(14551): a, c, t, g, unknown or other
  modified_base (14644)..(14653): a, c, t, g, unknown or other
  modified_base (14746)..(14875): a, c, t, g, unknown or other
  modified_base (16639)..(16648): a, c, t, g, unknown or other
  modified_base (17676)..(17685): a, c, t, g, unknown or other
  modified_base (18422)..(18431): a, c, t, g, unknown or other
  modified_base (19263)..(19272): a, c, t, g, unknown or other
  modified_base (19969)..(19978): a, c, t, g, unknown or other
  modified_base (21227)..(21389): a, c, t, g, unknown or other
  modified_base (22002)..(22011): a, c, t, g, unknown or other
  modified_base (22702)..(22711): a, c, t, g, unknown or other
  modified_base (22882)..(22891): a, c, t, g, unknown or other
  modified_base (23325)..(23334): a, c, t, g, unknown or other
  modified_base (23595)..(23604): a, c, t, g, unknown or other
  modified_base (24855)..(24864): a, c, t, g, unknown or other
  modified_base (26895)..(26904): a, c, t, g, unknown or other
  modified_base (28042)..(28051): a, c, t, g, unknown or other
  modified_base (28254)..(28263): a, c, t, g, unknown or other
  modified_base (29477)..(29486): a, c, t, g, unknown or other
  modified_base (29609)..(29618): a, c, t, g, unknown or other
  modified_base (29718)..(29727): a, c, t, g, unknown or other
  modified_base (29973)..(29982): a, c, t, g, unknown or other
  modified_base (30324)..(30333): a, c, t, g, unknown or other
  modified_base (30491)..(30500): a, c, t, g, unknown or other
  modified_base (31070)..(31079): a, c, t, g, unknown or other
  modified_base (31269)..(31278): a, c, t, g, unknown or other
  modified_base (32779)..(32788): a, c, t, g, unknown or other
  modified_base (33055)..(33064): a, c, t, g, unknown or other
  modified_base (33296)..(33305): a, c, t, g, unknown or other
  modified_base (34249)..(34258): a, c, t, g, unknown or other
  modified_base (34863)..(34872): a, c, t, g, unknown or other
caggcgagccttgagctctgttagcacaccggggggggcggaccagtatacctctaagactctcccaagaaacaccgtcattctccccccctctcccccccccccctttaacccagccacacctgtcgtctgcctcatcaaagcgggcacagaggtggatgttgtccgaggaggtgatgggatgcccgcccgaggcccggatcctcagacccttggagtccagcatcaggtcgtacatgctggccgcaagcctgaatggtgagggaaccggggtcgtattggggtgggtgcccgagtgtggccaagctgtgcaccattcattcatgccgccctcacagacaggcagggctgaaagtgaaagcattccacccctccacagcccaccacctacctgccgtccaggtacagactgtaccccagggagttgttggggtgggtggaaaccgtgatcatgtgccagttgccgtcgttaacgtctacaagggaaatggaggaattggagggagagggctgcataagaagagtggcacggctcctgcagccctggatccaatctacacgcccttgcaccttccaggacaagatcctgacccgacacatttaccccccaaccccggcccccactccccgtcgacactccccacgacgcactctgggctggactggagnnnnnnnnnngtcctgacccgagatatttaccccccaaccccggcccccacgacgcactctgggctggactggaggtgttgcgcgcctcattgtcattgacgtgcccgtccgaatccaggtagttggcggagttgccggtggggtcgccggtgccatccaccaccatcacccgcaccaatcccgaggcgggatgctccgaatcaggcaggtagatgccgatctgagggggaggtggttggggatttggaagtatgggcaggggttcaggggtggcaagggcgtgggtttgaaggcgggagtaaagatgtccgatggaaagcagtatcactccaaggaacaccagccctgccagtccagcccgccgactgctcaccgagttgggctgggccaccagggaggagggggtggaagcctgggagaagaggtactggtactgagtgcccgtgaggttggcgttgccgggccggcgcatccacaggttgatggtgaaggagccgttggtggcagcaaagggcacattggacagggtgatggagtccgagtcggcctgtgtgtgcgtgcatggaggggtcaggctcatgaagcgtgctcaccggcaagaacggtggcgccatcacagcaggcggggtcgtgccggccaaagcacatggcagcgtggagtggaagatccagctttccccccttccccatcccaccaaacccctcaggcacaagcgcacaaacaagagtagagctcaccctcatgcagtctgggacagacccaaaattggtgtcgttggcccagcgcagctgcaccggcccggcgctgctgccgttgtacagcggcagggtcagcgtctccaggccgccgccggtgagcgggtagaaagcgaggggcgccatgtcttccccccgcaggatggcaggcaggtcgaaggtgcccccctgcggcgagtcgtggcagtagcccaggccgtccagcgccgtcgtgttctgtggtgcgaaagaggggatttcctttggaggatggggagagtcgtggggagactggttgggacaagacaacagtgccgacgtggacgtgcagggcgggggaacgaagctgcaacaagaaaagcaggcaatgatgccgaggagcactggggccaatgcctggctgggcctgccagcaccaggcaagccctcccccgggcttcacaagactcaaaccctcccagggcagcacnnnnnnnnnngagcaggcaatggcgccgaggagtgccggggccaacgcctggctgggcctgccagcaccgggcaagacctctcccgggctccacaagactcaaaccctcccagggcagcacaggggccccaatcccctgcgccccggcccattcaagcctcaccagctggggcagaggcacgcacaccaggtcctccaggcagccctgattctcattggcgttgtcggcggggtccacatggcacagctggttcaccctgcccctcgccgtgcgcgccagggtcacagaggcgtcaaagacggtgggcgcggcacgggacagcggatcgcaggtggcccagctggagttggcgatggggcagatctccacattggagctctccgtggcgtactgcacgcagtcgaagaagacgtagccgctgcgtagggttagggttgtttggaggggggggggggggggggnnnnnnnnnnggggtgagaggcgtgcatggtaagacgttcgcatgtaaggatggagtgagagctggactgccagaagacccaactcaacacatgtgcaggccctgcaagtcgggatgccggacaaaatcccccccccccaagtcaagcgccagctgccacactgacttgannnnnnnnnncgccagaagacccaactcaacccatgtgggggccctgcaagtaaagatgccggacagaatcctccccccccagtcaagcgccagctgccacactgacttgaggacggcggggaggaggcaggcatcgccgcccacggtgttgcggctggcgacgtgcagcaggccctgctcctccatgggctggtcatcgccggaaagcgcacacgccttccaggcgccgctgttggtcaggcacgaccaggtgccgttgcgctgcacgcagtcgtccaacaggtctccctgcagagcgggggggtggatggagggaggaaaggtgaggaggttggggccaattgggtggcacttgagagggcccatcaccgggattccggcgtctgtaccagcacatgtcatgcttctcaccctcccagtgcaggtgcctgtgcacggtggagaatcgatgcatgtgatcccccctccctgggcccacactcgcccaacccacacaagcaactcacgtcctggacggtgggcaggatgcacatgtcgccgtccgtgctccaccggttctggatggggatgatggggacgggcacgacggaggcattcacagacccgactgcccccgagggcgggacgaaggtggtgttggcgcaggaagcccagccctggaccccctcggtccagcaccatgatcctcctgggttgcgggtagaaagggggaagggcttgggtgggagatgagggggtgctgcaggctgagcaggaacagggcatggacctatggccagggcccatcgcacttgacagcacacaactacggcccggctcacctcccatggacacgcagttgtcgatggcaatgccgcggtagttcaggggcagctggcacgcctgcccgctggcagaaaggacggcacggggtttgagggcggcggtggtggtggacgctgaggcaggggagggggaggtagagggggacagcggcgcgcaggtgtcccacacgccagaggatgtctgcggcaaggggatgttgaaaggttggaagtgggagggcataggaggggagaggagactgccctagaccaggatgnnnnnnnnnnattggaaggttggaggtgggagggcatgggcggggagaggagactgccctagaccaggatggggcatgtgccttccagcatggtctgggtatcccttggacatgctcaggaaatcatgtcttgcagccagggcgcacaccatctcacaacctagaacgtttgatcattccgtcctccgattctcatccgcacctcccaaccacaaccagcaccgcacctggcagacggggacgccgttgaggctgacgcaatcggtgaccagggagccctggaaggtggccgggaactggcaccgctcccccgcctgtgtcatgcgctgcacgcccgcggagtcggcgctcgcggcggggctggcggcggcggcgggggaggacacgctcacccctgcgcactcctcccactgccggccctccacctggcagtaggccacgcccgcgatctgcacgcactcggtcaccacgttgccctggtacagggcggggaagacgcagacgttgcccttgaccgtggtctgggactggttggaggtggcattggtccccgcgccggggagggagatgatggtggactcggtggccggcgcggcggcggcccccgcggcgtccgcggcgcgcagggcgggcagtacggcgaggtacagcgcgtccacctggtcctcggtcagcgcgacgtcgtacagtcccaggttggccagccgcccgtcgaactggcgggaggtggggtcgtcggcgcgcgtgcacaggaccgcgttggggtagaggtccatgggcaggccggcggtggcgcccacgacgtcgcccaggctggacaccgcggtctgccccgcccgaatctcgttcaccagcaggccgtcgaggtagaggcggaagcccttgcgcccggggggcatagtggtgaccgtcagcatgtgccagccgccgtccagggctgcactgggcgccgcgcgcgccgagttgttggacacgtagccgtcggagtcgagccaggtctggtcctgcgggccgtcgtaggtgtcattggagtcgcgggcgtaggcgcgcaccacgccgtaggccgggtgctggcgctgcgggaagtagatctggatctgcagggcggggcagggttttttggggcgtgggtggcgggggaggtgtaatcagtgggtgggctgagttgggtgtgcacacacatggggggaggggagatgaagcgagagatgtggcgcaggagggaggcaggccgatgatgggccgatgcatccccacgcattcacnnnnnnnnnngtttcggtgtgggtggcatgggaggcgtaatcaatgggtgggctgagttgggtgtgcacacacatgaggggaggggagatgaagcgagagatttggcgcaggaggaaggcaggccggtgatgggccgatgcatccccacgcattcacnnnnnnnnnngcagcccctccaccctgacacccccgccccttgctgatgcatgggcctctgtcctcaggaccccagcccacctggttgggcccccacccnnnnnnnnnnactctgagagcgacgtactgagaggaaggggctggaggctgacccccaaacctcagctttcacaaccgcagacacgcacagaaaccaccagcccctccaccccgacacccccgccccttgctgatgcatgggactctgtcctcagaaccccagcccacctggttgggcccccaccccgagttgctcaggttgttgaccgcgcccatctgggagaagatgtaggagaactcgccgccggtcaggttggtcacctgcatccacacgttcacgctcagcgagccgttggtggtgtagttgggcgtggccagccccaccaggtccgcctgctgcccgtcgcagcgcagcgcggcaccgaacaccgggtcggtgaccacccccgcgccggagttgacgccggcgtacaggggcagggggaagctctgcagggtctgggagttgagtgggtagaagacggcgggcagcggcgcggcggcggggtcgggcaggcggtagccgtcgggcgcgtaggcgcagaccccgatgcggccctccggcagccgcgcgtagacggggaggaagcgctccagctgggcgcgcggcagcggcgcgcagacgtagcccgcgtagcaggcggtcaggctgctcagccccgccacgctgccgttgggcgtgcacacgggctggccctgcaccaccgccaccgccgcggtgaggggcggggagacagccgcaggggggccgggcgcggcggcgacggtcgtcgccgggctggcggtcgccgggctggcgggaggtgcggccaggtacgtggccccggcgctgtacaggctggcccagtccgcggccgtcagcgactggttccagaccatgagctgggtgagctggccggtgaagaagcgctcggcgtccaggtcggagcgggagcagaggaccaggtcgccagtgaggtccatgggcgcgccgccgctggcattgtgcatgccccccttgtagtccgtgtacaggccgggcggcagctcggccgacagctggccgtcgatgtacagctggaaaccgcggcgcccgtcgggcagcgtggtcaggcccagcaggtgccagtcctgggtgtcctcgatctgtgcagagtgggagttttgaggaatggggggccttgtgcccagggcgcgttgctgtcaatgttgctgccggcggcgctggcctgacgcccaggcgcggtcggcgatgcgcacacgatgtctccctcggcattggaatatcacactctcaaccccccccctctcccccaagagtaactcaccagggtgaagttcttctggttagtgcagaggatgtcggcgatgcagccgttggagtcgaggaaaaggggcacgctggtgttgccgtgcgtggcagtggagtcctggacgacggcgcgcaccagcccatagctggggttgcccagctctggcaggtacaggcccacggtgttggggtccagagaggcctccacgttggtggtcttgttctggctcagcacgtacgcggaggcggtgccgttggtgacgttccaccgcgcccagacgcccagcgcccagggccctgcctggccgtaggacaggccggggatggacacgtggctgcccaggctggcgtcgcactgcagcacgcgcgtgccgaacgaagggtccgtcacccagctcacgttggtgcccgagccacggtacgcattcagcggcacggaggaggtcaggtcgccatctggtatggcagggaagaacggagagggggggggggggggggggggggggnnnnnnnnnnnnnnnnnnnnnnnnnnnnnnnnnnnnnnnnnngtagttcattaccaaaaaatcgattctgttgataagccgcatcccctcccgggctgaacgctcctcctcacacgcctannnnnnnnnnctagttcattacaaaaaatcgattctgtcgataagtcgcatccccttccgggctgaacgctcctcctcacacgcctatgcgcatcaaacctcagccctcaccattcacaggaatgcctgtgccacatgcatgccaaactcctcatttccatgttgcggtaaacccagcaaatcataaaatctccgaccaaagtaccctcggctcaccttgcagtgtgaagaaggcgtttgnnnnnnnnnngcactcctcatttccatgctgcggtaaacccaggaaatcatagaatctccgaccaaagtaccctcagctcaccttgcagtgtgaagaaggcgtttgcagcagggaaggcatcgcctgctggactggccgcctgcggtgcatgatgagaatggagcggcttgatcgggcatgcttcggactgctgtatcatgcttcaccagttgcccggacccgatcggccaggcaggcaggcatcgggaccatgggcagggaacggccaacacaaacggacctggagcaggactctcgtcgacagcctcnnnnnnnnnnccaggcatcgggacaataggcagggaacggccaacacaaacgaacctggagcaggactctcgtcgacagcctcgccaggcatactggcgccgccatgcagaccaggagcacgactagcatggctccccgcgccatgacggtgtcagactgagacttaacaggggcactccgatgagggccgctcccgtgcgattacaggttcaaactgcgggcaaggtcatgtgttgctggctggcgagtgcttgcacgatgagtggcccgggcatgggatggcatggccatgcattgatccttaccacgtcaggcaggccagcatgtgctgttcccaaggtatcgagtgactcccgcaacggcgcctggttgtcggtctgactgacgtgctcagctgctggctgctgtgcaatgcctccaaatactcattacaagcagcaagatgatggtgtaaaccctagtgtgcacggcgtgcgtgcgcgatcttagctcgcgatgctatggtagctgaaaaccccgcccccacgtgatccgtcccagggaaccttgggcgcggggcaacacggacaggaaatcaataagcaattcgcttcgtagagccaattcggtgtatcgtatggccgcggacatccaaacgcaccccctggagcttgctaaaccggtctgccaccgcggcggacacactcggtctgaaatcttcagatcaccacccccatatacatacatcctttgcgaacaacaacattccgcggcaaaatgaatatggatgtagcacaagcatgcacttgtcgggaataaagagttccggcttgccgtgccatcgggaacagcaggacaagtgagtgattccgcctctagccctttggaacgatggcagcgtcctcggtcacggccatggaattcaacttcgcaatgcctcaactgcagatggcttgcagcgaacgctttggccgtcaagggccgttgggaatcaccctcccaggccatcgcctccattggcttggtgggcttcgcataccaggccccaagaaaatctccgttgagagatggccagcaggacgagagctgcacagcctggaccatcctgcagccggcgaagtcgctcgactgctttgcaaattgctgcttttcagctgagggtgtgcagtccgtgaccctcaatgccttatgtgagggagagggagctggccatctgcactctagcgcacacatgcagtatgccccccctgctcctagcctcctcaccatagaggcagctggcaagtaagtgcagggctggtgcgatggcggcatgggcctcacatgagcttgccccgaatggtagccgtgcgttgctgctcacagtacaggccggcannnnnnnnnncgagagggtgctggccatctgcactccagtgcacacatgcagtatgccccccctgctcccagcctgctcaccatagaggcagctggcaagtaagtacagggctggcgcgatggcggcatgggcctcacatgagcctgccctgagtggtagctgtgcgttgctgctcacagtacaggccggcactcccatgaagcttgctccctggcgcacctttgctctgcaggtttggacccgcgcgaaattcactggcgctggtgcacagctgcacccttgactgcaatcgtcggcagtgcaccgcccagcaggcctcctgcaccgtcagccttccagcagaggcaacagcgcgggtgactgtgcgctgggaggaggatgcgcagtcgcttggtccgatgcagctgagcttctggtcccagggcgcagaggcctgtcgtgggccgcatcatggagacgagcgcagaactgtcggtgcaccctcgctgggtcaggctgcagtcccgatgaccacttccgagctccgacagccccccccagggtcggacagccctcttctggacagcagtgccagcgcgcgcgtctctacctcccctatgccccgccccggaatcaggggcgagctgcggctcggcccannnnnnnnnntgatgaccacttccgagctccgacagccgtccccagggtcggacagccctctcctggacagcagtgcctgcgcgcgcgtctccacgtcccctatgccccgccctggaatcaggggcgagctgcggctcggcccagacctgaggggctgccggtccggatcggtgtcgtggggcaggggttggggccctcggtacctcaccctgctgaacctggggagcaggcaggggcgcccctgggtgtccgtggacgccgtgtctggcaagaccaggctcagcctgagcttgcgtcgcggcgcacccacggctgccgctccgtcgccaggccagctgccggtctcagtttcgctgcagtcggcctggtcgcgagtcctggggctgagcagcgtcaaggccagggtggcgtgctcggcgggcggcgtttctcccagtctcagcgcttgggtgcagagcagcacgctcagactgggggccagctggagcggggcggggacctggaaggcccaggctgaggtggcgttgggcaccctggcttggcactgagaagtggagcacattcttgaatttctcatcgtattctgaaatcaaacctcccgagattcatgttgtattaatgcaagacctttgctgctagggactgtgcatggaaccttttaacaatctgtccccgcaacccccgcccctcccgcgccagcgcattgggnnnnnnnnnngatgcaagacctttgctgctgggaactgtgcatggaacctgttaacaatctgtcctcgcaccccccgcccctcccgcgccagcgcattgggagattccactccgaaacgttttaggggcatacctttgcatgctcagggaccgatcaagctcgctggacaatccatccgatcgatggcggggtgtccctatcacacgaggatgggcgagatgacgtcgcagctggagcgactggtgcactcccccgccggggctgccctggtggtggtctccgtcgcgctcacactgctggccatggtggcctcttccctgcgcacacttgggggcctgtatcggcattttatccgaggaggacggaatttgaggcagtatggcgagtgggccgtggtcactggggccaccgacggcatcggcaaggcatacgcagaggccctggcgaagcagcgtgagccccggggtgtgaggactgtactgtgtctaagacttgtatctgtgtcaaacgtactcactcacaccctcttgaaaccgcctgcccccaggtctacgcctggtactgatctcgaggaccgcctcccggctggaggaggaggccaaggcgatcacggacaagtttggcgtggaggtgcgggtcgtcgccgcagacctcacctccaccgatcccgccgtcttctcccgcatccaggaggccctcaagcccctggacgtcggcatccttgtgaacaacgcgggcatgtcctacccccaccccgagtacatgcacgttgtgggcgacgaggacatcaagaacattgtgaatttgaatgttctgtccctctccaaggtaactgagggggctggggcatgaatgcatgcgggcccagcacaccgcatgacacatgcatgcagcccactgtccccacccgcggccatgcgcaccgcctcgtcatggcacagccctgctcaaggaggttcccccctccccctcgtcccacacccatgcccacagctctgccgcatcgtcctggggggcatgaaggagcgcggccgcggcctcatcgtcaacgtgggaagcggcgcagccaccgccatcccctcggggcccctcctcgcagtgtacaccgcttccaaggtggaggaacgaggctgccctttggtggccgtcggccgatccctggctcagcgcgtcgagctggccgcctggccatgccctgcgactgcctttcctttccgcacgaggatctccaacccaaacctccccacacaaaccacgccacccccccccaggcgtacgtggatgctctcagtcggnnnnnnnnnnccacccccacacaaaccacgccaacccccacccccccaccccaggcgtacgtggatgctctcagtcggtcgctggaccacgaataccgcgagttcggcgtgcgcgtgcagaaccaggcgcccctctttgtcgccaccaagatgtccaagatcaggcgagcagaggggtgtgctgggtgggggattcgtggtggtgtgtggcttcatcggctgggtgccgatggtctgtacacgcannnnnnnnnnagatgggggattcgtggtggcgtgtggcttcttcggctgggtgccgatggtctgtacacgcagaggctcccccctcgccatcaccacagcctgcaaaggactcgcatgcagaggccggcacggtcacccactcccacgcaggcgagcccgcattgacgcgcccacgccagaggtctgggcggcggccgcggtgcgcgccatgggctacgagacggtcttcttcccctactggttccacgcgctgcaggcggccgccgtgaagctgctgcccgccagcctggtgcagtaccaggtgatgcagatccaccgcagcctgcgccgcgcggcgtaccgcaagaagtccaaggcggcggcggagctgctccgcgcccggagcgggaacgaggcgggcgaggcccccgcgcccgctgccaacggggtcaagaaggacgactgagagggatggatgtgatgactctcatcgctgccatgagagggtgatggcgcgcctcgcatggctacgcaggcgcgcacgcccctctcctgagacatgcatggccagaccgaccaccgcgcgggcagctgcccttggtatgtcctggatctagtggcatgataacggtgtgcaccagggcgcaacatgcattcctgtgatgggaaacctgnnnnnnnnnnggagggtgatggcgcgcctcgcatggctatgcaggcgcgcacgcccctctcctgagaccgtgcatggccagaccggccaccgcgcgggcagctgcccttggcatgtcctggatctcgtggcaccatgacggtgtgcacaagggtgcaacatgcattcctgtgatgggaaacctgataccctccaccccaccccccgatcaattcagacccgcctccgttccttctgcaaacacaccgtgctcctcttagctgccctgctgctcccctcgcctgtacactcttgccctcccggtgctggcgagctgcatcaacagcgccggcgcctcactccccccaggccagcatgcagcgcgccgccgcgacgcgcacgctgcgcgcgtcgtcgtccagcgccgcccgggccgccgcacgcgcccgcgcgcgcagcgggtgcagcgtggtgtagggcagcgcagccagcgcacacagggtggaaagcgcggcgcggcgcacgtctggctcgcggtgggccgcgcagcgcagcagggcggggaaggcgtcgggcaggagcctggcgatcacgtctcggtctgctggggatttggaggggggaagagagggcggaggggttgctgctccggcgaggtgcagagttccatggcgtcaaggcgctgggcggtgcagatgtgccctccaaattaagcgacaaggcatccttcagagcgagaacgaccctatccaccccattcccccctcacctgttgtgnnnnnnnnnntctggtgatcacgtctcggtctgctgggaatttggaagggggaagagagggcggaggggttgctgctnnnnnnnnnncgagcgacgcggcatccttcggagcgagaacgaccccatccaccccattcccccctcacctgttgtggcgccactgcccgccagccctgccagcatgtccagcagccccgtgacggtctgctcctggcccggcaggtcggccacggccgccaggcagggcgccagcagcgtctccacgcgcgccagctggctgcgctgcaaagcggggtccaccgaggtcagggccgcgcccagcgtgcacagcgcgggcacgaacggcggcgggggccccagcgcacgcagcagcgcgctcacgagcagggtgagggtgcgctgccgccagagcggccggaccagggccgaggggctgcgctgcgcggcggccgccagcaccccacgcacgaagcgtggcccgtcctcgacgcccgcggcgggccggcagcaggccgcgatcccctcctcgagggctgccgccgcccgcgcgtgggagcgcagcgccagggcgcgggccagcgccgcccgcccctcgatccaggccgcgtcgggggcggagcccttcccggccagggacgtcatccatacatcaagcgcgggcaccaagccctcgggccggtctgcaaggaaaggacatggatggggggggaaggcttttatgctgtggaatgctgagagggnnnnnnnnnncggccggtctgcgaggagaggacatggatggggggggaggcttttatgctgtggaatgctgagagggaggcggcaatgagcatgacctgcggtgcgggatgccaggacctgccagggcatctgacaaaactcgccgggcaggcaggcatctgcatcagattgcctcttgtgaggccgagagctcagcccctgcccaccagcctccctccagatacaaacaccctcaccgtccggccacttgttgaccagagaggccgctgcctcgatgtacagcgagcgctggccatccgtccgccacagctcgctcagccgccgcaccagtggcaacgagcaggcggcacgcgcggccgccctgctgcacccgannnnnnnnnnnnnnnnnnnnnnnnnnnnnnnnnnnnnnnnnnnnnnnnnnnnnngccgggctcgcgcccggcagggcggctgcaacgagctgcgccgcagcctcggcctccccatcagtccccgactgcggcacgtgacaaggcgtgggcagtggttccttggttggcaaagtcgctacgccctggcgggccagcaaagccgctcagctctgactggcnnnnnnnnnnccagcaccccgcagtgcaagagcgcgtcgcctgggtcggattcggtagccagcactgaggccttggcgcggcctgcccaggcagcctgcgccnnnnnnnnnntcagcaccccgcagtgcacgagcgcaacgcctgggtcggatttggtagccagcaatgaggctttggcgcggcctgcccaggcagcctgcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattggtgggcaaagttgccacgccctggcggccagcaaagccgctcagctctgactggcacggaaacacaagcgcccccggtcctcaccttgtaggctcccagtaaggcagccaggacgccctcgctaccgctctcatcatgcggatgcgtcagcaggtctgccaggcagttcagggcggcgaggacgtggccagcgtcgatgctgccctctgcgccaatcgcctccatggctgtcgcgccctctgcgtcgggcctgagcctggccagggcagcctcgatgcccatcgtgcacgccgtggcggaggcccgcgccagctggcgcaccaaggcgtcgccggcgggcgcccaggccccaggcccttcgccctgcaaggccgcgcgtaggacgatggccagcagcgccctgctctcctccccaaatcgcgccagggccagcagcgtctgcatggcactggcagccaggtcgggctcggcggcgtccatggcctgcaaggtgaggtatagggcagcttcctgggcggcaggcccaagccccgagggccccagcacttccacggcgcgctgcaggaagcacagagaccgcagggtgacggtcgaagccgtgcagggccagtccagggtccagaggtctgcatcggagacagctatgacttcagaagcttgctgtgcctcagcgacatcgtgtctgcgaatggcgagctgcacccattcctgacatggagccaggagtgccgtcagtattctcgggcccgccttgatcatctgcgccaggccctgccaggccagcgcctgcgctgccagcggcgcagtcggagacttgatcgcctcggtgatgcgacccagagcatcttccagctcatcgcaggcgacgaccgagctgcacacctgccaagggaagagaggaaggggttgggttcccatggaggttgggcaggtggttgagcggtgcggatggggtcaggcaccagctccaggccacagggctccatggctcgggggggcgcacgccttgtatacagcatttgtcgccaacgccatcagcacgggctccctgccagaggatcccaccaacccaccccgctcaagatgtgcacgccggcctgcaccagcctgctggcccgcgcctgggcggcctgggttgaccctgggtcccgtaggcactgcagcgcctgctgcaccgcagcatcctgcaccagcgagctgccctggccgtgccggacccggctgagctgcgatacctgcgcgggtatggtcagatgaatcagggttgagtgaaaggcgcccagagccaagggcacgcggttgggatgggggttggaaagtccttcccatgcagcagagcacagacgagcaaggtaccatgcagagccatgcaaaccccatgcctcgcactagatcccccatcacccgcctcacccactcggcgaggcactgcgccgcgggggtggcgaggtcctgggcgctgcccagcgctggcgcttccagggcctcgggcaaacagatctcggcccgcagccgggtccagacctcgccccagtcggcgtgcgcgtccagatccgcgggcgagcaggcgccggggacgcgacggaggacgtccagggcgtcggtcttggcctgcctgcgcttgcgacggcggcgagccggtgacggggtccggcagcctgaaacattgagagtgcgtggcaggcaccctttcccccagggcccacgatttgacaggcacgctccagcgattgtgcacctgagggacgaggccaatttcnnnnnnnnnnggtccggcagcctgaaacttcgagagtgcgtggcaggcaccctttcccccatggtccctgatttgacaggcacgctccagcaattgtgcacctgagggacgaggccaatttctccagcagcactggcaggaggaaagggaggaaggcggggctgcacagtaggacgtctgccagggcgctggccaggccctcgcgcgtgatgccgtggggatcgttggcaggcgggctgaagctgatggggaagtagcaggagaggatgtcgaacagctcttcagagccctcctggtgagacttggcggagggtgggggaatggaggccagggaatggttccagggtcgcgccggggtgcgccgcagactggccactcaatgcgagtgtggtgtagttttcccaaaccctgcaccgcagcacccacctccatctgtcccgcagccaggctgtcgctgggctgggcggagtagagcgccatcagggagcgtgccagggcgaaggcggccagcagtccgcgagggtccctctcgccatccatccccgccaggcatgcatcccagagactgaccccggcatccagcagctgttgcccatagtcctgtaggtgggaataggcacatttggggctgccagcaatgtgccgtcgctggctgcactgcactcgggcagccgccatgcttagactggacctgtcttggccgtcccccaccccacctggacaagagcctggagagctctgtatgccagcaggcgctctgtctgggggaggtgctgcacgaacacattgctggtcaggttcttggcaacgctcagcagctgtgcctggctgaggcttggagggcaggctggattctcaaggaacatgaggcaccccaacaaggcgccgtgcagggagggcctgcagtgtgagaacagctttattgttgtggcgttaatccagagtgagagctgtcccagactaatttcagggtttatatcaggcactcagccttgccaaatgtccatgatcagcttcgcatgacatcctgagcctgannnnnnnnnncagtgagatctgtcccagactaatttcagggtctatatcaggcacccagccttgccaaatgtccacgatcagcttcgcatgacatcctgagcctgagcctgccttcaccatgcagtacctgtcattcagcctggcacaaaagaagtcgccggtatgatgagcatccgcctcagtcgcaatcagtccaggaatgccgacgagcgcctgtgagggtagcaggggggtcatgcgcgacaaaaggtaccagccatttgggcctccagaagctagctgggacacccactcagcaatcgtctcacctctgcgaagacggtgagtgccttgccgcggttggcatcgttctcggatatcagaaaaggcccaagagctccattaagcacggctagattgaccctgtcccttttcaggctggtaatcagtccagcgagccgctctcccgtctctgcagtgctgaagtcagtggtcaccaactccgagagggctgacgtccatggctgatcgaccgacatgctgcgcctgccgtcagtcagtattgatggattgatggctgctcttgttgtgatcctgcgtcgctcctgtgtttggaatggaggactgatatgcatgctgtgggcggagcatcggtgtctctagtgccgtaacattcaatacacaggacgtcgtaatgctcctcggctaaaatgcgtgacgtttgcggtattgcttaaaagcccttgataaggtgctagaacgtactnnnnnnnnnntgagcatcggtgtctctagtgccgtaacattaatacacaggacgtcttaatgctcctcggctcaaatgcgtgacctttgcggtattgcttgaaagcccttgataaggtgctagaacgtacttgcttctcccgaggtaccgaattccagctcagacgacggtgccatggtggcaccaagcaggtatgcagtcgctcatgtatgacggatgcacgcaatggtgttgcatcaataatataaacaactctcctgaacggccctgcaggattctgtgctttgcacagagggtcaaaaagacatcggggggccgtgcgtggcttcccaagtggggtctcacaggtgccgtggttgtgagggtcctcaacttgcgtgccttctactggcttaccgcccagaatcgtgtttgtatggatcctgtgcagctcctccttccttccaaggccgtagcttccgactgtgcaggcttgaaccagactcagaaggccacgcgccggaagaaccgaggccaagagcaagaccttgcagctgccctcaagcaggcagcggcaggtgatcccaaggcattggaacaggccgcagcatagacaggcatccgcatgcctggcccctgaccccgacgacagggcgtgtagtgctgtctgagatggaagtgggcgcacctgagcgatggggcccacagcaaccagctcgtcagaagaggcttcagacagcaaggcagtaggagatgctgttgcatgcaccactgtgcccatcagattatagaggcagggtgccactcctacttgggtagttgtaaaatgacgtgttctgtgcaatcccaagagtgagattgannnnnnnnnnagaccgcagcaaccagctcggcagaagaggcttcagacagcaaggcagtaggagatgctgttacatgcatcattgtgcccatcagattacagaggcagggtgccactcctacttgggtatttctaaaatgacatgttctgtgcaatcccaagagtgagattgaagcccctagattgcaaccgaaacgtacaagttgaagagtatccagtactgtagcatacagtgtccaaatcttcgctcattggggttcctcaccaaactccatcgatgagggttgtttgaagtgaaccgagttccacgacacgacgcgccttcgacggaacctggtcctcgtcaatcaccgcatgaggtccgttcaagataacgcacactccttcggttgctcagcaaactagaagatcgtcgcgtgcctcccaaatcgatgcaaggttgctccacagcatgggagcccctgctacttacctcgtgaagcacatactgtttcggggcaggaggacgcccatccttcttcaagatgtcaatggtccctgccctctgattgccctggccaatgttttgtttctcaggaacaggctggagctgccgctgggggtcggggaggtatcctcggtaggtttgcgaattgggtcggtccccgcccctgcttgtgccgagatccacccttgaaccagagcgcatccctgcgaccttcgccccnnnnnnnnnnctgggtcggtccccgcccctgcttgcgccgagatccacctttggaccagagcgcatccctgcgaccttcgccccctacctcaattatcaccgacaggataagattgtggagctgctagcaggctacttcctggatgctcagacatctgcgagcgggcgaaatgaggagcagcaggcagcccttcagcaccagctggcagagaccatgcagctcctgccccagctaacaaccggcatagatgtaaatgtccgatttacaagcataggcggctttgaggtgagtaatggggggggggtgttatagacggcagggtgattgtggcgttgtgattcgtcgcccacctacaatgaggggatggcgtaaaagcctgcacctatgccatcactggctgcttctctcaggcgattattaccctccagcccctgccctcccacctgcagtttacgagggagactggcatctttgatctgctcaatgttcgcctggtgcatggttggctcgtggacccccaggtgtgtgtgttgggggggaaatcttgagcatgagaatagaacttgctgactgtcatgcacatgctctgactgccttcgccccactcttgatccgggcccctgctcaggacacggtcaccgctcaggctgtcggccaggcatcctacaacgagctcatcctgcgggtcgtgtgcgcactggacgggtcctacgccgccggggtcacctcagaggcgcccggccaggccccggcggccagccagcctctgcccatcccagggcatggcatcgatgccgcatcactcacagcagcgctggccagcgcggcgtctggcgcgccggccgcctcccccagccccgccgaccacaaggacagcctcgcatccgccatcaactccatgctgggggacctggtgaaggtgagtgcccccttgcgcagccgagatgacaagggggggacaggctccatatatgagcattgtccgccttgatccgcgagagtttcccttccccgacctgcaaggcccatcggcccccgtctgacggttccccacccacgctcccttgcgcactccaggatgcattcgatcgctcctacagcggaccccgccccctcaggtcctctgcaataatcacccggcccagccgcaatcagagcgagcgcgccgagagccaggccggctctgtggcgcctgatggattgctcggcaccgcctgcgactcccaggagctggtgtgtgtgcttagacagggtgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttgcactggataaaccgagccccggccccgccccggccgatgaggagccggcacggcagtcgacgccgccatgggcagatgcaggcggcgacgatgggcccagttcctctgtgacgccacgggcttccccttttgaccatgtggaggctcgtttcaaggacctgaccgtcgccacgggagtgccaggccggcaggctgcacagggcaccgtggccggcatcgacacgagacaggaggccgccgtggccgcagaaaacaacgcaaggcagggatctgagggtgcgggtgggaccccagcgccggcctctgttgcggcggcctctgggtcacagcgtgaggcgcggcaggtggacgaggaggtgcggcaggcgctcgtcatccaggatttcctggagagctgccccagccagctgacgtatcatgggctggccagcctgatccaggacttgcaggagggggaggtggcggtgttcttcaggtgcgggtgatgtcgtcgggtgggaggcttgtgtcgcaaacgccgagcgcggcaaggcgaggtgcatggagtgtgattcccatgctgcacgcttcataccggggcaggctctgggatgggccactcccgcgcnnnnnnnnnntgtgttcttcaggtgcgagtgatatcgtcgggtgggaggcgtgtgtcgcaaacgccgagcgcggcaaagcgaggtgcatggaggatggttcccatgcggcacgcttcataccgaggcaggctctgggatgggccactcccgcgccctgtatttggatctcgatttactccggccaaacccccccttcctgccccgcactgcccactctgcctcagcccactctctcaacccacaggaacaaccacttcaatgtgctgcacaagcatggcggccagctctatttgctcatcacggaccaggcaagggctgagtgcatgcggtggccggcttgtgtttgatctgaaaactgggaggtgcaccaagctgtgtgagggggtcattttgcaatgcaaggcctattcgggcactgagagctgtcagccatcctgctgaagcctcaccctgcctcggcctctcaccccctgccctctcaacagggctaccagtatgaatcagacgtggtgtgggagcaccttgcgtctgtggacggggacacctcgctcttcaacgccgacttcaagcctttccgggtccactccttcccagccccaactgccggtgagggggtgctggcggcctggggccctggacttgggattctgaacatctgcgagtggatggtgtcccgacaatccatctgcctgtgtgatgnnnnnnnnnnggggctgagtgcatgcggtggctggcttgtgtttgatctgagaagtgggaggtgcaccaagctgtgtgaggggtcatcctgcaatgcaaggcctattcgggcactgacagctgtcagccatcctgctgaggcctcaccccgcctcggcctctcaccccctgccctctcaannnnnnnnnnttggacttgggattctgaatatgtgcgagtggatgatgtcccgacaatccatctgcctgtgtgatggacacgggatgtagagatgccatatgctggacatcacaagaaccgtgcacctggactgactccttgcctccaagcgggtcaacgcatccctcctaccaacagcctgtgtgtgcgccacacggccgcaatcagcgcactggcaggcttgctgatcaacctccccccccgcctcgcctcgcaggccgggcctcaccctccatgctcgccgacagcgactttgcgctggccctgcagctgcagcaggaggaggaagagagcgaggcgaaggtacggccccgccgcgaccccggcaggccccccatcctgtccccggccggctcctcgccccccgccggcgcctcgcccacggctgggcagcgggcgcaggnnnnnnnnnnacaggcaggcggcaggtgggcctggccccagcgcaggccaggcccagctggagggtaggtccctgacccggttctcgccgggcgcctacctgcgccgccccagtggcggaggcagggacaagtcgacgaagaaggagaagaagtcctccgactgcgtggtcatgtgatgcccgttggcgtgccgcgctgggctgcgtctggctcgccctgtcgcagcagcatccctcggccccacggccttgccgtccttgtcagccgccnnnnnnnnnntcaggcaggcggcaggtgggcctggccccggcgcgggccaggcccagctggagggcaggtccctggcccggttctcgccgggcgcctacctgcgccgccccagtggcggaggcagggacaagtcgatgaagaaggagaagaaggcctccgactgcgtggtcatgtgatgcctgttggcgtgccgcgctgggctgggtctggctcgccctgacgcagcagcttccctcggtcccacggccttgccgtccttgtcagccgccttggctctctcgcttggccttgtgtcccggcccgtcgcgtgatgccggggccctcgctggttttattctctccccagaaccaaccgaacagccactcctagagggtccgcatggggactggggttgccgctggggacgctgagcatgggtctgggcacccagtcaccgacatggcttcaggattctagcatgttcccagctctcaagctccctgccgtaagcatcctgccactggacagccccgacgccacgacccaatagctctaggtagtcgccccccgacacgagcagctcatcgctggtgggaatgtactccagcgcatagcatctggtcgacagctcagcctggaattgcggagccctgctggcaaacatgcctgaaaatgtggcctggtgaccgccaccacgtgtgccgaagcccaggaggaaaacatcgccgccttggtcactgacggcatactcgccgtctggcagccatgccccaggctccggcggacctggcagggtacatgtttggggatcagattggggtgcatacgttccaggctgtgggtaaggatgcccaaaccccatggcgataagcgcaaagcgcaccgccacccctccaccgcaccatgcacagccctacagccaccggccgggccttacctgtaagaccgggtcgccgtgcctcctcgtcaggcgtatactcaggcgcgtagaggtgggtgatcctccctgccgccacgtccaggaccccgcaccatttgccgaggaggtggaatgctaacctgtctggatgctccggatcaggctggcagatggagaaaggcggggcgactgatggggaacttgccggttccagactctcctggcagccatgcgcctaggttgcggagctggtgccccgcctcgcccaggagtgcacccctcccacccccagagctgggcttcttccttcctttcccgccctcccacctcccgcgcacctgtgcaagcctgcagtttgagnnnnnnnnnnaactgatggggaacttgcccgttcaagactatcctggcagccatgcgcctaggttgcggagctggtgccccacctcgcccaggagtgcacccttcccacccccagagctgggcttcttccttctttccccgccctcccacctccgcgcacctgtgcaagcctgcagtttgagtgccgctccaagcatttccttccccccacccaatcttccaggccaggaatgtcggccagcatgcccggcagcgacacctggctcagctcggggtgggagtggatgcgggcgccgaagcaggcggccgcagtccgcccgccacgtaggtcccaggtgcgcactgtgcccgtggagtaggccgccaccaccgcgttgccgccgtcccgcacgctcagcccagccacggagtgcctgccgggcgcgtaccgcccgctgaccatctccagcaccaggtccggggccagagcccccccctggccgcgaccggggtcgcgtgagtcccacaggcccacgtggccatccaatgtgcccgctgccaggcggaagggggcggtgccgggcggcggcacgtgcaggcaactgaccgcggcgttccgaccctggctgaccagggccagggcggtgtgtgggagggagtgccttccctcggcgccggcgtacaggaggacgcggttggaggcaagcgaggggatggccaggtcgtctgccgcccagactggcatgaagaatgggccggcgccggggtcgaggcgtgtgcagggcacggctggggcgccccagctgaggaccagcgaggagctgcgcagggagcccaggctggacaggaggacgttgccatccttgcagtgcagggccatcgcatctccagcgccatgcactgcgagccggttgacaggggcggggtcaaacccgggagcaatggtcttgccgacctccactcgggagtgcaggaagcggtagagggtgtagggggggaggcggcctgtgcatgctcggtccagcacctctctatgcacagggaatgacacatggagggggctgtgaggcgacagcatggcctgggctgcagcccctggcacagaatctggcagggcacccgcagcccatcacaggcaccaagcagaccttgctgcgcaggtggaggcgaaaggggttggctgcgggcggttatccgtcatatttacatgtgaaatagcctcaaacttgctgtcatcatgcgcatcgggtgctaggatgtagcgatccagcgtggagtagcgtgccatacccgcccgtcactcccgcagcccatgcatgcacctccgatgaccagcacagtgtcttcgcgttggcatcaatagctcgacaacaagctctgcacctgatcatcacctcacaggacgtgcaccaggctgtcgcgctctcctcccggcctcggttcaaatcgggaggaaagaaatcagatcctgcatgtctaccctcctcaatcacagtatgtgccctggcacggctcatgcctgggtgcagagggtgttacaggcgtggaaaaggggatcgaacaaacacgcagaggggattgattgtgcagcgcaggcatcaattggggagtggtacgagtcatgggagtgcgactgccagcaggtagcaggaaaactgtgagggtacagggaagtagagtacatcgacagcctgcacaggccaaacgaaagtgtatctctggaggaacgaggtgggtccagtattgccaactttgctgctctgtggctcaggaacagccgccgcggtcatgtccgtgatcacaggacgatccgcgtgcggcaggttgggcagcgggcatgcttgcacagccaaccgtcagcacagcgagcatggaaggcatgcttacactccgtcaggactctggtaggggcccgggtggtgcggcgtgggtgggccaggcactgttgcatggctgcaccccgtcgctcgggctccgcacacccccccagtccccctgagcacccaacccaccgcttcccaaccctgcaactcccaggatgcccaacccccttcctctcggnnnnnnnnnntgtcaggactctggtagggggccggggtgtgcggcgtgggtgggggccagtactgctgcatggctgcaccccgtcgctcgggctccgcataccccagtccccatgagcacccaacccaccgcttcccaaccctccaattcccaggatgcccaacccccttcctctcggcccgccgctcaccgtatttgctcggcatgcttccagtcctccaggcatatcgcgcacgtggtctgctgcagtgctcccacaccatgctgcaggtcccaggccgtgatcctcctcaggcccagcgagcgcaggcgccacgcctggtcctctggtgaggtgagattcgggggggggggggaccttcagcacggtgccgcagggcaggcgagcgtttccaaggcgccaagccaggaaggcatcaggacctgaaaccccgccatcacggcagccaagcccggtgacagggcccccccacccagcgtcctcacctggtgctgcctgaaaggtcttctcgatgtagtccaggacacgctggagcacctcctccaggtagtcgcccagctggtcacagaagacagcaaacctgacctcaaagctgttccgcgagcagacaaactggtcccagatgtccacgaagcccagcaccgtggacgtgggaacgggccagttgatctggaggactctccagagccaccgcacgatagtcacccgggctgccagtttccgcatgcactccacgcctgccgggaagggcgagggagggctgaggctgcctgggcgccagcgtcaccggacgcgcctgctggggccccaggacgatacggcttggatatgaaacacgtctccggcccatgacgcacctatcccggctgcaaccacattgatcaggatcagcagggccaggaccgcgtccaggaccggcatctgccagcacacggctggcaccgcagagttgtgccaacgccctgtttcggagagggaagaggactggaatgtcggtgggggacgaggaaagtccaggaagtggctcctgccgcgcaggacccggacctttcaatcggcgaaggagagggaggttccggttcccgcgccctgaaattacgatctcgggttccaatgcccagcgcctctacaactgatttctcagccnnnnnnnnnntctgccgcgcgggggccggacctttcaatcggcgaagaagagggaggttccggttcccgcgccctaaaattacgatctcgggttccaattcccagcgcctctacaactgatttctcagcctgaagacaaagggatgatcggtaagatctagatcttattgaaatgccgtttttgctcgaatccgatggatgatgctgccggcnnnnnnnnnncagatctaaatcttattgaaatgcccttcctgctcgaatccgatggatgatgctgccggcggatgcgctccatgccgctcacaaacctggttcaggccgtccggcctgtacccatcacgatatgcacggtggccaaggcatctagcccagcggctagggccatggcctcggaatggcgtgacaagctgcagcggtgattgagattctgcaagttgggcccggagtgatggaatcgaccgatgcatcagggtgggtaggcatgcacatgccaacctgtgggtcatcttactgtcctcaagcgctctttctgtcccacaaccctcccacccgcgctcaggtacgtgtctgtggaggaggtgtgcgtgaagcccaaccccaagaatgtcaaggacccgctgctggcagtgcagcatgagggcgagcgaactctggctgcccttcccaacgacgcctatgtggtacttcttgacgagcggggcaaggccctgaccagcccagggctggccgccttactcaccagggcctcctccgatgggtcgccacgcctcgctttcctagtggggggcccgcatgggcaccatgcctcggtgagagcccgcgctgacatcagcataaggctgtctgacatggtcctgaaccaccaggtggcccacgtggtcctgctggagcagctctaccgcgcgtggaccatcctgaaggggtcgccctatcaccactgacaagggctgcgcctgccatggtaccgatcggggcccggcggcacatccaagccgggcagcccattggagtggagctgtacgtgctgtgatcaattggcctcgaggctgaggcacaacagcgcgacctcttctgacatctttgcttattaagctggtactgtcaagttatcgtcctgcttggtcaaatgatggcacagagataaggagaaaggggctctttttcagattgtcgactagccgagcagcacaactcactgctgtaacagcagtgtcctcattggcagcccaatcaacatcacaccaggctcagaagatgtggctgatcacccccatggcaatgcccactcccgcgccccagaggagcatgccacccatgccgggtcgagccggcgcaggctggactcgtcgtccctctggtcctggttttggctccccaatcgcagtcgtttccccttcatgtataacaaagtgatggggctttgaggctttgcacgnnnnnnnnnnatgtcctgcttggtcaagtgatggcacagagataaggagaaagggggtcctttttcagattgtcgaatagccgagcggcacaactcactgcagtaacagcagtgtcctcattggcagcccaannnnnnnnnncgtttcttgtaaacaacgcacagcctcgaggctttactcaatgcattgaaaccctgaggagtgcgagtgaaccagccatgaagggctcacctgtcttctnnnnnnnnnntgtttcttgtaaccaatgtacagcctcgaggctctactcagtgcattgaaaccctgaggagtgcgagtaaaccagccatgaagggctcacctgtcttctgattccagtagtatagctgcccgctgttcttgtcttgaacagaggtccactcctctgcgagagcattatcgggctgggaggccaccgctgggagccctggtcgtctactggttttaggtgccgaagctgttctcttcgcgccggtcnnnnnnnnnntgggctgggaggccaccgctgggagccctgatcgtctactgggtttgggtgccgaagctgttctcttcgcgccggtcgcgtaccagcgtttggagacctgtgcactcagctgacggagcattctgcttttcgagatcctttcggaggtcgtcgccgtgcatgcagcggaagggacacccttggtcctgtaacagtgtgcattcaggttctgaatactctttcatcacattgcgtaaagtgcattcttgcactccctcgaggcggacacgaccagatcattttctcatccgggcgcgaaggggggctcctaattcctggtggtgggaccaatacccctgtaannnnnnnnnnctcatccgggcgcgaaggggggctcgtgcttcctggtggtgggaccaatacccctgtaaagtacaccccatctaaggctgcattattcaaactgtgagggggtctagttctcttctcccctcctcagagctagtatgagaagacacagagagagggannnnnnnnnngttattcaaactgtgagggggtctaggtctctcctcccctcctcaaagctagtatgagaagacacagagagagggaaagggcacacaggtcgtggtccctcccatggggtggccacctcgccgggcggggtgtggggtgtggagcaggccaccgccatgggactgcatgaaattccgtcggtccgggcgccactccatcaaagatgccgctgctgctggcttccaacgaatgttgagacctaggccaccgtggcgaggcgctcggccttgagcatgtcgatgaactgggcaaagcacacatcggcatcgtggggtccgggcgacgcctccggatggtactgcaaggagcatgtgggagaggttgttgaggagattggtcgacaggaagccttccgggcggtggaaaatgcaatttatagagagaaaacgccatcgcacaacccatgttccactgcaaagggttgcatggaaagtattccccccaaatttgcctgcacggatgccacctccaattcagatcagccattctcatccgcttagcagaccccccgctggcctgtgcctggccgnnnnnnnnnngattcagatcaaccattctcatccgctcggcagaccccccgctggcctgtgcctggccggtctctcttgccctgcacggcaagccaccccttccccatcactttcctccctagcctgaccgacaggcaacccctcccaaacaggcacaacacacatacacacctggatggtcatcgccttcttggagggnnnnnnnnnntggcaagccaccccttccccatcacgtccctccctggcctgaccgacaggcaccccctcccaaacacgcacaacgcacacacgcacctggatggtcatcgccttcttggaggggaagagcatgcccccacatgtgccgtcgttgaggttgacgtggctgacctccacctcctggggcagggtgtcggggtccaccgcaaagttgtggttctgggcgctgatctcgatgcgacccgtgggggtgaagcggatggggtggttcccgccgtggtgcccaaacttgagcttaaaggtcttggccccgaaggcctggcccagcacctggtgtcccatgcagatgccaaaaaccggcttcttgcccaggatctcctccgcgttggccaccgcgtagggcaccgcgctcggatcgccctgttgcggagaagaaagagaggagatggtgggtgggtgggtcttgggggaggggggtgtacttgtgatggctggcatcgacggatgtggattctgcgcagacggcctgccactcctactgcacataaacgaccagggcgatcttcggtgacccccacggccttctcatggagccatccccttgtcgcagaaccttgatatataaacccactgctcccttcctcacgtctcccccttcccacttaaagcttcctatcccccccccaagaaaaattcatccccatgcacaagacaatataatcaccgctctcaccggcccgttggagaagaagacgccgtcggggttcatctccagcacctttgccgcggggtagtcggcgggcacgacggtgatccggcagccaaaggaggctaggcggcgcaggatgttgtgcttgatgccgaagtcgtatgcgacgacgtggtagggctccgcaccgccgcgcgaggccacggcctccggcgagaactcccactccgcgccggtggggtcgcgccactcgtgcacctcgtcgcaggtcacctcccggatcaggtccttgccgatgatgctccagccgcgcgccacggccagcaagtcggcgtcggagcgggccaggtcggtggtgaccacaccgttgaggcagccggtgacgcgcaggcggcgcgtgatggcgcgtgtgtccacgtcggcgatgcccagcacgccctgctccttcaggtaggcgtccagcgtcaggctggagcggtagttggacaccgtggcggacaggtcgcggatgatgaccgcgcccaggtggcacttggtggactccatgtcctccaggttgatgcccgtgttgccgatgtgggggtaggtgaagcacacaaactggcccttgtaggaggggtcggtcaggatctcctggtaccccgtcagcgatgtgttgaagaccacctcgcccactgcgcagtgggggcaggggatcaaatgggtgaggggggtggtggggttggcggtgatcggaagttgggagggtggctgatgatgctggaaaggcaggtgcaagagctagatttggtgggaggggcannnnnnnnnnaaggttggcggtgaacggaagatgggagggcggctgatgatgctggaaaggcaagtgcaagagctagatttggtgggaggggcagtgatccagaactgtgagccctggacgccagcgctggccatggaccttgggaggtcgcgttgagacaaggaataactagagcaccaggtcacatgattgtcggctgcaccagcatggttaccgcaggaacgggtgcttgcggcaggagcactgcaccccataagcaatgtgccttttcgaccnnnnnnnnnnaaggtcgcgttcagacaaggaagaactagagcaccaggtcagatcattgtcggctgcaccagcatggttaccacaggaaagggtgcttgcggcaggagcacagcaccccataagcaatgtgccttttcgaccggtacgcttgcatgcagggtctcatccctggctcctttctctcattcactctcttctcgtgctcttatatacacctccccctgcatcctgggccctcacnnnnnnnnnncctggctcccttctctcattcactctcttctcgtgttcttatctacacctccccctgcatcctgggccctcaccctctgtgcctgtcgctccgaaagctgtgccgttccataccgatccgtcctccaacaccagcctgcatgattgcaaagagggagtgcagacccttagctcccatggcatgcctccatctctggagactcaaacaagccctccttatcgctggaacctactttgccggtgggcgcttgccccagggaggggagaccgcggcagcagatacgaccagcccacgacgtacacccgaggggccagcagggctcgtgcgctgcgcaaaggacctcagacggggagctgtgctgaagtacaggctgcgctgtaggttcatggcgcgggttgtgcatgtcgaagacacttgacgccggcactgtactgtgccgctttggggggccagtgctgaggccatggttgctaggtaatggtcgcaagcaattcagaagaggcgacgctctggaaggtagatctatggatctacatggggtgtgctgcgcccgcgtgacccctagggcgtgacctgcccagcccttgggtccggagccctcgtgctcacgtgcgcgccctggccgatggaaaggcggaagccccgagcagacaccccaccgaggagcaaccctaaacacactggcccaggacgagccaacaatgacgcggacctacccatctacgttgcctcacattgcatgtgagcagggggggtggttgtgaaggggatgcacagagggatgctcgccttggcgccctggctgaggagtgggggtggaacccctgcctttgagtatccttcgactcgcatgcacgcagattgatgaaaccgaatggcctacattcttcttcactccacagaggtggccaaccccagcttggagagttaggggtccgcgcctnnnnnnnnnnacctacagtcctcttcattccacagaggtggccaatcccagcttggagagttaggggtccgcgccttggccgttttcgaggcctgggcaggtggccatggctctgcgccagcgatgcccggccctggcgcggggcatattcctccacctagcgcgtagggaggctgcaggcggctgggcatggaccgccgcggctgcccccggccccactctgccatctacgtgcgtcccggcatgcgtgggggcatggcgcaccttcgcttccgggtccctccccgagcacaccgagcttgccatgcccgcgctcagccccacaatgaaccaggggaacatcctggagtggcagaagaaggtcggggacaccatcgcccccggcgacatctactgcgaggtggagaccgacaaggtgagcggctgggctgggaggttgttgctgaggagagcatacgttctcacggtgtggactacgcaagcttggaaattctgtcacagaaaggtcgcactgtcttgttgtccgctcgtacttcatcatggagagggggcacaaccttcactcccaacatcgcgcatgccaacaatgccccggacccccatcctcatgccgannnnnnnnnnatcacggtgtggactgcgcaagcttggaaaatatgtcacagaaaggtcgcactgtcttgttgtccgctcgcatttcatcatggagaggggacaccaccctcactcccaacatcgcgcatgccagcaatgccccggacccccatcctcatgccgacctctttccaggcaagcatggagtgggaggcccaggaggagggcttccttgcccgcatcgtggcgggtaacaataccaaggatgtgcccgtgggccaggtggtcgccatcattgtggagaacgaggaggacatccccgccttcaaggactgggcgcccggtgcgtcgtccgagcccgcgccggcgccggccaaggaggcgcccggccacaaggaggcagccgcccccgccaagcccgcgcccaagcccaagaagggcggcaagaaggccgcgaagccggcgggccggtcctggcctccgcacgagatcctgaccatgcccgcgctgagccccaccatgtcccagggcaacatcctggagtggaagaagaaggcgggcgaaaccgtggcccccggcgacgtctgggccgaggtggagactgacaaggccagcatggagtgggaggcgcaggaggagggcgtcgtggccaagctgctctgcgccgacggcgcctcgggtgtggccgtgggccacccgctggtggtgctggtggaggagggcgccgacatcaccgcctttgccgacttcaccgacgccgacgcgcagggcggggcggggggagcggctggcgaaggggaggccgaggaggccgagggtgcgaaggaagtcaagccggccaaggaggccaaggaggccaagcccgcggcgtcagccaaggcggccaagtcggcggcgcccggcgcccgcgtcgtggccagcccctatgccaagaagctggccgaggaggcgggggtgtccctgcagggcgtggctggcagcggggagggcggccgcatcacggcggcggacgtccgcgagctggtggagtcgggcgggggcaagcctgtcggcggtgcgggcgacgccggcgcgcaggcggccgccgccagctgggagggcgagggcgacgacgtcgcgcactcccagatccggcgcatcaccgcgcagcgcctgctggagtccaaacagaccgtgccgcactactacctctccgtcaggtgtggagggagccaaga

SEQ ID NO: 45381 - DNA, 71 bp, Chlorella protothecoides
ttatgcgacctcgccccggtgccatgccaaagaacctcactccccccccctctgtgactcactcgtagtat

SEQ ID NO: 45382 - DNA, 62 bp, Chlorella protothecoides
agaggaagggcgacgcgcctgttgtcgactcagcgatggcgcgcctcggcagccgcccactc

SEQ ID NO: 45383 - DNA, 61 bp, Chlorella protothecoides
cccgggccatactagtactggatgcatctgaaggatatcgcggccgcgtcttcagaggggg

SEQ ID NO: 45384 - DNA, 62 bp, Chlorella protothecoides
ctgtcgaccgacgctttccatattagtagacgcgttgtccggaatatgtaagccctttcatg

SEQ ID NO: 45385 - DNA, 71 bp, Chlorella protothecoides
cagatcggccaacccgggacaatactaatctcccagtcagatgccactcaagccaaacaccatgtttcagt

SEQ ID NO: 45386 - DNA, 64 bp, Chlorella protothecoides
tttatttagtccatcatttaaattttttactacaaaataaacttgaaaaatcaataaactttgt

SEQ ID NO: 45387 - DNA, 79 bp, Chlorella protothecoides
ccaccgtggtctgacagagtgattaccggtatgacaagcaacgcggtgtcccctcgcaagggggcccaccaccccggtg

SEQ ID NO: 45388 - DNA, 61 bp, Chlorella protothecoides
atttcggattcaaaggctcgaatagcttggtgatatgagctccacggtataccagcttggg

SEQ ID NO: 45389 - DNA, 61 bp, Chlorella protothecoides
aaaccccgccgcgttctcgacgcgcagcggtgcggcgcagccgctacgcggcgtgaagaag

SEQ ID NO: 45390 - DNA, 99 bp, Chlorella protothecoides
acgaacctgcaaatatcatatgcgctgctgacctccagcatgtagacatggggaccgtaactgtgtgaggagaggaatcttgttgtgtgtgtgtgtgtg

SEQ ID NO: 45391 - DNA, 61 bp, Chlorella protothecoides
cgtcctctaataggtacgggccccacgtcttcatgctggaggccagcagcgcggacaccct

SEQ ID NO: 45392 - DNA, 207 bp, Chlorella protothecoides
ctttgcgtttgctgctttgaagctggtgagacaaagtggttgtgttgcgcaattcagaacaaccctcaagtgccaatatgccacataaagcggagccatcgaatgcgttctgctgccacactgtcagcgtgtgactacccatcaggatctgtgttgcagaatttccaaaagcaagagtaactgcactcggcgttttctatcagcggg

SEQ ID NO: 45393 - DNA, 72 bp, Chlorella protothecoides
cgggcggacgcggatgcggccctgcagccatttgacaagacttttttcagcaggtgggtctcctgtgtgttg

SEQ ID NO: 45394 - DNA, 62 bp, Chlorella protothecoides
cgctcaccacctccctcccgctcaccacctttctcccgctcaccacctccctcccgctcacc

SEQ ID NO: 45395 - DNA, 61 bp, Chlorella protothecoides
ctgcgtgacattgatgttactacacgctgtaccccccccggcacaattcatcagcggctga

SEQ ID NO: 45396 - DNA, 82 bp, Chlorella protothecoides
gaatttgttttacacgagtatagaataaaaagtattttattgtatagtctcactactggaaaaaatctatatatataacaac

SEQ ID NO: 45397 - DNA, 74 bp, Chlorella protothecoides
ggcgctgcgcttcaccgaccaggtctggcgagcgtggaaggggggtgggtggaagcggcccatccatgcctcat

SEQ ID NO: 45398 - DNA, 114 bp, Chlorella protothecoides
atcctcctctcgtgtggtctgcagctggctgcggtcctggagcagccatgggacgcgcctgacctagaggtgccggtggccctggcgtcacagccacgagtcacgctgaacagc

SEQ ID NO: 45399 - DNA, 61 bp, Chlorella protothecoides
cgggttgacaacctcctggaggcaggaacctgggcgatgctcggctgtatgaaggatgggt

SEQ ID NO: 45400 - DNA, 20946 bp, Chlorella protothecoides
  modified_base (4792)..(4801): a, c, t, g, unknown or other
  modified_base (5192)..(5201): a, c, t, g, unknown or other
  modified_base (5296)..(5305): a, c, t, g, unknown or other
  modified_base (5399)..(5408): a, c, t, g, unknown or other
  modified_base (5539)..(5585): a, c, t, g, unknown or other
  modified_base (5828)..(5837): a, c, t, g, unknown or other
  modified_base (6847)..(6856): a, c, t, g, unknown or other
  modified_base (7099)..(7142): a, c, t, g, unknown or other
  modified_base (7885)..(7894): a, c, t, g, unknown or other
  modified_base (8306)..(8315): a, c, t, g, unknown or other
  modified_base (8786)..(8795): a, c, t, g, unknown or other
  modified_base (9955)..(9964): a, c, t, g, unknown or other
  modified_base (10350)..(10359): a, c, t, g, unknown or other
  modified_base (11011)..(11020): a, c, t, g, unknown or other
  modified_base (11575)..(11584): a, c, t, g, unknown or other
  modified_base (11677)..(11686): a, c, t, g, unknown or other
  modified_base (12354)..(12363): a, c, t, g, unknown or other
  modified_base (12723)..(12732): a, c, t, g, unknown or other
  modified_base (13847)..(13856): a, c, t, g, unknown or other
  modified_base (15698)..(15707): a, c, t, g, unknown or other
  modified_base (16152)..(16161): a, c, t, g, unknown or other
  modified_base (16721)..(16730): a, c, t, g, unknown or other
  modified_base (17918)..(17927): a, c, t, g, unknown or other
  modified_base (18464)..(18473): a, c, t, g, unknown or other
  modified_base (18979)..(18988): a, c, t, g, unknown or other
  modified_base (19983)..(19992): a, c, t, g, unknown or other
  modified_base (20572)..(20581): a, c, t, g, unknown or other
  modified_base (20778)..(20894): a, c, t, g, unknown or other
ggcgacgcacatccaggacatcgagttcatcgcccagaacaaggtgcagctggggggggctggaagcgggggaatggggttggagccgcatggctgtgttgtgttcccacgacggttcgccctctgaagtgtcgctgctacggttcatgccagatcagatcacccctaccccataccaccaccaggagtatgagatgctgactcagaccgtggacgacgggaatgtgtctgccctggacttcaatctccccatcatcggaaagtatgtcctgttctacaatggggtactggccgcacgggatttcctcatgggcgatgggaacgggaggccgcacttcgactgggccaagtacaaggaccaccgcgccaacatttctgcggccaaccgacgtggccccaacaatggggtgggcaatggcagcgcccgcttggcccaggtggtggggacaccaactcagtgaatgtttgagtcctgagttataagctctgccctccccaacaacattttttgcggccaaaccctgctgctgtgtagattgttcttgcatgtcatcgaaaaggcttgtactactcatgtgcacagtttaaccccttctgtggtcaaaccctctagcagctgccatcctgcgacgtctttcaaacccggaggtcgaacacaactaatgtgcatgccatgtttgtaagaatggaaacgtttagtataatggtgatccagctgtcatgcctgataactccagcatggtccatgcctagactatgatagtactgccgtgaggaaaaggcttgatgggaggtcgagaatccattcgagatagctggattttagcctgactacaagctgctgcgtacaggctaccaggatgggatcgaagtggcaccgccgcaccgcgcttgggattgcggcatatccggggagttctcactggcggcttcatatgccttcacatccgacatccagggaatccgaaaccattccaaacacgagcaagggagactgcaccttttcattttaacggactcgaacgattcagcagtacattaactcgagaaaagccatccatccgacctttccgtccaatcccaggcagcacccttgtgacaccttaaccctcgccgacagcacttaatcctcatgttggtcgaccgacctaaccctaagccgttgaactacgcggagatcaagaggcagaaaaaattcaaggattacgagaagaaatggaggaagcttctgaaaaacgggagtactgaggctatcgtcgacgatttcttgttcgaggtcggacccttgctggacaccatccaccttgactcgcccgtgagcgacctgcggtctgagacgaccacccactcttcagagaaaagtggctctatgccgaaagtgctggattgggtggacctcgtcctggcaggttgagtgttgggaaagcatgtggaggctgagatgggcctccactgcttgcccttggtgaacatgcccattccaagcaccacctcgaagttggcgcacgtactgctggcgggaatgcctcacatccatgatctcgacactcagcatcacatgcactcaggctccctgcgtcatccatgacaggaggcgccctcctgggcgtggcccatgtcgggtatatctttgcgctggagcatgctggcatacgcttcaggtaacccagtgccctggtgcaagagcgagggctcatgcaactttcttccaggcgctttacctgatatgcaagtgcgcccctgcgtcagcccatctgggtcatgcctcaccatcccacacgccagccctcactctgcgggtctgcatcctcacgcagggcaatcggcgggacttccgcgggggcactggcggccgtcctgctcgcagggctgcgcaccaagccagacgcgccggcggggaggaagctgctggacctgctcctgggcatgcccgtccccaaattcaaggatgggaagctgctggatcgcagggtgggggatgccatcctttccctcatgaccgacctgccttcatctccttggaagtggctcatgctgccggcgtttcctgttgcactggtgggctggggccgccagtgtgccaccaggggtcgtggacaggatttactgcgaggatgaagcggacaggatactgtcgtgcccaagctgagctccttgcggtcgattccagtcctggctgtcgtctgccatcccacccccctccaacccccccaacacacacacacgcatgtcagggtgtggctgcagggaggcatccatccaggggatgccctcgaggactgggtgcacgaacagcttgctgcaaatggagccggcacgctggcaggtttgaaggggaagtgcgacctgagtgagataaacttcaagcaggacgtgcttgacaacgactcggcatcgtcgggggtgagctgggagcagggcccgtgcaggcatggaatgtttgggcctgccgtgtgcttggctactgggagcccagcgtgtggcgctcatgtccagaccagcctgcaaccccactcctgcaactgcataggtcagaccatactgggaatcggttgagggactggtggtagcagtggccgccgacgttacgagtgggatcaaggcggtgctgagctggaagagggacaggcaggcgcaccccgtgcccctcacccactctgagctctactggtccgacccaggtgccagtggtggtctttgaggagggcaggacgagttgggggcttcagtgtcaggggaggccatgcatgggttgagcacgcaccatcagcatgcaggcggatcggtgctggcgcccaggtgcttgcgcccaggtgcttgggtccaggcccctccaaagccctaccaccccttgctacaaacagacctggagagtcccgccagatgcgtgagggccagcgtctctctgccactgtacttccgtccgatgactgtgcccaggaagaggggcgagaagctgcccctcgctggccagaatgccagcaggttgcctgacagcaagtgggcggacacggggttcaccacaaccatccccgatcgggtgattatggccccagggggcgttggcaagagtttggattggcgggagcgcaggcagcatgtagaggggaggcaacgttccggaagggtgccaggggttgatgctcgcctctttccaggcctggcgcagggcattcacctcaccacccctgcctcctcccatgacaggtccgcttccaggacggcggcgtgctctccaggttccccatcaatctcttccatgtgccgcccaccaccgaggtgcactggcccacctttggcgtgggcctgtcccccccacgacaagccaaatcaacatccggcctcggtcagctgctctacgcatcgatctccaccgccatccgcatccaagacatccagttcaccgcccagaacagggtgggtgggcaagggcagggacgagggtgtggtgaagcgggaagaggtgagccccagagtcctcttgccccgccccgttccatcgcccacacaggcccctctagccttgccatgcaggagtatgaaatgctgaccaagaccgttgatgtgggtcaagtctgcgccctggacttcaagatgtccatcctcgggaagtttgtcctcttctacaatggtgttctcgctgcgagagacttcctcatgggaacgaaggagaagaaggggttccagtgggagaagttcaagaaattgaggcgggaacgttccgcggtcgttttaaacaccaccagcattactccgacctgatgggtcgaacaacagccgtacgaatactgcacttggtgtttttgggattgaatagtaccagaatttgcaacgtcgtacctggcatgagctagagtagaggcaaatgacacttgcggcccttcccattgcctgaggccaccttcatcgtacaattgcttctcagttcaattaatagttgtgccttgtttgcatttcgaccctattagcattgctgcactggcccgatcctttctctgtattccccatgcagtgccagactgcagcgtaacttgtagtaaaggatgggattcgacctgcatcggtggtttacagcacaactggggagtccagctcaatagtgcgttggcagtaaagcatgtgtaggggagctgcattgcattgggaaaggccgcagtcaccctgctaccctctccaagcatcacttgcccccaaaaggctcttggcggcagtcgcagacctgcccaaccgtggacgaaggggaggagacggcggagacctccacgatgggggagagggcaagcggatgcccggaccgcagcccgctgaggaggccaccatcactggcttggatctctgtgagggtagaatcaggagtacaaatcattgagtgcgggccagcagattcccaacctttccacggcaccatccctgtgcctcaacaccaggcgtctgcatgatgcacgcacccgcaccatcaacaattcgtgtgcacggccacattgacctctcgcatctttctgccggagcaacacaaccacccactgcgcacacacaccattgagtccgcctgcagaagctgcgaccgagccatacaggctttggaacgccgagtgcagctgcgggggaaggacgctcattgctgccaggaacggcagccaggcagccgaccgcgacccgctcagcagcgccagcgggttcaccttttgagggttgttggacatagggagcgagatggagcttaagacagaagggcggcttggctctgcaagaaacagaggccaccagctccttggccacgcccctggcaccnnnnnnnnnnggacagaaaggcgggttggctctgcaggaaacagaggtcaccagctccttggccacgcccctggcaccctctgggtgtccacagtttggcattgcaacgctctgacccacgccccacgccgccacctttgccctgccttgctcaacgccccacctttgccctggagaactcgatgacgggcacgttctgggccagcgggatgtcggcggccagcttggccagctggagcgcccgcccgatgccgcccagcacgtccaccaggccgtgctccagtgcctgccgcccagaccacaccctgccttgtgccacggcctgcaggaaaggggggaattgaggggtgacctcgtgggagggctgctttgccgcacaggcagctggagtgtgtgcaggnnnnnnnnnntaatcagtcctgccccggtgctgtatgccaaacacccctcgcctgcaaaatccccaggccacaaattccacccactcaggcccgcccacctccannnnnnnnnncaatcagtcctgtcccggcgctgtatgccaaacaccccccgccagcaaaaaccccaggccacgattccacccactcaggcccgcccacctccannnnnnnnnngagggggaaattgaggggtgacctcgcgggagggctgctgtgccgcacaggcagctggagtgtgtgcagggcgcctcgggcgtctgatttgcacccttgagttgtgctccacgggtcctgccactcgatannnnnnnnnnnnnnnnnnnnnnnnnnnnnnnnnnnnnnnnnnnnnnnggtcgtcgggcgagacgccccgactcgccgccgcccgatcgcgaaaggagcggtacgcgatccaagccccctcgtcgaaccaggcctcctcctcgctggactggggccgcgctcccgtcagcgcctcggcataccgacccctgcggtaggtgatgtgtgtgtggtgaagcacgagtgtcaagtgaagccgcaagggacacccactcgttctcgatgtttgcgcagggcaagcggccacctgtnnnnnnnnnnggcctcggcataccgacccctgcggtagggggagtgtgtgtggtgaagcaagagtgtcaagtgaagccgccagggacacccactcgttcttgatgtttgcgcagggcaagcggccacctgtgctgggagcagctgaagttgaaacgcaggtgccaaaatcgatccatccactcccttgcacgccgcccccctctgacccacctggagatggtggtctggttgaaacccaccctctcaaacagccgctccaggctgaacttcccggtcaccacgccgatggagccggtgatggtcagaggctcggccacgatgtgcgtggcgcccatcgccatgtagtagcctgcgaggttgtggacaagggtgcggtacggtgatgtgcagaagatgagtcggagccagttcatgggcagccctgggagcccttgcctgcattcatggtccagccatgaggtcaccaccacccaacaggctcaagcctcaccgccagaggccgcgacgtccaccatggaggcgatgaccggcttcttggccgccagctgctggatctcccgccacatcaggtcggaggccagggcgtcgccgccggggctgtcgatgcgcaggatgacggccgccacctgcaagatgagtgatggagaggggcgggtgggccttggggaacattgggacttgatccacacgagcaagagcaacactcatccctcacaaaccacaagcatcatactgggccaccgaatacgctcctactttcccctgcctataaggcactactccatgtccagcaatgcaaatcaagctggaggaatgcggtgctagctgcctaccgctaaatcctcagcaggcacagaccccttactcagatagaacaacccctggcccccaccaacttctcaccttcttgttgtccttgaccgctttgagctggcggatgacgtctggcgcggtaatggcggagccagtggaggggaggccccccccacctcctccattgatggcacccgcggtccgcnnnnnnnnnngaacatcgggacttgatccatacgagcaagagcaacactcgtccctcaaaagccacaagcatcatactgggccaccgattacgctcctactttctcctgcctataagccactactccatgtccagcaatgcagaccaagctggcggaatgcggtgctagctgcctaccgctaaatcctcaccaggcacagacccctttctcacatacaacaccccctggcccccaccaacttctcaccttctnnnnnnnnnnnnnnnnnnnnnnnnnnnnnnnnnnnnnnnnnnnncagctggcggatgacgtctggcgcggtgatggcagagccagtggaggggaggcccccgccccctcctccattgatggcacccgcggtccgcaccacggcaatcacctgcctgctggccagcttccgcagcaccgaattgcccaccgccgccacacgacgaagcggcgcgcgcagcaccctgtcctccttgccgcccgtgcgctgcttgagcagctcctccacttcgtcctcgtacttgaggccagtgatccagccttgcgctgcatattccttggcctggtggtagcccgcatccagcatctcccgcacctggttgagtgggtaattttttattcaatgaaacaatcccaggctgaggcaacgccaattacagactgggcgggaagcacaccttcacccctgcaagtctaccacatgcagcagaggtaacacttcccccccatccccttgcaccagctcacctcagcctcggtcttgccgcgagagctcgccacgtcggcgctgaagccggcgtagatgtcgtcaagcagcgccgagagctgctcccgctgtgaatctgaggatggatttgacaggagccaggcctttgtttgatggggggttgatcttgcaaatgacataatcaggttaggtgacttggagagggatggacaacagcatgcctcgatggcccacaccctgacagacagcatgtcacagctcttccggtttcggcctcacccgacatgtctgtgcgcaggagnnnnnnnnnnaatggggggttgaccttgcaaatgacataaacagattaagtgacttggtgagggatggacaacagcatgcctcgatggcccacactctgacagacagcatgtcacaactcttccgggttttggcctcacccgacatgtctgtgcgcaggagctggtcacccgccgacttgtacttgccgatgcgcttgatttccggctcgaccccaatctacgaggcggtgatagcagggagggaggggatgagaatggtccacactccaactcacagcgcttgaaaaggctgtcgtgtggagtacacgcagctctacccaatgtatcgacggcaacacttggaagctgagacaccgcagctgaaagtgccagcataattttcttgatagatttcagatcccatgtccatgcctgctatgannnnnnnnnncataaggctgtcgtgtggagtacacgcagctatacccaacctatcgacggcaccacttggacgctgagacaccgcagctgaaagggccagcatatttctcttgataggtttcagatcccatgtccatgcctgctatgaacagggcgggaacactcgccacaccttgtccaggactcccctgaggaagctgcccccaacagagaagccacgcaggcccagcgaggcggtggggggcgcatagatctcctcaaaggcggatgccaagtagtactccttctcgcccgcgcgctccatgtaggccaggctgaacttgccagactccctgaagtagtcgatgtgacgccgcagctcctacagggtggcagtgagacaggaggccttgaaacgctggcttaaggtgatgacggtttctggccagacacaaggaggggcagggaatgaaagagcctggcatgatagagaattatgctnnnnnnnnnnggtgggacaggaggccttgaaacgccggcttaaggtgataagggtttctggccagacacaaggaggggcaggaaatcaaagagcctggcatgatagagaattatgctttcgccaaagcaagtgtttgtcaactttcagaaaccttgccctgctccacaatcctgctcacagacccacctacacaatcccagcacagaggtacaactccctcaagcctcccattgcctgccctctagtgccctacctggagtttggcccaaccgatggacaggggatcgatcttcaccgcaatgccacgaatccgcggatcagcagccgccttcttcagggcttctgtcagcagcggcatcgacatggccgatgagaagcgtccctgtgggacatctggcaacgctccagacagctgcagatgggtgtgggaaggtggcatggggctgcatggtcgggagcgagggagaactgcatgctgagtggctaatctcatcaaacgtcccatcaagatgctcctcagcatgtccttcaccctcactccctttccaaaactcactgtgaatgccatgacagatccatcggagatctgtcgccatggcagggcaaaggccagccgagcctggttcagccagccactcacgccctcgggtgcggagtggaactccagctctctctcagggagcttgggaagggggggtcgcacggtgacatgcagaggagcctccgccgtctgcgcaacctctgtctcagcagcagatgcccgcaggcggcctctgccatgaagacgtgcatgcccaagtgcacgccttccagtatttccagaaactgggagcaaatgagggtcgtttgaactaggctggagttgatgcactggcaccatggtcatcacgcccagagctgccaggaaaatcagacatcctgaagatgcaagcccggtatgcagccttatattccctcattacctgtatgccaagggtatgtgctcgctgcaagggctacagagttcctaactgtcaacgaaccgagtgaattaaaagccaacattgcgacggatcgtcgagcaccggctacgcaagatgtcgaagaagcaaaggccttccgatggtatgtgtgatcttattgtgtgtacaatgctccaaatctatgtcaagcgtcggcatggcgcatgnnnnnnnnnncgaagcaaaggccttccgatggtatgagtgatcttaatgtgtgtacaatgctccgaatctatgtcaagcgtcggcatggcgcatggggctctccaggtgcatgaagaagaatcgggggagctttcccaaccattcactcggcgcggagtttacgtgatttgactggagaggtgtcggcgatcttacacacagctcgctcggatacgagtgtacaaagttttctcattcaagagtaggccctcaacacgtagatattagactgaatcagaactcaagatgtgggtgagtgaatcacatctgttctgtctctgcagcctcgacagcgttcttgaccacgcctgccacatctcgacgatggcgtggcaggggacctcacgacatgaggnnnnnnnnnnaagtgaatcacatgggtttcgtctctgcagcctctacagcgttcttgaccacgcctgccacacctcgactgtggcgtggcaggggacctcacgacatgaggaacaatgataaagctgtgatgacggtcgtatcaggatcattcgaccaggatcattcagatcagaagacatgagggactgcccgtcccccacggagagcgagtgcgcggagctggccgccatcgacgccgccctccttcaccatcagggtaaagggcccgcgggccccccatcccgccgaaatctcgacctactacacgactggatatgtgtcagtggatggggtgtgttgagattcgttgtgtccagggcgttagtctgcacctcgggcctgggtacacctagatgtatgtggctgtgctcctatgaagttggattgataggcaatcgtcagcactcatccacatactcaaccaacaggctgagctcgcccacttcaatgccacccacggcatcagggtttgcgactcgcagatcgacttccttgtgtcttcggcgcaggcggctgccagcattctggctcaggcagccttccaagctgtaggactggtcagtgcgggaggtggggaggaggggggaggtggagcaaggcatgttgactggatccgactcnnnnnnnnnntattctggctcaggcagccttccaagctgtgggactggtcagtgcgggagatggggaggaggggggaggcggagcaaggcatgttgactggatccgactctctcacctgattgcatcccagtattttgccacccaatgcattgttacgtgcatggcacatcgccacaaggcctcctccccaccctcccaccctccagttggaggcctggtcacccgccctcgcccaccacctggcgggcctgtggtcgacggctgcctcctgctacacgggggtgctactggagattcaggcccactgccacgaccaggccacccgggcccgaggcacggagatggaggccatctccctgcgcgcccagctgcgccaggtacaggcgatgctcgaggagcagaaggtgggcacgatgggtgtcctgggacgtgagaattgcgtgccctgacaggccacatggtttaccttgagtctggaggggcattgtattgtactgggacggtccatgtgacgctcggagcgtgaatataccctgcgagtcctcctcgtcacaggctgggctnnnnnnnnnncttcttggaggaggactgagcctggttgcacggcactgtctgctgcggacactggagtggggtttggaggcaggacctggggctccagctggnnnnnnnnnnacagaaggtgggcacgatgggtgtactgggacgtgagaactgcatgccctgacaggccacatggtttgccttgagtctggaggggcgtcgtgttgtactgggatggtccatgtgacactcggagcgtgaacatactctgcgagtcctcctcgtcacaggctgggctggccggacccctggcaggccagaggtctgcagcaaccttgtcagagagactggatgtacctgtcttgcttaaaggtgccagatgatgacattcttggaggaggactgagtctggttgcacggcactgtctgctgcggatagtggagtgagctttggaggcaggacctggggctccagctggcactgcctctccaagagtggacagcctcacatcacatgcatcccgggagaccgttcaatcactctccgccaccgcaggggattccacagaggctttgggcaaggtaccccctactccagacgcagcgcacgccgaaggtgggtggtttagaaactggggcttgccctgctcctggctgacatcggagtgcctgtgcctgtctttggcgtgtctgggttcgccttcacaggccgtcttccacaggcacccactcatccgacccggtgaacccggcacagccagtttctgcccgacggcctccgaggtggaggaggaaaggannnnnnnnnncgagcacccggcacagctaatttcagcacgacggcctccgaggtggaggaggaaaggaagacctggcagcgccggctggcggcatcccggcaggagacgctggacgccctcaggaggctggcagaggcggaggccggtgccgaggagctgtcgctcctgaggagcgggctggagaccgccgaggcagagagggaggacgcccaggatgcactgcgttcctgcacgcctcgtccgcccccccttttgtttcagagccgggacgatgcggagcagggtgagtgttggagcgcatcctgtcctactgtcagctgatgaccatcacctagcagtatctttggctggtggtcctggtgttgctcnnnnnnnnnnaggtgattgttggagcggattgtgtcctactgtcagctgatgaccattatctagcactatctttggctggtggtcctggtgttgctcgcaagagtttaccagacctgcatgcttcagttctagtacataccaacaaggcagttcagccctgctgcttgccttccatccactgcacagagcgcctgctctggagcgcgttgaagaccgcccctgccggcctccccaccgccgacctggcgcgctggctcctggggggcctgcctgcggccggggacggcacctgtgggagtctgcacacgctgcccgatctgccggactttgcggacctgagggcagtgctggaggccggggctggcccatccatcctcgctttcctggaggcgcaccacgagctggcctggggcggggacgccggctggggcgccctgcccagcccgcggtaccccctggcggccgacttcttcaccgcgagcacggcggctggggtctcgctgccaccggagctgtacggcctgctggagcaccgggtgcggggcctggccgtggtgttggggaacgagccgaactcagcatggccaaaaggtgccatgaccagaccgctgttgcactgccttcaaaagaaggggccttggcatgggtgcatcgggcagttgcgacgtcaaccgaccccctcctctaccaatattcctccgccccaggggctcactgccgaggaggtggagggtgccatcctgtgcagcacgcagtccacagcccagaggtatgcggcgctgcaccaggcacatttgaacctccacgctgtgtgtgctgcccaggctgcccaactggaggcccagcgccaggcagaactcaaggtgagtggccggctcatgatgcacagggaaggatgcgctcttttgaggtgtcttgaagacttgtgtggtgtccagcaaatctaccttgagtgatcatcctaacgccggaaactcccattggagacaggtagtgcaaacctgcaagctcaaggtcccctccttccatcccatggtccaccaatactgactcctaacactgcattcctcctccaacacagagggacattgcaaagcagaagcgggaggagatgagcgagaagnnnnnnnnnngactcccattggagacaggtagtgcaaaactgcgagctcaaggtcccctccttccaacccatggtccaccaatactgactcctcatactccattcctcctccaacacagagggacattgcgaagcagaagcgggaggagatgagcgagaagaagcatcccatccaggacttcgtcgaggtcctggctgcgcagcctgaagaagcttgggcgacgcacctgattggcatggggcagtccaacgatgtcccgcgcctcttccgagtcaccggcaaggtgcaccttgtcggggagggaagtgaaagctggcaaggggtgtcggcccccctgcaaagagggctgacatggatgagatgtgccactacccgttcaagatttccagcatcagcaaaagtgtgatgagtctactgcgctgtgaatacactggggccccagccaatatgcacctggcaatctccctcaggttcggaacaagaacatgtccaagcgggagacggagaaacttgtcaaggaggtgtgggcccttcgagtgcaggacccaggtgagaggggaagtcgccgaggcaaagataatcagtctgtcgctgcctgtagtgaggctcagggtccactcacagaccatgctcatctgcagcgtttgtatatgcatcatgaaaatgcaaaggggagtgactacgtttggatgcagcgcaacactatccctgctacacttctctccctgccgccttcccctgcagctgtgcgagtggggaaggcgccggagctggtggagttcctgttcaccatgttccagaagaggatgggcatcatgactgcggtcacagaggtgagctggcgcccagggctggccgctcagccgccaggccccgccggttttgaaggcgcaatctcgtccttccttactctcctgggctggaacgactggcatggcttccaagatgcccagcataaaccatccctgcattacaaacccatgccagattgcttacagcttcctctacggcctgtggaagtatcagtgggacgccgactgcgagctcttcctgaagatactcatggtgagggccactgccgacgggttgggagccatgctctgacgatggccaatggttgttagacaacgacccttcccctcgtcttgcccctgcccaccttcaagggtgaggtgaaggaggacgtctactttgcccagctgcaactccaggacagcctgaaggaattgctggagtctctggaccgagcccagggtgccgcgacgggtactctgaagaaagtaggtggtggggaaagggagaatattctccaagccatgatgttgcactggccagaggatggtcggtcattgatgcggtgatctcagtgaactgtagtatcatttctccatgcccaacacctgcatccgggcatgcacactccagtcgcttcgccaccaatactgctcccccctggaatgccatggatggtatgaactcggagcatctcacacagctaccaaaaccctgcacccctcttcctcacgcactcctcaggaggacctgagggtggccctgcatgcctacttcagggtggggctgccagggggcaagaccctgcagcgctttgatgagctcatgcaggccctggatgaggaccagcccggccccagcgtgcagtgggccaccatcttcgaggaggaccgggagttcaaccagggtgagtgggtggtgaaagggttgatggaagcagtagcgatgtgtccagaatgccacgctgtctgacctgctggcatgccacggtgccgccccacaagcaatcccctgccacctcccccaaccccaccacaaggcgagttcgccgagtcggtnnnnnnnnnnaccacaagcaattccctgccaccttccccattcccaccacaaggcgagttcgccgagtcggtgcgtgaccagtttctctgcgagcgcatagagtacttcaacgccctcgaggaagccctgtacgaggaggcagggcacgcggaggagtgctccgtggcccacattgcccgtgccctcatggcgatggacagcgagctcagctaccgagcggcttccctgctggcggcgggtgtgtggggagactcggcctcggagctgatgtcagtcaagctggccatgaagagggtgcgtcttggggtggagcctgggacatgctgcgctgtgtgccacatgattcaatttagaggggatggtatcggtggggatgacatggtcagaccttcgcacccagaagttgatgagcctccatgcagatttcaagaggtacggtcaagaagggccaaannnnnnnnnnaaacccagaagtcgatgagcctccatgcaggtttcaagaggtacggtcaagaagggccaaaagaatcgagcctccagcgctcgtgcctccgtgctccctggaagactggctggtgcagccagcaaagggaagtcgggcctggccccgcagaaaggcaagtctccgggcatgccatggtcggcagtattgaagcagtccacagtgtggtgtcttccggacagggcgttgcaccggatcggattttactcatgttgcacacagtgatttctctcagttacttcagctatatactttgtcaacttatgtaccatcctcaggagcacgtcgcggtgtagacgagaatgtggctcgagctctggaggcgatacggcagagctggctcaagggcttgagcggcaacaccaacgcaggctagcccaagggtgctattggctatatattgagctttatatacagcagcttccttgggattgaggggtcattaataatatgctgaaacagatcgggtcaggcgagcgagtttgcgaacgcaatgttttcgagaccctaaatccggccgnnnnnnnnnntttctttgggattgaggggtcatttaaaataagccaagccagatagggtcaagcgagcgagtttgcgagagcaatgttttcgagaccctaaatccggccgcgcttcagagaatcatggctgaaggaaatgaaatctcatcgcccagggctactgagtagccccaaggcacctttggcgtgtatttaccttactcttattgatctcgtcttcccgagagcgcgcacgcaagtacatcgatgcagtagcgaacggtcacactccgtccccgcaatgacttctgttggctggatcggcctcggtggcatgggagccggtgagacatgcagtgctacttgatgctcatggatttgagtgttacataagggagacggagaggctgcgaggttatggtgggtgtgctcaccacttgatctcgtgcgccagtgctccgacacctgcggtgcccatgtagggatggcgagcaacttgcacgagggcctttcgaagggcatcccggggtatcaggacttcctgcaagttttcaatcgcacatcgagcaagacaactcccctgcaagagcttggggccaaggtggctcagagcatccacgatctggccgactgtcgagtggtcttcagcgtctccagcaacgatgcctctgccgaggaggtgagacccgggcgtcgatgccatgacttgtatcaccacgttgacccgaagatggatctctggattgcaacggccaagttcatgcaacccatgactcctgattatgctgctcccaaccctcagctcttccttgcctggctggagggacgcacaggggagtgccagccagccgcctacattgactgcagtaccattcttccggagacctccaggagacttgcaaaccagggcgctgcccggggcgtgaccttcctcgcctgcacggtgtttgggcgtcccgacgtggcagccgccgggaagctgacggccctcctggccgggggcagggccgagctgcgggagcggctggtgcccttggtctccacctttgctggggtagccgtcaggaacctgggggacgacccaggcttgagcaacgccgcgaagctcaccgggaagtaagtcggtgaaggtgtactgggcactgcagtcacagatgctggacaatcacaagggttcagacagtagcccctcctctgccatgccacctgcgtgcagcnnnnnnnnnnttgtactgggcactgcagtcacagattctggacaatcacaagggttcagacagtaatccctcctctgccatgccacctgcgtgcagcttcctcatcggggcccagatcgagctggctgccgagttcctcaccctgggtgcgcggaatttgggttggtgggtatgactaccttgcagacgctggggtagcgctggagcatccaaccttgcggccagggactcactgccgcctcattccgccgatgcaccaccctccacattcacccctcgctgccacattcgcatcaccaggcgagcgtctgggcgtcggcaccgacgacctgctccacgtccactccctcatcagctctgtcatcgcgcccaagtatgccgcccacattgtcaggggcaactatggatcccaggtgagcccacgcaagtcccatgcatgcttgcggcatagcttggtcgagccgtctcctccatacaccccaacaccaccctgacccacatcatcttcccttcatgccagggaggctttgtgctggacctggcgctnnnnnnnnnnatctcctccatacacccccacaccacccttacccacataatcttcctttcctcccagggaggctttgtgctggacctggcgctcaaggacatcgggcacgtgcggacattggcgcgtgacgcctcctgccccgtccccatcgccgacctcgtgttcaacagcctgctgtcggcgcgggcgcagcatggccctgacctggactggagcggaatcgtgctccccgtccgccgggcggctgggcttggggggatcagggatgggggggcccccacagcagcgcaaggaggctgagcgagggaggtggtcgtccatgtctgtctgcttcgggaggctgctccagcgcagggcggggccaggagtctccagccctcctaacgcccaggccaaacaacctgcaaaaccttgccccgcgaaacccagttcttctaccttggcgtcacaagtttaagagacccccaaggtctgagtcagggttatacttgagtgagtcagagcactgtgtagtnnnnnnnnnnctgggggatcagggatgggggtgcccccacagcggcgcaagggggctgagcgagggaggtggtcgttcatgtctgtctgcttctggaggctgctgcagcgcagggcggggccggaagcctccagccctcctaacgcccaggccaaacatcctgcaagaccttgccccgcgaaacccagttcttccaccttggcgtcacaactttaagagacccccaaggtctgagtcaggttcatacttgagtgagtcagagcactgtgtagtcggtctaccggccgtgaagctgctgcgcggcaacaaaccgccgcgtcagcctccgcgatggctcagccgcggcaacggcctgggtgcgggagccgtgcatcgagcttggcgccttggcgccgccgccccagtctcccagggcctccgccagttccgcgtcgaggggctggggcgggagcagcctcttgcgaccccggcgcttggccggcgacgtgtgcgctgattgagtattggagagcaggatgtcagatgaagatcaggctggtggctgatgctctgtcaccggaggactgcataccccagaaacacatccaatgcgcatgagcagatcagagggagggaagcactactccacgagggggccacaccacctcacctgggagctccttggcggccacagcgccgcccactgggcttgcgctgggcccggcgacagtgttggtcaggtcggtcagcacccgcgcccggggcccgcgggctgtgctgtccagagcctcaccagcaactttgcccctggcagccgccgcaggagcagagttggccaccgccgcctccaggtcgacgtcgagtgcaaaggtcacgccctgccgccccttcctcctccccctgccggcctgctcagctggtctgggcgaggatccttgtgctgccagctcctcgggcacctcctcctcctcgggcggtctcggagcggccagaactgcggcccgagtctggcgcctgccccgcctnnnnnnnnnngttcttgcgacgccagtgcctcgggcacctcctcctcctcgggtggtctcggagcggccagaattgcggcccgagtctggcgcctgccccgcctcgccgccctgccctcccccggcgccgcaggcggggcggcatcacgccctgtccctctgccgctcgggccagcggcggacgcaggagccccatcgcctggatcggcagcctgtttggtggtctcgtcaatcttgtcggaggcctcggcaggctcctccctggcctccagagcctcccgggcactgccctggacctggctggacccctccgcagccggggtcacagccgcaggccctccctctggctcgcgaggcgacgctgcgccccgcgccccggctctgcccccccccttcttcctggccatggtgcgccgcctctgggcccggccctcctgccccgccgcgcccgccgccgccgcctcctccgccgtggatggccggctggggcgcagtgcgcccgaccccggcaccggccctgcagagccctgctccggggttcgccgcgccgcgccctgggcccccgtccccaccgtctcctgcgtggcggnnnnnnnnnncttgccggtgaggctctggacagcacagcccgcggccccggggcgcgggtgctggccgacctgaccaacattgtcgccgggcccagcacaagcccagtgggcggcgctgtggccgccaaggagctcccaggtgaggtggtgttgacccctcgtggagtgatgctctcctccctctgatctgctcatgcgcattggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacatcctgctctccaacattaaatcagcgcacacgtcgccggccaagcgcc

SEQ ID NO: 45401 - DNA, 61 bp, Chlorella protothecoides
gcgcgcgccgcggtacggtctgcgcagcgccgggcgcgccggcgcgggcgcgatcccctcc

SEQ ID NO: 45402 - DNA, 233 bp, Chlorella protothecoides
acccgggatgggggataattcgattctctcattagcatcacttaaaacccatagaagccagacgaccaggctattcagtgtcagtctgaatgcagacgaggtgctcctgataggccctgcgtgagggcaggcacgacttcaatatgtgctataccgagccccaacttgtaccaaaagctaagcaagctgtatggcaacatgcgcctattctgtacactagaagcaaacctgct

SEQ ID NO: 45403 - DNA, 66 bp, Chlorella protothecoides
cagggtgctgcttggctcggaacatatcacgaatagggatcatgacaaaggcataaccccgaagga

SEQ ID NO: 45404 - DNA, 61 bp, Chlorella protothecoides
cgtcctggccagcatcccgccctacgccacgggcgccgccctcgtcctggtcggcgccatc

SEQ ID NO: 45405 - DNA, 83 bp, Chlorella protothecoides
catgatgttaagggtcgaggtgcgaatggatccggacttgctgaagcccttgtgcctttagtttgtgaggggtggacgtgttt

SEQ ID NO: 45406 - DNA, 61 bp, Chlorella protothecoides
tagccagcaggtcagcatgacatactcctgagaggcaaggattcggggatggtggacataa

SEQ ID NO: 45407 - DNA, 61 bp, Chlorella protothecoides
gaaaactcgattgagatcctcgggctgaggacccttgccagccactgccaacgccggccta

SEQ ID NO: 45408 - DNA, 107 bp, Chlorella protothecoides
cttcttgggtggagcgaacgttaagacttgcagcaagattccggaagcgctcttggtggcagtccagcgtgtcaagcagctcaacactccatgcaagcgcagccaca

SEQ ID NO: 45409 - DNA, 61 bp, Chlorella protothecoides
agaagtacatctacgccctcatgtcggcggtgggaatcttctgcctgggggctggggcggc

SEQ ID NO: 45410 - DNA, 61 bp, Chlorella protothecoides
gtcggcgggtgcatgaagacgccagctgggtggctgcttttgaagcattatgtccttgtgc

SEQ ID NO: 45411 - DNA, 80 bp, Chlorella protothecoides
ctctgcctcttgcggggttgccttctgctggtcctgcagatgtccagcagcgctgtctttacttgtggccgagtcgacct

SEQ ID NO: 45412 - DNA, 62 bp, Chlorella protothecoides
gaggactccccaagccccagtccggaggattcgccttcccccagccccgaggactctccctc

SEQ ID NO: 45413 - DNA, 69 bp, Chlorella protothecoides
gagtaacgcatttggtgaggattgggttctctgccgtgtcgaccatctattccagtcacaggcactacg

SEQ ID NO: 45414 - DNA, 61 bp, Chlorella protothecoides
ctccttgccccacacgctggccacctccacatggtccagcctcccggggtcaacccgcagg

SEQ ID NO: 45415 - DNA, 87 bp, Chlorella protothecoides
aaaaattgtgtattgccttgtaagtctgtaagtgtaactagagtattattagttgtactctgtatgtgtataattccactttttttt

SEQ ID NO: 45416 - DNA, 106 bp, Chlorella protothecoides
atacaagcggctggcggcatgggttcttctggtcatgaaaaagggagcgcaggaggagcgcgcagcactctacaattaccttgtggaagctgatccgcctgtgctg

SEQ ID NO: 45417 - DNA, 61 bp, Chlorella protothecoides
tctcattggctgcacaaaaggggggcggggatgttgtcagtgtgcagagcgcagggcgcca

SEQ ID NO: 45418 - DNA, 61 bp, Chlorella protothecoides
cgcagggggagaagtcaggggtaaggtacaaggaacgggaaaagtacaagcacagtcccat

SEQ ID NO: 45419 - DNA, 65 bp, Chlorella protothecoides
ggcggcgtgcccagcacctgacccggcacgccctgcggtttgtgttggggtgacgttgggagtct

SEQ ID NO: 45420 - DNA, 61 bp, Chlorella protothecoides
tggaccatatagattctcatggcggtcggggtgcgacccaccactcgccgatgaactgtca

SEQ ID NO: 45421 - DNA, 66 bp, Chlorella protothecoides
ctgcgcccgcatgctggcgtgcctcgggtcttgatgcagtgacgtcgtgattacagagcgtgccat

SEQ ID NO: 45422 - DNA, 104 bp, Chlorella protothecoides
ggtctccagggtgtggatctcggagggcaccagccagcccatagggccccaggaccaggcgaaggaggcgatgtagacgcagatgacaacaagcacgcccacgg

SEQ ID NO: 45423 - DNA, 69 bp, Chlorella protothecoides
tggtgcgtgagcacccatttccacctccacaggcaacaccaccattatggccaccaagctctatactct

SEQ ID NO: 45424 - DNA, 61 bp, Chlorella protothecoides
ggtggcaagcgcatcctccagggagtcggggaggacgtcgtcgtcccgagcggcctcgggc

SEQ ID NO: 45425 - DNA, 83 bp, Chlorella protothecoides
ctgcgaggggaagaaggttacgagggtgaattcggtatgtaattgttatgtgcaattgcagatgcaggtcagcatcattcctc

SEQ ID NO: 45426 - DNA, 61 bp, Chlorella protothecoides
gggaagggtcagacattgcattaccctcagtcatggaaggccaggaagacacagatgcccc

SEQ ID NO: 45427 - DNA, 93 bp, Chlorella protothecoides
gccggtggtcgcatgggggtggagggcttgggcaggcttcaggccccgcacagcacacacacggacacccccgcgttcgtttcccaagatcac

SEQ ID NO: 45428 - DNA, 167 bp, Chlorella protothecoides
gggtggggcagtgcattcctggcggtggggaagggcgtgtttgtctgtagagggccatacgcaggccagcagcaccctcgcccagtccttctctgtgcagcctcctgccgtgaaatggccacccgactgaagtgcaacccctccccacttgcacatgtcaggacgcc

SEQ ID NO: 45429 - DNA, 63 bp, Chlorella protothecoides
cattggggcttcttgaggactgatggaccctcccatacaacatgccctaccaaggatcacatg

SEQ ID NO: 45430 - DNA, 61 bp, Chlorella protothecoides
aaacatggctacctcactgcacagtcagggtggatctggcagaaccatcgctggtggtctt

SEQ ID NO: 45431 - DNA, 61 bp, Chlorella protothecoides
cagatcactcacatgcacacatcatgaatggagggaccaggccaacatgggtttggcagcc

SEQ ID NO: 45432 - DNA, 61 bp, Chlorella protothecoides
ctccccggccaggtgggggacgtggtctggcacaaacgcagggaagcctgccttggcgcgc

SEQ ID NO: 45433 - DNA, 66 bp, Chlorella protothecoides
cagcaccggccctgcccgctgagggatgacaagtggagtcaacacaccacccctgtccccctccca

SEQ ID NO: 45434 - DNA, 61 bp, Chlorella protothecoides
ccatggtgtgtgcgctacgtgatgcggtggtgtgggtgcaaccagggaagccatggaggag

SEQ ID NO: 45435 - DNA, 68 bp, Chlorella protothecoides
gatggaatcatatcccataagccgagggttcgaatcccccttccgctaaagcatgaagtaatgccttc

SEQ ID NO: 45436 - DNA, 61 bp, Chlorella protothecoides
atgagtatctcctggacgctagcatgctatttgatgcagatttaaacactcatatggccaa

SEQ ID NO: 45437 - DNA, 68 bp, Chlorella protothecoides
cgggcgcggagccgacgacagcaggaaccgagtgagttggaagggccgagatttcctcctttccaggg

SEQ ID NO: 45438 - DNA, 76 bp, Chlorella protothecoides
agaacgtgagtctcctggtgtgaggcgtccagagtggggattgaagcaatctgctcccggggtcctgaagcagggt

SEQ ID NO: 45439 - DNA, 105 bp, Chlorella protothecoides
gcgccgcaggagattgccgccgaaatcagggccgagcagagccccaagcgcctctacaccgtgcgcggcaaggtgtacgagctcctcgtcaactgcatcccccca

SEQ ID NO: 45440 - DNA, 97 bp, Chlorella protothecoides
cccccccaaaaaaacacacaaaaagaaagtacctgcgtccagatcgttgatgaagagcgaggacattttccccttcttgatggtgtcggaagcctcg

SEQ ID NO: 45441 - DNA, 114 bp, Chlorella protothecoides
cctccccaactccaggctccatgggtcccattggactcactcatcaacatcgtcatccagtccatttcatgagcctccttcagcgtcttgtaggttgccacggcttgataagcc

SEQ ID NO: 45442 - DNA, 72 bp, Chlorella protothecoides
gggggtatgcccccaagttcgtcagctgcagcttgtactcagctgtcttcaagatgatcacctcagcgggtc

SEQ ID NO: 45443 - DNA, 61 bp, Chlorella protothecoides
cctgggaccttgtgtctttagttcaaacaaaccgccataatcacccacctccagcgtcttt

SEQ ID NO: 45444 - DNA, 89 bp, Chlorella protothecoides
atccccacgcggccctgcagccaccggagcgtgcattctagtcgctgaacatgccctggtacctccactccttccaggcggaggaggag

SEQ ID NO: 45445 - DNA, 67 bp, Chlorella protothecoides
actcacagctgagactgacactcacacatttactgctgaacctcacactcacacctgaaactcacat

SEQ ID NO: 45446 - DNA, 61 bp, Chlorella protothecoides
acccctcgacgcccaagtgccatgcgatgatccttcccatgcaccccacccgatgccatca

SEQ ID NO: 45447 - DNA, 80 bp, Chlorella protothecoides
cctcagctcctaggcagcgcaccgcctggccattcctgcgctcaaccctgccgcggtcccctcctccggcgtaaggatca

SEQ ID NO: 45448 - DNA, 61 bp, Chlorella protothecoides
tatccagggtctggtagatgcgggaggagggctggtggatggtggtgacgatgacgcggcc

SEQ ID NO: 45449 - DNA, 81 bp, Chlorella protothecoides
aattggccagaccctacctttaaacccgttgtgagaggcaagcgcaacctcctgatctcacagaaccctcgtattccctcg

SEQ ID NO: 45450 - DNA, 66 bp, Chlorella protothecoides
atgcactgagggctataccaggacaccccccgtgggaatatgctactacatctgctttgagcaagg

SEQ ID NO: 45451 - DNA, 80 bp, Chlorella protothecoides
agtgccttgatgggtgccggaccgcacgcagaaggcgtcatgggcaagtgagtgggcccttgggcgtcaccccagcggtc

SEQ ID NO: 45452 - DNA, 61 bp, Chlorella protothecoides
agcactgacacatgtctgcaggagtgactaaagcaagctacatgcattcgcacgaggcagc

SEQ ID NO: 45453 - DNA, 74 bp, Chlorella protothecoides
acgtcgtcgcgccctgactcagatcgatcttgactgcgagcttaacatcgtgcccaggacgcaatcccatccca

SEQ ID NO: 45454 - DNA, 76 bp, Chlorella protothecoides
aatctgcatcttcatggcagagcagcgtaggatcctccagggttaccctttctgagtgacccagagactcctcagc

SEQ ID NO: 45455 - DNA, 61 bp, Chlorella protothecoides
ggttgaccgtccccgtggcggcggagggggggccgggatcctccagcgacccatcaaggtc

SEQ ID NO: 45456 - DNA, 70 bp, Chlorella protothecoides
aaggggaagccgccgcaaccccctccctcggctaatgacaagaaatggcagcggtaagcgtggagggctg

SEQ ID NO: 45457 - DNA, 76 bp, Chlorella protothecoides
aaaggcaacctacgtggctcgttggcggagggatggggatcggccaaggtacgagtcctgttgtggtgggctcctg

SEQ ID NO: 45458 - DNA, 75 bp, Chlorella protothecoides
ccaggtggtggaggcggggctgggccacctcccctttgcggagaagacggtgatcacccccaccggccaccccta

SEQ ID NO: 45459 - DNA, 85 bp, Chlorella protothecoides
gctcgtgatttgggaactcggccattattgtacggcttggacatcctggcagagagtgtggccgatgggcttgtgaaacaccgaa

SEQ ID NO: 45460 - DNA, 61 bp, Chlorella protothecoides
tgcatggatgtaaattcaagatagattggatgcaaattgggatgcgcctccaatggacacc

SEQ ID NO: 45461 - DNA, 66 bp, Chlorella protothecoides
aggaggagcacgatttggttcccctttgctgcctcgtccgccttggtggagagcctcgaggcggta

SEQ ID NO: 45462 - DNA, 72 bp, Chlorella protothecoides
acctcaggatgcagcagctgcggggacggggacggggcggggagtgcgatccagggcccaatgcagggcgct

SEQ ID NO: 45463 - DNA, 139 bp, Chlorella protothecoides
gggcagatcaggtggcggcatgtcactagtatcaagcaaggtccagcatcgcaaaccgcttcaagcgctgcacatgcgatccagtgagagtgcttggcaagaacccatgccacatgcgagccgtttcgcacccccgcat

SEQ ID NO: 45464 - DNA, 92 bp, Chlorella protothecoides
tctctgcagcagtgggcagagggtgtgcaagtgggtgaaagccttctgagtaatccctcccaggtgtaaacatcaagaatgcgacacttgca

SEQ ID NO: 45465 - DNA, 74 bp, Chlorella protothecoides
cgatcatgaccaatctatatgtcgagtatcgacagcattgtttccatgccatgcgtgcgcattgcttcatgcgt

SEQ ID NO: 45466 - DNA, 61 bp, Chlorella protothecoides
aggtctccactgtaggcggctgtctaggagaccaccctccatgtcctcggcctttccgtcg

SEQ ID NO: 45467 - DNA, 121 bp, Chlorella protothecoides
aacaacgcaggagcgcatctggaccctgcccaccgccctgacgctggcccgtgtggcggccatccccgccttcgtcgcgctgtggtactcccccgcgccctgggcaccggcggccgccacc

SEQ ID NO: 45468 - DNA, 61 bp, Chlorella protothecoides
aagacaggtggggtttgatgaaggggggggtgaaatttgatagctggcaatgtctatcgtc

SEQ ID NO: 45469 - DNA, 90 bp, Chlorella protothecoides
ccactagatgctggccacatcacggtcctcaggctcctgacctatagtgtttgtgatcgcggtgggctgggtccaggaacgagaaggtcc

SEQ ID NO: 45470 - DNA, 78 bp, Chlorella protothecoides
ttcgtcgcggaggtggtggagagcgcagatgccgccctctttgtcggtgagactggaggagcctgtgactgagagggc

SEQ ID NO: 45471 - DNA, 72 bp, Chlorella protothecoides
aaagattgagtacatcctttgggtccactggtacactcatagtacttcatactcctttgtggccgcggatca

SEQ ID NO: 45472 - DNA, 61 bp, Chlorella protothecoides
gcagcatggtatagtcccatccttttacataccatctgcagccactcatggcaaggcagag

SEQ ID NO: 45473 - DNA, 73 bp, Chlorella protothecoides
ttcaacaccttcctccccaaagtgtgcagctggtggattgagcgcaccctgttgcacttggcggtaaatcttg

SEQ ID NO: 45474 - DNA, 62 bp, Chlorella protothecoides
tccgatgctccgacgcttgaaggggcccgcggggggttgtccgggccgatgccgcagtgagg

SEQ ID NO: 45475 - DNA, 79 bp, Chlorella protothecoides
gctctgcacttcccatggagattatgccttttctgaggacagcagtgtatgagaatggaagcatccagacaaacatcat

SEQ ID NO: 45476 - DNA, 62 bp, Chlorella protothecoides
acctggctgtgatgcgccatcatcctgccacacctcccacctggcgtcatccaaccgtcgag

SEQ ID NO: 45477 - DNA, 61 bp, Chlorella protothecoides
agacgccttgcgcagcgctcgctccgcttgcagcctgcagggaaatttgttttggggggag

SEQ ID NO: 45478 - DNA, 2312 bp, Chlorella protothecoides
  modified_base (327)..(418): a, c, t, g, unknown or other
  modified_base (476)..(485): a, c, t, g, unknown or other
  modified_base (552)..(561): a, c, t, g, unknown or other
  modified_base (701)..(761): a, c, t, g, unknown or other
  modified_base (1103)..(1112): a, c, t, g, unknown or other
  modified_base (1522)..(1531): a, c, t, g, unknown or other
cgagctggggccggagcacgacccgggcgcgcccgtgcccgccagcgcgagggtgcaggcggcggaggaggcggggccctcgctcgcccaccgcgcccggcagctgagtgcctgggtccaggcgggaccggccgggagggtcctgggcgcgacgcgagggacgatgggtgcttccctcccctcgctcgccctcctgggccccttgctggcctttggcgggcccgccctgctcctcgtcggtgtcctggcggcctgcctgctggcggggcagtcctccaccggctcagcatcgaccactgggctcgcgtccggcgccgcgaccgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggggtggcgggtgcccgcgatgctctgtcgttccagggcgggcgcggcacgaccnnnnnnnnnntgtgtgtgtgtgtgtgtggtgggtgcccgtgatgccctgtcgttccagggcgggcgcggcacgaccnnnnnnnnnncgtcctggcggcctgcctgctgcgggggccgtcctccaccggctcagcatccaccgctgggctcgcgtccggcgccgcgaccgaggcgcccgactttcccacgcacacgcccgctgtgggcggcaggtgagcgcggcggnnnnnnnnnnnnnnnnnnnnnnnnnnnnnnnnnnnnnnnnnnnnnnnnnnnnnnnnnnnnnacgtccccatgcacggcgcccgtgtggaagcacgggggcggtgccctgagagtgacccgccgcccccccacgcgacctccccgcaggcgccgcacggccacggccccccggccgcagaccgcctcgcccgtggcctcgtacaccgcgcgccagtctgccaagcgcggcgcagactccgccctcaccggcccgacggccgccacctccacaccgggggtgcacacccgccgcatggcacgcactgcgctcgcctagacgcgcggcgcggcgccccaccgtgcacggcgctcgcctggacgcgcggcgcggcgccgtgcacagcaactccctgcgacggccggnnnnnnnnnnggcgctcgcctagacgcgcggcgcggcgcggcgcggcgccccaccgtgcacagcaactccctgcgacggccggcgggggacgacctgcgtgctccacaagacaccccacccacacacccagcaccgacggacctgcactgcgtttcattgagttgcctcaccccccgtttcggacgcggacagagagatggacgatcgacagcctgtgaccaccctgtaatttcctgcgtgaggcatggtccaggggtcgggggagctgggatttcctcgagccccgacgaccgggtgctgcaggggcgtttcgaagatctactggtcagcatcctgggccgggagtgggagcggaggggtgtcaggctttgcccccccttccaaaggcatgcaagcagtaccgtggcgatcccccagtnnnnnnnnnnctccccccccccctcttccaaaggaatgcaagcagtaccgtggcgatcccccagtaccgcacctcgaaccgagatcaacaggtggatccgagtacttgacccacccaccccccgcgatcaccgctcgacatcgacgcgcactcccatggtcctgccggagcacatcctggtgcaggaggccctgcacgcctgccagggcatcagcgggcgctacgtgtggtggcagcccggcaaggatgggggttccttcgcgctgggcccgggggcagaggtgccccccgcccagcgccaggccgtgtcccgcgtggctgaggttggagccctgctgcgtcgcatcgaggagctgcgtcgcgaccccccctccccgctgcacgaggccctgggctcggcagcctcccgggaggtctcctccctgctccgcctgctggccatcctggaggccagggccggcacccgctccgacgccctgaccctgcgacgcctggaggtgtggctcgccgagccccgcacccggctccgcgtgctggccggcgccctggaggccgcgggggcgcggcgcgggggcgcggcgctggacgcgctgcacgccctctcccgccacggcgaccccctggtccgcgccgtgctggtccccctgctggaggccgcggcggcgcccatgttccggggcatcgcatgctgggtgctggagggcgcgctggagccgggcgccgactttttcgtcgccgccacgcacgcggcggcgggggcgggggagcgcggcggcgcccccgcccccgcc

SEQ ID NO: 45479 - DNA, 61 bp, Chlorella protothecoides
ataagtaggtcctgccgaccgacttcacgcaccctggctggacgagacgatcgaatcatgc

SEQ ID NO: 45480 - DNA, 75 bp, Chlorella protothecoides
ggtgtgtgcgtgtttgcgtacctgggtggggtttatgtattaacggagtgttgggggctgggtgtccaatggctg

SEQ ID NO: 45481 - DNA, 61 bp, Chlorella protothecoides
ttggctgtgtgttgggctggcagggggtgcagcagccttcgctgctctgcagcgatggagg

SEQ ID NO: 45482 - DNA, 61 bp, Chlorella protothecoides
tactgcaatcagaggatgaagtgtttgctcatgtagccgtcacacaagatgacgtacggcg

SEQ ID NO: 45483 - DNA, 61 bp, Chlorella protothecoides
agggtacgtggggatggcccctgcagagtatcatttactggagtcccccactccctcccca

SEQ ID NO: 45484 - DNA, 61 bp, Chlorella protothecoides
ttcaccttttcccaacgctgggcctcaaagtcgatgttcgggtcagggtctccgaagacga

SEQ ID NO: 45485 - DNA, 72 bp, Chlorella protothecoides
gtgctggatgagtggttgggagttcgcagtccacccacccttgactgatacaagcagtgagggtgcctgatg

SEQ ID NO: 45486 - DNA, 83 bp, Chlorella protothecoides
gaaatgcagaggttgaagtacaacccgcttgtctccaactacaaacacccctgttcatcagccgtacgcttgacgctgtcaca

SEQ ID NO: 45487 - DNA, 61 bp, Chlorella protothecoides
gcccagcataccgcggggtgttatttggcgtggagacagctggtggtctgtggtgtggttc

SEQ ID NO: 45488 - DNA, 62 bp, Chlorella protothecoides
atatcctgccaagggctcgacatcaatcgaacatgccttcctcacatcggggagacagcaat

SEQ ID NO: 45489 - DNA, 71 bp, Chlorella protothecoides
gctagaagcacagacctgtgaagcaaaacttgttccaggaggtcaccatgcctgaagcatacttgctggac

SEQ ID NO: 45490 - DNA, 1380 bp, Chlorella protothecoides
  modified_base (218)..(227): a, c, t, g, unknown or other
  modified_base (543)..(552): a, c, t, g, unknown or other
  modified_base (1218)..(1227): a, c, t, g, unknown or other
cctcccgccagggccacaagcctgaccagggaccgagtgaatgctgcggtgcctggccgccctctgctgccagggagaggggagggacagggggtggcggaggggacgggcaccagcccccccccttcacgcagccactgctaggacgttggggtcctcggccgcctctacctggtccggcatgcttgcaaggcagggcgtccagtccagctggaagnnnnnnnnnnggacattggggtcctcggccgcctctacctcgtccggcatgctcgcaaggcagggcgtccagtccagctggaagtctgggtctgtctggtgtgcagccaggggagggaccgcctcgggcagcggctcaacgccccccgccgacatcccacgcagcagggcctcgctccgggccagcacctgtcgcgcgctgggcctggcccgcgggctgggcgccaggcactcgcgcatcagggcctgtgagatggggagggccgggcgggttggggcggggacgcgcgtgccctggcctttgcggcgtcggggccccgccccgannnnnnnnnnagggcgggttggggcagggacgcgcgtcccccggcctttgcggcgtcggggccccgccccgaggggtgctcctcgcagaggcgcggcgccgcgccgtgcaggcggcccggcccgcgaagcccgagcctgcggcgcctgcgccccagccgcccctcgcaaccgctcgcaccccgccgcactcagcggctgcatcaccccttcgcccccccggacaccccaactccctgctccccccacctggacgtcggccccaagcgcgtcgccctgggccaatggggagggctccaggcccctgccctgggtggcgacctggtacaacacctggctggcgcgcatgcccttccaggcacgcgcgccctcgtacatctcgtacagcagcacgcccagcgcgtacacgtcggcggacagggtcaggtgaccggacatgaggacctccgggggcctggacggaggggaggacgggcgggaggagtgggatgacggggaggaatctccggcgcgacacctgcagcggcgcggagggccgcaccggcggggcgttggtccaggaccggggcccccttttgcaagcatgcaggcgcgcacagggctccgaggtctcctgcacctctccgcgcacgcgcatctgggcagcgaccgtcaccggtgccccaccccacgcgtcgnnnnnnnnnnagcgcagagggccgcgccggcggggcggtggtccaggacaggggcccccttttgcaggcatgcagccgcgcacaaggctccgaggtctcctgcacctctccgcgcgcgcgcatctgggcagccaccgtcaccggtgccccaccccacgcgtcg

SEQ ID NO: 45491 - DNA, 61 bp, Chlorella protothecoides
gacgctgctcagcatttgtgggagacctggtcgtggagggggaatcaggccattcagggtg

SEQ ID NO: 45492 - DNA, 19032 bp, Chlorella protothecoides
  modified_base (1503)..(1512): a, c, t, g, unknown or other
  modified_base (1738)..(1763): a, c, t, g, unknown or other
  modified_base (1824)..(1833): a, c, t, g, unknown or other
  modified_base (3677)..(3686): a, c, t, g, unknown or other
  modified_base (3852)..(3861): a, c, t, g, unknown or other
  modified_base (4172)..(4181): a, c, t, g, unknown or other
  modified_base (4439)..(4540): a, c, t, g, unknown or other
  modified_base (4635)..(4644): a, c, t, g, unknown or other
  modified_base (4793)..(4878): a, c, t, g, unknown or other
  modified_base (5366)..(5375): a, c, t, g, unknown or other
  modified_base (5465)..(5474): a, c, t, g, unknown or other
  modified_base (5560)..(5569): a, c, t, g, unknown or other
  modified_base (6626)..(6635): a, c, t, g, unknown or other
  modified_base (6714)..(6925): a, c, t, g, unknown or other
  modified_base (7369)..(7378): a, c, t, g, unknown or other
  modified_base (9781)..(9790): a, c, t, g, unknown or other
  modified_base (10495)..(10504): a, c, t, g, unknown or other
  modified_base (10681)..(10690): a, c, t, g, unknown or other
  modified_base (11074)..(11083): a, c, t, g, unknown or other
  modified_base (11268)..(11277): a, c, t, g, unknown or other
  modified_base (11345)..(11366): a, c, t, g, unknown or other
  modified_base (11572)..(11581): a, c, t, g, unknown or other
  modified_base (12228)..(12237): a, c, t, g, unknown or other
  modified_base (12568)..(12577): a, c, t, g, unknown or other
  modified_base (13327)..(13336): a, c, t, g, unknown or other
  modified_base (14430)..(14439): a, c, t, g, unknown or other
  modified_base (14919)..(14928): a, c, t, g, unknown or other
  modified_base (16452)..(16461): a, c, t, g, unknown or other
  modified_base (17303)..(17313): a, c, t, g, unknown or other
  modified_base (17943)..(17952): a, c, t, g, unknown or other
  modified_base (18086)..(18095): a, c, t, g, unknown or other
  modified_base (18549)..(18558): a, c, t, g, unknown or other
  modified_base (18864)..(18920): a, c, t, g, unknown or other
gcggtgcgcgcccagcgcctggccgccgcgctggaacatggcgaggttggcggggtaggcgcccgtgccgccagccgcggcgccaccgccgcccatgcggccgcccaggccgccgcccaggccgcccagctgctggggggcgccttgctgcgcgcgctgggccatgccgtactgcgtgtgcgcggcatgctgtgcctgctgcgccccggccatgttcatgcgcgggttctggcccaggcccatggccaggccggggttcaggcccaggccggccatgcgctggttcccctggaccggcgcgttcatcccgggcatgccagacctgcgggggtgagtttgagggggcatggatgcatgggcgagggtatgagagggagctagcgcaccaaacacacgcccgtcagcacacagatgggccggcctccagtcatgacacgcacctgccaccctggagctgaccctgaagaccgtagcccgccgtggcggccccctggaggccctgcaagccctgcatgttgttgggcaagccaccatagcctggcaacaccccctggccagcgtggaactgcgcgtagcgaccgtccatgccaggcccattcccgttgttgttcatcatcaaaggctggcaagggggaccgggatgtggggagggtacagcatccgatcgcgagaagagcacgatcagctcaagcacaacaacgtcgccccgacagttcgcatgacgggccctgcaatgctagccagcatgcacctccggtcccataccatgtcgatggccctaacatcctgcctcacctcatcccttcagcctcctctgatgctatcccaggccttcttggcgctcacaaggtatacaaactcgcagctgccctagagatccggctgaaaacgatttaacgctgtcctgacgagatgagtttgcacaaggaagaatacagtctccaccagggctcacgaggggctgtcggtgtctcggactgggaactcgccagcctggaggaaagcagcaggctcggatacagggcgcgcaagctgagccaccgctggggcaagccagcaggtcccctctacgcgataatgaccgatcggggtgacatattcagtacacataccgtccttgacgtacccatttcgaaaagctccctcttgtcgaccgacccacgttcttgcacaggctgtgaggcgcccgtcgcagtccttacagttggccaagagcggcgcacgcacattcgatgggcgattcctgggaggattgggatgatgaggaggcggtgccggtagtgcccgtgcctggctccaccctggcggcagcagacatcaactccaagtttgcgggggaggacgaggaggaggaagcccccaagtggaaagccaatgtacccaagccacaggtgggttgatgtgcaaggtgctggaccgaggatcggatcgaaaaggaatctgaggagtttggttcctcacagctccatggtaatgcaatcaggggtggctcgataagcactnnnnnnnnnngcgaggatcggatcaaaaagggatctgaggagtctggttcctcacagctccatggcaatgcaatcaggggtggctcgataagcactgtgcaccgacccctccacccccgccaggccaaagccaagaagatgtccaagtatgacgagagcaagggactgaggagcgccgcggatgagggtcccctcgatgatcccattgcagaaaaactgcgcctgcagcgactggnnnnnnnnnnnnnnnnnnnnnnnnnnttgctctgcaatactactcctaatatactccctcaaacacgtttctgtgcagtgcgagacnnnnnnnnnngctctttggcacaggtgatggcgcgcagtgctatacctgaggcgcccaggttcatgcatagagtcatgggcatgcagtccactgagagcctgttggggagaggctgagctcccggacgtgtataagtggcgcagggcacaggccagccccatttcctgctctacaatataactcctaatgtactgcctcaaacacgtttctgtgcagtgcgagacttggatggcttcgtgccaaagtctgccaaggattttgaagagtatgcggcctctattgttgccaagtacctgctcccacatgctagcaactctaactacaagacgctgctgaagcagctgttccggaaggcactcacccctctcactgccacagacaccaaggacgtggagacatctgtggctggtatggcatcattgacgtttgggatgagatgggtcgctgctagtggagtgcacgtcgatttgctatgccaatgttgactggggattggaagatcttcattcatacttcggccaccgtctgaagggccagcgtgaagcttcctgctgccaggtgcctgcagttacccatcccagcaagctccaagacagacacttcacgcaattctgtcgatcaggtgtgcgctctgagaagctgaaggaggagaaggcggcaacagcggggaagaaggcgaccaagaagggatccctcaatgtggggcggagtggcggcacagctggcctggacgactatgtgtatgacgacgtgggtgtggatgaggactacgacttcatgtgatggcttgacttgtagtagaggtgcagttaggcaggccaggctacttgtgcgacggtgaagattagagcgcgcgatgatgcaacactcaaatttggcccagagctgtgcatcgggcgggccaagcagcacgagtgtacgctgggtaacaatgcgaagcaatacagacgttctgatacgatgattcgtcatgcatgaatcaattcgtgtgatctacaaggcgcgacttcgtacttgagatgtagagcaagagatgcgcgatgccttgctccatcaactccagaacaggccgtgaaattctgtgaagctcgaaggccagcacctcctcaacctcctgcatgctccgtgcattgacgaaagcagctattttatgagcactgcccgttaccaagaggcggttgtgttcgctgcagctgcgcatgcggcatcgaccaggccgccctgcaagcatcctggtaatgccttactctactacttcctcaggtacgcagtgttgcacaacgtgttgacgctggtgccagaatatggtgcatgtaccgtataagggtcactaggctgagccttgttctatgctacaccgtgccccacagccactcaatcctacccactgactgaaccccattccagggaggttcggactgccagacaggctgctgccccagatgccacagacaacctggtctccggtcttcgagctgcagagaagggcctggcagaccacccgacacgtgtcgtggacctgaagacagctctggcagtcaagggcatcggcccgaacattggaaaggtcggttactgtgtactggtggcgatttgctgcccggggccctgctcacctgagatcgtccttctcccacactgcagattgcggtcgatcacctgtttgctgcataccctcccgcgcccctggatgctggggaggctgcggctgtggaggaggccatggcgtgtgccaaggctcagagacaagctgcatccaaggcaagccatatatccctgcaatgagacttggtgccccaccttcctcactcaaagcacctacatcttcttgattcatggcacgtaccattgannnnnnnnnnttatatccctgcaatgccacttggtgctgcaccttcctcactcaaagcacctatatcttcttgattcatggcacgtaccattgagatatgttgtcggggtcctcatcctccctgctgccgggatgccatctggtcaccacccactgcccatgcagaagacaggcannnnnnnnnngcctcatccaccctgctgccgggatgccatctggttaccacccactgcccatgcagaagactggcaagaagggccgacccagcgcactcgatgcagcgtcgactgaatcttgcgagcgtacatcggccccgcctcagaagaaacctgccaaggaatatgtccctgccatcggctcagccaattatgccttcctcatcgtcatgtatcaggttggtggcttgccgacctggtgccaagaaatgacaccccagaaccctagactgagagggagagctttgtgtcatagaggccggctcccagtcccctcattnnnnnnnnnnttgacaccccagaaccctcgactgagagggagagctttgtatcatagaggccggctcccagtcacctcattgtggcaatgccggtgccctgagccccccatccaggctgctgtggggccagagcagctttgtgagctgaccaagtcggagctgatggagcgggcggagaggagtggcctggcggatcgacccattatcggagacggtgagggcctagcagagggtgtcctcgccgggtccgaggagatgatgctagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaatgcatgttttgacgtgatctggataatgcaaatccaccttgtcccctcgcctgacatcgtctgcagcgggtgcagctgtggcaggaaggnnnnnnnnnnagagaggagtggcctggcggatcgacccatcatcggagatggtgagggcctagcagagggtgccctcgccgggtccgaggagatgatgctagcccattcaaaggctggcactcgggccaagcctgagcaggtttgctgacgcgctgtcnnnnnnnnnnnnnnnnnnnnnnnnnnnnnnnnnnnnnnnnnnnnnnnnnnnnnnnnnnnnnnnnnnnnnnnnnnnnnnnnnnnnnnccacacaaccggggaggtgaacgaggccctcaaagaggacctggcggcgtcaacttctacaacggttggagctccttcaacccgctgctggtgcacaagcatggcctggctgccacccggtccaaccccaagctctgctccctcaccgtcaaggtgggtgccggagcacttgtgttctcatgtgcgccagcgctggtgaccatcagcggggctggagggtagcgtgctgggaatgtacgcgcgctgtttacccgagttcatgcggctgacaccccacccccaacccttcatggaacccgcctcatccagggaatggcactggctgctcggctgtttgagggcgcactgctgcgaggggcagtggccccgctccaggcccccagggcggatgatgcggtgcggcagcacgcagcgcaggatgccatgtcccagctgggccctggatcatcaagcacggactccgacacgtgcagcagcggggcggatgnnnnnnnnnnagcgtgctgtttacccgagttcatgccggctgacgcccaccccccaaccgtttatggaccccgcctcatccagggaatggcactggctgnnnnnnnnnncccctgggcgcaggccggtgcgaggttcccccagccttttgtcacaggcacaagtctgcggcgccagcgaggagcggcccggcgcnnnnnnnnnnaccctgcgcgctggccggtacgaggttcccccagccgtttgtcacaggcacaagactgcggcgccagcgaggagcggcccggcgcaagctgggactcggtcgtcgacctgtcccagatggacgaggacgagggcgtgccggggtcgcagcgctgccccgcaacccaccatcccggcccctgcgcctcgcagccggaggcgctgagtcagccgctggtggagcgcctggcggctgccctcgaccgcgccaggatgaacggggccgtcgcatcgctgcccgtccagcccggcgcgacgacctgcagaccgagcccaccgcctcccccggccggtgcctgcgttccagacgctgcccccccctccccacgggccccagcgccactccaggctgccgccacgctggcgggcgccccgccgccccgggcctcctcgccgccctgtgccgcgggcggctgcgtcgccgcctccgagcgcctgcccccccttcacccgggggccccgtttgaggctcagtacgacatcatcttcctgctggacgcccgcgaggtcttcacacgagccgccgaccagggccggtcagaggccctggcgcaacacctggctcgcctccgcgccatgggcctggtggtggaggagcggacgctgcccgcgggggacgggctctggatcgcgcgctccaagtgagttggaatgggggggtccgatgtatgggaggggatgtgggggatggggaagggtccctggcgtggtgacgtggtggcgccagaatcggagccaagtcttgtcctccgaggcctgactggatccaggggtgcggggccggtatcggcagcgcactggagtgggtccctcacgtgccactaccccctccttcatccctccctcccctcgcccctttcctccctcaccccagggctgatccgacgcgggagtgggtgctggactacatcatggagaggaagagctacacagacctgatccagtccattcggggcgacaaccgctacgaatcccagaaggtgcccattggggaagaaagggcgggcctgtaggatacnnnnnnnnnnaactggagtgggtccctcacgtgccagtaccccctccttcatccctttctcccctcgcccctttcctccctcaccccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcccctccacagtttgccctgaagcgatgtgggctgcgccacgtcttctacctgctggagggggaccccgacatgcttcccagccccacggtgagccaggagaagggtgggagaggagagcacaaggcacctctggactcgatcacagtgcgggatccaccaggccaggggccgccctgggtatcgcatgcacacaggcacacatgcttccattgccccgctcccattgcaggagcagaaggccgtgaaaactgcggccgccgacatggagatcatagacggcttccgcatcctgcgctccaagagtgaggaacgggccctgaggtcgactcgccctgtcatgcaaccctgttcatcttgcaccctcaatcatccaccgctccatctcaataaccctcacatcgaccccccgggtgcagatcacgttgacacgctgcgcctnnnnnnnnnngcgggccccgaggtcgactcgccctgtcatgcagccctgttcatattgcaccctcaatcatccaccgctccatctccacaaccctcacatcaccctcctggggtgcagatcacgttgacacgctgcgcctgctgtgcacgctgacccaccacgtgatcgaggcgtgccgggcgcggcgcggcgcccccgccaccgcggggcctcccgcccctgacgtgctgcccacctggtcggagttcaagagccggcgcgaggcgctggggcggggctccatgagcctggccgacacctggcgcctgatgctggccagcgtccgcggcgcggggcacgaggctgtggccgccatggtccagcgccacgccacccccgccgccatgcacgccgccatgcgcgccgcacaggcggggggcggggcggcggccgcgcggcggctgctcgcccccttggcgccgaggcccggcagccgcgccgtgggcgagggctccgcggcccgtatctacgataccctctttgccctggaagaccaggcagctggggacggcgccgtgcttgcaaaggtggattggggcatgggctgcggctgagagtggagcgccgtggtgactttttgcgagggttttgtatgagagaaagtacacccagggcgagacgaggggctatactgctgagcgggccccctgttgagttcggttgcatttttcagtgcatggcccgacgagcaagtcgtgagcagtgcgctgagttattccgcatcgctggcaatggagctctggtgcagcggtgggcaggggggggcatgatggccggcagctggattgccgcagagcagagggccagaccttgcgccgttcgaccctgccatgtccctggctgaggcacagcgcggccgcccagggtcccccccgcccctacgcctcgcctcggtggtccagcaggacacgcgaccgcccctgctccttgaccaccaggtccagctgctcggcggcttccgcggcggcggagccgcgctgcgccaccaccagcaccgaggcctggggcagcgtgcgcagcagggccgcaacgcgtgcgcagccctccgcgtccaggtgctgcatcacctcgtccagcaccagcaggttgctgcaagggggtcaaagacgacagggtggaatgggatcaaggagaacggggacgggagaggggctctatggcccactcgttgcaacagtcgcccattgcaggcccaggaggctggtaccagggctgacgaggaggagcaccatcccggcaccaagccctcccccgcctagcatgctttgacctctggactggccatagccgagctgcccacctctggaggagtccgcggcgcttggccagggcgctgaagcccagcgccagggacagggccagccggcgccgctcgccgccgctcagctgcttgatgctccggggctgcagcacctggctcccgggcacccgcaccttgacactctacgcttgtggacagaaggaggggtttgcagggccgcaggggcgggaaggctgcgccgcactccgtgcagtgcccctcgcagcgcgccagccaggcccgcagagcaggaggccgcatcccggctcgctcctcccctgccccatccaccccagcgcaccttctccacctgctccaccaccgcctcggggtcggcgcggcccggccggctgggcttcagctccagggtcaaagacggcgccagggctgccaggaaggtgcccgtggtggcctggaggtccgccagcacgccctccagcaggtagttgaccacgccggtggggcgcagggcgtcgtgcacctgacggagagggagaggaaagggggaatgtgagggtgcacatgggtggtgcctgcatgtgcgccgtcgctcatgcggcgggagtggaggccgagaatgcttcccccgcccctccgagtcactggaagaagctcctgagcgccagcacgaggtacaacaaaccacgacccacatcccagccgcctcaccagcttgaggtctgccagctgagctgccaggtcggcgccccgcccctccagctccagcaccctggcggcctcggtcgccagctgggcgcgcagcctgcccgcctcaacctcgtgggggttagcggcgctggcgctgcccggcggcacgggctccgcggcgatgcaggccgcggcctgtgaggcactccttcccagctgctccagtagacgctgggagtcaaaggcatgcggatcgcgatggggctccccgggtggggtttggagagacaaagcgtccacatcgacagcgccatcattaatgctctggcccagcgtggcgcgcaggcggtccaggaggctcccggcctcggcgcccgcgctctgcaggcgctgccccatcccctcgtgctcctgcagctcccttnnnnnnnnnntatcgcggtggggctcctcgggtggggattggagagacaaagcgtccacatcgacggcgccatcattcatgctctggcccagcgtggcccgcaggcggtccaggaggctcccggcctcgacgcccgcgctctgcaggcgctgtcccatcccctcgtgctcctgcagctccctttccagccgcgcgagccgtgtgtctatggcatgcctcgcctgctgggcctccagctgagcctgcgacctggcccggtcccgggcggtctggcgcgccgccagctcagcatctgcagaggcagacgcctgagcggctgctcgggctgccagccgggcttgctctgcggcgagcagcgcctcctcggcctctgactgcaaacagagcgacgcacagaaggccaataacttttgaaattttgaagaggtgtccccatcacagagacactacgtatggacatttgacacaaattagatgctttattgaatctctgaggccgtcctccgtcctccagtcccttcccccatcccattcggccctaacctggagcctggcaagagtgtctgcagccatggattcgctgatgggctggtgacaccggtcgcacacgggtgccgaggtgtcggctgttgtcacagctgcagggtgctcgaccgtttggccgcccggtccacggctcacgagctcccttccggcgaattgttgggcagaatgnnnnnnnnnngcggccgcccagtctgcggctcacgatctcccttccggcgaattgttgggcagaatgggtgctgcccttgccatttgcctgagccgcctggcgcgccgggtctccgtagtcagactccccccacccctcgtgccgcagtacctcctggaactcttgcaggcggcgctcgcagccggnnnnnnnnnngcggcgcgccaggtctctgtggtcagactcccccaaccccccgtgccgcagcacctcccggaactcttgcaggcggcgctcgcagccggccgcgacgccctggcagctgccctgtgccagcctggcagcctcggcctccgccctcagtgtgtcacgtcgctggcgcagtaggtccatctccgcggtctcctctggggcgtcaagggtcggagccagggcagaccaggggtctgagcacagctccgcgcgggcccccaagagctcgcgctgcaaggctttggcacatccagtatggtccgcccatgcagcctgggcagcgtgacacagctcccccagagtccaggcgaggtcacgcgcttcccggcaccacccctcccggcgctnnnnnnnnnntccccaggagctcgcgctgcaaggcttcggcacacccagcatggtgcgcccatgcagcctgggcagcatgacacagctcctccagagtccaagcgaggccatgcgcttcccggcaccacccctcccggcgctgggcgaccacttcctcccaggtctccgcccgtgccgtggcctgtcaatggatnnnnnnnnnncgtcacgtcgctggcggagcaggtccatctctgcggcctcctctggggcgtcaagggtcggagccagnnnnnnnnnnnnnnnnnnnnnnaagccatccagaggcgagggagagaactggctggtaatgcactgggcgtgagggggtgtcaccctccatccagcagccacacttcatttgcaagagcgcctccgcgggcaagatcaggaggcagcgctgcataccagaccacgcaccaacctgtatgagatcttcctgaaaacggtcccggaacccttgtcgcacaggcagctcannnnnnnnnngagccatccggaggcgagggagagaactggctggtgctgcactgggcgtgagggggtggtcaccctccatccagcagccacgcttcatccacaagagcgcctccgtgggcaagatcaggaggcagcgctgcataccaggccacacaccgacctgtatgagctcttcctggaaacgatcccggaacccttgtcgcacaggcagctcagtgcacacggcagccagcgcagctttcctgcgaggtgcgatggtattcacctgtacgattgcatttcccatgacagactgcaccccttcctgcacaggtgcacagatcaagtattcaagtacacacgatcatgagctgtacgacttttgcccgaccctcctcccctacccaacatgcacacctgtcggccaattctttgttggccacagccctggcctcctcccagatcgacaggtcgaccagcttgcccagctcctccttgaaagccctgtcccctgcctgttaagtgaaggacacgacaacgaggcatggctcagagataggatcgctggcttatgcagtgagcgtccacaggggcccaattcccttgctgcgagtatcatgaaacagtgcctgcgcctgatgcaaatgccacctcccaatatccagcagcccttccannnnnnnnnngattccctcgctgcgagtatcgtgaaacagggcctgcgcctgatgcacgagccacctcccaatatccagcagcccttccatacctcaagcaaggcattgacttcagactggccatagaagactgtcttgccaagcaggggagcacccagcactcgatcgatctcagcctaccgtgtagtgtgagggggcggcttgcaggatgagtaagataaaagagataaagcagcctccaggccacagcaggcaatggctgatgtcaagacacccatcaacgtctcctctggcagtccagacccccccggcagaggcaatgggaccccttactcacctnnnnnnnnnntctaccgtgtagtgcgagggggcggcttgcagaatgagtcagatactagggatgaggcagcctccaggccacagcaggcaatgacttatgtcaagacacccatcaatgtctcctctggcagtccagaaccccctggcagaggcaatgggaccccttactcacctgcgtcatgcgcatctccagcatggtccgatccacaccgtccaccatcaggctgagcttccctccacgcctagggaggtgcatgagggcatcgatgagctgttcaaagacagaagatcatgctggtttctccacagtggccctggtttggtacactcagtcatgccagccaaacaaggtgtcaccgctccctcacaacatctcctcccacaccctgcggagccaccacaccaccgagctgcagcaagtctgcagggtccgtcggcatcgcgatgtgaccttctcaacacctctcatcctcacctgcgcgccgtcctttccaccacaaagggcaggccattcacggtgccttccacgcgcaccgtggcagacttgcaggccgagtgaataatgtctgtgacgctcagtcctcttccggtacttgcaccctagtaggaatcgagacagaggagggtcctgttttcagaaggtggcaacctggtctctcaatcctcagctgtccatgtcattgacaattcaaggaagacggagccctgacggcccctatccttgccacagcaagactcacctcggatcgtgcatccatgnnnnnnnnnnccaatcctcagctgtccatgtcatcgacaattcaaggaagacggagccctggcgggccctatccttgccactgcaagactcacctcggatcgtgcatccatgccaccggtgaggcaccacagggaactcatggccagtgcagacttgccggccccgttggactggaatcctgaggcaatgaggggatgtgaggcggagccgggtcgggatgtggtgcggcagggctcttgaaggctggctgagtgataggctttcgcgttcaatgactggatgcaccagatcctcggcttggccctcccctgacggagctctttccctgtccatgaacctcgggcaggcatgcacccgactctccatgcccatcccgcccgccgaccttggccatcgacggagccggtgaggaccaccacaccccgggcgtccagggggtatgaaaccctgtcagcaaaggaaaggaagcctgacagggtgacctgcccaaaggtcaacaccgtggctgcagctgagctgccctggctcgtcaagagcgcctggggcaggaacaggggaggtgggagggctggcagcaggctttgagacattcatcatgccaacccccactgaaccgaatacacgctccattccctcggtggacgtcaccgcagtccaccacccgctgaacacacctgcagcagggagaggcctcgagcctccacgccggccggcatccccgtggactttgcgtatgcggcaaagagctgggggggggtcaggtcctccgagtcctggatcctgaccggagccgcggagggggccggcgccaggatctccacctccacccctgcgacgaggcaggcttgggagggtggattgtagacccttcacaaaccagtgcatgggtagtgaccagtctctgcctcccgcatcagagcctgggcagcccttgtccaggataaaactcgactcaccctgctgctgcagggcctcgatggcggccatcccatcgatgacctgtgcctcattcagcaccagccggagcctgtagggggggggcggtgtgtgtgtgtgtgtgtgttggttctccatgcaggctgcgcgaatgcagcatcgtgcgnnnnnnnnnncggagggggcggggtggggtggggtggggggggttctctatgcaggctgcgcgaatgcagcatcgtgcgcttttgttcgcagagagatatggtcaaacatggccccagcacgggtccatgcaaggcaatcaaagtcccccacccgcggcctcacctgtcgccactgcgcagatctgccgcgctctccgggccctgggcatccgggaaggcgctggcagagaagtggcgcggcccgatgtccagcgggatctcctccctgacgcgccaggtgtcgccgtccaggaccagcaggcgcttgccctgccccgcctcgccccgggacactgcgctttgacccaggggaggggcaggagattcaaacatgggagcaggcagcgccgcgccccaggcggcgtgctgccatgatgtcggcgcggaagcagcctgaacaggccagctcaccgcacaaacgcacccctgcccggcgccttccacacatcnnnnnnnnnngcatgggagcaggccgcgccgcgccccaggcggcgtgctgccgtgatgtcggcgcggaagcagcctgagcaggccagctcaccgcacgagcgcacccctgcccggcgccttccacacatccctcccccacccaccctggtatggcgaccccacgtagtgaatgctcgtccccggcacggtgtgtggcctgtggtagtggcccgtgtacacctccaggccgcgggggaaggccgagggcggcaccccgtcccgcgcctggaaggcgtcgttcagcgaggcccccgccacgtccacgtgcgcgaagacggcgcggacagcctcgctctctcccgcacagcgcagcgcggcgagcagctcgccccgcgcgcggcggtagggcagccacagagcgccagcgtgcagcgtgggatgctccatgacgtggatgtgcggggagcaggcggccaggggggtgagcgcgtggtccaggccgcccagcgacacctggcgagtgatgggtggaggaggggagcgatggtgcaggtacgggggttaggtgtagggaggggagaatcatgactgagaggagggaccgcatcatgtcactgtgatcccaaggtgcccccgccctcgagagcatccactagcaagcagacctggtcgtggtttccgaccagcatgatggtgggctgtgtccactgagacagccgcagcacggcgctgttcagggtctccaccggaagggcccccctgacgtgccaaaaatcacctgcgtgggtagagatcacacagtgggctgggggcatggagactgccgcggcgcagctgggctcacagacctccatgtgccattcagagcgctacaacgaccgcaggtcagcatcgccgcatgggatctgccccccagcgtcgccatctgcccatgcctctccctgccaaccctcactccctcttcatcacatccccgtaccacatcccaacgcaccgaggaacaggatgccagcgttcctggacaccgcctcggcatgcacgaggtccagcactcgcatgcatgtgggtgcggtgctgggggagaggtgcagatcactgaacaccacccaggagtccgggctcttccaggtactggggtcgggggaccaactgggcagggcctcggcagtggcgaggcatcgaaaggctcgagagatggtgggtctgagccggcatggcgcacatcgactcagtcggggaacggcgtgcatggagggaccggtcctgagaatgccagcgatgggaatcaccggggctccagaacaggcatgcggcattgccagtcctgggcccagtctaccatctattgggtcgcaccggcgatcgtggcgtgaggacgagtctttaagagtggtcctttgactcttaatcgtgagggcgcgcaaaacacacaaacatcaaatattacgtaacgcgttcccacaatgcagtacaacacgatgcgtactgctgccatcccccccccaccagcagcagtggcgagggacgaggcggatgggaatgcccgagcgacannnnnnnnnntgtactgcggccatccccccccccaccagcggcagtggcgagcgacgaggcggatgggaatgcccgagcgacattgcgccctgcgtcccgggctccatgaggaaggagcatcgttccagcgggccagactccagtgttccgtggccacccttgcttgcagatttgggtgctgtcggtgcacgctgggtggtttggcgttgcgagacggcccctgccacgctgggctccaggcctcagctcctcgccgtcgacctccaccacctgtcgctgccacaccgagactgacctggtgttggggcgtccccgtcttcgaggtgctgccgcgggaaggcgcagccacctttcggaaagtgtcggctgtgtcgcggcgtccctccgccgggaccgacacgcctgccggcacgacagacggtgctccccacggatggagccgcagctctggccaagtcacctcactcctcccggcctgcaacttcctctgtaccaacgggagatcccacaccaagccatgaacggcactggcaaaccccctggccggtcccgcccaaccaacaaccagctcctgtgagtcgggcacgccatgcccgcatgctcattgggggtgcacaatgccacatgcattggtatgggacggaccatgaccagctggctctggaagggtgctgggggaatgtccccaccctcatcccctgtatcagaagggggcaggggggtgctgtggccgactgcagcctcgaccgacggccatgcatatgctaggctcacacccaccccagctccctgctctgcactcatgtcctcccttccatttccccccccccacccccccccccccccccccnnnnnnnnnnngacagctacaaggcacacttccgctggaagcactacacctcccccctgccggtgacccaggagctgccgtccggcaccgaggcctgcgcctcggtcacctccgccttcctccaggtcctggccaccatcgccgacgtggagcgcgtgcggctggacaagccccgcaacgtattgcacatcttgtccaccaacacccgccgtaccaaggtcgtggagctgtcctccggcacccacaggtgcatggtgttgagtgtgagggtgggaagataaagaaccgatcccaggcatgccctggacgcctggatttgtcataggtgctgcacacacctttccaggtcggggtgccctcgcccgcctctccccgaatacccgtccacacgccatgctgaccccctgcccgtcactgcagggtggctgatgagctgcgccggcactcgctgtcggacggggacggcggccagtactcgaccaaccttgaccggaatcggtacggctcagacaacaactacctcttcacaggtgtgcagggtggacgtcggaggagggatcgttgctgtgattgggtctgggagaatgagtttccaccttttggatgcagctcgtgtggggtcatggctcagcaggggacgnnnnnnnnnnagatttgtcataggtgctgcacaaacctttccaggtcggggtgccctcgcccacctctccccgaatatccgtccgcatgccatgctgaccccctgcccgtcacctgcagggtggctgatgagctgcgccggcannnnnnnnnnaaggagggatcggtgctgtgattgagtctgggagaatgatttttcccttttggatgcagatcgtgtggggtcatggctcagcaggggacgttcgggtgctgggcaacatcctcagcacacaaccagcatcggattcatctctggggctgaggaccgaggctcaacccctccctaccccgccacccccacctgcagtcacccgcttcaacctggagtgcttgggcctctgtccctgcctggtggacatcgagatcatggacacccggaacggaaatgaggtgcagcttgtgaccgcggggcacgctgcttgtgcctgcgactcgcccgcgcgcaaggtgggctggggggggtcaattgttgaaggctggtctcgcagtcggaggtagtccgaggagagggcccccccggctgagaatgttgtgttggagctggaacagaaggcagggggaaggtnnnnnnnnnncgcctgcgactcgcccgcgcgcaaggtgggcgggggggggtcaattgttgaaggctggttttgcagtcaggaggtagtccaaggagaggggctcccggctgagaatgtcgtgctggagctggaacagaaggcagggggaaggtctgcacagagatagcggcgcagcgtgcgctacatgacgtgccttctttcaaaggtgtaaatggcctcctcagggtacctgaggtccactggaagcgctctgcaaggcgctaacctcccccacctcccccccacccccccccaaaaaaaaaacggcttaacacnnnnnnnnnnnnnnnnnnnnnnnnnnnnnnnnnnnnnnnnnnnnnnnnnnnnnnnnncggctcaacacccctcctccccttccccatttccttctcaggagcgcgccgacgcctcctactgcgcagacagcggcgcgggcgcgcgcgcgcccggcagccccgcgcggcg

SEQ ID NO: 45493 - DNA, 20911 bp, Chlorella protothecoides
  modified_base (114)..(123): a, c, t, g, unknown or other
  modified_base (736)..(745): a, c, t, g, unknown or other
  modified_base (1140)..(1149): a, c, t, g, unknown or other
  modified_base (1219)..(1301): a, c, t, g, unknown or other
  modified_base (1552)..(1561): a, c, t, g, unknown or other
  modified_base (1890)..(1899): a, c, t, g, unknown or other
  modified_base (3701)..(3710): a, c, t, g, unknown or other
  modified_base (3871)..(3880): a, c, t, g, unknown or other
  modified_base (4345)..(4354): a, c, t, g, unknown or other
  modified_base (4602)..(4611): a, c, t, g, unknown or other
  modified_base (4672)..(4681): a, c, t, g, unknown or other
  modified_base (5230)..(5239): a, c, t, g, unknown or other
  modified_base (7500)..(7509): a, c, t, g, unknown or other
  modified_base (7717)..(7726): a, c, t, g, unknown or other
  modified_base (8405)..(8414): a, c, t, g, unknown or other
  modified_base (9327)..(9336): a, c, t, g, unknown or other
  modified_base (10172)..(10181): a, c, t, g, unknown or other
  modified_base (11759)..(11768): a, c, t, g, unknown or other
  modified_base (12783)..(12792): a, c, t, g, unknown or other
  modified_base (13281)..(13290): a, c, t, g, unknown or other
  modified_base (13608)..(13617): a, c, t, g, unknown or other
  modified_base (14022)..(14031): a, c, t, g, unknown or other
  modified_base (14685)..(14694): a, c, t, g, unknown or other
  modified_base (16401)..(16410): a, c, t, g, unknown or other
  modified_base (16808)..(16817): a, c, t, g, unknown or other
  modified_base (17280)..(17289): a, c, t, g, unknown or other
  modified_base (17917)..(17926): a, c, t, g, unknown or other
  modified_base (18046)..(18055): a, c, t, g, unknown or other
  modified_base (18139)..(18148): a, c, t, g, unknown or other
  modified_base (19180)..(19189): a, c, t, g, unknown or other
  modified_base (19739)..(19748): a, c, t, g, unknown or other
  modified_base (19954)..(19963): a, c, t, g, unknown or other
ggggggcgcgcgcgctcgttgagtaaatgtgagcctgcatcgctgacactgcgcaagtgcatgcgccatgccaggctgagacaggtgtctcttggagcatcaggggccaccagnnnnnnnnnngcctgcatcgctgacactgcgcaagtccatgcaccatgccaggccgagacagggtgtctcttggagcatcaggggccaccagctgaccaggtggcagggtggcaggacaacatcaaagtcagggcagcccagattcccctcccctcaccccaatgaatgcatgctcatcccagtggcacacctggacgtctggcggaatggcataccgccccagcaggacggcctggatgtaccgcttatcccgccccttgaaagggaaggcgccaaagagcatggcaaagaggatgatgcccagcgaccagatgtcggcgaccttggcatcgtaggttgtgtagcccaggtacacctccggtgccatgtagcaggtggttcctacgctggtcttgggcaggctgttcagctcatgcttggagtagccaaagtcgcacatcttcagaatgggccgggggctgtccgccgagtcgagcagcaggttctccagcttcaggtcgcggttggctacaccacgactgccggtatcagagaaggggaatggggggatgaggatgccttcttcccatgcagtccggcgctaggatgggacggcacagagccatgcatgctgctcggtgcnnnnnnnnnncgccttcttcccatgcactccggcgcgaggctgggccggcacagagccatgcatgctgctcggtgcaggcccgtcggtgggagtgacatcggccagatgatggcagtgctgctgcctcccactcctgtccccccatccaaacttggctccccagcgcgcacctatgacagtagtccagccccacgactaattgctggaagaaccaccgagcttcctcctcacacagacgcatggcaggacgccgggtgatgtaagcatgcaggtccccaccgttggcacagtccatgaccactccaatgtgggttggtgtcatgaaaaccttgaaagaagagtgggggggaggggggtggcatggcgagagtagttgccgttgcgaagtctttggtcccgagagnnnnnnnnnncgtccccccatcaaaactcagctccccagcgcgcacctgtgacagtagtccagccccacgactaattgcnnnnnnnnnnnnnnnnnnnnnnnnnnnnnnnnnnnnnnnnnnnnnnnnnnnnnnnnnnnnnnnnnnnnnnnnnnnnnnnnnnncgtcatgaaaaccttgatagaagagagggggaaggggggtggcatggcgcgagtatttgccgttgcgaagtctttggtcccgagagtcccactgcacatcgcacgagtgtaaagttgcccgccatcataccctcgaagaccacattgccgcgtcaggggactctttcaaccaacacggttttacaatcctatggatggccgcgtctcatcctgcaagcagctgctcctgtcacacagccagcgcccacccnnnnnnnnnncgtgtaaaattgcccgccatcataccctcaaagaccgcattgccgcgtcaggggcctctttcacccaacacggttttacaatcctgtggatggccgcgtctcatcctgcaagcatctgctcctgtcacacagccagcgcccacccacctctcgcaaccggatgatggaggggtgtcgaaggctggactgatgcacaatctcccgcttcacataggtcttgtagttccgtatctgcacgagcatccaggatcaaggtgtgtacgcctccatgcaagttcattcaaggtaagcatctccaaaatctcttgccaagaggcatgtgcaatctnnnnnnnnnngttccatgcaaggtcattcagggcaaacacctccgaaatctcttgccaagaggcatgtgcaatctgagcgttcagtggaacctgctgccagcacctgtttgcactctggcacttgtgctaaatgcccctatgctagcacactactccgcctccatcaccctactactcacaaactctccgcggggaagcatttttatggcaacctcgggcgactgggaggtgggccgggtatcgagggctcgcaggaccagcccgaagttgcccctgcccagatcgccgatctgcgggacattagcagaggacggggtcatgagttcagaaccaccacctagctccgtgtcgcggccgcgagggacgttcgtatgggcatgggtgtactggacgcatcagcatgaattttcgctacccagcggcagccaaccccgggcgtccgctgtttaccaccattacaccgcccaaccgccaccgcctgcgacccacctccacataatggggcacgcagtccaggagcgatgcgggacggatagggtctggcgcttggccaatcgggtggcaggcctcctgtgtcctcacggaggcgctgtcctgcccccacgagccttccatagcagcggaaggagcaggttcagacccaaacgacctcctgcatcatgttggagtcaatccaggcatcttacagcccgctcatggtttgaacgccactatggggaaggggggaaaggggttcaggcggtacaggtacccagatgtgcgccagccctcttgcgcggtgctaatggtcgagaatagggtgcgagagcgggtccaagctctgcgacaagacaggttgtgcggcaaacgaggacgttgggggacgcagcgcgagcttccgtcatcccccgatactctcctttcccggtgcaccgagcacgctttcctcccctgccctctacgcctaaccctgccggtgacctgctgcatggcgcggctcttacaccccacctctcaccggacttcagtgcgctttggcagtccgacttttcccaggcgcaaacctttctgccaattccgcgcaggactgcagcttcatctcctctgccttcttcttctggccataataccggtagcgctgctgcatcatgcgctcgttgtagcaggcctgctgcagcccctccttgtaatcactctccacatgatgctctacccttgctctgttggtatgggaagagagggcagcaaatggggctgggagggggtgttaaggttaggcccgagccacgggccaatggggtgggagtgcagcgcgcggtcatgcgtggaacccaggctggagccaggcgcctagcagcttccccgcccccccttccttttgcatctgagtccctcatcgccatcctcatcccactttagctgccacccccgtcacggacctgggttgtgatctcgcagggtactccttctcgaaagctttgaggttgggcacatagtagggcacctcgtgcctcactgtggacagcatcaccgggtagtccgcggtcttgtgtagcgagaagacgggggcagagggccgcgacatgaaggtgaccaggaggaggagcaggaggggcgccagctgcaggagctgcctgatctgcgggggcagggagttgacctccgcatgctgctgagcccgagggcggccagcaaaggggtgctgtcccccgccaaagtttgcacggtagacacgggccctgtcgtaagggcggtgaagactggggtcatggaccggcttcatggggggaaggcttcgctactgcagccccacccctgggccaggaagcggnnnnnnnnnnccaaggggggaaggcttcgacgctgcagccccacccctgggccaggaagcggggctcaaccccctcagccaccatcccccctcctgggtcacccgcacgcacattattccatgccctcccctcctcgaatggcacctcaacccacgctcacccctgctggnnnnnnnnnngcactattccattccctcccctcctcgaaaggcacctcaacccacgctcacccctgctgggccatgaaggggttgcccccgaaaaacatgttgaagaggtcctcggggtcgatgccaccctgggcgtacatgccgccgccgttcggcctcgcctgctgggacagggcgtcctcgctgccgtgcacatcgtagtgggcgcgcttctgggggtcggagaggcaggcgtaggcgcgggagaccactgcagggtaggtgtgtagtagggaaggtgggaagggagcgtggaagaggaccgcagtcaaagggtacgagcggagtaaatcttgtgtgctcctagagtcaaacaatgccacggaactcctggccacaaccaagcccggccggcccccaaacagacttaatgctgatatatcaaatgctgggcgactgcagctcggcacggggatccaaaaccaagctataatnnnnnnnnnncagagtcaaacagtgccacgaaactcctggccacgaccaagcccggccggccccccaaaagacttaatgctgatacattcaatgctgagcgactgcagcccggcacggggatccaaaaccaagctataatagcatgcagtgcagcccagtacaacagtctcaaccccaactgagcctccccccttcccccccccacacacacatgtaagcccagggaccgacatgccacagcaactcactcttgaaannnnnnnnnntggtacagtgaaccggaatctaaacctctggaccgattgcccaggccccgcactttttcannnnnnnnnntcacaacagtctcaaccccaattgagccttccccctccccccccccaacacacacatgtaagcccagggccgacatgccacagcaactcactcttgaaagcctcatcggcacctcgtgccttgttcttgtcggggtgcagcttcagagccagcttgcggtatgccctgcgcattgcggaagaaggtgtttggcacatctctggtgcacgccaagttgtatgaatgcgatggcaaagcctctccattcctagtccggtacagtgaagcggcatccaaacctctagaccgattgcccaggccccgcactttttcaagtcgtcgtcgcttgcgctccgactgagcgagagtgcctcgtaataggaggttgtggcccggatgcgagccaccagctgtcgctgatcgggagtggcctgctagtgtgacaggggtatcaactgggtgggaggcattgggcttgctacccaggcatcattgagtagttcacaaggaggcattcccagaacccatcgtctaggccacagggagcaagctcctcagcccgagcaggannnnnnnnnngtcaactgggtgggaggcatcgggcttgctacccaggcattattgagtagttcacaaggaggcattctcagaacccatcgtctggaacccagggagcaagctcctcagcccgagcaggatgcccaaccaggcccccaccttgtgatcctcatccggagtctcgtgcacatgagcgccgctggaagctggtgcgccgcgctgcctcaggcctggctgaggacccatgccccccggctgggcggcgcctctcctggcagtggggactgggccggccggcctggcccccgtgctggaagacgaaccgttgctgctcctggctcgctccagcttggtgataaacttgcgcacctgtgtgacgaatggtgcaggattcacggtcctattcggcctgctgtgcggcccaagccaccaggtttcacgcagatatcaatgccaggaaggtccatagagcaaccacacaccaatccatgtcacagcctccagtacctcgtcgttggggaataggcgcatcgccttttcagcaaatctggttgccttggtcaggtccccagcctggagggcctgctctgcgatgtgcaggcaccgcgtaccctcgtccttgttggcgtgatcccccatggcgagcgtgcgaggagctcgatgacaggatgacaactctcgaaactgtgccactaaaacccaggattctggtacaccgctagtcctgattggaacgctcgtggacagtccgagtttcgcgttgaggtcttagctacactggccctcgctgccgctggtgcgccagggaggcaccacagcaggggagcgctctgcaggcttggtcgaaagatgctgctgctgaagttgtgacgccgcaccaggcctgtacctgccggctttgcatgcatgcgcacctcattgcccgtaggttttgcgcgcgggcgtgcgtgtcaatagccctggccggcagctggggcttcatgtcgacccggccttgcgtcagcatttgtctcccccagtatcaaatgtaacaagcccttgagagctctccatgcacactctgcaggttcatgagcatactgccggggctgcagtcgccccctgcctcaaccctgccgctgcctgggggcggccttgatgatgtcgtccaccctgagtatcatctccgtcgcctcagtggcgctcatcagcgccgagttcttggccttgtaggactcgaagatacccaactgcgggggacaggatcatgtcaggcacccagcaggcaccggtggtcaggggacagggtcctggaccaagatgaaactgcctctaagccccggtgcacacagctgagcttccaagacccctcccccagacccctcctcccacctcctgcatgtctccgacggtgcccttctcgatgtcgatgccggcgcggcaggcatctggcgccgctgcgtgggcagccctgagccggctcacgatgtcggcggagtcgagcccggcgttgtcgcagatgatggtgggcagggcgcgcagggcacgtgcaaaggcctccatggccagggaccgcttgccaggggtcttcgcagccaggtcatccaccaccagggacatctgggcaagggtggggatgcacggagtgcatgcagggatcagggggtatggtatcgcaagctctcgagaatggacggccaccgccgctggcttccgtggcagtcacggccatcccccgtgggtgcaggctcgcactgcgtgggagcgaggacggctgcgggaatgcctgccaccccctgcccacctgcgtctcggtccagccgccgccgtacacgacccgcgagtccttgaccgtctggaccagcacacagagggcgtcatgcagggagcgctccccctcgtccagcacatgctgacctgttggagggaagcggggagcgacgagggccgtagggtgcaggcgatgccacggagcaggcgcgtgccatccatgcattccatgccccaaagcgtgcagcctgtcaacgccactcacttgctccccggagaacgatggtgcaggcctcgcccagcttgcagccggagaagtggatcatgcgctcgttgccgatcatgatctcctcgatcagcttgcactcccccagcttgacgcgggtggggtcgtcaaaggtggacacaatctcgccacctgtgtgagggaatggcatgggggtgggaggcagggacgacaaaccccaagcttcataacggttgctgcctggagtgggtcactaaaggcacaacatgggacccacatgagaatnnnnnnnnnncggtgggaggcagggacaacaaaccccaagcttcagaacggttgctgcctggagtgagtcaccaaaggcacaacatgggacccacatgagaatccacatcagtatggatccccaaatgacaggcccatcaaattgtggcaataagaggtcggcgatccccgaccatctgcaaggtctgccagcatgctgcactcagcccatcactggnnnnnnnnnnttaaatgacaggcctatcaaactgtggcgatgggaggtcggccacccccgaccatctgcaaggtcagccagcatgctgcactcagcccatcactggaggctgccgctcccactggggcacccggctcccagccccaggctgcacctgtcacaagggccagccgctctgtgccatcaaagtcaaggtgctcgatagccatgacccccgcatccgcaaacaattgctcggggtagttgtagatgagctgcgcgggtgtggaaaggggtggagggatggaggcgtgagctatgcatcatccggtccctgtgccggcgcactggacagttgggtacccttgccgctcatttactgctccgctccttccccacccgcccaccagggacactttgcggttgcagggccccactccacagtcccccacacccaggctctcacctggcggttggtgaagcagttggcgccgtgggccaggatggcctccaccttctgcttcatcttgtccttctccgcggcctcgatgctcgccacctgggtgtgtacggacactgtgagttgcttgcaatgtggacatcggcttggccaagggagacactcacaccggggcgtctccccggccccatccttccccccacggccgtttctcacattcccctcagcccacgccagggtttcttgggcnnnnnnnnnngggggcgtctccctggccccatactcccccccacggccgtttctcacatccccctcagcccacgccagggtttcttgggcaccgatctcatctaaccaccccccctttcacccccctcacgcaacaaagaggactgaccttgtcgatgccatccacgcgcacgcgcgcgccgtagatcttgatcttgtcggtgtccatgggcgtgttggccaccaggatcttggcgttctccacgcggcgcggctggccgatgcccaccgccttttccaggatgaagccctcgtccaggtaggactcgcgcagcgtcccgcccacacgcttgatcacctggatggcgtccatgttgcccgagccgcgcaggcgcagcaccgcgtccaccgccagctccgcaaagtggtccttgtcggaggtcaggatcttgctggacagcgtggtgcgcgcgatgttgaccaggtcggcgcggaaggcgacctcgtcgccgctgtggtccagggagatggcctgcaggcggcgctgcgccgcctccgccgcctcgcggtaccccgcgatgatgatggcggggtggatcttctggcccaccagcgcctccgcctcgcgcagcagctcacccgccaggaccacgaccgatgtggtcccatcccccacctcgtcgtcctgcgtcttggagatgtctgcgtggcaggaaagggggaatggtgggggacgaggatgggggacagaggatgggaggagcacccgtgccgtcgctgacatccccctgggctacagggcatgagtgtggggctcttgcaggtccacttcctctaggtagctgtcctggcagccgctcccatccaagcggggcaccaggcgggcgccgggaacatcacccccacaacccttgccaaaacacacctacgaggacgcgggcggnnnnnnnnnnatccacatcctctaggtagctgtcctggcaaccgctcccatccaagcggggcaccaggtgggcgccgggaacttcatccccacaccccgcgccaaaacacacctacgaggacgcgggcggcggggttgtccacgtggacagacttcaggatggtggcgccgtcgttggtcaccgtcacctcccgacctcggctcatgctctgcaggatcttgtcctgcggcggggggattgggagggattgcgagcgaggtgggatgcacgcttgaagcctgatccagatggctaaaggtaagcgtgggcgaaaggtaaggctatgatgtttaccagtcgcaggctcaagcgctgtcactccgcctttcccttctcccatcacccaccatgcccttgggtcccagggtggtcttcaccaggtccgcgatggccatggcgccgacgaaggaggacaggcgggcattctcacccttctcctccgtggatcccgctcccaggacggactgcgtgaagttgctgggcacactgcgggtagcggggaaggaagggggcacggtcacgacggcgggtcgtggcttcccggtccgctcgggtcgtgaggcacaccacttacccagcttgacccattctgtgggaagactgatctgctggtcagactgtgtcgagggcgaaaggattccgatgatggggtgctcgcgaggggtcccggaccaaggtgatcagccgctgcccttgctcgtctacagggatcgtggggacgtcgtgatcggatgtttttaggtatgcctgataagttttattcccgcgctgtactgtcgccgagcaccactctttttgactggaannnnnnnnnngattccgatgatggggtgctcgcgaggaggtccggaccaaggtgatcagtcgctgccgttgctcgtctacagggatcgtggggacgtcgtgatcggatgtattcaggtatgcctgagaagttttattcccgcgctgtacagtcgccgagcaccactctttttgactggaatccctccccactctgtcctagtggcgcgtgctgtgctgcgcaggtgccggtcggaaagtcaccgcgcgcattccatgaggataggggggtgggggcactgacactaccttacgatcttcgacttgtcaagggaaggattcacccagctatacccgcgagtgcatttacccgcacctgctcaacgcgatgacgtcgttgtgcggcgccttcagtggcctgcacattggcaagcaggtgggtggcaccgagaagtcgcgctgggtgtggcaaagggaggcctcgcggcacgctggtggaactggtgtgtttccacacttattgtcactaattcaaagtcttcagctggtcgtgtgccatcctttgtaggcctttaaggctttcgtgcccgcccagcacctctccgctcggcggagtgcgttcctgtgtgcctcccggcctgtgacagtgcgggcccccgtcacggcttctgctaccatggccgcatcccagctcacgatagagtgcgcagatgggaggaggggcggcaagctgaagacgcgcaaggtcagtggctggtctgggtcagtggcggattgggagggagagtcttgcgttccattctcatgatctgtgcctgcttgaatatctggaaagcatgcagtcaccacttctggtgtcctaccggactcctgagtcccttgttgagtttcccatgtcccaggcggcggtcaagcgttacaaggtgacggggtctggcaaggtcctgacgcgcaaggccggcaagcagcatctgaacgagaagaagcggcaccagcacctgctccgttgcaagtgcgtgtgcttggtcatgcggaggtggcagggggtgatgcagtgctgttggactggaggggtgtgttgatccgcatgttgcaaagtgatttggtggggttactgctgcacactctggctccgtgtggataaagcctggacatcctcccaaccccgccatgtgcactgtctgtaggaaggagcagtctgtgtcccccggggacctcttcaagatcaagcgttgcatcccttatgctggcgtaaagtgatgtggtgcagcgtagagggctgctgtgctgagagtcgcctcggcatgctttccctgactgctgcgtcttcggggatgagtatggtgtacaatgcttaataagaagggggagagcacagcgaatccaagcattctaacggctgagttgaggtataggagctctggggtcgcgtcagggcacagcatgggatactggcttccaactctcgacgggatggctcgcaatctttgcagcagcttcttaccactgcagcaggggacggaagcatctgtccagatcctggaggtggccccagcatccctgtccaatactagacgtccatggccgtgatggcctctgggctgtagggnnnnnnnnnncagcatcgctgtccaatcctagacgttcatggccgtgatggcctctgggctgtagggcttgagcacccgctgcggcaggttcacgcgcctgacgccggccaggggcagcgggtgcgcctcggtgttgaacacccaggtgtcgagtggaaagagggagggccggcctggccccgcgcgggtgcagttggccacggcgcaggcgtccggggcatcggcctgcaccagccagaggtacttgagcgtctccgacaggaagaagctctcctgcgagtcgcgctgcgacgagggcgccgccgccacgttgtccaggctggcgtagttggcggggtgctcgtggcaatcctcgcccgcaccctcgcacccaccgccgtggggggggtgcgcccccgcccgcacccgcgcccagcgctgcaccgcgcggaagatggcccaggcctggtcctggtaggcggggtcccccgtgaccttgtacagcaggtagagcgactccgccgtctcggggcgcagcaggctgtgcgcgtccaggctggtgatgctgaactcgcccatgccgcgcgggttgtcgtcggggacgtgggcaacccagtgccagacctcgggcgccaggcccgagggcgtgttgcggtacccctcatagcagctgcgcgccagctcccgtgccagccgcaggtcgctcatgcccggggggtggtcgcgctgcgtcgcgccggggacgcgtgtgtccacgccgtggtagtggcccagggccagcacgcctgtggtgagtttgagtgtggttctggcacttcaggaggtatctgtgtgcagggatgaggggagggaaggaccccacctccagggcattgctggaacctgagcccggcacatgccgaagacaagtcatgagccggagcagtcaggatgagggtgggagcctcggacacaaggatcagcagaggggcccaggcagcagtggaacgtgcagcccatcaggctgagacaagtgggcagccggtccagccacagagccttccannnnnnnnnntggggggcccaggcagtagtggaatgtgcagcccgtcaggccaagacaagagggcagccggtccagccacagagccttccagtccaacctggggtgcaatcgacccaaggctccgggtgcacaaaagatccagcatttgctgcgtccctgccaccccaactcctcctcccccgcacccggcaagaagcaggcaaggtggtccatcttgggccaggtccggttctgcgtcaggtccagctcggagacaaaccagaggttgcccaccgtcctctggaccagcctggaccgcacgctgcgcatggcctgcaggaaggaggagtgggagtgggatgtgggtgatatgataccgtgtgaggcgtggttttctttgcacgctgcacctgagcctgtcatcagtgcttcgaacgtgagacatggtggctctgcatcaatcgcacaatcttgattcacaagctcaagaacgcagccaacccgctccacaatgggcannnnnnnnnngatcagtgcttcgaacctgagacgtggtggctctgcatcaatcgcacaatctttattcacaagctcaggaacgcagccaacccgctccacaatgggcagcctcacctcgatgtaccactgaaggagggtcttgtccttcttccccctctggatccagcgcttgagcaggtactcgtagtacgaatccgccctcccacctgcaccattgtgcagcatgggggggcgtgttggtggagccacaccgtacggcactcccttcaacagggggaggcccccggtgagtaccaactggccgcggcatcgctcctcccaaacaannnnnnnnnngcactcccttcaaagggggggggcccccggtgagtaccgactggccgcggcatcgctcctcccaaacaagcacggctgagggagaccatggaccttgcacccatgcagactgcctcaccgagtgtcacgcggtctccctgcagttcccccgtggcaggatccagctcgtagggtaagagtccaccatacttggccgtctggctggccaacacctcgtacaccttgtcagtgtgcttctcaaacacagggtttcctgcatggatgtcgtggtggaggggtcggtgggtcttggagatgtatcctgtcgcccctcctgcccctccagctggtgtgcacctcggtgagatccaccccacaccaaggagagccttcccgcatgcatgcccgccctccacctgcctgagnnnnnnnnnntggcgagatccacaccacaccaaggagagccttccagcatgcatgcccgccctccacctgcctgagtatcgcgagaggagcgtccactccagggtcagcgtcgcggcttccgacaggtagctcatgtgcgtccatggggaggttgaggcctgcccgctgctcacgttgacgtccatgaagggaatgccgctggggctggcctcgaaggccggcagcagtcgcgcgcccagctctaccgcccgctccagcagggcgggggtgagctcggcgccgtctgccggggttgccagggcgtgcgccgacagcaggccgccgatgaggcggatggtggcctcgaaaacattcaccgtgcggccgttgtccaggctgagccccgaggcgacccaggccagcccctcccggaagcgggagtctaggcccatcatcttcagtgtagacagaccgtccaccagggtcaggcccatgtcgaaccaatcggcggactggcaggtgagaggcttgacgaggtccttgccccatgcgcatgccctggccggggtcaattggggatgggtcgtgggcatgagtggtgcggggcgggccgcctctgggccggggggggtgatggtgcgggaagcggcacaacaggctggcctggagtgaggagcggcgggnnnnnnnnnngggggggggttgatggtgcgcgaagcgacacgacaggctggcctggagtgaggagcggcggggcatgcgcctgcaacacccgcctgagctctctgacatgtccgaggccatggacgccaggcgccaggccctcctcctgggtctatggccgtccacgccccttcccatgcaccctcagtctgccaccaggcactcacttgtacccgtcccaggcgagcgccgccgcctccctgacctgctcggccctggacacggggtcgaaaatctgggcgaggaggcagtcctccgcctccagctcatccttggagaccttggcaatggcgcacgtcagctgccagctctcacacaggccccccgtcctgcagcggggggttctggtgtctggcaggggggtatagttcgacaggtcgtcttggacgtcgatatcggggccctccttcagcgccaccctcgaaaggagggctgccaggatgctggtcgcgatgagggtcacaaacacggcgcccttgtgccgcttcgtgcaccgagttagcgcaactgcgcatgggtcttgtggggagtctgaggggctggggatcgccatgcagatgaccgcgttttgcacgcacgtcgcgcatgcccaacccatctagtatcggcgtttgacactcacgcgcatgccctagcggccacgcgcgcgtgcgccgcagggaatggcccttcatcgccgttttgagtcccagggcggcatccgagggggaccaggttgtagcgtcctcagttcgagctcataatgactgctgcataaacgttccatattggtttgtccctcatttccccatcatgtggagccgaggtggacttgggtgcgggccctgacggacgtcgaactagggttattcaatttttacgtaattgaggcacggcatatgatcggccgaatgccgtatgcggtccctcgtacgccgcaatccaggatctgggcggcccaatccatcgttctacccgcactggggagctgagacagacgtacacaagagtgggcgtggcagttcgaccctcgcgcagcagtggcgggagggtttaacgactcaccggggtaaccatgaagactgcatacctacttcctttagactgcggggcctctccagatgcatgctcaggcattgccaggttctgtgaggtctcggatccagagggtgcagtgcgcttcgctcgcttattgctggaggccaggtgggttgtgggtgtcggggacgggccatctccttgcctgcgcgacatccggaggatgacctcggctcactgtgccgccggggcgtggcatgatgcaagctaggagcttgcaatggtggagttgattgcaagctcgctttttatattgcttccagtccgcggaggagcgcagcgacattgctactactctgtcaggatcccggcatcctggggatcctgtcggatgcgctggccactgccgacctgccgcactacgccggtgcgtttggtggcaagcccatccgctgaaagggggaacttcccacgactcatgcttatggcattgggacagcacgtattgtcttgattcctggtcggtgagggataagcatccagggcttcaacgcaggttgtgcttgatccatcgcaaagtatcttccctcccaaacacatcctcccccaacccccctttccccattttaatgcagtcatcttccctgctgggggaccatnnnnnnnnnntaggttgtgcttgatccatcgcagagtatcttcctcccaaacacatcctcccccaccccccctattcccattttcatgcagtcatcttccctgctgggggaccatctgctctcctggaccagttgctggcagcagggatcagcgatgtggaggccatcagcttccttgcagctgcgctgtggggcagtgccgccgccaggcacatccccggatggtcacaggacgacccaagcatgaactccatggcacagtgggaaggaaagcctgtgcttccaggagtagctcatgacgacggggaggagcaggatgcctggaccttggcggcggtcagaaggccgtcgcctcagctcactgcgctgccacaagaaggaggcctgaccgagcgctcagacccgcannnnnnnnnnaaaggccgttgcctcagctcactgcgttgccacaaggaggaggcctgaccgagcgctcagacccgcatcaacacccagccaggctgcatgtggatgtcacgggatcgacggttgtcgatcgcctgatggtcacggtcgctgcatatctggcggacagcggactctcatcggcaggtattgcacccaacaccccattcatggaggctggcctggactcgctggacctcctcaaactggccaggtgtgcctggtgctcagggattatgcagaatcgtcaagtaaaccaaagagatgggccgatgtacagctgctgttgtattgaacattggggtttcagaggtcacatgctcctagatatacctggcatttggcacgagaaacaacagtgcatcccctctactcccgagcgcagtgtggtgagtcaagagtttgaggcgaccctcccgaccacaatcctctttgnnnnnnnnnncgatgtacagctgctgttgtattgaaaatttgggggttttagaggtcacatgcttctagaaatacctggcatttggcatgagaaacagtagtgcatcccctctactcccaagcgcagtgtgttgagtcaagagtttcaggcgaccctcccgaccacaatcctctttgactttccctctgtggcaagcctgagcgcccacttggtagctgccggcttggggatggccaagggaggcgggagcaactctacgcggcctgaagccctgcacacaagcgctgcggcacatgctgacccaaaagcccatgcgagcattgaggccggaagcttctctgtcatcccagcgctccgacccgctcctaccactatagtcccaagccgaggtgctgtgctgatgcagagcggcgccatacaggttggggatgggggagacatgctggcgccagcagactggagcaacgcatatggacttcactggagccttggagccgagtgtcctcggccaattccaccagagcgctgggatgccgaggtacccggtggtgtcgtggctggaccacggtttggagcctttctcaagggtgagttgaatggtgaaacgggagaagaaggggtgttgttgactttatgnnnnnnnnnntcggagcgctgggatgccgaggtacccggcggtgtcgtggctggaccacggtttggagcgtttctcaagggtgagttgaatggtgaaaggggagaagaaggggtgttgttgactttatgnnnnnnnnnnatgtgaagggccatgcgcctccgatctacatgaccctcgtgtccctctgtcatgttgattgtgccccacggtaacagaaccttnnnnnnnnnngtgtgaagggccatgcgcctccgatctacacaatcctagtttccctctgtcacgttgattgtgccccacggtaacagaaccttcaccgtccctcgcatgcacagatgttcacggattcgacccgggtgcctttggactcggcagcgcagaggctgccctcatggatccccagcagcgcctcatgctggaggcggctgcctgggtgattggagcttgccaagcaactgcggggtgggagccctccatgggcggggtttttgtgggatccacacatgctgacttcctggttgccagccggacgcctgggagtgcaaccagtaccttcagtgcaacaggctctagcctgtctgtcatacctggtgaggcaggggaagagcttggagagttcctctcactgtgcctgcctgtgttgctgagaactcctgaattggactggtgggtggggaactttagccgtgggtgttgtacaggtcgacctttccggcggcgacactgggccctgtgctcaacctgcactctacagtggctggcacaatgctgacccacaggtcgcatctcctacacatttggtctgggggggcagtctgtcctcctggacaccgcctgctcgagcagcatggtggcagtgcacgctgcttccacagccctccaggtgagcggtaccacggcatggaggcatgagatgtgtggcagttttatgttatcaatcttcctggcaaggcagccctggtatgaatccaggtgcacatcttctgtcatctgttccggtttgatcccagtgaattcctttcagcaggcaggcagcctcacgtggggagtggcaggaggcgtgaatgtcatgctatcacctgccaccatggccagctatgatgcagcaggtggagcgagcgttgcatgcaccttctgggatctgggaagcaggctggccatggctccacccatacagccatccactcgaggaggggccattgtgattttgatcacagccaactacaaacacgatgttcaactgttgcagtggcccctatcttnnnnnnnnnnccaaggaggggccattgtgattttggtcacagccaactacaagcacaatgttcaactgttgcagtggcccctatctttgcagggatgatctcaccttcgggcagatgcatgagtctggatgcagcggcggatggctatgttcgggccgaggcagcgggcctcttcctcctgcgtgctgtcagctcaatggatgacacccatgcagggcaggtgagtgtttagattggctttggtagcgactcaccttgcatgcctggagggatgaatttggagtgactctggctcagcctgtacgcaatcaccccgcatattcactagacgagcgcctggtggtgccctgggacctccatcctgctgggcacagctgtcaaccaggacggaaggtccagcagcctgacggctccaaacggtcccagtcagtcagccctgatcgctgctgctctgcggtcagccttgtcggatcctgagcaggtggagagccatgagtgtgttcctggctcgataatttggcaatggattgtgtctcactgctcacccgcggttggtccannnnnnnnnnagacagccttgtcggatcctgagcaggtcgagagccatgagtgtgttcctggctcaagaatttggcaatggatggtgtctcactgctcacccgcggttggtccaggtcagcatgttgaacgtggcggcaccagctgtactgctcccgtgcatcaattcctcatgcaggtggacatgctccaactgcatggcactggcacgcccctnnnnnnnnnnaacaccagctgtactgctcccatgcatcaattcctcatgcaggtggacacgctccaactgcatggcactggcacgcccctgggggatcccatcgaggtgggagctgcactctccaccctggcccccaggcaccgaggtgcgggtggtgctatgatgatacagggtgctttgtcgctgcctgctctccctggtttgaggacatcatggcacgcagacttctagcgctgtcagcaaactcaacttcccgtactattaattctcagggcacagcctggcgctggcggcggtgaaggcctccaccggccatagcgagtcggccgctggcctcctcagtttggcagcggccagcgctggggcgggctccgcctacctggccccgctgaggacgctgcggtgggtggtggtgcaggggcctggtaatcaatatgcacgctcatgaatgtccccgtgagtgactctcagagggaattcatattgcgactccctcccgatgtcgcctgcccatacatctggtcgttgtggaaggagcactgaatctcaatcattcctcccggcatgcaggacggtgaaccccttcgtggccgccatcgagcaggtctgcaggggtggcatccaggctgccaggctccaggggcctcggcccgggtgtggcgcatccgaccaaacactggccggcgccagctcctttgccttccaggcaagctgcgattggtgggggtggcgtcaacggagcgctgggcacagccatcgggggcaagcctggcccggaccccttgcatctgctttcttaaagtagcccatcgtcctctccccctcctttggacagggcaccaacgcgcatgccctggtgcgctctgcgcaaggctgtcagggccagtccccaggaaccagaccccgctgtccctcacagcggctggtgtgggagcgcacgccgcatgggcccgccca

SEQ ID NO: 45494 - DNA, 61 bp, Chlorella protothecoides
aaccggcatcaccaacacctacattggcggcgtgggctcatccgtcaacgtgggcctgtcg

SEQ ID NO: 45495 - DNA, 61 bp, Chlorella protothecoides
gaccgtcatctttggaggtgtgcagatcgtgtcctcccaggtgcccaacctggagtcggcc

SEQ ID NO: 45496 - DNA, 61 bp, Chlorella protothecoides
gttcttccggcaccacggccccttggccggcctccaacccgggcggaatgagctgtatcag

SEQ ID NO: 45497 - DNA, 69 bp, Chlorella protothecoides
tatttctgccattatctcgggtacgtatcggagcccgggctccatccggaggaaagcaatgcctggtcg

SEQ ID NO: 45498 - DNA, 61 bp, Chlorella protothecoides
ccccaccagaccgtgccgccctcggccaagaccgccagcctggccacctccgagaactgca

SEQ ID NO: 45499 - DNA, 61 bp, Chlorella protothecoides
ctgtgtggccggcgtgcctgggactgcgagaccagccagcacccgacaaaagttgatgatc

SEQ ID NO: 45500 - DNA, 80 bp, Chlorella protothecoides
gagtgggcgcagcaatggcttgccctgctggcgcaggcagctccgcaccacctcccaggcgctcagacaccgcttgcgcg

SEQ ID NO: 45501 - DNA, 104 bp, Chlorella protothecoides
gctgtcggggtacagggcggcagccatcatgtcactgcacagcaccatcagctgctcgtccacagcccagcgtgtcgagtcggagagcatggaggcatgcgcca

SEQ ID NO: 45502 - DNA, 272 bp, Chlorella protothecoides
cccccttccccaccaagccaagtccttccctccccgacgggcaccatgacctggaatggcttgaatttcaactacgccatcgacacagggagctacatagccagttcgctgaccttggtgacatttgcatccgacaataccgtgctgggaacatatgcggcaaagcccacctccaccgtgaccgaacgcacagccactgcccttcctgttgttgccaagctcttcgcttacgcgaaggtgagcgcaactgtcgttggaccgcccaagcagcg

SEQ ID NO: 45503 - DNA, 61 bp, Chlorella protothecoides
gtccggcacggctactgaatcctctgcgagtaacgtggccccacctcttcttcctgactgc

SEQ ID NO: 45504 - DNA, 78 bp, Chlorella protothecoides
catgtatgcaggcgcgcgcgcctgacacagcgcgcaccgcaggcgttcacttctgcaattctcaatgagcccatcaag

SEQ ID NO: 45505 - DNA, 63 bp, Chlorella protothecoides
gtgtgcatagggccatgcctgagagtgagttccctttggatatttcctggactttgccatccc

SEQ ID NO: 45506 - DNA, 72 bp, Chlorella protothecoides
actctacttctcaggtcggcgcagggacagtctgaccatgctgcagagactgtctgttgacatccaggcacc

SEQ ID NO: 45507 - DNA, 61 bp, Chlorella protothecoides
tgtggtccaccatcctggatactctcgatgccgctgggatgccccaggggcctgccttccc

SEQ ID NO: 45508 - DNA, 68 bp, Chlorella protothecoides
ctcacgcttcggtgccaggtggtgccctgtgaaataataccgatgtccaagccacactcgggtcccta

SEQ ID NO: 45509 - DNA, 194 bp, Chlorella protothecoides
gcgaccagggattcggtgtgtggaatgcatggcacatcggatattgcatcttgacagggacatgtcacccgaaccaggtgcggtgacagccgcggcccgatttggagcacgacgcctttgcgggggagagcacgcgccgagggaattcccttcggccgcccccagccacccacctgatgtccccaggagctcca

SEQ ID NO: 45510 - DNA, 61 bp, Chlorella protothecoides
gtgccactgtgagccttatggattggtgggtatggggttgccatgagatctgccagccagc

SEQ ID NO: 45511 - DNA, 87 bp, Chlorella protothecoides
cataagcaagcacctgttgctcaggcgcagggccttggcgtagatggcagcattcagctccgcgcggatgatgacctgggtgccgat

SEQ ID NO: 45512 - DNA, 73 bp, Chlorella protothecoides
tggtagtttggatcgtcctcaaagttgtctgcagcgatgaatggtgggcgagtggtgcgttcagataccctca

SEQ ID NO: 45513 - DNA, 71 bp, Chlorella protothecoides
accccttttgccgggtgcgcatgctctgcgacagggcagagcgggagcgtgaacacaaatcagcctggctg

SEQ ID NO: 45514 - DNA, 73 bp, Chlorella protothecoides
ttcaactgtgtgcgctgatggccagtccacaatgctttatgggatctaagtaggtgtaaaccgtgccacgacc

SEQ ID NO: 45515 - DNA, 61 bp, Chlorella protothecoides
ttgcaagttggcatcgctcgcctctgcgaaccactcttcctccccgcggcccccctcgcct

SEQ ID NO: 45516 - DNA, 63 bp, Chlorella protothecoides
aatagtttccatacttatttatggcttttttttcgtagtacactacgtacaacaagccataat

SEQ ID NO: 45517 - DNA, 90 bp, Chlorella protothecoides
agcactgggtattgagcatgccggggacaggcaagaaacgcaaggcttgcagtccaaggggtgtagccttgactgtgggcaaagtgcagt

SEQ ID NO: 45518 - DNA, 61 bp, Chlorella protothecoides
tggttcagggtcaggctgatgtcctgcaggctgacgttgttcagcgcgatgttcagggcca

SEQ ID NO: 45519 - DNA, 77 bp, Chlorella protothecoides
gtgccagtgcccttgacatcgtcccacttctcaccaccccgggcaccacccttctccgccctggagcgagggccttc

SEQ ID NO: 45520 - DNA, 76 bp, Chlorella protothecoides
ttgctgggtcacggtgaaggccatgccggtaaagtgcagaccctttgggcgcagttatccaggagttgatcacatg

SEQ ID NO: 45521 - DNA, 61 bp, Chlorella protothecoides
cttaggcgctagagaacacaacacactcacacactcatatgtatactacatgcatacacgg

SEQ ID NO: 45522 - DNA, 81 bp, Chlorella protothecoides
ttgcacgagtcgtactgtactccttctccacccgctgcagtcgtatgaccctccaacgagaatgccgagatccacatgatc

SEQ ID NO: 45523 - DNA, 61 bp, Chlorella protothecoides
ggcagccacctacctgatgaagtgccacattggggagtaccagtacgtgggccagatcggc

SEQ ID NO: 45524 - DNA, 73 bp, Chlorella protothecoides
gctgctttcgctgcctggcggtatctgtcgtgggatttctctcccaggtttcgcatttattttcggatctcga

SEQ ID NO: 45525 - DNA, 106 bp, Chlorella protothecoides
gactagcagcactgtacctctgtgtattccacttgctgcctggtgggctgactcgaatgtccgaactatgatgctcccactttccacagctggagaaataacatgc

SEQ ID NO: 45526 - DNA, 61 bp, Chlorella protothecoides
aaggtggatacaagcagaggggcgtgtccgccaaggtacatgccttcatctctcaaaggga

SEQ ID NO: 45527 - DNA, 61 bp, Chlorella protothecoides
agcaggcaggcagcagagggggagggggggtgttgaagaatggacatgactttttaaagga

SEQ ID NO: 45528 - DNA, 61 bp, Chlorella protothecoides
cgccacggtcatggcagccaggcggcggggttgcgtgcaagcaatcatcttgcccccggcc

SEQ ID NO: 45529 - DNA, 61 bp, Chlorella protothecoides
tacagtctgtgctgtaatggcattaatcgctgaggcactactcctcttggacgtcctcttg

SEQ ID NO: 45530 - DNA, 150 bp, Chlorella protothecoides
cccagggtgcctgtgactgggaggacgactgggaggccgccgtccccccccgcgctgcgcagccctctccgaccaccacctcgggcgcaccagaacccgccctgctggcgcgagacgaatggggccgtggtgcaggacctccgccacttg

SEQ ID NO: 45531 - DNA, 62 bp, Chlorella protothecoides
gctgagtgacccatggagaggagcctgctcatcactcggtcctcttttcatcccaatctcac

SEQ ID NO: 45532 - DNA, 5138 bp, Chlorella protothecoides
  modified_base (127)..(179): a, c, t, g, unknown or other
  modified_base (310)..(319): a, c, t, g, unknown or other
  modified_base (1207)..(1216): a, c, t, g, unknown or other
  modified_base (1319)..(1328): a, c, t, g, unknown or other
  modified_base (3572)..(3581): a, c, t, g, unknown or other
  modified_base (3977)..(3986): a, c, t, g, unknown or other
gggaccatgccacagcctgtggggtgcagaatctgtgtgcagaccagtccgtgcctgtcccatacttgcattccctcggtggtatcgctacttgtgcgtctcccttgccgcctctcatgcactcctnnnnnnnnnnnnnnnnnnnnnnnnnnnnnnnnnnnnnnnnnnnnnnnnnnnnngatgatcccagggtactttgcatgcattggatgcaagcagtactctgcagtgcgtttcccccatctctgggactgctgcaactgtcacacccacccctaaccacccacagtggtccaactcagctgaagannnnnnnnnngaagattctagaggtgactgagggatggggtggaagaggaccctgggcgtgtatcagcctgatttgcctttgcggggcggcagaggccatgcctcttcctcaccaccaaacgatgccagggtactttgaatgcattggatgcaagctgtactctgcagtgcacaccccccatctctgggaatgctgcgactgtcacacccacccctacccacccacagtggtccaactcagctgaagaagccctcaagctggccctgtacctgaatgacaagtacgagatcgatggacgtgacccaaacggcgtggtaggctgcatgtgggcgatctacggcatccatgaccaggtaagggtgggggcccagaagggacagtgtccagtttgtggttataggacacccccccccttggaagcgctgcctggacccagcactcgccattgacacacaaacgtaagaataatgcatccgctgcagggctggactgagcgtgctgtgttcgggaagatccggtacatgaactacaacggctgcaagcgcaagtttgacattgagaagtacatcgctcgggtcgaggtgaccgtgagggaggcccgcaaggcgcacgggaaggtgcagccaaagacgacagcggtgataggcagtagcgaggcctgatgggttgtggtctggagaggcgttgtactcaaccacttcactcagtatctgttagcaaatgtttccaggacctgtcaatgtgtgctaggtgctccatgtataccttttgctcgaaagactgtcgatttgcattgtatgtagacatagggtacaaggtgaaggtcggatcccccatgggtgccagcagtgagaagggagccaagcgacaccacgctcggcacgcatttccgagagnnnnnnnnnncggcagtagcgaggcctgatgggttctggtctggagaggcgctgtatccagccacttcactcagtatctgtaagcaaatgtttccaggacctgtcaatgtgtnnnnnnnnnnggctttccttccatccctcccgccacacacagcagcatcctcaggtctgtccccgttcaggtgagggcccctcccatccccaacgcccgacacagatacggcattcatgagcagcctgtgcaagccttctgaagccagaacatccatcagtcctggtctccccagtaccccacctccgccctgctcgttgtctcgcgcgggtacccctggggcgggctttgggccatcctgggccatcttgtgagagatcaaagggtattggaaaccccagtctcccttcctcgtgtggttgactccccgggtatgccagcaggatcaggcctgagttcatggtggtgcagactcaaacggcagcagcagacggctcgctcacgggcaaaacccccgatggtgatactctgagagtgagggaagtgtggcaacacaacctggaggaggagatgcaggtgagggtggacggtatcggcgtgcctcgtacctgccccgagacgatgggatccggtgttccaagcagaacccccccttcccctgcgccattcactcccagctcatacgggagctgatctccgatttcccatacctcgccatggacacggagttccccggtgtggttgccaagccggttgggaactttaagaagagcagggagtttcattaccagatgctcaggtgtgtggccccatgaagcgggacgcatactcttcgatatggtctggagaatgcagctgaacgtgtttgttggaggggtgtgtgtgtgtggagacggggggagacaggggcaggggcgcagcttggccctgcttgcgctgaccgcaggggaacaccaagtccctgctctgtgggtgtaatcctccattctgctagtctgaaggatgatagccagcctcacccctccttgctgtctcacagactcaatgttaacatgctgaagatgatccagctggggctgactttctctgaccaccttggcaatcttccgcggatcaacaatgagctgtgtgtgtggcaattcaacttcaggtgatggtccaggcagcctgtgtcaagaggagggattggtgtccaaggggtgggtcacacccggtgtcccttgtgggccgcgaaggctacatgccacccgttagtccgccgccggcatgagcagcttcactcctgaggggctccattttgcctcttggaggagaatggggctccgaaaaccctgagcagcccatccagtgtgtgcacactggctgagctgctcgatgaagaggcgtaggtgccctcattgagggcttgccgagcccagcctagcctcagtctcgacacctcaaacctgctcccaccccctgcacagggaattccggctcaatgacgacatatacgcccaggacagcatcgagcttttgaagcagtctggcatcgacttcgcacagaacgaggcacgagggatcgacatccacgactttggcgcgctgctgatggtgtctggtgtggtcttgaacgaggacgtgcggtggctcaccttccactccagctatgacttcgggtaccttctccggactgtgacatgtgccccgctgcccaacaccgagtccgacttctttgaattgctcaaggtgggatgtgtggtcgggtggggtgcaggcacctcggtactgtgtccgctgctgcatggtgcagcacagagcctgctggccttgcttcagtgggatgtgctttgctggaggatttgtgactttgcttgccctcccatcaccgaggtcctcctccacctcacacctccagtgcctacccctccccccggcccacagatcttctttcccagcgtgtatgatatcaagtacctcatgaagttctgtgacaacctccatggcggactgaacaagcttgcagagaccctggacgtcgcacggattgggccccagcaccaggccgggtcggactcgctgctgaccagcgccaccttcatgaggctggcggagaagcacttcaagggcttggcggggacgcaaaagcatgagaacgtgctctatggcttgggcgcagacggcaataatgagctgctgaaccctgtggagtaacatacgtataattagaggccggggtagagacaagaggggagggtgtttgggggcgtctaatttggcgcggaaggcagttcctgagagtgtggggcaggtagcagatcccgggacacaggggcgcgccatggcgcgacaaaggtgtctgacggtcagaatgcaaccgtcttcgcatcgagannnnnnnnnnacggacggcagttcctgaaagtgtggggcaggtagcagatcccggggcacaggggcgcgccatggcgcaacaaaggtgtctgaaggtcagaatgcaaccgtcttcgcatcgagatgacgcgtaaaacatagaccaggaggcttgggatctcttcgtgacggctgctctaatgagctccaccctcaactatgcactggtgcgggagccccgtctcctggacattgtggacgatgagtgggcagcagaaaccctcccggatgatggtagggtccttgtattgagatgctcttgtcatagaatgtattagagtctgttgtggtctggagtgatctgggctacgcgaaaccagcctggcactgccctgaatcgcagacatcgagctgcctgcgggcctgnnnnnnnnnnggatgctcttgtcgtagaatgtatcagagtctgtcgtggtctggagtgatctgggctatgcgaaaccagcctggcactgccctggatcgcagacatcgagctgcctgcgggcctgaaagacctgtcggactcgggcgagctcggtgaggccggcgtaccgccggagccgcagggctgggacgagctggccttgagttctttgaattgatggcatcgtggagttgggggtatgcaccaggccccctcacgtcgtcgtcacccccttgcctgtaccctctactgtgttcatagagcttgtaacaacccaacactgaccctctgggcgagctgtcagacatgtatgggtcatcagcagaggccatatttgtaaggcatgcacccggcgctgcatcgcctgaaccccggtgcacagcccagacccggtgttctactcacccaacaccactcccctgccccaccgacaccccctacatgcccatgcccttcatgaaatccccaatgtccaggttggcatcgccgtgcgccacggcctccttgtcggccgggcgtgccagacgcccggagctggccttgcagtcgaggaagacggccccttccacgtccacgcccgtcaccgccccacactcctccagccatgccaggcagttggcgagcccgcgttcctcatcctgaagggggaaggtgtaacgaggaggtgaggttgtgattggcagagacgcggggacactcacccagcattccaggaggggccttcaccgaacacgtctcaggtgccacacgcattcacgaaagcctccagagaccagtgacacagcatccctccacccctcctctccccactccccgagcatgccatccaccccccacctgagcctcgtgctcgccaacgtatctcgccgccgagcagcccggcagcgggtcgctttggggctccgcaccaccccccccctcacccccagccccctcgcccatctccggccgccgcacaaagcccagcatgcgtgccaggtcgcgcccggccacgcccggcttgaaggccttgcaggccgcgcacagcgcgtcgtagcgcaggcccggcaccgccaggtccatcagcgcggcgcccaggccgggcgcgcgcgcgcgcagcgcggcaaagcgcggcgcgtcccc

SEQ ID NO: 45533 - DNA, 69 bp, Chlorella protothecoides
aagactgctttgatggccacattatgatggcatattgtgaatcccactcttggtgtggcaacatgtttg

SEQ ID NO: 45534 - DNA, 61 bp, Chlorella protothecoides
acaaagcccgtggctgccatccttgctgggtggtgactccgcccccatagccttcaagact

SEQ ID NO: 45535 - DNA, 80 bp, Chlorella protothecoides
ggccatccagtaccacctgaaggaaggagtttatactctcacagggtgaggggcacggagattgactccagaaataacat

SEQ ID NO: 45536 - DNA, 66 bp, Chlorella protothecoides
caggtctattggcggtacgtgggaaccaggtcacttcttggttctggacggctactcaccgcagcg

SEQ ID NO: 45537 - DNA, 61 bp, Chlorella protothecoides
gccgtgggtggactagcatcatccctggcttccagccacgacgccactgtctggagtgccc

SEQ ID NO: 45538 - DNA, 61 bp, Chlorella protothecoides
aacaaaaagggtgaatccagccatctgcaaaattgcccacacaaacagaagataacattca

SEQ ID NO: 45539 - DNA, 76 bp, Chlorella protothecoides
ggacagtacgagcctctcagtttgaagccacgtgcgtgccaggccagcaccgcccgcggtcccgctctgggctccc

SEQ ID NO: 45540 - DNA, 76 bp, Chlorella protothecoides
gcacgacgccgacctcctctcaaccccatgccccaggtacaccgcgtttgtggagatcatggtgcccatggtgcgc

SEQ ID NO: 45541 - DNA, 61 bp, Chlorella protothecoides
aggtcagggtccgagtggatggcagacaggtgacttaaattctcttaatcctggtggccat

SEQ ID NO: 45542 - DNA, 69 bp, Chlorella protothecoides
caacatgggagacctcaactggggttacaataatatggacaccaatctgcggtgcaacaacgcgattgg

SEQ ID NO: 45543 - DNA, 61 bp, Chlorella protothecoides
ggctgcaaacttgcaagattcgccaaacagtacccttccatgaaagcacaggtgtccaagc

SEQ ID NO: 45544 - DNA, 69 bp, Chlorella protothecoides
aaggtgagcactgggtctcggcgcagccagcgaccgccgccacgacatcagacgaccacacccgagggg

SEQ ID NO: 45545 - DNA, 61 bp, Chlorella protothecoides
ggtccaccctgcactacatcaacaacctggctggctccatctcctggttcttcggcctcgc

SEQ ID NO: 45546 - DNA, 144 bp, Chlorella protothecoides
tcagatcaaaaccttgtggaacaattcaagccatttattaatgttgctcagctctctgcacagcatacctgtgcacccgcttgaaaagtcatgtgtcacacgcattgccacatacaggtgttgtcaagcgatacacgcaggcct

SEQ ID NO: 45547 - DNA, 61 bp, Chlorella protothecoides
cgtgtatgctccttggcaacacgcggtcccccttacgactgcatgctgatgatctgggcgc

SEQ ID NO: 45548 - DNA, 117 bp, Chlorella protothecoides
acacaaatattaatataataattgatattttattttattacaaacctaaatataacagttgaatttatggataaaaaacaatgggaacgttttgaaaatataattaaaacgcgtttt

SEQ ID NO: 45549 - DNA, 35735 bp, Chlorella protothecoides
  modified_base (495)..(504): a, c, t, g, unknown or other
  modified_base (645)..(654): a, c, t, g, unknown or other
  modified_base (922)..(931): a, c, t, g, unknown or other
  modified_base (1253)..(1262): a, c, t, g, unknown or other
  modified_base (2452)..(2461): a, c, t, g, unknown or other
  modified_base (4844)..(4853): a, c, t, g, unknown or other
  modified_base (5455)..(5464): a, c, t, g, unknown or other
  modified_base (5524)..(5533): a, c, t, g, unknown or other
  modified_base (6384)..(6393): a, c, t, g, unknown or other
  modified_base (8051)..(8060): a, c, t, g, unknown or other
  modified_base (8555)..(8564): a, c, t, g, unknown or other
  modified_base (9359)..(9368): a, c, t, g, unknown or other
  modified_base (12528)..(12537): a, c, t, g, unknown or other
  modified_base (15099)..(15108): a, c, t, g, unknown or other
  modified_base (15363)..(15372): a, c, t, g, unknown or other
  modified_base (15889)..(15898): a, c, t, g, unknown or other
  modified_base (17580)..(17589): a, c, t, g, unknown or other
  modified_base (18281)..(18290): a, c, t, g, unknown or other
  modified_base (19851)..(19860): a, c, t, g, unknown or other
  modified_base (20370)..(20379): a, c, t, g, unknown or other
  modified_base (21188)..(21197): a, c, t, g, unknown or other
  modified_base (21269)..(21278): a, c, t, g, unknown or other
  modified_base (22686)..(22695): a, c, t, g, unknown or other
  modified_base (24088)..(24097): a, c, t, g, unknown or other
  modified_base (25532)..(25541): a, c, t, g, unknown or other
  modified_base (25682)..(25691): a, c, t, g, unknown or other
  modified_base (26131)..(26140): a, c, t, g, unknown or other
  modified_base (26241)..(26250): a, c, t, g, unknown or other
  modified_base (26464)..(26473): a, c, t, g, unknown or other
  modified_base (27088)..(27097): a, c, t, g, unknown or other
  modified_base (27494)..(27503): a, c, t, g, unknown or other
  modified_base (27751)..(27760): a, c, t, g, unknown or other
  modified_base (29214)..(29360): a, c, t, g, unknown or other
  modified_base (30364)..(30373): a, c, t, g, unknown or other
  modified_base (31316)..(31325): a, c, t, g, unknown or other
  modified_base (31541)..(31550): a, c, t, g, unknown or other
  modified_base (35214)..(35223): a, c, t, g, unknown or other
gcgacggccgcgcgtgcgccggccgccgccgccgacagcgaggacgaggaggaggacgacgtgccgggcatcccgctggaggagctgctggaggacctggtggccatgcagatcggggaggatggcacgcagggcgacgagctcctggacgacatctcgggcatgcagctgggctgatgtagcgccagcggtggccggaaaaggggggccagggggggttgtcctcgtgctggagcaatgggtgccgcgcgggggcgaggtgcgtcctctctcgagaggcgctctccctctcccccccacctcgttaccactccctctggaggtgctgtgccgcggcacagggtggccgcacacacctctttgtaacattacaaggatgcgctgaggtttgattagatggggaattggggattggcatacctgacacagcaaggaataaaaagcgcaacaggacaaggatgttgagtggctcactccgtgggcactgacaccccnnnnnnnnnntgcgcgggggcggggtgcgtcccctctcgagaggcgctctccccctctcccccacctcgttaccactccatctggaggtgctgtgccgcgacacagggtggccgcacactcctctttgtaacattacaaggatgcgctgannnnnnnnnnggtttctgtcgccggcagtgctgcatgcgcccgatgcctcctgatgccaggagcggtgcgtaccggtccgtaccctggcatcggggcgcatttccacctcctatcagtcatggcatccatcactgcatccgcctccggcatccgtggcgcctgcctggcccggccgaggccggcggggctggtggcgtcgacaccctgtgcctgcctggccgtcccgcgacctggcatggccaagctgcgccccgccatcggcatccatgctctcaannnnnnnnnnatggtggcgtcgacaccccgtgcctgcctggccgccccgcgacctggcatggccaagcagcgccccgccatcggcatccatgctctcaatttcgagtcgtcgcttgcatcgagcatgcgtgcgggtgggatgaagtgccgggcctcaccatcggatgcggcaggtgggcgggcatctggtggtagggtttttgaatcgggcagggcaattacgcttggccaggctatcacagacctccaccgagcacattgtgaccccaacccgcccccatgactggcagtccccgttcccgaggagggccccaagaagagcgccatggtgnnnnnnnnnngcctccaccgagcacattgtgaccccaacacctcccccatgactggcagtccccgttccagaggagggccccaagaagagcgccatggtggagaccctgctgctggggtccctcttcggtctctggtacctcttcaacatctggttcaacatgtgggtgccgggagtggccttgtgtattcgaggggcgtcactggtgggctgcctggcgtgttatgcaggcccatcgccgggggttgggaagcacagcctcagatcaaggcctcccctgccccccctccatccgctccaccccccaactgcagctacaacaagcaggtgctgaagaccttcccccacccgctgaccatcaccgccttccagttcttcatcggctccctggtgtccctcaccatgtggaccctgggcctccacaagaagccccaggccagcactgagaacgtgagtcgagggatggatactcagggacgtcgcacaagggacactgcatgcctggctgcacggcacgacgtcctggcgcgtgcctgcccagcccattcagcataccaaatggaccccctctcccgacgagaaccctctgtcgcttgcatcgacaccctcccacggcacaggtgatgggcgtgtcccccctggcggcggtgcacacactgggcaatgcgctgaccaacatctcgctgggggcggtggcggtgtccttcacacacaccatcaaggccctggagcccttcttctccgtcctgctctccgccatgttcctgggcgagtcgcccaccctgcccgtggtcctgtccctcttccccatcatcggcggtgtggcgctggcctccacctccgagctctctttcacctgggtgggcttcctggcggccatgggctccaacctcaccttccagtcgcgcaacgtgctgtccaagaagttcatgggcaagggtgggttggtgggtgaagggtggggtggcaggaggctgcgtgcctcctgaagaaaggtctggaaggcggcctgggcctggcgtcgatgctcggccgtgacgtggtgtgattggcagatggtgctcatcaccagtgcggaattaagaagggacaatgcgctccggcagagcacctgatgccgtgcgccgcagcaacccatggtgccccgcttgtcacaccaacgcacacgtgtgacccggcaggcaagggatctctggacannnnnnnnnngaatgcgctctggcagaacacctgctgccgtgcaccgcagcaacccatggtaccccgcttgtcacaccaacacacacacgtgacccggcaggcaagggatctctggacaacatcaacctcttctccatcatcaccattctctccttcttcatcctgacgcccatcgcactactgctggagggggtcactttcacccccgccgcccttaccgccgccggcgtgctcaaccacacactgctgctgaagcgggccgtcatcgccgccctctgcttccatgcctaccagcaggtgagtggatgaagagatagttcctggcacagacatgggcattgtgacatgggactttactggagagttgtgcatggatcgaatggcacgacattctgacgaagaggcgaacgatattcagcgcagcctccacactccgatctctcgctgcaagcgtcgatacatgagcatcctgccccctcttgaccccttccccaccctcacccatgcccaggtttcctacatgatcctccagcgtgtgtcccctgtgacccactccatcggcaactgcgtcaagcgggtggtggtcatcgtggcctcggtgtttgtcttccagaaccccgtcacgacacagaacgccctaggtgaggggggcggatggccggcaaggtggggctgagcacagggttctggcacaggccctgcaggaggggtgccaggggcagcgatttgttgccgccaacttgacgagaagctgccctgcaccgagcagtgcaaatgctgagaggcagccgagcaaaaattcaccatacatgcaccgtgcaggcacggccattgcgctggcgggcgtgtttgggtactcccaggtgaagcggctgagtgggaagcccaaggctgcttgagcggtgaagtcgacaacttctacttgcagggacacctccccacaaagcaaatgctctcttgcatcgtactagaactctgaaattcaaccattactgcctgtgcctatcctgcaatgtgatgggaacacccagatccggtgtcatgacatggacccctggaggaaggaggattccatggggttggcgcgcgacttcccggaacggatgatgacccggttgcccagggcggagccaggatggccggccctccctcgctcaaaccaggcaaagcttattccgagcgcgctggcatgccctgcattgctttcgctcctatctagtgatatccaggcggcatcgaggagagccaccagggacccgaccttggcacccactcgcacgcccacacccaagcctgcgccctgcggtacctccgagcagaagtgcaccgccgaggaagccttgagccaaagcactcccctttcggatattcgtgcgatcgctctcggcgccacagcccttgtacctccccgcgccgcagtccagcatgtcacagccggtcatctcccacaacctgttctcggcgctttccaagtcgaagaagagcaagacaaaccccaagcagaaggtgaagaaggttaaggaggtagaggcgaaacatgcggagctcgagaaggccatcttctccgccccggctgtgccgatgacgaactgggcggacgactcggacgaggatctggaactccccgtcacaagcggtcttggaagcgatggctggaatgaggtgagatggaccctcggggcattgctcgggcccgctgacaggcgttggctcgggagtggaggggcagggacctccgatggtcggtcacccttgtcccttaagacggtgcccatttcactgcaggcgccgcgcggcgcccaagctgctcggtattcacccttcccggaggagcctgcggaggccgaatcggagagcgagtacgaagagttcgagcaggtgagcaactttacctgtgtgtttgtgggggcaggggtagggcagcagcagcatgccatggagccctcagcctgcagagcccatgaccaggttgccaacgagaatacaaaccctgtgcaggtcgaccatggcgacatcgaggcagagctgggtctggaggtcgcacacagcgacagcgaggaggaggaggaggaggagggccagcctatgccggccgagggtggggaagagcaggcgacagccagccctgcagtgtctgctgcgccagtcgcccctcgcccaccgcagcagatcctctccaagaaggtgggtggggttgtgtgcggcgagaatggtagggacatgactaacgctgaggaggctgcaggtttgtgattgactgcggcgatctctgtccaaggccactgtgatgtgctgtcaccacggctgattccgaacccttgcatgactctcactgagccagccgcccgacattctcgcccacaggagctcaagaagcaggagctggcggagnnnnnnnnnngactctcactgagctagtccccctacattctcgcccgcaggagctcaagaagcaggagctggcggagctggatgccgtcctggcggagctgggggtcgaagacataagggccccggagcccgcgcctgctgctggcgacaccacctccgccaaggcactcaagcgtcgccaaaagaaggcacagaagggccccgggaccaacggcgaggctgctgcggcgagccggccagcgtcacctgaggcttcagaggaagcagaggaggcaggggtaagtgccccgtcctgagaagagctgtggtgcagaagggcgcgccctgttggttggcaggaataggagtcagcaacagcagtaatgactatcccatacaggtcccctcactgctaatttgttgcaaaagttactcacactccgttccacttcaccccacacgcagactgctgatgacggggccgaggccatcgaccccgaggaggcgcgcaagcgcgccgccgctgctgtggctgcgaagaagcggagctctgcaacggctgctgccgcaaagaaggccatcgcaggtatgaacagaagtttgcctgcaggtggccctcaatctcgaagccannnnnnnnnngtgttgtaaaaattattcacactccatttcacttcaccccacacgcagactgctgatgannnnnnnnnntttgttgtatgaagtgggcagggccaggagtggccgaggagcctgaggatcagagttgagtagttagctgacatctgctggcactcctgggttgtatctgaaggcaaaccggatgaccactcccctccccacccgcgaaacgcatcctgtgtctttagctcccttaatcctccttccacagccgcggccgcatcggttgcgagtgcaaaggctaaggacaagaagaagaaggacacttcgcgctacaaccaagcccccaagcggtgacctgtctggtgactggcaattgttcagctgcgtctggaccccctgtcgctgcccacgtgtttgcccctctgtggctgcttgcctccttggcaggattctgatcacaggccgtccccttgccttgtcgatgcttgggaaggaagtgacgtttctacaaactgaacacagtgcgtgtggctgaatgggaaacaaaagggctaacacaggggtaatatgatacctggggccctctgtggcacgccaacggcctgaacctggcccaggggtgccaaggccatgccctgggtgacccgcagatgctgctcatcggttcagggcatagaggatggccagcgcaagcaccaggaggggcagcaccgccctgagcagggcggtggacagactggtggtcccggcggtcgacccagccagcgtaccattctgcttcttggtcttgaccggcagttcaccaccctgtgagacaggggaaggtgtcaggccaccatgcacctcatgggagccaggccgcatgccgaaacaggtctctggagacatccacagcgcaactacctgaacacctcaacacgctcggccacaaagactcnnnnnnnnnnccaagtatctggagacatccacagcgcaactacctggacacctcaacacgctcggccacaaagactcaccacaaactcgccgacatagtattccttgagcatgtccttggcggtcttgctgtggccaatctcctcgaaatcctctgttgcgtccttgcctggtgcagggaaaggatggtttccaggtaaggaccagatcgagccattggccactctgacttgggaatgaaacgcctggcaaaccgaggcctcccacaccgccctctgcaccggagttggagaccacgatgtcgtagcccccagggtgctcgtccaggaagtctgtgacattgtacactttgccattgatggccatccagcagtctttttctgtctggtgcagtgacacttctgcgaggtcgaaagtcttcgcacccggcgcggtcacttcagccatggcggtcgactttgtagtcgcactgggcgagaatgagggcagaaggctgccggcagaaatggaagggcccaaactcagctatattgcacaagttgtcgccggtttgtggtccaggagggcgaggcattagttcgggctttttatcgtcgacgctccagcgcaaagtgtgacgtggcctgcacctgcatcgctgctgcattcgcagacatcgcggacttcagggaagcgttgggcggcacacggcacacccgaggcgcacgcattcgtatattgagggaatggtgcaggcttcgctgctcgtcgatcctagactggacgacgtgcgggctgcgatcaccaaagcgcgtgcacaggtccgtcacaatcctgccaggctgtgatccgctgcatgcacagatgcgcgatgaatgaattgatactctcactcctgtcgcagctcgatgcactgcgctcccttgccaacgagctgctggacgtgctggctagcccaggcaaagatcgtcagacctccatcaagcagatcatttcgagaggcaatgagagcatctctagcctcaaacgtctcacgaagactctgagccctgcattggatgcttccagccgcgcgcctgacggaccggcatcggctagcctgctaggtattgggtgggtcgtggtggtgttctgagcggctatgactgtgacgcagggcagctcttcactccaccatccatgctgcccctgcagaacgggcctgggcactgcattcaggcgaggagctcaaggacgagcaggtcgaagaggaggtgcaccccgcaccagagtacccgtcccgcccgggcaagaatctgtcggaagtgttggacaacctgagagccctggcctacctcggcatccgtgccgacgcgctgtccgtcaccgggagtcactgcgagcctgatcaggccaggcgcgtccgcctctccatgcctggcacctttgtggccctgctgggcctccccacgccgggcggcacggccccgacctgggcgacaatcgttgggcacgaggaggctcagggcgccctccgacgcccctgggctggctctcggcacgccgtgttccgggccttcacccagctggcaaacggcacggtcttgcacgagcttcggacaggctcagcaggggttgcgcctgcggagacagcaattcccaccgccctagaaaccgtcgtcctctggctggccagctactcggtgagctnnnnnnnnnnaacacggtcttgcacgagcttgggacaggctcagcaggggttgcgcctgcagagtctgcaattcccaccgccctagaaaccgtcctcctctggctggccagctactcggtgagcttgggcagggacggtgggcttgtccgacaaccgccggcaacattcctgttcagagcacgcgagtgtgcccgcctcgcactgaatcgagtcccaatgcatcaccccgcacgcatgcaggatctcttcagccgccccgcgacctccacgaggcgcctgctgcagagggatgccgccagcggggccctcttgccccccctcctgcgcccacacacgctgagctggcacaggctgggcctggcggccatggatccctcccagcgcaccgccgagcacgcctctcagtcgctggccccaatgctcccagctgatggaggggcgtgaatgaggccaggccagccagacggcgacatgtggagctctggtctccaccatgaggcaacnnnnnnnnnnactcccagctgattgaggggcgtgaataaggccaggccagccagacggcgacacgtggagctctggtctccaccatgaggcaacatggtactagggagagcgcctggaggaatcagggctgcgcatgcgggcgatcctcaccctcctcgccgctctgcgagcccgcctctcctccgggtgctggcagccctgctccaggcaccagcaacccatcctctggcggccccactgcgcccagttgctcggtcccccccgaggaggatgcggccgtcccggaccagcgcaagaggcggctgcccccctggccggcgcggttgagcgagctccagcgcgccagctgcgcccgcagctcagtgaccaggccgtcggcgtcacccccggggccggccggatccagcaaccgcgtcaggccctctagggccgcagcggggttgccccccgtggcctggcccgcccgcaccgtggtccgcacgccctcgagccgggtctgcaggtcctgcagagcatcggtggcgagcagcagggccgccactgccgcctcaaactccgtggcagcgttgtggctggccaccgagcccagccctgcatgtgtgtgtacaggagggaggagatggcggagttggaacggtggctgcaaagacgatggcgcggcacttgtactgcacaaggtctagcacgccaggctccagaggtcctgcatcctgctcagaacgcagccctgcagtccctactccaccacgcgaatcgaccctcacgtgaccttcaaatccccatgcactctgtaagctctccacnnnnnnnnnnaccgccacgcgaatcgaccctcacgtgactttaaatccccatgcactctgtaagctctccacacaagcgcaccgctcccccctgcgcagccgggccgctcacccgcgcatgccgcctggcccagcgcggcgcgcagggcccccgccgtgaagccggcggcaccgcgcgccagcgccgcctcggcctcgttcaggtctgcgggcttcaaggcgggcaggccgtgggatcgcgccagctgcacctgcgcgttgtcgccggacagcaggaccacgggcatggaggcggggcggggcggcgcggcggccgcccccggcccccggatctcgttctggaagtagagcgccacctccacgatgcggtggtcggtgcgctgccccttggttgccacggcggtgctgcgtgagccggtgacctcggccccggcctccactagcaggccctcgccctcgtgggcgcccaaaaccgtgaggatgtccagccctgagcgcagggtgtcgtgggtgggacaggggtgaggtcagcgccgacaaggggctggggacggtcagcttgtgagggttgtcaaattcagcatgccagggccgcatgctgcgtaagggtgcagagcatgccggccacaggctagcaagccaggccgcaggtcggtggacgcccaccacacgccacgctccaagcgtacccgctgggccgtacgtgtccaggcccttggagaagaagcgacgcacggtgaggccgaagccggcatcgcccttgagcccatccagctgcttcaccaccgagtctgtcaccacgatgaacacctgtggaaagggggaatggttcaagaagcattgaaggcaatccgctttcaaactgaggtgctgggaatgaacgtcacccatgctcaggtgggtgttactgggagggggagtgccctccattctacctgactagattctcacaccctccatctattacaagctccccctgcctgcccacacccacctgctcattggagggcagggtgcgcccaaactggccccgctccgtcagctctgccagtcgctccagggtgagccagcagggcgggaccgcgctgcgcctggcgcccagcatggccagcagggccgaggtgtccgggaagaggaggagcgggccggaggaggcgtggtggggatggggcgacggcgacttgtccccagcgttgaggggtggggccgtggccgggacctcattcgcgttgccttccccgccccgcggcccctgccactgcagcttggcgctgcgtaggacggcggcctcggcggggagctcgaactggctgaccagccagggcagtcgcacgtggcaggggtggaccaggaagcgcaacttgttgcgcgacgggggatggccccttgagggtcggcgggggccgggccggccgccgcccgaggctgccaggtaggagggcatgtggggcagggcaggggtcgacccagggtcaagtccctcggggatgtccgccaggaggccccgctccgcatgctgtgcctccaggtactgcattggtggcgaaggtttgtgtgggactgagccatgcccttgcaaggcggtcgtgacccaccaacgactcccactctttgccaagctgggcgccggctcaatgagccagctgacacacaccacacccacctgcccgaggtcggtcagggagatgcgattccattccaggcgcagccacaggggcttggctgggggcggctgcgtgctctgcacgctgtccattagcgcccgggcccccaccattgtgagctggttgtgggataggtgtatctgcatttgcagggggaagaagggataaggcaggagagcaggatggtcagcagggtgtcacagctcattgaagctatggtttgggccgcagcgatggactgaaatgctcactcctcggcctgtcgtgggccggtgcgccctctgctgccagggccaggttggcatgtttccttgttacgcgtcgcagccctcccctgttcccaaacgtcccccatgcaatcccctgaccactctactcggctcacacaagccccgccccacctcctccaggccgagatgaaggatcccagccacggccaccgctcccctgtccccgcacttattgtcaaacagccacagcttccgcacagctgcccgcgagcggtgagccaggcaccaggccgccacgcaagcgacctcctcgtcccccagctccaggcgctccaggcggagcgagaggggcgtgggcggggcggggccggccgtcgcagcctcgccagcctcgctgggcgcacccctgagccacaggtccgcaagctccgcagccagggtctcggccgaccaggagcctgcgccctcgccgctccccgaggcttcggccacgtgggtctgcacagagcgcggcccggcgtccgactgccagacagacaggaagtcggccaggccctccaggaaggaggggagcaggaagggagcgtctgggtgaggcgtcacggtgaccagccccccggcatcctcctcccagaccacggcatgggcgcccctgccgtgcacggctgccgagtcggcgacgctgcgatgcagtggggagggggaaaagcgggccttgcgccccctcctcgacttgggcgtgctgtcacggtggtcagccgtggtcctggtggctgctggggtgtaggagctgcctggtggaggagcacgtgggggggtgggggcctccctgccagcccctcttccacgcccattcctgccactagtcccacgcccacgagccgccctcccctgtgtggcggtggtaaatactcagatggaggcatgaagagacgatgtgggcatggtgacaacaagataggatcgagcaccccgctcaccccaattcgtcctccatgtggagtggtgaccatggggtggggagccactgacattcgtcagcacaccgtcttcatcctctgcgtcttgatccccgtaaagctatggaactcatggttatacagttgtatggtgcagatcaagcaaaagcttccggctcgatggttcgaatgaacccctgcacagagagatctcgcgtctgggcgcggaatcatggacctgttctcagaactttagagttgggaagttgtcccagatctgggtcaccacatcacccatcgggttcggatcaaggtcnnnnnnnnnncaacccctgcaaagagagatctcgcgtcagggcgcggaatcatggacctgttctcaagacttaaaagttgggaagttgtcccagatctggggcatcacatcacccatcgggttcggatcaaggtcacataggtgtcttagatcccacaaggagctgcgcggcctctcgctgacaagcgtgtggtggtcgcgagacagtcgtcggaaggaggggcgttgggactggccatgcagtctctgcgcacctggttcggggggtcggctaccgatacagaacccccagcatcagttttggcagagtggaatgcgtacagcgccactcccagttcatcccgagccaccgaccggcttctcacctccgctgaagagggagcggcaggggtgaccaagttcgtgaccgaggcggtgggcgtcttcaacacccgcgtatctggagcagccagggatgtgactacgacagtccagagcgtccagttgtgagtctcgtgacaatgtggagtggagtgaggcgacgatattgagaacggcgttcacaccctgggtgtttgagtctcctcacacactatgctaccccacttcaaatgatgagatcagcttacacttctcgccagcctgctgctgggattcaggactactctcacaggagcctgtcgcacgcaccttaccacaacccatcgacccattccccgcagcataccgagcgccgctcaatggacatactttgcggtgtttgctggcacaggcgtcttgttcctgctggcgtcgctgttcgtcttcctccccctcatcatcctgtcgccctccaagttcgcgctcactttcagcctcggctcaggcctcatcctcgcctcgctgggggccctgaagggctggcgccagatggcggggcacatgacggcaaaggagcgcctgccattcactgctggtgtgctggagggacgcggtgtgcaggacgccctgcacgtcaagctctggaagcacaatcttgtgtttggggtggtcatgattgccgatgctgaagcacgctggggtgtggagtcgaggagccacgccctcacaactcaccccgggtgccacccaccctcacacagcatatctcgggagcctggtggggaccatctatgctgccgtggtcatgcacagctacgtcttttccatcatcttctgcgtgactcaggtgcaccgcgggccgtgggacatatgtcaaggtactgcgctgcggctcttgacgtgttgtgcaatgaccgctgtacccgacaactcaatactgagcctgctttccatgttgctccccgcacagatcatcaccttgctctactacctggcctcctacttccctggcggagccacgggggtgcagtaccttgtgggtgggatggggaagggggtgttctccctcggggccgcggcggcccgttctgcattttcgcgatgatccttacttgtgcacagtgtcaacttttcaaagagattgcattgccatcgcaaagccattcattcaaggaagggggtgggggtcgagcatggtcagcacaccgtcgagcaaagagtaaacaaggatgggcggcagctacaccttgcgcaggccggcaacagccttctccacctggggcacaaccacctgcgctatgcgaggccggccgaagcggacaatcagaatcccaatcttcagggtgtacgccatgagcccctcgaccttgccctccgacagggcgtagagggcgtcgtcctcctttcgtaggatgaagagctccgtgccgccgatggtcagggcctcgggcacagcgtccgctgtcatgactgcctggagctctttcgctgcgtctgtggcttctccattcccagacgcatccaggagcagatcctgggcatttccaaaggcacactggaccgtcccattgacctggatcagtccgtagcccaagatcacgtcttctatcaacaagctgcgaagcccatcgtcccagctctcagcagccattctgtattgtggagagatcttttggtcgatgccatggacctccagatgcatggcacaagatgtctttttattgggtatggttgggtttcaccctacgtggcagggaaccaagcgcgcgcaacctccttcgaaatttgctctcgatgctgctcacgaccacagcttcccgtctgtttcgtgcaactccacatcatagcgcagacagaaatctgatgcgcgatagtttagtggttctttgattgtaaagataaatcctatcggggcccccctccaaaccctgaccttcacaatctgtacagccgaagatgtctcactgccgtgccctgccaacgcactgcagagccgcgcaattttctccgcagtcctgcgcatccagacattcatcagtcaagagtattagtctgaggtctgtggccctgcgttcgtcttcgagggtagcacctcgacggtcacacgcgttccgtgttcaagcaaatgaactgaatcgctggtaaggcgtgatgcagtgcgaccatgtcatccccatgtaactgtatcatgtgcctctaaagcgactcatatgaggtactcggcccacctcgnnnnnnnnnnccgtccccatgtatctgtatcatgtgcctctaaaccgactcatatgaggtactcggcccacctcggacctccagggcggacaagggtgggatggacgacgattgtgcgcacgactacttcgacaggtgagggttctgagcacgggggagcagtgtggcacctggacgcgcacatctctttgccatgctgctgtctgggacgtgtttggggggtcgttggtccagaatccgtcatcctgcatggcatacggtaggnnnnnnnnnnttggcacctggacgcgcacatccctttgccatgctgctgtctgggacgtgtgtggggggtcgttggtctaaaatccgtcatcctgcatggcatacggtagggtctcactgccatcacatggtgcaggaccacggcggcggtcgtaatgcgggtactcacagcccaggcaaccaagcgtgtgctgcatcagctgcaggagtctgacctcatcatcgcacagtggctcaaccacttttgcgcagagcaccctcccctggatggcaataaggtgagggctttggtgtgggcagggaggtggctgtgtctggggcggcagcagggtgggacctgccagggtccttgttattcaaccaggcgtgcaccagccagcccatttgccccttgcccccggtgatctgcccttgtcgggggggccccgggctggtggccacaatccatttgctgattcagaagttttgactgttcacacggtgcccatgtgttactctggtcttaccaccatctgaacccctgcccnnnnnnnnnntcggtgatctgcccttgttggtggggcctcatgccggtggccacaatccaagtgctgattcagaagttttgaccgttcacacggtgcccatgtgttaccctggtcttaccaccatctgaacccctgcccgcagttcattctgtcgctgctgtccatgaagggcaccactgtggatgaggcggcatttggggtgactcaccacatcaacccccagaacatagcccaccgcatactcatggtgagcggcatggactctgggcgtgggatgtcatgcggcatgcaagctccccccggccctgccaggccaaaaccgccttgggtttgtcattgcattcaccctcgccacaccgccggttcacccccccaccccacccgcccctcccccagacccgtgaggacatggctctcaacatggcacagggcctgtcaaagtatgccacccaggagaatggcatggtgctgcggcggcacttggagaacacgacgtacttgagcggcgggcacgacaccgcctacaagagccgccgggggtaccaccggccccgcccctgaatggggcagagccagcagtctgacggatcccctgccgtgcagtgagtgatctcggtcctgggacagcacctgccctgtcccgccacgcccccgttccctgacgcaggggagcaggtggcccctgcaggccctgcgccgcccgtgcccggctagcctcgacgccgagctctgtaccattgtcgctgtgtctgcgcttagatgtttgcttaggcccgaaactctgcagcaccccacctgtgtaccctccccttgacgagacgatcatgcctgatacgaattcagaccccgtaataagcctgcctgccgcgccgctccccaggctactcacactgctattcccccgtgtacctgtcacgccccccccacccatacgcctcagccgatcgcccctttaatgtaacacaatcacacttgaaggggttggaggcctgggtgcccatcgcagagcttgtgacgtgtgtgctgggatgcatgccactgccagctcaagtcctcaaagccccactgcgtaggatcggccgtttgggttgtggatggctcccctcagggtgccgcaggacaccgaccattcgtaccagaccttgtggttgccgtcgcacctccacatgtccaccctgatctcagaccctgtggagcacagtacaggcagtgagggcagattggcacagcgatcgccgatgccacagggcacatccgatgcatcggacccctgccgcatccaccccccctgccgccacccaccctgcgacacgacaaatggctccttgatggggaagtagatggggaaccagctgaacatcttcggcgtgtgtgtggagggccggatgctgaggtggacatccttgtatagcttcgcgtcaaagtatccagccagcccgtgacacactgcggggatggatgggggaggggggaagctggggcacaagcatgctctgagccccgattgacctgcatgtctgagcccccgactcagactgcataagggtgcatgcttcgcaacaccccgagtgcttaggcctgcttttgactttgcttgcgcatcccgcacagcaaattcagtccagggccccgcttgtcaggagcccttttgctcctcgcgatctcacctgttgtgccgggtggggcagccnnnnnnnnnngtgcacgtctgagcccccgactcagcctgcataaggatgtatgcttcacaacaccccgagtgcttaggcctgcttttgaccttacttgcgaatcctgcccagcaaattcagtccagggccccgcttctcaggagcccttttggtcctggcaatctcacctgttgtgccgggtggggcagccttgaacacgaggctgatgctgcgcctgttgtctggcggctgctgtcccggatgctcgaatgtgaagaccgcctgcgtgaagaggggaacaggttaggccggaacagcacaaccttgactctactgaggagtgcagcggggtaagcaaagacacaaatgggtgagacgtgatgcagcaggagtgggtggcctgacagcctggtgtcaggccccaaacactcaggcatcttgcctgaggctctgccagcgtatggaatcggtggaactttacgacaaacggcgtctcgaagtgctctgtgtctcggtaggcctgcgtcaaaaaatgagaggaaggggtgaatagatcgtctaaccgcaaggccaccagtagagacacacgcagcggccaggtcagccatgcaccctgacggcccagtctgcggagctgtgaatccccatctgggacagatggtccacaagatcattaaaatctcaaggcagccctgttgccctgcaggtgtacgactgccaannnnnnnnnncccctgacggcccagtctgcggagctgagaatccccatgtgggacagatggtccacaagatcattgaaatctcaaggcagtcctgttgccctgcaggtgtacgactgccaaacagaagacatgcctcaccgcaacatcagtccacagcttgtgggtggtgaccgggtggagaaaggaggtgtaggagctggggatggagatgccgcctggcttcaggaagcgcatggcaccgtccaggcactctggcgacagctcgttgtcgccaaaggagcccagtagctcgctgacgaggatgtcagccggctcggacgcctgccactcccgcatgtctgccgggacgagggtcaccttgccctgccatctggggtggacaaagggtatggtgtgagaaagctcgctgaggctgctcgacgtcggcattggcaagctgggtgagcaatacttgggtatgttggaaggaataatgaatctttcgagcgctgaagcaagcaaatgatgcagagtcagagatgagtgtgcactttcctgacagtggctccgagcggctttgagcaggccaggtgctctatccctgtgcatgaccccatgtcagtccccccacatcccatcccgccgcactctgtttcgactctgtggctcagggtgacgatggcgttggggtttttctccacggcatacatacgcacggcacgctttgcacgctgcgccgcagccaggcacgctgccacgatgggtccgcgcccggctcccaccaccatcacaacctgggagggcgagacacgcacgtgcgtcaatctgtgcactcgaagataggccctcagcggccgggctcgccaggctgaagtgcagcggccacccacttccatgcccctcttgacccctgtgtttcatctgtgcactcaccgtggcagtgccctcctcactccctgctggcactcggtctaggagcgcacaatacacagcttcctcgtaggtgttgtacttggtggcatcccgctcgaacacctcatacgtctggctctccaggttgtcctgcagcggctgcagtggagactgcagccaggaagcagtgaagggaagatacactttgagtggtggagtgccaccatggacctgccagtttgcacaccctgagcagattccggggaagcaagggggattcgtgtgcatgagtggagctcatgggtggggcacagccccttggctgaggcccgcacaccatatgcattcctcctacttggaggaagtcgcggtacgccagctctgcaggctgctgctcagctgctatttcccccttcctgaacaggaaggacaggtactcccagtatggccgcagtgggttgctgggaagcttcaagccagcatcagattcatcgcctcccgggggcgtatggcggggggcacctcgcagcacgacctgttgggagcagtgggaggcatgctgtgcgcctgcatgtgactgcagtggcctggccttgaggggagccaggcgcagcacacccttggctgggaatgttcacccaaaaaccccacctgcacccccagcttgagcatggatgtnnnnnnnnnnagccaggcgcagcacacccttggccggaatgttcacccaacaatctcacctgcacccccagcttgagcatggatgtgaggaaggcctgatgcttcttgggcagcacagggtacccacgcttgttggtggtgaaagcgtgtgtaggcacgacgattgccctgcaatagtgatggggaaaggggtgagcacccaggccctcacgtttctgttataccccaggcaggcaggccggggcggctgagcaactcgcattgtccggcctgctacttacagccccgacaccatcgcaccaaacaccggcccctgcagccaggtgtgaagagcgggacccttcatcccctgccatccctgcaccctgtcacattcccaagacctgtccctcgaaaatcccactgccggaagaaaagcctcacttgacgttctccccgctccatctgcccaggctggcttccgacggcagctgcgcccccacttccagtacggcccccagtcgggtgctgtgggcgcagnnnnnnnnnngccaggctggcttccgacggcagctgtgcccccacctccagcacggcccccagtcgggtgctgtgggcgcaggcaaagcggagagtgttccactcctcccacgcgtcctcgggcccacccagcctgaccctgacccagagggccatgcccgtcagggtgagcagggcctggttcaggatgcgggcctggttggggcccccagcccctggcaggatgcaggcctgcagggacaggtgggccgcccagtgcagctcctggcgcagggcagcctcgctctgggagcgcagggcggtatcctgaggcgcgtcggggttgatccaggggctcgtgctgcccaccacctgcccgctccattggctggccgtgaggaggaggtcggagcgcgtgaaggcaccggggtagtctggacctcttcggaaccggggatgcaccaggggggccaggacaaagtcgaagccgcagagcagcgagcgctgcatggtgggaggtgcagtacggctgcgttcttgggctccggggtattacgacgggaggcgtcctccagggcaagcgtatacggggcacctttcagcaagtgcctaagatcctccccgaatctaccatcggatcgttcctgcccacctgcagcgtgtcgactatgtcgcatgcaaaggccacttccacgccgcagaatcgggcatcgccgcaatcggtgcgacttcccagcggcatgctgggctggttgatatgtcaatcctccacttatcaacacctccttgaggagtcaagcctattgtagaggctgagcaggcctgtccataatggacttnnnnnnnnnncttcagcaagtgccgaagatactccccgaatctaccatcgaatcgttcctgcccacctgcagcgtgtcgacnnnnnnnnnntctggttgatatgttaatcctccacttatcaacacctccttgagggatcaagcctattgtaaaggctgagcaggcctgtccataatggacttcgcgccttggccggaccccacgtgggaaattcgaccgccatgggtcaggtccatgcgagagcatgtcgtggacgccctcacacacgagcacatgctgtgatttcagatagtaaatgatttttctatccgctcagtctagcgatgcatgagtgtcttgatcaccagatcgtttagccacccgtcgactcgaccgaaccggcagtcacaccgatcgagagctctccgatgccacgctcatgccggagccgatacatccaaaaggatttttgacatggttaaggctcatctgacttcagtaatgcaggcatgaggtcaaagtgatcgacgaccggacgtttaccttcacgaccggaagctggctaggggacacgccatgaccggtgaggaatgcgaggttttgccagacaggaggctactctgccaattgaatttacatgctgaggtaccatggtggtgcagaccaaaggatcgcggcccgacccaaagggacttggggccccagcgacgattctcgactgatgcagtgagtgtgggtcaaaatccgtcccttgatgcctgggacacggtgacggcgggggcgacacccgggtttccaaattgggatttaaccgggagaccacagggaggtcgtgggagtgtgcatcgccagaagactgggagtcctgaaagggagtctatcatttggtgaacactccctcacagtcctgcaccacttatgtaccatgccttcccaccagccgaccctgaacgcatcactcccgctgcgcaggctggttcaggcacacggcgagggctcctggtccaccatcgcccgcgccttcgagggtcggaccgggaagcagtgccgcgaacggtgggccaaccacctgcgccccaacatccggcgcggggcctggcgggaggaggaggagctgcgctttgtggactgccaccgcacggtgggcaaccgctgggccgacatcgccaagcgcatccccgggcgcacggagaacgcggtgaagaaccactggaacgccaccctgcgccggaagccgtgcagtgcccccggcgggcgggacaccctactcaagcgctacatggtggagcaggggctgtgccccggtccccccgccctgccgccagactccgggcgaagcaagagatcacggcggcacgtgcgccagggggcacccccagggctggccgatgcgggccccggcgccgcccgcctgtgtcggcccctggaccctggggccttgccctccccagagcccatggtgtccacaacccacccgcccctgccgacgcgtgggtcgggcctcatcactcgcagcatnnnnnnnnnnaggccccggcgccgcccgcccgcgtcggcccctggaccctggggccctgccctccccagagcccatgatgtccacaacccacccgcccctgccgatgcgtgggtcgggcctcatcactcgcagcatggcctggagggaggggcaggcgggggtccaccctgggcccgtctccccatgcaggcgcaagccaccgccgcagccgccgttctgcacgcccgccggcgcgggtggtggtgccgcgcccatgctcgacggggtccagcgccccaccccatccacccccgacctggagttggatgggatcctggagtggctgggttccagcagggccaccacgccgtctgtccgctctgtggtgcgtgcgaggggtggaggatacttggattcggaaaggcaatccttctgccacttgcccccgtgcttggtcaggcgcggtccccatctcatccaaacaaaactcaagccagtcctggcccacttgctgtctgtccatagggctgcacaaccgggcagagcattgggtcgctgccgcaggatggcgctgacgactccttccttacgcccaccgtctccctcctgctgccggcgggcctcttgtcccctacggaaagaggcaggctgggccccggaccgctcagtccacccagcaggccgtcccgggcctaatgcagaccactgcgagagaacaggatgacagtccacggtcatccaggagtcagcaaggacagccatgggaccaagccctgatccaggactgaagccaacttccagcagcatcctgtctctgatttggatgcccgaacgctgtctctcccagggacaagggaaccctcgcggcctcgaatccggctcagagctcaagagggcagctgccccatgcgcagaagccggcaggccagagcttggtgtcgttgcttcattggcctggagttgcaatgtctgtgctgcacagagtacggggcgactctgctccctaggcaatatcctcctctgctaccaaaccctgaaatccagtgtcccacgaggcaccagggtcatcctgggcccgatgagtgaaggactacaaggggtcatgatccaggtgaaactgcagagagatagattacatgcggatcacattccctgtcgtagtgggatgagagggaagaccccagaagagatgaaagtggtagtcggagccagctggaagaaagagacggcatggcctcaggcagcgtcaatctccctagggtgttggcaatggccggactgcaggcacatcgtgtgcaggagcttaagcctcacaagaaaataactggcaaggcccaccaagggattgcaccgcctatcgatgagagcactaagttgctgccacggttaccggcccttcttgctcctccccgccacgccctcnnnnnnnnnngagaaaataactgccccggcccaccaaggaattgcaccgcctattgatgagagcgttaagttgctgccacggttaccagcccttcttgctcctccccgccacgccctccagcaccggtccccagcagcctcctgctggccctggccagggcctctttgagcagctgccaggccaggttgaagagcacccgcggcaccagcaggacacgggatggggctgccagatgcgccaccgccaggaccaggccatagatccgcgcgtcgcgctgcgccacccgcgccaggcagtcgagcgtggcggtgagggaggcgggggggcggcgcgcgccggggccgctcaccgtggtcgtggggtacctgggatgatccaggtggggtttgtgggcgggtgagtgtgggagagggggggtcattcctgcgctctagaccccagctcctgccgtgcggcagtgaatggccagccatacacaaagaattctgggtccagggcagggagtcaacacagctaaacccaaacccttcaacctgaggtccgtgccggcggcaagcgcccaggccggctccaggacatcggtcgccagagctcgctgaaatgcctggccagacaggccggccagcctgtggcgtcgtgctggcaggtcgcgggcgccggccagcgcctctgtcagctgccggcggaggaggagggccgtctgtgcagccacagtcatgccctgggagatggagagtatcgagaagttgcggggttgcccaatctgagaccgtggtttcttctggctgaaaagcaaggggacactgcagcaaggcgtggcatgcacacaactacgtggccccgctgttgccctacactcaggcacatgagcatgccagccgctcacctgtccatacacggggttcaggccctgcaccgcatcccctaccaccagcaggccccggggcagggggcacaggtcatagcagcgccggatgtttggccagcctccgtaattgttcactgcgcatgtggcaggcagggaggcagcgagaagaggtgggccaaagactttggttggccttcttggaggcacgcaagcctgggcggtagcgtagccgcatctcctggcttccacggatcaagtatccactttcccttccaaacaactagcatgggctcaccgggggtgaggggcttgcagcgctgcagcacagagtgcatggtggggtcgggcagctgctttgcggcttccagtaccccctcccatgtgcacggcgcccgcgtccctcccaactctgccagggttaattgccaggctcgaccctcgatgggcagcagcaccccgcctcgttttccgtgcggctgggtcttgcatatgtacagcgagaatgcctgggccgggagaggtggggaggggaggcatggccgggaggtcgatgttggatggcggagtttgctgggnnnnnnnnnntgcgagaatcactttccacgctcaacataagccgcaggtgcccaagcagaaccttgcacacagctccctgctgatgactggcattccctgataattcctcgcttcccacacaccctcaccttgtggcagtcccagtcttcnnnnnnnnnntttctgatgactggcattccctgataattccttgcttcccacgcaccctcaccttgtggcagtcccagtcttccggccatgacactgtcagactggcggcgaccaccttggcaagcaccctgcgctcgggagggggggcccaccccttctccgccagccactcaggcagggaggagcggcgcccactcgcctccacgacaaggtctgcccccagttgactcccgtctccacagtgaatgcctgggtaggtgaggccgagcggacgcagtgaggtgattgacggtgtccctgacaagcctccgtgactgtcagaacatcatgccaacacatcaccctgaatcagcttatgtgcagcggataacaacccctgccaactcaccgacgactgtctgatggtttgcatcccacgcaaggccagtgaccatcgttcggggaatgannnnnnnnnntgacaacagcttgcaagatgtacgttgatctgaagacagacttgataccttcagtccagacacgtaacgcgggaagaggccaccatagtcatggtatgcgnnnnnnnnnncgcaaaggcgtttccctcctgtgctgaggaggtacgcatacagctcctcctccagcaggcggcgagacacccccagcccctgggcattgtagagaaggcatgaaggtgtgagcggcatggtaaggtctccactgggactgccgggcgctcgagaagatttagagctcaaagcaacacatggattttaagagacactgcaagctaccgtccagannnnnnnnnnaaaggtctccactgggactgccgggtgctcgagaagaattagagctcaaagcaacacatggagtttaagagacactgcaagctaccgtccagatgtttcgagcggacaatagcttgcaagatgtacgttgctttaaagacggacttgataccttcagtccagacacgcaacgtgggaagaggccaccatagtcatggtatgcgacgtcctttccaagatccaactccaaagcgccccttgcaagcagctgtgcaatgagtttgtagaaggctcagaggcattgtagctgcactctcatgtatgaatgtacgagcatctcgttctgtatgcctccaggcatgtgcaaccacagcgtcagctacactacctgctgcctgcagccgggcatgagttcctccatggccatgactccacccacaaggaaattgtggggctgattgatttgaggtactccagaccttctattcgatgtctggaatcggagaccgtaggcttacattaccgcctagtcgatgtgtttctccattagacagtcaagaccggtgtcaagccctgggctgtcacataaacgcagattagtcatgcatgaccaactcacctcctcccagctttcgnnnnnnnnnnggacagtcaagactggtgtcaagcctaggctgtcacataaacgcagattagtcatacatgaccaactcacctcctcccagctttcgcttgccacggtggcccgcagagggtcattgcgttcaaccaaagtgacgcggtcgaaggtatctaggagggcttgagcggcaaacaggcccatcacccctccacccaccacgatggcatgcagtccttgttggtctgacgtcggggcgcgactggtgacaaatgctgctcccttgccgaccaaagatttgcatgaggccctagcaaacgaggtaaggccattatataatatcgagcgcgtttgggtcccacattgccgcgcaggtgtctggcgcgaggccatcttgggtgcaacgtgggtgatgggtaccannnnnnnnnngttgtcgcgcaagcgtctggcgcgaggccgtcttgggtgcaacgtgggtgatgggtaccagacccggctggcaccgcgacgactggcagttgacggccatggcagccatcggcatgtgcaagtgttatggtatggttgcgagaatgactctgaccactccagtgcccagcatcaattgaaagagtgacgtcgctcttgcgactcctggacttcgaggggccagcaactctcgtgacatgctgtgcatnnnnnnnnnnaaccactccagtgactagcatcaattgaaagaatgacatcgctcttccgactgctggtcttcgagtggccagcaactctcgtgacatgctgtgcatgcccggaccgaaatcgccatgcgagggataaggcgcgcgcggaaaacaaagtccttgtatagttttagcatggaaagagaaacacagcataccagaaagatatttgaagcatacttccgccattcccgtaatctctaaaaggtcccgccccgtcggccgaggttgcatattagaccgtgagcaactggagttcacagagcaagtgccctgttcagctcagcaagccaccactgcttgaggtcctgttgcgggatggcgaattgaagtttctgtgaaatgagtttatggagcgccagcagcatgcagcaagctagcgcgcccctaagctcgagcagcggtagatgttggcagcgagtgtcgtccccacccttcacccagcggctaccacggcatacctgcagaagatgcacgcccagcgtggtaagcaaaacacatggttgctgaagcgtctgttgtcctcgactccagagtttcttcatctcacggcttacccccatgtttcatgcattaggcccggcatgcaatcaagcaacgtccgctccagacctctaccagcctggaggtcctccaggctctgagcgacgacgactgggaagaggacgatgaggacgttgatgcagcagattttgacctccctgaatcctcatccttccctaccaagcgcctgccggcagaggtccgatgctttgacaccgctaccatcatggtggcggggggcacgggtggccggggctgcgtcgcctttaggcgcgagaagttcgttccgcgcgggggcccctcgggcgggaatgggggcaaggggggcgatgtttacctcgtgggggacgcctcgcaaaattccctgctctccttccggcgctcggtgcacttcaggtgggcatggggtgggggggtggaagcgaatgacgtaaggaaaggtcggctacagctgtctcgcctgaccatcagcttcctcaggagcacccatctcatgggctgcatgccacctggccctcgcttggtatggacttgtctcccaggatgctccgctgttcatgattctatcagcccctcagccccttaccctcccaccctcccatcctcctcaccgtgcagggcggagcatggggagcccggccagggctctgacatgcatggccaggggggcaaggacatctcggtctccgtcccccccggcaccgtggtgtgggcccgggatgccgctgcgggggaccccccccttggcgaggtgctggcgccaggtcagcgcgtgctcatcgcccggggaggaaaaggcgggcggggaaacctggcctttaagaccgcaaggaataccgcgccagccttggcggagcacggggagcggggacagggtgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatcccccccacaccttggatgtcgcagcaccccctccctcgctccggctagcttgttgtcaaccccccatctaacccccgattcctcctcgctctcgctcagagacgtggctgaggctggagatgcagctggtggcggacgccggcatcatcggcgcacccaatgcgggcaagtccacgctgctgcgggtgctcagcgcggcccggcccaaggtggccgactaccccttcaccaccctgacgcccaatctcggtgtctgcggcatggacggcaggagcaccgtgtttgcaggtggggcctgtcgatgggaacgtgtcatgcttgggctgtcagtattaccaggctgtgtccttgctcggtacctttccattttaccatcccatcgcacattccccccccgccccgccccctccctccttctcgacccacccactgatccgcccaccaccaaacacacacagacgtgccggggctggtggagggcgcgcacgcgggcacgggcctcggccacgagttcctgcgccactgccgccgctgctcggtgctggtccacgtcgtcgacggctccggccccgacccctgcgccgacttcctggccgtgcgccgcgagctggagctgtttgaccccggcctggcggccaagcccttcgtgctggcctacaacaagatggacacgcccgcctcctccgattactggcccgacgtgcgcgcgacgttgtgcgaggagcacggcctggccgacgaggacgtcctggccgtctcggcggcggcggggacgggggtgcccgccctggtccgccgcgtgcgccgcctgctggatggcgcaggggcttcggggagctgggaggagccgggggaggttcggcccgaccgcaccggcccccgtgccgacggctggggctggaacgtcgccggggcgggggccgcggggccggcggcgaccccgctccgccccggcgccgacgccaccgtcgagccggaggtcgtggcgctggcgccgcnnnnnnnnnntggctggggctggaacgtcgccggggcgggagccgcgggtccggccgcgaccccgctccgcccgggcgccgacgccactctcgagccggaggtcgtggcgctggcgccgccgcccgcggcggtcaacaccgcgcgcctcagcgacttctccatcagctccgacctggcgggtccgcgcacctggtatgtcagcggcgaggcgctggagcgcttcgcgcagatgaccgactggtcctactttgaggccgcggcgcgcttccagggcgtgctcaaggccgcgggcgtggaggcggccctggtcagggccggggtcaggccgggggacacggtggtggtgggcgaggtggagttcaactacagcgaggaccagggcaagggggcgctgtacggggcctggatcgaggcgcgcaaggaggctggcgtcgtggggcgggggtccgcgcgatggccgcacaccactgggtgacggcgggggcatggatgcttgcatccgcccttcctcaaccccatgctgcgccggccagggtttccatggtcctggcccgaccacccctgcgccgctccctgcatccgctcgaacgcggtgcacctgcttgtagcaatgttcttggtcggttgtacacccgctggagcagtcacctcaggctgagaacagcgcccatcatagaacgcaggtggcatcagaagttgagcaggatggcgtccacgccccgctccttcagcagcgccgtcagttccacggtcatctccttttgcccgcacaggacagcggcggtgccgccagagctgtttgggtccacattctcgtccttgatgaggagagggggtgtttaacgatggcatgaagggcattgtacaagatctgcgtacacagaaccaaatcatccaggccaccccgactccaggcctgcgaccattcacgtccgtccgcctgccgcccagnnnnnnnnnnggggggggggggcgatggcatgaagggcatcgtacaagatctgcgtacacagaaccagatcatccaggtcaccccgactccaggcctgcaaccattcacgtccgtccgcctgccgcccagcaagccccctggccactcctctcaccgctcaccctggcaaaggcatcctgcacgtagccgtcggaggaggaggagaagacggggagcacggtgacnnnnnnnnnngccgctcacccgggcaaaggcatcctgcacgtagccgtcgtcggaggaggagaagacggggagcacggtgacgccgtgctcgctgctccaggcctcgatgctctgggcaaaggccatgtgctcgggagtgcgcgtcccgtagtacagccggacactcctccggccggccagcgcccccgactctatgagcgccttgatgggggagatgcctgggtggagggggtgatgcacgggagggtgagcgggggtccacggccgtggctggcaggggacaccgggtggatctggcagccagggctgcgctgcggtcccatgcatgctggaccagccagctcctgccgggctgagggctgcacaatgcataccaagggcacctcacacaggagtactcccccacctgatcccgtggcaaagagcaggatcgatgggtactgctccactgggatggtgtcgatccggaagcccttgcccatgggcttgctcaccaggacctcctcgcctgtgggaggaaagcaaggaaaggggggttgatcaggatcaaacaggtgggctcccactccagtctaaaacgcccgctcctgcagagagtctgccgtgcctgggcgcatgtgggaatggcaccagtctccacagccccgtacccggtttcaaggcgcacagctcctcggcagtcgcgcccgaggccttcagcaggagctccaggcgccccgaatccagatccggcggggaggcgatggcgaagaagccggccttgtcctccgcccggcgcttggcctgcacaaactgccccggtgtagagtactctgccgccagcttgcccacttcaatgaccagcctgtgttgctgcgagcgtggaatggaggggcagaagggtttgcagccagcggagctgtaaatgatgtctagaggaattcccagtcgcacatgcaggcttgcacgcacaccattccaatcttcccagccaactaccttcagtgcttcctccttgttgctcgtgaccttggcgggatggaactcgacatctgccccccaggcagcacgaacgaggccgctcctgcccggcctaagtctcagcacggggatcccgggtgttctgagggggagggcggcggtggaggcttggagtcgccaagacatatgccaaaaactatgccaggcagagtcgcaccccgcagcgcacctggcattctgagggttgagaacggaactgaattttgaacttgctaaggatgccggcgtggccgcgaagggacgcagtgagcggaatgcctggacaccgtgtcggcaggactgggaagtgtgcacacaactgaacaccaggggcagagcgagcaccatccgatcgctctctatatgcaaccaatggtaattttggataaaggggtttgcgatcttccagtcgatgagtatcatggtgagagttgcatgatgcttcatccagcttggatcactctctggtgggtagcgcgcgcaggcgggaaccaatcacccagcacccctggtttggaaccaaaaggagtccagcgaggagcgattcaggtgtccaacggcagtgaatattagagatcagctgtgtgttttgagagagcattacatactcacggtcagaagttaaagatcgtgtctcattggtaacagggtgaggcacggtcaactcgcggttgccaacacccttgaatacatatacttactgcctgatcttggaaagcttgattggtatggcggagacatcgacatccggagcgtcactccccgagctggtacccaaagcctccttcatcgaggatgtcagtgaataccttcaaggtctgtgcgcctagtatgcaagcaacacgacacaccatcaatttttcatctcatgcaaagatgaaataaccttgtgacgcgactcatttgccgtccccaccacaggtgcatcagtcgatgatgcattgaatgagctgcggggggcccaccaaaagtacaagtacatcgagcaggagattgtgcagcggaagcagcgtctagcatttaagcaaccagagatcgagaagtgcctggctagcgtcaagctgctggccgctcaaaaggaagagggaacagaggtgtgcggtggggttggtggtgggtatttaggtcgagtgggcttggcggggaggtcgagtgggcttggcgggtaggtcgagtgggcttggcggggaggtcgagtgggcttggcgggtaggtcgagtgggcttggcgggtaggtcgagtgggcttggcggggaagcccatggttgcgctgggacccctgcctggcatccacataccaggacactctctgaatggagtgaggaacatgttgccctgtgatacaatggcattgccagcattgccgggcatgcctcaacccctggccatgactgatgggtacattcggtgcgccccattactacttgaatcgcaggcggtgctggactttgcgctgtccgaccaggtatttgccaaggcgcggctggcgaatgtggaggcggtgaacctgtggctgggagcaggcgtcatgctggagtactcgctgccagacgcgcagcagctcctggtgaggccgggcgcaggcgtgcggcatggagttgcctgagttatgctctgcgtcgaggttagattgtctgagcggatccggaacagggactgcactcgcgtcctacactcagccgccgcctgtgctaccccatactgcactgccaggagacgcagctggcggggggcagccgccagttgagcattgtccaggaggagcatgactacatcaaggaccagatcaccaccacagaggtcagtgcgtgtcgtgaggtgggctggggcactgtggtccagggaggcccatgtgcccgctgctgacgtcattgtgccagacgactcggatcagtggcctcgggagacgcaatgcacgccgccccacaggtgtccatggcacgagtgtacaactacggcgtctcccagcgacggacggcgtctgcttgaatggcctgcatcaatggcgcttgcaaacccacttgtaagaacagccctgagcccttgctgtccgaggggttggcgttgggtggcagggagtcagttcagcctgggcaaagagacgagaaggcaccctccttcatgatatcctcagtcaacagtgatctctcacagccgccatgggcggcgcagttcgcggttttggacacatcaacggtgctgggactcggacagactcggggcagtggggcgcggcacggcgcccgccgccgtgccgcgcccaggcgctcaggccgccaggttcatctcccagacgcggaggtggtcggggatctgggtgctgcgccgcgtgatgatgaggccgcagcaggcccagccgcgcggcgccccctgccgcgccagcagcatgtccgcctccagctcgctcatctttgccgcggtctcctcggcctggcaaggggtgaggcaagtgtgtgttttcatgtctgtgtacgggggggtcaagccttgctcagtgagtgaagcggcaatctgaatccttcaaggcacacaccgccatctggaccacatcgaccagtcactgcgcggaccggcggcgtccatgggccctccccccggccccacgccgtccccccctcacccccaaatccaaaccaaatcaaccccacctgctctgggctcatcccgaggagcnnnnnnnnnnagagggtcaagccttgctcattgagtgaagcggcaatctggatccttcaaggcacgcaccgccatctgaaccacatcgaccagtcactgcgcggagcggcggcgtccatggtccccccccccagccccacgccgtccccccctcacccccgaatccaaagcaaatcaagcccacctgctctgggctcatcccgaggagctgcggctccgcggccgtgccgggcgaggcgaggggcaccacggaggagatgccgcgcccctcgcagaactccaccagcttgtgcgccagctgctgctggatcgccggccccgcccgcgccgcgcgctcgtgtgcggcgctgggacgcggcgagggacctcgtaccggcgtgctgtgcccgccctccgacagcgcgccccccagccgcgagtcggaggacagcgacttggcgtggtgcgccgcggtgcgcagcgcgggcagcggctccccgccggccagcggcggcagccccgcggcgggggccgccggggccg

SEQ ID NO: 45550 - DNA, 114 bp, Chlorella protothecoides
atgcacgttgctcggccgtgcatgtgcagagcgccgcgacaaggagaatgtgtcggatcatacgacgctccagcgcccccttccaagcactcacaatcgtccaggaaggcgtcc

SEQ ID NO: 45551 - DNA, 61 bp, Chlorella protothecoides
tctgcatgccaatattaagtgtagtgctgacatgagaccctgcctgagtgaaccgtgtcgg

SEQ ID NO: 45552 - DNA, 61 bp, Chlorella protothecoides
gtggtgaatcgacaggcgagggcggaggggatggtgaatcgacaggcgagggcggaggggg

SEQ ID NO: 45553 - DNA, 71 bp, Chlorella protothecoides
cccctgccggtggacacctagcaatgccaaaggtgcgccgcctggatgccagcaactgtgatgcatatgct

SEQ ID NO: 45554 - DNA, 61 bp, Chlorella protothecoides
tgcttgcggtgcaccatgcctgagggggggtgagtttggggtaatgtggtctgtaccagca

SEQ ID NO: 45555 - DNA, 61 bp, Chlorella protothecoides
agctcctggaggatatccggatggacagggtggaggaggtcaagttcttccagatgggccg

SEQ ID NO: 45556 - DNA, 61 bp, Chlorella protothecoides
agagaggtgctgtggagtagcggcttgcttatttcattggcataagacagttgcatatctg

SEQ ID NO: 45557 - DNA, 67 bp, Chlorella protothecoides
gcaagccctccaaccccagcagcagcccgtccccccattccaggccctgacaatccgtctgaccccc

SEQ ID NO: 45558 - DNA, 61 bp, Chlorella protothecoides
cttggtcttgatgtataggagtgagtgggcgagtgacagattggaagcccacatgcgggga

SEQ ID NO: 45559 - DNA, 81 bp, Chlorella protothecoides
gcacgccagccgtgcccctttcctccaggtatcgccagtgtcgcccttcgtggaccagctccacctcagctgggcctcgcc

SEQ ID NO: 45560 - DNA, 62 bp, Chlorella protothecoides
gggggcctggggttgcatgatctgacgagctggaggcgcttcgccatcccagggccgccggg

SEQ ID NO: 45561 - DNA, 61 bp, Chlorella protothecoides
acacctctttctggtcgccactggctagagtgcccacctgtcaccctcattgccctcctca

SEQ ID NO: 45562 - DNA, 127 bp, Chlorella protothecoides
gaactatgtgaatgcaattcgtaggggctaagcactcgctcgaagggcactggagcccttatcctagtcctctggtctcataccgatcctgcactcagacatatgcctgtaatagcgaagctcataa

SEQ ID NO: 45563 - DNA, 104 bp, Chlorella protothecoides
gatgcaagtttagaaatcgaatggacactctgatcaggaacaccgcttccataaccaaagtatatgagtgcatgtcttttcgccctccccgctcagatgatggt

SEQ ID NO: 45564 - DNA, 72 bp, Chlorella protothecoides
cacgagtcgaatgtgcattctccaacacctcctgctctatacacccaccactcacagggccatgaagctcat

SEQ ID NO: 45565 - DNA, 62 bp, Chlorella protothecoides
gtcgccgaggagttgctggccctgcaggcaatatacggggaggacctggtgccccatgccga

SEQ ID NO: 45566 - DNA, 78 bp, Chlorella protothecoides
acacttgcgcggcacatccctgccacatcggtccctctctcgttcaatgctcctgtcgggccgcgtgcgacgtggact

SEQ ID NO: 45567 - DNA, 4034 bp, Chlorella protothecoides
  modified_base (1374)..(1447): a, c, t, g, unknown or other
  modified_base (1612)..(1621): a, c, t, g, unknown or other
  modified_base (1803)..(1812): a, c, t, g, unknown or other
  modified_base (2737)..(2859): a, c, t, g, unknown or other
cactggcgggcgtgcgcttcgcggagggcgcccgcggcgccctggaggcggcatggggccgcgcggggcggcgcgtgccgctgtgctccgggccggccgccttcctggcgttggtgtgcgaggcactcgggcgagacatccgcagcgtgacgcagcgcgtgcgcctgcctgcgcgccgcgcggcggggggcagccaggccctggacctgacacccttgaccccgggcggggaggcggccgggttctggcgcgtcgcgctggacggcgtggaggtggcctacgacgtggtgcaggaggggagcgaggcggggggaaggcccgtcgtgatcgtgcggggcgggagggcctggaccgcggcggcaggggagggcgaggaggaggcatgggctgacgacgtggaccgagcgccggtcgcccctgaatgacattgtggagtgggcgccgcccgcccatgtcgacgcggtaggagagtgtggccacctacccatcccaccccttccatgcatctcctggcccctcaacaacaattcatatgcaaagtccatgggcaaaaacaagcgcatcccatgctcaggacactagaggttgttcagttgcgggtagtcggtgaacaggtcctcctgcgtgaaggtgtcgccctcctcctccggcgtccacagcacctccaccgccagcacgtcctcgctcctcaccccacccagcttggacagggcctccagcagctcctcgcggctggtcacgcgcggcagcttcagcggggccgccaccgcggccaggatggtgaccacgatgagctcgttgggccccgaggactgcctggcgagtgggaatggggaggaactttgggggttgctggagggaatgaggtttcaccctgagaatccaggataagactgactggggaatcacctctgccatgttcaaggcaccagggagctcaaaccaaagcatgcacaccgctcagacacctcagctccccacgaggtgcggtacctgttcagcgaggactggcgcttgcgcccgccgacgttgaccagcgtctccgcctcgaacttgcgccgctcttccagggacagggcattgaacctgttctcggcggcgtcggggctgtcctcccgcccgctcttcccatagcctgcgtgattgcggtgggcgccgggtggaaagggtgggagacgggaggaaggctgctcaaggagcacggcgtcgagaaagcacggcacacagttgaaacccaacaacggatcccaggccgcccgttggccccatggccttaccgtacaccgcgtagtctgggttccgaagcagggccagcaccgtctctggggattgggagagtatttggtagggatgagcagagggggaagggggggnnnnnnnnnnnnnnnnnnnnnnnnnnnnnnnnnnnnnnnnnnnnnnnnnnnnnnnnnnnnnnnnnnnnnnnnnncgagtgtaccccctcagcaccccaaatgcagccggcgacctcttcaaacttcaagtgcacagccctgtgaacctgcgcccggctccccctcccccctcctcccagccctgaacacccgaacacaaaccccgcgacaccacaccttggaggatgaagtggaggccnnnnnnnnnnccaggaggcgtgttgaccatcacagatcagagctgggcttcctcccacttgctggatgggcctggtgcaccacctgcatgcacacctggcgattcctgcaagagtgtaccccctcagcaccccaaacgcagccggccacctcttcaaactccaagtgcacagccctgtgaacctgcgcccgnnnnnnnnnncccagccctggacacccaaacacaaaacccgcggcaccacaccttggaggatgaagtggaggcccgcggggccgctggtatcggcccggctggcgatgcgctccaggtcccgctgcaggccccgtgcggagccgaggagggccacctgcagtttcgccacgctgaccgggtcgtcgccctcacgcagggcgcgggagccgccgccgccgcccagcacgccctgcgccgccttgaccatgatgaaggcaaacacgccccagaaaaggagggaggtgaggccgaagccgccgccgccgccgcccaggggggtcatgtaggcgggggccagcgcgctccggcccgtcacactgaggtggtgaccgcccgaggagcgagccgccggcgaggagagggagcgggcgccctgggaacgctgctgctgcaggaacgaggagtcggcgccccggcccaatggaaaggagctgccgctgtcttgaaatccggacgacgggctgctgctaggtgagagggggagggtgggggtgtgtgtgaggaggtaagaggatcacttgcatcttcctttgtccatggacctggagttcacaccctgacgctcctcttggggaaattgaacatggcaaagcgccgctggatctgtccgtacatggtagcgctgctcaaccacagtgtcaccacacctcgagctggagaaggcgctgccacccatgcgtcccccgcttcctgccgcgaaagcagggtcgcaggagcagaagagcagggcggcgctggcggtcagggctgccatggccatcccggccctctcccaggccacgacatggcctgcatcagaccactccagggctgcatcctgcttccgggactgggacttccctagagcaccgagggagacggccgaggtgtggcgtgcgtcataatgtgccgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggctcccatgctgcacagggcactgcacgccacacgggaagggtttgttgatcacttcttgctgaaatgtgtgagcaggttctttcgtatgagtcgtgatcggcgtggatcaggggcttttgtgggatgctcgcctggtcctcctggccgcgcgccaacaaaatctgctttccgatgcgtctaccttcggatcatgttccccagaatcagccccctcagaccggccgtgaacgccgtgcatgcatggcgatgatccccatcggcatgcacaccgtgtaagcatctgctgccacccaccgctgacacctcgcgcgatgtcgctcgcccacctcggctcgcgaatggctgtgggcaggggcctggccctgtccaccaagtcccggctgccccgcctgcctgccggccatgcacactccaccagcgcagtacaggttttctgtgctgcccaggaatccagcagaatggaaggagggcggtcgagtgcggccgagaagctgatccgaggtgctggggggcggggctctggcacacgtactgcattttcaccgggcgtgcatgaagggaaacatcgttgcgatcgcagcatgcgctcctctcctgatgacagctgcatgcatcgcgctctgaacgcctctagggagccggtgactgtggggctcatcaggggtaacctctcatcatgacatggaagcccctggtctccctcgccgtccccatgcaccaggcacaccactcctgcccgcagctcacccatcacccttcccttgctcaacacaccaggccacatcgccgccgccacgactgtcggcggcctgctgctgtccgaggcctcccccgccctggctcaggacgcgggtcccgccgcgagcgtcgccgccggcgccgcccccgccctccccgccatcgaccccgcccagctctcctccggcgtggacaccgcggtggggacgctggtggacctcctgcgcgccgccggctccggcatcaagtccggcctgggcggcgcccaggacggcctggaggctgccgagtcggcctactcccgcatcgcgccctacgtcgaccgcgccgtggacgcggtgcgccccggcgtggaggccggcgtggccaaggccggcgccgcggcgggcccggccctggagcgcgcgctgccggcggcgcaggacgcgctggc

SEQ ID NO: 45568 - DNA, 19822 bp, Chlorella protothecoides
  modified_base (251)..(260): a, c, t, g, unknown or other
  modified_base (1336)..(1345): a, c, t, g, unknown or other
  modified_base (1908)..(1917): a, c, t, g, unknown or other
  modified_base (2342)..(2351): a, c, t, g, unknown or other
  modified_base (5313)..(5322): a, c, t, g, unknown or other
  modified_base (5799)..(5822): a, c, t, g, unknown or other
  modified_base (6061)..(6070): a, c, t, g, unknown or other
  modified_base (6597)..(6606): a, c, t, g, unknown or other
  modified_base (7698)..(7707): a, c, t, g, unknown or other
  modified_base (7950)..(7959): a, c, t, g, unknown or other
  modified_base (8231)..(8240): a, c, t, g, unknown or other
  modified_base (8735)..(8744): a, c, t, g, unknown or other
  modified_base (9321)..(9330): a, c, t, g, unknown or other
  modified_base (9536)..(9545): a, c, t, g, unknown or other
  modified_base (9654)..(9663): a, c, t, g, unknown or other
  modified_base (10057)..(10066): a, c, t, g, unknown or other
  modified_base (10551)..(10560): a, c, t, g, unknown or other
  modified_base (10790)..(10799): a, c, t, g, unknown or other
  modified_base (10971)..(10980): a, c, t, g, unknown or other
  modified_base (11367)..(11376): a, c, t, g, unknown or other
  modified_base (11617)..(11626): a, c, t, g, unknown or other
  modified_base (12177)..(12186): a, c, t, g, unknown or other
  modified_base (12699)..(12708): a, c, t, g, unknown or other
  modified_base (13079)..(13180): a, c, t, g, unknown or other
  modified_base (13677)..(13686): a, c, t, g, unknown or other
  modified_base (13757)..(13766): a, c, t, g, unknown or other
  modified_base (13868)..(13877): a, c, t, g, unknown or other
  modified_base (14498)..(14507): a, c, t, g, unknown or other
  modified_base (15001)..(15010): a, c, t, g, unknown or other
  modified_base (15147)..(15212): a, c, t, g, unknown or other
  modified_base (15771)..(15780): a, c, t, g, unknown or other
  modified_base (16027)..(16036): a, c, t, g, unknown or other
  modified_base (16883)..(16892): a, c, t, g, unknown or other
  modified_base (17944)..(17953): a, c, t, g, unknown or other
  modified_base (18403)..(18412): a, c, t, g, unknown or other
  modified_base (18639)..(18648): a, c, t, g, unknown or other
gctggcgcgggcgggggcgacggccgccccggcgccccgcacgctgcacgtccagagcatcagcccctgggcacccagctgcatcgggccctacgcccaggccgtggcgcacgccgggctggtgcgtttcgcgggccagatcgggctcgacccggggagcatgggagtggtgcggggcggcctgcgcgcgcaggcgacgcgctgcctggcctcctgcgcagcggtgggcgtggcgcaggccacgcgcctcnnnnnnnnnnacaggcggcgcgctgcctggcctcctgcgtggcggtgggcgtggcgcaggccacgcgcctccacgccgcgctgctctgcgccacggtcttcctggcggagggggcggggggggagggcgccgcggatccggtgcgcgtggtgggcgaccttcttgctggcttcctggccgacgggcggagcgggtgggcggaggatgatggtacggcgggcggggcagagggcggcgtggggggcggaccagtgaccggaccgactgccgagggaggccccgcctcggcccctgagggccgagatggtgggcgactggtgtgcgcctcctcttcttcgtcagcgttggtcgacgaggcaggcagcatgatgcagacgtgccgcgcgtcgctttcagaagacgacaaggatacaggttcggtgccatcggatgcatacctggagccgccccagatgccgcggcggcactggcagcccctcatcacctacatcaccctgccccagcttccgcgagggtgggcaggcacatttgacgtggtccaacgggtggaaggggacatcaggggttctgcagtgtatgatcccgacttgcaaccacagtgctcagggagcacggagctggctcccgctcccaccccatcactccttccgcccatctcacaactacagggtgctggtggagattcagcccactgccctggactccaccgtcctgcgacctgagcaggacagcagcagcagcagcagctgcagcagcggtggcgaggagggcgcgtccacaagctgggctcgccggctggagaatatggacctgggttcgggcggcccctctgagatccctgcccttgcagcctcgcagtgcatggcacagggcctcgcctcccccgggcgcatggcgcagtggcaggtctggctgcctgccggcgtgccgctgacacgcgccggcgccgaggccctggcgaccgcggcacgggacggtctgcgtcgcagcacactgaaggaaggcgacctcgtctgggcgcgcatctacgccatcgaggtcggcgaagcggggatttggccggacgtggagctcgccggggcggcnnnnnnnnnngagcgacctcgtctgggcgcgcatctatgccatcgaggtcggcgaagcggggcgttggccggacgtggagctcgccggggcggccgttcccgtcatccaggtggcgcggctgtccttggcccggccgagcaacggccggggtcacgcactggaggaggcaggggcagtcctggagctctgggcggcaaggggcctgtgagcgacgcggtggagggagagcggcggcgatgtgccagtgctgtcaaggagctttgctgtgctcgtattgaggagacgcgcggcacttggctgacagaactctggcaacgatgctatgtcctgcttcaatcagtgccatgtacagccctgtcagaccccaagactctgcttctcaagtcgaaatcagacgtgcccccggccagcataatcagtgataccgacatcccacccagcgcatggcgccaggaaggtgtgcaagccacgtcatatatctacagcagtgcatgcaggtggagatggggggattgcggtcaaacgctgtaagcacaccccctccgcaagataagaaagagactccaagaggnnnnnnnnnnagggggattgcggtcaaacgctgtatgcgcaccccatccgcaagataagaaagagactccaagaggcgctcaggcctcacagcccgcggcgcggcaggcgcggcccagctcctcagcgccaaggcactggctctcgtccaccagcttccccctggcgtcaaagagcacgccctccttctccagcagggcgcgcttcttgcagacgttgggggtctggagtccccactgcccgctgaaccctcccagttccaggctggcggcgatgacacggtggcacggcaccgcgggggcgtaggggttccgacgcagggcctgcggggcgcacagagtgccaggtgtcccgctcattaactcgaataagctgatttgttgccggcaggccgactcggtcctcccagtccagcacctcagcactgaaccctcannnnnnnnnntcgctcattgacacaaatgagcttatgtgttgccggcaggccgactcggtccttccagtccagcacctcagcactgaaccctcacctggcccactgcccgaggagcgctcttcaggacggcggccatggcaccataggtggacaccttgccctcggggatgctcttgcacacggcatacagcctcgactcgaagaccgtgggcgggcggttgggcttcacctccgcgacggacacgccactcggggcgcgggccatcatgtcgatcagtttccctgttcttgacgcgcctgccgccttgcttcctgctccaattctctctggagctcggcttccagatcgtagccggtccctacccggcggatggtgttgaagtaagtggtgcccacgaagcccacgaggagcgcacctacgatcaagttggaacgacgccgcgccacttgggtgagcctggcggtcacgctcccagacatgccttgagctgatgtgtgatatgatggagatggtctgtgcagttgtggggtttggggagatcccgcaaggcagggctccgtgcggtgcgtgctgccgccgatccgcgtgagctcgatctggatcagttcgcaccgaaggatgcagtgtgatctgccagcgaggctacacctcacgccatgctgccggcattgcaacactcgatctaagtgaatttcatttcgcgatgcataggactctcttgccgacccccgctcagtttacctctctctggggtcgcactgcgccggcactcttctgcacccacccacaaaaccagctctcagccaggtcgcgtcaggacaggaggacatcgagagccttcatgggcaaaaaagctgatgcacctgcccaggtatgttttttttcgcccaaacgcttctctggcaacctagttgctgctcctcgcaaagcgtacagccacccgcaggccactgacgaggccctcacacactccacaggccatcaccatcattggaggcgggcgcataggccaggccttggtcgacatgggacctggctccgatgtgcgctgcgagggtggcctcttggatgtcacccctgccctgtgttggtcggggtccctcgcatctcagcaaatgtccatggcatgtctctcccgaccctctccaccctgcacggcaagtgcgcccagcaatctagcagaaagcaccagacctccccgccccaatgacgtgccaggtgctgctgaaaaggggctccagcttccccaaggatgcgccctcccccatcatcgtctgcacccgcaacgacgctctggagggcgtaatagaaagcgtgcccaaggaccggcacggcggtgtgtgagggaacagacccttggctctggcatggtctggcttgaggtggggattcaccgcgttcaactttctgggcggcagttgccacccacacctctctgttaagccgcaccccctctccccagtacacaccatcacacacccctttcagacctggtattcatccagaatgggatgctgcagccttggctggaggggcagggtcttgcctccgccacccagctcctcgtctactttgctgtggccaaggctggtgacactccagtggatgggaagaccgacgtcaacccggaggggctgacctcggtctgggggcctcactcggaggccgtggcgcagcggctggctgcagggggcctggcctgcaaggtgcgtgccaggctggaacagggcttgggcgggagcgtgcgaggcgcatgcggagttgagaggggctggggagagggggaagcttcacgcttctctccatgcatgcgtgggagcagagccccgggtccccgccacgctgcctcccaggtgctggatcgccctgccttcctgcaagctatgctggagaaattggtctggatctcggcattcatgctggtcggagtcacccatggcggctgcagcgtgggcgaggtggagagggtgcactctcaacaggtaggtgtggggaggagggtgttgctgccacccgctgcaggggtctcatggggtgggggggaggggaggggggccatgtgatggcttccaccagtaccaggtagctgcggcagggcccccaggcccccctgtctggcgaggtcggggattggaggtgcggacgcgcagccagggtggctgcatgtcgggccggacctcgcagcttagagctcgtcgtcagccggcccacctgtggcgcaagccccccctgccgcagacggccgagctggtggaggagctggccagcgccggggccgcggcgttgggtgttcggctggaggccggcgcctgggagcgactggccgcctacgcgcgctccgtggcaaactacccgaccgcgctcaaggagtttgagtggcggaatggctggttcaaggagctgtcccgggaggcgagtgcctctggaaagcaagacccgtgccccatgcacacgcgcctcttggccgggctgggctactgaggaccagggccatggcgatggcaatggctgggcgtggccattgcgagcgtgaaattcctcagcgtccggtttcggtgagcaggcgagccctgaacctgggagtgacccttcaggactgaggctgaaagcacaggcggacctgactagagcagcagatccttgcctgagggcttggcatgcgaggcagcagcggggcatcgtgatgcaactcactcacagccgtgcatgcgagcttgcggtggaatggcagaacatggaagaatgagatgcgaccgacatcaagctggtgatgcctgcctcccatgcgaaagccacagatactaagagtgtagtgcacgagcagaagagcatgctccgcccatgcatagggaagaaagtggacattgggtgggtgtctacctcaatcgccaagtgctctggcaagctctcaggcatggtgagcttgctgcttgcaatggctatgggtgtctacaatctctgaaccgtggnnnnnnnnnncgagcatgctccgcccgtgcgtagtgaagaaagcggacattgggtgggtgtctacctcaatcgccaactgctctggcaagctctcaggcatggtgagcctgctgtttacaaggactatgggtgtctacaatctctgaaccgtggcccacccagtgccacatgccaccagacccctcacagtcgacccccggtttcggatgaggtgcaaattcctggttcggatgtcactgcaggatggtctcaggcgagagcatggtcatgcgtcaacagtactatatgctgcagtttgtgaggccttggcatcaaacacggagctgcaaggacatcagaggaagtgcaagatctggccttgcatgtcctgaagcggtacatgaacggaggaccctcagggcagtgtccgcacagagtccaccgctcaaccatgcgtgagctcacccagtagacctcccctgcatcgggctcagtgcgccacaactnnnnnnnnnnnnnnnnnnnnnnnntgacccaattctcagcggttgggcgggggtgccaatgtctaaagggtcgagcatgtactttacaggactcagctggtccactagcaggcaatgggaacccccagccccatccaaggaactcatgcatccagcatgctaggaaccctgctgcctacatcattccagtggatacacagacgattggtgctgcaccaaagggggaaatgatagcttggatgcaccccgtggagatggtgcannnnnnnnnnccatgcatccagcatgctacgaacactgctgcctacgtcattccagtggatacacagacggttggtgttgcaccaaagggggaaatggcagcttggatgcaccccgtggagatggtgcatcaatgcttgtacgtattggggaacatgcaattgcttgggtatcgagagactaggcagaaagttggggagcagggacaggattgattcttacggcaccgtctgcccagatgatctgattggacagcgtgcgtcccatggcggtgaccgtccccctgccatagtctgctgggagagtggcctcgcaccttgcgtggagaccagccgggatgcatttgagggacatgtctggtcggagatcctcctggaaggtcacccagatgttcttcagcagcagcaccgtagtgaggaacacctggcacgtggaccgcttgtcgccgatgtcgtagcagtacgctccatcgatgactaactgccctgagggcggaggaggcgcgaattgccctggggccagcaccggtgccggaggnnnnnnnnnnctggaccgctcgtcgccgatgtcgtagcagtacgctccgtcgatgacaatctgccctgagggcggaggaggcgcgagttgccctggggccagcaccggtgccggaggagggggtgggctcgctggggcgggcgggtttgcatcggacttcagccgcagcgtttgaggtgtcctcagcatctccaggacgcacgcgccttccccctgaaccaagttgtggcagaacaggttgtcgccacggttgttgttgcccacattcttggttccattattgtagttgcctggggtggggaatgggggcaaggggtagaggtcaccagtgggcctgagcagacagccggcgcaggcaagcatactggtgctggcgagggagcaggggcccgtaggctcatggggcctcctcgatggaaacagaacaggtgcaggctacttttgaacatcatgctggacctggcctgcacccctgcacgcaccaaagttctcattcccaaggttcgcgttgcccttgttgtagcgccccgtgttgttcaggcccttgttgtagcgggcatcccattcgcactcgtgctgctcatgtgggatgcactcgaccaggaggagcatgtcgcaggcaccgtcgcaggcggccatgctggcgatgtccaggatgtggatgtccactccgggaagacgcccgggcagctcgacctgggtgtccctcaggaccgtcgttaccgccttcgggaagccttttgctctttgaagggggattgtggtgaccgggcatgtcctgacaccttggtccttgtcgcttttatggaaaggcgtaccatgaacctacaccctttctctcaattggagagctggccatgatgccccttccctacatcgcaactcacctgcaaaaagctggaccgctcgtctccgagacgaagaagagctcaccatccacacttggaaaggagtgaggagggatcccgtatcactacagttcagaagggcctgtcatgtggtgtcatgcaagtagaaggtggaccctccaccctgcgctaatactgcacaccttgcggttggcagggcgaagaaggtggagttgcactccgtctgcaggtgnnnnnnnnnngaggcggaccctccaccctgcgcttatactgcacaccttgcggttggcagggcgatgaaggtggagttgcactccgtctgcaggtgatcgaggcagtgagggtgaggaatttgattgggtagctcggcatgcgttgcacagttgtcaaaaaccgccggacagcacccagacacgttggacctagtgcatcggggacactcaccgcagccaaggacaatgagctcatggccgacaccataagtnnnnnnnnnnaagttgtcaaaaaccgccggacagcacccggacacgttggacccagtgcatcgggaacactcaccgcagccagagacaatgagctcatggccgacaccataagtgcgatgatgaccagcgaacgcatcgtgaggagatctcgcgcctttgatcgagctgcgcgcaagttgcgctgttgtacacaggggcgcttttcttcagtttatcgatttctccctttaatgtgttacaaaattgcgggaaattaactattgggagtgctcctgaggttnnnnnnnnnnaagatctcgcgactttgatcaagctgcgcgcaagttgcgctgttgtaagcaggggtgcttaacttcagtttgtcgatgtccccctttaatgtgttacaaaattgctgaaaattaactattgggagtgctcctgaggttctggtgaggcactcgtagcctggaggctcgtgcttgcaaagtgaaggcttgcccgtgcggttttcctttgggtcgcggctctcccggtttgggacacctgtcgctcgctccatgtttcgtggttgagtgggtcaagaaaaggatgtgaatcacctgacaacataattactccgtcctaccgtgcgtttttgtaggtaggaacctgtcgctggtttttgtgcaggtttgttgtaagcttgcggcttccactgtatgctccttagatccttctgcagtcgagactttgcccacccacccctagctgcaattctttttgacacccaactcaacatccacttccctcttcttggctgtgcnnnnnnnnnngggtcaagaaaaggatctgaatcacctgacaacataactagtccgtcctaccgtgcgttgttgtaggtaggaacctgttgctgggttttgtgcaggtttgttgtaagcttgcggcttccaccgtatgatccttcgatccttctgcagtcgagacactgcccacccacccctagctgcaactctctttgacacccaatacaacatccacttccctcttcttggctgtgcgatgtcctgcgtccgttgtgtcgcgggttgaacccgcgctgtggatcttgctgcgagttggccatgatacatcccaatatctgagtcaatgacctgtgagccacccatcgaacaagccgtcaactggccgccctgactcaccttaccttccctttattttcaagacaattaattctttttctttgcgaattggggagaggggaacccttttcccatcagaggaggtacatcaatcttcacagggtggggccagaaatgcttgcttcaatgtgggatacattccattatcttgcaggtagcttctaatcatcccttgtggatgccttctggggatgtgctcatcccacannnnnnnnnnaacctttcctttattttcaagagaagtaattcgttttctttgcgaattggggagaggggaacccttttcccatcagaggaggtacatcaatcttcacagggtggggccagaagtgcttgcttcaatgtgggagacagtccatcatcttgcaggtagcttcttagcatcccttgtagatgccttctggggatgtgctcatcccacannnnnnnnnngcccaaatcatctccctcattcatgtcaagtattaaaagaggatgcacgatcccatgcgcctctagccacatgcctgtatgatggggagcaccggcctgagggcatcannnnnnnnnnattggggatgcgcatcgttctcagcatgcatggaacatcggtttgttctggaaccccccagcagaggtcttgagggcagcacgattccccaaatcatctccctcatttatgtcaagtattaaaagaggatgcacggtcccttacgcctctagccacatgcctgcatgatggggagcaccggcctgagggcatcaactctgagagtaggggcacgaagcatatcagacagggacatgcaaactaggatccccctttcttaaaattgaccgccccccccctctatttcaatggtacaggctacatcagcgcaggcctgttccctttgtcaacaaatattccttcgtcctcgctgctgcccctctacacccttcccttgctcagctcacggaagtcnnnnnnnnnngcatcagcgcaggcctgttccctttgtctacgaataccccttcgtcctcgctgctgcccctccgcacccttcccttgctcagctcacggaagtccagcgcaaggtccaccatccacagctaagcctcccagggcctgtgcatgatgtcactgcaagcaacccgtggccagatcagaaaccgccactccgccaggtgcaggctgcttccagcccatgcaggggcagaggagtgcgctgcatggccaacatctggacatggatccggcaccatgttgccgctgcagcccgttctccgagcgccgcagtgcgcatgagctgcccatgtgtttgcactcccaacagcccgtccttgcatcggactcggggtctcacagatctcgccccgtgctctcgcaccgacatttacgctgcagaggccaaaaagtggtgcagacggctcctggtggcgtgcaggtattgcagtgcgtccccaagactggcctccnnnnnnnnnngtggatccggcaccatattgccgctgcagctgttcttcgagcgccccagggcgcatgagctgcccatgtgtttgcactcccaacagcccgtctttgcatcggactcagggtctcacagatctcgacccgtgctctcgcactgacatttacgctgcagaggccaaaaaagtggtgcagacggctcctggtggcatgcagatattgcagtgcgtccccaagactggcctccnnnnnnnnnnggcatgtgccacctggcttgtcgagtggagttccagcctcgcccccaacactaatgtatccagcatattacaggcaagattgctgctcatggcatttcagctagaatgggggctgagtgagactgaatcaggaaagggggagactttatgtggtgctgcagaagtgcatgtnnnnnnnnnntgagggcagttggactgtggtgccgacgttcaagaggatgggcatgacatgcaggggagtgcatgtgtcacgtggcttgtcgagtggagttccagcctcacccccaacactaatatattcagcatgttacaggcaacattgctgctcatggcatttcagcaagaataggggctgagtgagactgtatcaagaaagggggtgactttatgtggtgctgcagaagtgcatgtacgtattggtcgtcatgtcaaaccgccgctcatggttctaggcggtggaggggggagcaggtacacgggtgatgtgaatggcatggtcagctaggatgtattggttggacagcgtgtgccccgtcacgatcaccctgccgtcgctgtagtcaccccnnnnnnnnnngcacgggtgatgtggatggcattgtcagcgtggatgtattggttggacagcgtttgccccgccgcgatcaccctgccgtcgctgtagtcaccccaggtcatggcctcgcacttgatgttcagacccacagggaggcacgtgccgtacgcatccggccggtcaccgtcctggaaggtcagctggatgtttttcatcggctgtgcggcggtgacgtacacctggtacccggtctgcttgtcgnnnnnnnnnnagccgtacgaatccggctggtcaccgtcctggaaggtcagctggatgtctttcatcggctgtgcagcagtaacgtacacctggtacccggtctgcttgtcgttgagcttgtagctgatggcgctggcaatgatcaggtcatgtgagggtgggggaggtgccatctggcctgggggcaggactggcgccggcgagatcttgggtgccgggggcgccggggggttggggtcggtcttcagctccaccgtgtccgccgtcctcagcatgtccagggagcacttctcgttgtcctggcgcaggttgtggcagaacctcttggagccaacgttgttgttgccaacattaccgtcgccgacgttgttggagcctgggatggcggcggggtgagggacagggtgagtagcaggcctggataggcggggggggcgctggcagacagactggccctcgggagtgtgaagggggcatggtggctgaggacttcacaggggacaatagggagagagcaggccgcccagcacactggagtcggcgcgcccatctgcaccacannnnnnnnnngggtggggcgagggacagggtgagtagcaggcctggattggcagagggggcgctggcagacagactggcccttgggagtgtgaagggggcatggtggctgaggccttcacagggaacaccagggagagagcaagccacccggcaaactggagtcggcgcgcccatctgcaccacagcacgcaccgaggttgtgctccccgacgttgttgttgccagtgttgcgcatgcccttgttgttgttgccgacgttgagcttgccgtcacggttgcagttgtcctccccctccgggacacactcgacgaggagggccaggttgcaggtgccatcgcagatggtcatggatgcaatgttaaggatgcggatgtccaggccattgagatacttgggcagctgatcgggggtgtcgaacatcaatgtaaccactcccctcgggaagcccttcatgctgtggatggggagcggaggggttgggcctgtcacggtctgggtgcagttattggtgcaggtgcatnnnnnnnnnnactcgggaagcccttcatgctgtaaatggagagcggaggggttggtcctggcactgtctgggtgcagttattggtgcaggtgcatgccttgggatcgtatctcccagcaatggtgagtgtgagccacggggcgtccctcccgctcaatgtctcaccggcagaatgctgggccgcttttctccgagatcaagtacagctcaccatccacactgcgaggggtttgaggagttcgatgttactttgtaggcagggagggcttgaaaccaggatccttacaggtgcatggtgggcctgcacgttctgtttccatcgcatacctcgcggtgggtaggctgaagaacgaagacttgcattcggcctgcatggcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgcacgcatgatatttcaattgggtgatgaagttgatgctggaatgagcaggtgtattactacgatgagacgaggtgcctcgggaaccagtggcgacgatgaactcctatcgggcaaaacagaacacacagggtgttgatgcccagcgatatgatttgagtatcagaggatgagttcgaggagtcgtgatgcttgaaatgggctgatgagtgaaggttatattcaagtacgtttgtccgcggcccggagaccgcgggtccggcgaccgcctaccttgagagaggtgcggtgccacgttttcctgaccggcgaggtctggctcgaggagacccagtgcggtcatcccgggacaatgctaaccgcctagtctggagcaacctcagccgacgcatgtggtgcaaggaatgagatgcaaattgtcgttggatggccttgcgagggccccggtcaggccggacctacaagccgcacttcacgaggccttgctgtggccannnnnnnnnncgagtatcagaggatgagctcgaggagttgtgatgcttggaatgggctgatgagtgaaggttatattcaannnnnnnnnngcacgaggcaggtttttctgttaaaaatcatacaatcggtatcgcatcgatcataagggcgatataacgcgggcgtcacacatcggtcctgcccggtgtccnnnnnnnnnnccacgaggcagattgttctgttaaaatcatacaaacggtatcgctccgattacaagggcgatataacgcaggcgtcacacatcggtcctgcccggtgtcccacactgggcccctgagagccgccgaggactcctctcatccttagcctccccaggccccagatgcctcccccccacactgctcgcctagattcttgcctagatgttaacaaacaatggtactcacagcaatgtcaaggtcatcctggctttcatctgcctgctggagcagtctgtcgcctcttgacactctccctctggagatgggatcaaacacggcatgctctgcagttgacgtgccgctcctgggagctggtctcgaccttccaagcgaagatcacaagcggtgcagcttctgtcagagttttgtttactggatcgcgctcctcccagcgcccccttcccttgatgagggagatcgcagtcgtcggtgtctggagtgcttacctgagccccggctgaccctctggtgatgggggaggactgcctgggaggtcgtgcagaggcagtggtggtgtgatgtcactgtctacaaggtgtgaggcagtggcgctccttgggtctcaggctccatgcatgtccnnnnnnnnnnggtcttgtttactgggtcgcgctcctcccagcgtccccttcccttgatgagggagatcgcaatcgtcggtgtctggaatgcttacctgagcccctgctgaccctctggtgatgggggaggattgcctgggatgtcgcgcagaggcagtggtggtgtgctgtcactgtctacaaggggtaaagcagtggcactccttgggtctcaggctccatgcatgtccaagccagatcaggagaggcagcaaggggggggtcagatctgggtggctcctgtgtcccatgcattacggatgacacggctgctgacattaaggcataggaggtggagtagattggtcacacaccagaaatggtgtaggatcatcgagtgcccttgaaagagctacaggagcgcatgtatgcattggacacaaagtcagagtgccgtggtcctaagcaggaggagggggcgcagggacactggcgatgcggatggcgttgtcggcctgaaggacnnnnnnnnnntctaggcaggaggggggggcgcagggacactggtgatgcggatggcgttgtcggcctgaaggacttgattcgacagcgtgtgccccatggcgttgaccatcccgctgctgtagtcaccccaggtcatggcctcgcannnnnnnnnnnnnnnnnnnnnnnnnnnnnnnnnnnnnnnnnnnnnnnnnnnnnnnnnnnnnnnnnncagcatacgcgtccggcctgatatcgtcctggaaggtcagctcgaggtccttcagtgcctgtgccgtcgtgaggagcacctggcacctggactgcctgtcgttggccttgaagcacgaggcgctggtgatgaccagcgcgtgcgagggtgggggtggtgctgtctggcctggggagagctttggagttggtggaaatggtgagctctcgggggcaggtggggtggggtcggtcttcagctccagagtatctgcagtcctcagcgtgtccagagtgcacctgtctccatcccggcgcaggttgtggcagaacctcttggtgccaacaatgttgttgccaacattcttgtctccgacattgttggagcctgaggggtggtgtggtggggaggaaaaggtgagggggggcgcgcagtgcatctgacagggcaagggcagaggccagcaggctgtccgtcgggagggcagggaacattgtgggaaagggcttcacagcagcggtgagggggttggcaggcggccctgtgatgttggagagtgtgagccctccctgcatcacannnnnnnnnnggaggcaagcaggctgtccctcgggagagcagggagcattgtggggaagggcttcacagcaggggtgagggggttggcaggcggccctgtggttttggagagtgtgagccctccctgcatcacagcgcgcaccaagattgtgttgtccgacattgttgttgccctcgttgctcattcccgtgttgttgttgccaattttgagcttgccgtcaaagctgcagttgtcctccccctccgggacacactnnnnnnnnnnattgctcattcccgtgttgttgttgccaatgttgagcttgccgtcaaagccgcagttgtcctcccccttggggacacactcgacgccgagggccaggtcgcaggtgccatcgcagatgctcatggcagcgatgtcaaggatatggatgtccaagccattgagatgcttgggcagctgatcgggggtgtcaggcagggatgtaacgactcccctcgggaagcccttcatgctgtgaatggagagcggaggggttgggcctggcactgtctgggaacagtaattagtgcagctgcattctgaaagcttgtagtctttcactcgggggaatgtgtgagccacggggcgcccctcccgctcaatgtctcaccggcagaatgctgggccgctcttctccgagatcaagaacagctgaccatccacactgcgagaggggtacagagattgatgttaccatacagtcagggagggcttgcaaacagaatccatgcagggacatggtggccctgcacgttctgtttccatcgcacacctcgcggtgggtaggctgaagaatgaagacttgcattcggcctgcattgcaatgatgcgaagcccgtgagcgaggaaacaaggagactggtcataccagtacgattgcccactgctccgggcggcacccggacatccctcgcgttcgccagacgacttaccgcagccagggagactgggccaagcgccagcaacaaggcagagaggactatagtcgcacgcatgctatttcaagtgggagattaagcggattggaacgcacgagtgtttcagtgaggtgaggcgatatccctcgggaacctatggcaaagataagttnnnnnnnnnngaccatacagtcagggagggcttagagacagaatccatgcaggggcatggtggccctgcacgttctgttccatcgcacacctcgcggtgggtaggctgaagaatgaagacttgcattcggcctgcattgcaattatgcgaagcccatgagcgaggaaaaggacactgggcatgcctgtacggttgaccactgctccgggcgacacccggacatcctccggctcaatgcgtcgcggaaactcaccgcagccagggagactgagcaaagcgccagcaagaaggcagagaggaatataaccgcacgcatgatatttcaagtgggagattgagcggattggaacgcacgggtttttcagtgcggtgaggcgatgtccctcgggaacctatggcaaagataagtttcttcccagtgaggccaaacacacaagggattattgttcatagatcctgatgtgaatcaaacgaagtagacacgttgacttatgatgttggaagggggctagtagatgaaggatagcctccgttcctcgcgagatcgcgcgtccatcgttcagaatgcggtacggtgccacgttttcccgacagtaaacactctccggtcaggagtccctgcaacgtgtccagacacatgcttgctgcattcttgcaggatgcattcccaaacgatttctcccatgaagacctacgcctttccctgccttccaccccgtgccgagcaggcattgacaggatgatcttggcggccacattgtgtttgccctgtgtccccaatagttcggaccagtacctggtccgcttcaatttgagcgtcgcgaattgggtgcttgataactacaaatcgaccccttggtatcgttcggctgcaatgtggagttcatcaagcgattgcaagagtcgacgtccgagatgtagaccggtcgtgccacatggtgcttagtcgtgaagattaagctgcatgaaaagcaggtaaagaaggtccagttatatcaggctgagtacagcttgtgtcgagacatgcgtcaccacatagtagcctagtcttggcatggatgnnnnnnnnnncaaaagcaggtaaagaagatccagttctatcaggctgagtacagctcgtgtcgagacatgcgtcgccacatagtagcctagtcttggcatggatgcttcaaacccaccaggcggaagcaccaggcaccctgttttgtgacctgtagactccaacttgacgttgacattcctcgcgttcctttacatgcaccacccgccctctaccatgcatacccatcatgaaagctcgtgcccaggtccttcaactgtacaggaaggaggctaggccagccgaacaaggcgcgagcgttagccacacttcattgtgcgcttagcccgatccaggggctgaaagtggaagggacggtggcatgtaggggactggctgcgggcaagcgttcccataagcatgggatttccacatctaagacgcttccatctcaggatgggttgtctgtttgcctcccagannnnnnnnnntgggcaagcgttcccataagcatggggtttcaaaatctaagacgctttcaagtcaggatgggttgtctgtttgcctcccagacatctgtcaactgtgactctctcaaccagggacttgaatgagaagtccacatcccattagcaacccttgtatgattgtagcgtaagcggctggaccacccatgtccacgataccgacgagcatctggcgtacgacagccatgggnnnnnnnnnncctctcaaccgtggacttgaatgaaaggtccacatcccattagcgacccttgtatgattgtagcataagcggctggaccacccatgtccgcgatactgacgagcatctggcgtacgacagccatgggagggatccgaccccgggccaccggtgcacagaaaggctggacgtactccccacgataccatttgttcgcgctccacacggtcatttatgggccatgcgcccgtgctgtgcgcgcctccaggggtgtcggcccgccccaccataccaccaagtgtcccctccccgaccctgcgggcatgtgcctgacgggcgccccgcgccgagcgtgctcgggagcaggcatggcaggctggcaccgccactcatgcggccacaaggggagcgtcgaggcctgcccgccccagcactggctgtgtccagcggtaccctcctgggcggcagcacatggggtgcggtggcagctcgtcccatgcgcctgcttggtttctggcatcacccacgcgccccaccccactcctagacacttctctcacaacccccttatcttccctttccatcctcgccccccaaacccttcccaccaccactgttcctcctcgccacaggcatgtggagcgcgctgtccgccatcggcgctgcgtcgctgtgggcggaggggactccctggggcgcgaccctgaccgcccccctcatggccacgctggcaggactgctgtgcagcgcgacgcgcgtgctgccctcccactcccccgccgtgtacggcacggtgaacggctacctcctccccctggccatcccgctgctcctgtttggcgcggacctgcgctgcatcttgcgcgacaccggccgcctgctggttgtgttcctgggcgggtcggtggccaccatcgccggcggcctgctggcctacgcgctgtgcccgctgcgcgccctgggacgcgacggcccgctggccgccgccgcgctgaccgcgcgccacatcggcggcagcgtcaactacgtggccgtggcggagatggtgggcatggcccctgccacgcgcgccgcggcgctggccgccgacgacctggtggtcacgctctacttcctggccatctacgcgctggcgcggcgcgtgccgccggagccggcggcgcgcgacgccgccggcgacgcgctgccctccccc

SEQ ID NO: 45569 - DNA, 125 bp, Chlorella protothecoides
aggtccctcacagggagcgggtcgctgttgccgttccttgatgtcgctcacacgagcagccggctcacgtccgcccaaaccccaatccccacgctctgcagacatggaggtggcgctgagcacgc

SEQ ID NO: 45570 - DNA, 77 bp, Chlorella protothecoides
cctcacctcctccggcatggtggcagggtctctggccgccttgaatgctggcgggcgcttcgtggagatcagcaagc

SEQ ID NO: 45571 - DNA, 127 bp, Chlorella protothecoides
agagaggggccaggacaaacgcagggggtcgcagcagcaggtggttaaggtggggatgtggagttggtgaccctgtgacgaggcatgtcggacatgtctcccaggaatacgtccagagacaccatgc

SEQ ID NO: 45572 - DNA, 61 bp, Chlorella protothecoides
tggtgatttcgtcacgattataggtgctcgttggagctgagtgtccccgttgcaagggttc

SEQ ID NO: 45573 - DNA, 64 bp, Chlorella protothecoides
ccgggtgccgggctggcgggacctgtggggccgtcgcggccagcttgggaggggtctgcctcgg

SEQ ID NO: 45574 - DNA, 61 bp, Chlorella protothecoides
ggagatgggatccttgagcaagcgcgtgccacctccaatcctgccatcagtgcgcacctgg

SEQ ID NO: 45575 - DNA, 79 bp, Chlorella protothecoides
tggctgcgccggaggacatactggctgcgggactgaggggggcgcagggccctcccctagaaatccccgggcatgatgt

SEQ ID NO: 45576 - DNA, 61 bp, Chlorella protothecoides
gacaacagaggagcagcaaatggagggcactcatcgctcttgcaccggagagggctcaggc

SEQ ID NO: 45577 - DNA, 79 bp, Chlorella protothecoides
gggcgtggacgtggtcggcctggcctctctgcagaactgtgctaccgtcccctcgtgcctgaccgccgcggcccccgcc

SEQ ID NO: 45578 - DNA, 275 bp, Chlorella protothecoides
cctccacaacattgacaaacacccacaaacacccccccaccctccaacaccagggcatgtgggctgagcagaatgtccccaccatgactgcaaagcaactagaggactacaatgttgtgctggatgaggtaagcatgactacggacgattctgaaggtgtttgatgcagactgcagaccggtgttttctcccatcagcagcacctccgtccgtcttgactgcactttccatcacggtgcaacccataggagaacccagacctgttcaagtggctg

SEQ ID NO: 45579 - DNA, 140 bp, Chlorella protothecoides
cacagtgagggaagggcagaataagaaggggagcttgagggaagagagggcgggggtgtctagggagtgcgcccaacacctaaatcaccctccgagactgccactcagcaatggcatctcgacagaccactccacggcat

SEQ ID NO: 45580 - DNA, 61 bp, Chlorella protothecoides
aaatggctcccgtcgccagcaagaagcccgtgtcggccaagaagcccgtcgcggcgaagaa

SEQ ID NO: 45581 - DNA, 57945 bp, Chlorella protothecoides
  modified_base (2707)..(2805): a, c, t, g, unknown or other
  modified_base (2884)..(2893): a, c, t, g, unknown or other
  modified_base (2973)..(3210): a, c, t, g, unknown or other
  modified_base (3299)..(3308): a, c, t, g, unknown or other
  modified_base (3543)..(3558): a, c, t, g, unknown or other
  modified_base (4240)..(4249): a, c, t, g, unknown or other
  modified_base (4334)..(4450): a, c, t, g, unknown or other
  modified_base (4664)..(4673): a, c, t, g, unknown or other
  modified_base (4850)..(4859): a, c, t, g, unknown or other
  modified_base (5135)..(5144): a, c, t, g, unknown or other
  modified_base (5338)..(5347): a, c, t, g, unknown or other
  modified_base (5646)..(5655): a, c, t, g, unknown or other
  modified_base (6006)..(6015): a, c, t, g, unknown or other
  modified_base (6367)..(6376): a, c, t, g, unknown or other
  modified_base (7047)..(7056): a, c, t, g, unknown or other
  modified_base (7123)..(7132): a, c, t, g, unknown or other
  modified_base (7258)..(7267): a, c, t, g, unknown or other
  modified_base (9641)..(9650): a, c, t, g, unknown or other
  modified_base (10431)..(10440): a, c, t, g, unknown or other
  modified_base (11148)..(11157): a, c, t, g, unknown or other
  modified_base (11665)..(11674): a, c, t, g, unknown or other
  modified_base (13396)..(13405): a, c, t, g, unknown or other
  modified_base (13749)..(13758): a, c, t, g, unknown or other
  modified_base (13916)..(13925): a, c, t, g, unknown or other
  modified_base (14481)..(14490): a, c, t, g, unknown or other
  modified_base (15186)..(15195): a, c, t, g, unknown or other
  modified_base (16173)..(16182): a, c, t, g, unknown or other
  modified_base (16609)..(16618): a, c, t, g, unknown or other
  modified_base (16721)..(16730): a, c, t, g, unknown or other
  modified_base (16888)..(16897): a, c, t, g, unknown or other
  modified_base (17980)..(17989): a, c, t, g, unknown or other
  modified_base (18454)..(18463): a, c, t, g, unknown or other
  modified_base (18827)..(18836): a, c, t, g, unknown or other
  modified_base (18956)..(18965): a, c, t, g, unknown or other
  modified_base (19888)..(19897): a, c, t, g, unknown or other
  modified_base (20163)..(20172): a, c, t, g, unknown or other
  modified_base (21740)..(21749): a, c, t, g, unknown or other
  modified_base (22363)..(22372): a, c, t, g, unknown or other
  modified_base (22873)..(22882): a, c, t, g, unknown or other
  modified_base (22939)..(22948): a, c, t, g, unknown or other
  modified_base (23127)..(23187): a, c, t, g, unknown or other
  modified_base (23421)..(23430): a, c, t, g, unknown or other
  modified_base (24158)..(24167): a, c, t, g, unknown or other
  modified_base (24247)..(24256): a, c, t, g, unknown or other
  modified_base (24656)..(24665): a, c, t, g, unknown or other
  modified_base (24967)..(24976): a, c, t, g, unknown or other
  modified_base (25391)..(25400): a, c, t, g, unknown or other
  modified_base (27001)..(27010): a, c, t, g, unknown or other
  modified_base (27307)..(27316): a, c, t, g, unknown or other
  modified_base (27829)..(27838): a, c, t, g, unknown or other
  modified_base (28044)..(28053): a, c, t, g, unknown or other
  modified_base (28543)..(28552): a, c, t, g, unknown or other
  modified_base (28610)..(28710): a, c, t, g, unknown or other
  modified_base (28778)..(28787): a, c, t, g, unknown or other
  modified_base (28881)..(28890): a, c, t, g, unknown or other
  modified_base (29772)..(29781): a, c, t, g, unknown or other
  modified_base (30608)..(30617): a, c, t, g, unknown or other
  modified_base (31081)..(31090): a, c, t, g, unknown or other
  modified_base (31982)..(31991): a, c, t, g, unknown or other
  modified_base (32516)..(32525): a, c, t, g, unknown or other
  modified_base (33413)..(33422): a, c, t, g, unknown or other
  modified_base (33781)..(33790): a, c, t, g, unknown or other
  modified_base (34072)..(34081): a, c, t, g, unknown or other
  modified_base (36022)..(36031): a, c, t, g, unknown or other
  modified_base (37001)..(37010): a, c, t, g, unknown or other
  modified_base (38160)..(38169): a, c, t, g, unknown or other
  modified_base (38281)..(38290): a, c, t, g, unknown or other
  modified_base (38555)..(38564): a, c, t, g, unknown or other
  modified_base (38835)..(38844): a, c, t, g, unknown or other
  modified_base (39324)..(39333): a, c, t, g, unknown or other
  modified_base (39506)..(39515): a, c, t, g, unknown or other
  modified_base (40092)..(40101): a, c, t, g, unknown or other
  modified_base (40724)..(40733): a, c, t, g, unknown or other
  modified_base (41132)..(41141): a, c, t, g, unknown or other
  modified_base (41462)..(41471): a, c, t, g, unknown or other
  modified_base (41847)..(41974): a, c, t, g, unknown or other
  modified_base (42319)..(42328): a, c, t, g, unknown or other
  modified_base (42498)..(42507): a, c, t, g, unknown or other
  modified_base (42686)..(42695): a, c, t, g, unknown or other
  modified_base (44158)..(44167): a, c, t, g, unknown or other
  modified_base (44314)..(44462): a, c, t, g, unknown or other
  modified_base (44634)..(44668): a, c, t, g, unknown or other
  modified_base (44732)..(44741): a, c, t, g, unknown or other
  modified_base (45567)..(45576): a, c, t, g, unknown or other
  modified_base (45762)..(45891): a, c, t, g, unknown or other
  modified_base (46168)..(46177): a, c, t, g, unknown or other
  modified_base (47112)..(47121): a, c, t, g, unknown or other
  modified_base (47835)..(47844): a, c, t, g, unknown or other
  modified_base (48272)..(48281): a, c, t, g, unknown or other
  modified_base (48710)..(48719): a, c, t, g, unknown or other
  modified_base (49143)..(49152): a, c, t, g, unknown or other
  modified_base (50016)..(50025): a, c, t, g, unknown or other
  modified_base (50092)..(50101): a, c, t, g, unknown or other
  modified_base (51157)..(51166): a, c, t, g, unknown or other
  modified_base (51930)..(51939): a, c, t, g, unknown or other
  modified_base (52708)..(52717): a, c, t, g, unknown or other
  modified_base (53323)..(53332): a, c, t, g, unknown or other
  modified_base (53676)..(53685): a, c, t, g, unknown or other
  modified_base (56788)..(56797): a, c, t, g, unknown or other
  modified_base (57144)..(57153): a, c, t, g, unknown or other
  modified_base (57563)..(57572): a, c, t, g, unknown or other
ccccaatcctctcggagaaacctgacccgctcacccttggcgatgatggggaagatgatgcagcaggcggcgtagatgatggccagccccgtccagaggccgcgcagggtggggcgcgggtaaagcagcctgcccacgccgaagagggcgaccgagaagaaatgggcggcaaggatggaggggcgtgggttcaggcccgacagcaagccgatgggcccgcgcgcgcactcgccgccgcgcgcgaggtagtcgaagcaggcgctgcgcatggcctcgtgcgcctcgccggggccggcacagaagacgcggtacagcgcgttggccagcgtgttgatggtggccgcccagggcttgcgccgcacgtagaaggcggcggtggcgtcgctggtggccgccgcgcgggccaggtcgggcagcgggcgcagcatgtcgcagagcagcgcggtgtcggccagggccacggtcatgccgccgccggtgagcgggtggcgcatgttgaaggcgtcgcccaggagcagggcccccgggacgtgcagcggcgccgacgtcagctgcttgttggccatggcgcgcacgcgccccgcggccagggcctccaggaaggcggggcgcagctgggcggggacctggggcgccaccacgtctcgcaggtgggcggccaggtcgccgttggtcgaggaaggcagcgcctcgcccgggtagtccaccaggcaccgcacctcgtggctggagatggggtagaagaggatgggggaggggtcggccaggatgacgtgcccatggtgtgggtggggcagcgtgcatccgtgcagcttgaggccgatgaagtgggagggcgtgcgcaggtcgggcaccgccagcttggaccgcagggccgagtacatgccgtcgcagaccacggtgaggtggcccagtgccacgcgctcgccgccgtcgcccgcgcggtaccgcacgcccgtcaccacgcgcccctcctcccagtccgcgccggcgtcatccaccagcgcgcgcaccgtgccgcgacgcagcgtgaccccgggcgcagccgccgccgcggcgcgcagccgctgcacgaatcgcccgttgtggaaggagaagcccgtgacgggggcgtcgccggcgggcgcggcgctggcgcttccagtggggcccctgcatgccgcagccgcagccgctggaccccccagctcggcgggggtggggtaggcgatgcacgcctcgcgcccgcccttgaacatgcagtacccgaccacgggctgcgcgtcgatgccgtccacggcgccgcccaggcccaggcgctccagggccagcacgccgccaggctgcagcagctcgcccacgatgcggtcgggctgggccagatcccgctcgaggagcagcacgcgtcggccgtccaagccctgctgatgcgccagcgccgcgccggccacgcccgcgcccaccactatcacgtcccacacctgcttgtgtcgaggtgggagggggtgaaggtccggcggaggaggtgtgcgatgcaggacaagaggcacaccccagggcaaggggtgtcgcacggcagaggggccggcagcgggtcgggggatctgcaacaggcagatcaatctcatgacacaactgattgactcgcctgggggtcggtggcggtgtcgtcctgggaggggatggggggaaggtcgaagcacgcctgggccacctccgggtcctcctgccgcgcacccttgcccatgctggagccagctgctggtattgggggcctaatgcgcgttacgtactatgttgtgtaaaagtattcagactggctgcgctggatcccgcctgcgagcgacggtgagggccagaagacaggggtatggtagccgcggaggtacaactcgggatggcaaccgcgttggggcgaaaaaaaaatgacgtcaaaggtatacgaatgtgggtgattgtcagtacgagtgccccatgccctggaaagttgatcgctttaaaggagcagtttgtgtgaggacacgcagcaacctgtgctgagcatgctgtgcggccatggagggcgacgtgggggggggggtgaaatcgggcagcttcctctcgatcattcaggaccgttggacgacctgccgccgatgtcagccagtgcatcggagtgacgggatgtggatagtcgccggtcatggctctggctgttgcctttttactcctgcacagactcctgtacagatgatctggcgtgccggtatactaggaatacttagcctggtacacctcgtactgcattgtccaccttgtcacagcaagtacaggatcacatgctgagaccggccgtctccagcgtttgcctcggcgcaggtgtcctgcccttgccagccttgtcagccgcggccttgacatcccgtgctcgagcgtccctggcggcatatagcttgatcaggtccggggtcacatgctcctctggctcccagctgggttccctcccatcctcccacctgggagcgggtgcggcggtgggaaattgggtgtgaatggagcagtgactggggtcctaactcgcagagtccagttggatggggcctccgcagcgggccatggcagaggcattaggggtcgacggcccagctacctgtacctgcaccaaattctccaacaccccactgaacaagaggaccaaatctccactacactcttctctgagcccagtcacgcaccggaccaggtaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacccactccggctgggggtgacaatgaaaggggggaatgtgacggaatgagtgcgcctggtgcgaggccaacgatgcnnnnnnnnnncacccactccggctgggggtgacgaggaaagggggggaatgtgacggagtgagtgcgcctggtgcgaggccaacgatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaccggggttcatacagcgttcctcttaccatcaccacagcccatagaggtcagccgacgtctgctcgcaggacatccttggccagnnnnnnnnnnggaggcattaggggtcgacggcccagctacccatacctgcaccaaactctccaacaccccactgaacaagaggaccgaatctccactacactcttctttgagcccagtcacgcaccggaccaggtaggccctgctgtcgccacgctggcgcatgtccaggatttccaggccctgggcatactccagccccgcctcaaagtcctgcatcacgtcctcggccacatacctcgcagcnnnnnnnnnnnnnnnngactgcatagtctgcagtgatccaagcctccctgccctccatcgacagcagtcagccacagtgaccaccaaaacaacttggctacctcttcggagtcgtggaacttgaccagaaactccctgtcctccccctcattccggctctccaggactgccaccggttcgacatcctcgaaagtattatctggtggagtgagatatgggcgccgccaggttgaagggaattcctgcgcacagacctctccaatgccaccgggggtcatacagcgttcctctccccatcaccacagcccatagaggtcagctgacgtctgctcgcaggacatccttggccaggcagggatgtatccccatccttcgatcagcaactacgccccacacaggagccatctctgaccaacccccccacctgtcaaaaccttcaccacgtcctccaaggccatgcgccgcccgatgagggccgggttgttggtggggagggcctctcggagcccctccacaaggcccaggggactgcagacaaaggagtgttgaatgtgggccttatagtggtgtgggcatctgcagcaactgaagtgcagctgcaagatgctgccggaccttgcacgcctccaagtccacctaaaacacgccacccacctcctgccctgggcatcctcctgctccggatcggcacctgccgnnnnnnnnnnctgaatgtgggctttatagtggtgggggcaactgcagaaactgaagtgcagctccaagatgctgccggaccttgcacgcctccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtggaggtagcctgaggccatgtgcagcggagtgtagcctgccgaagaaagggaggggagggggttgggcccagagagcacaggcggacagagctgaacggcgagggatgcccacaagccgttggattttgttttcagtagggcagagcctaaagggaaaatagcgatttgcaggattggcaactaccagcacatgccaccttcaccccatnnnnnnnnnngttcagtagggcagagcctgaagggaaaataacgattttcaggaatgggaactaccagcacatgccaccttcaccccattccaataatcctattgtctccttgggtcaagccagctacccagaaacccaccagctctgtctggcaagttgacctccgctcccgcttggaccagggcnnnnnnnnnncaaacctatcgtctccttgggtcaagccagccacccagaaacccaccggctctgtctggcaggttgacctccgctcccgcttggaccagggccttcaccagctcgggtttcccgcgggcggccgcaaagtggagggccgaatgccgctcttcatccagcgtgcgtgccaggaccttgccgtcggcctgccaccgggatgcaactttgggtggtggatgcacaatggagcactgcacctgctccgctccttgcccatgagatgcactaggaaggcannnnnnnnnnagttgggtggtggatgcacgatggagcactgcacctgccccgttccttgcccatgagatgcactaggaaggcaacgcacgacatgccagcctcgatggtttcaaacactgatccccccaagaagtgctaggcgcccagcctaaggggcgccctcgaagcccttaagatggcgcccatgtatgggcttcaggcannnnnnnnnnagagtgctaggcgccagcctaagggacgctctcgaagccctcaagatggcgcccatgtatgggcttcaggcaggataaatttgcacctttggtcacagtacgacctccatgaaccctcctggccaccttcatcatggccagcatggtctcctcatcaccctggcgagcagcggcccaccacctgtcctcaaagtcgcggaggaggtcatcggccagattcttggcaggttccctgtttttggaaacacggtgttgaaggacaggcaatggcgaggggcacatatctgcctcggcaagcnnnnnnnnnnggggaaacatggtgttgaaggacgggcaacggcgaggggcacatatctgcctcggcaagcatttgctaatagtttgtgctaccaagctgatgagagccagtcagtgccccgttcttaagacatgtcgctctacatgccagcaacccacagacagattgtgcgaggagcatggctgacacggccctcccagcactcaccatgtgtcgtgggagtcgtcgctccaggccaccaggtactcgacgacaggcttctcctcgctctcgttcagcctgatgcccttcacctccgacaccttcagaatctcgtgagcagacctgcccatgagagcctgtgacttgcactgtggatgtnnnnnnnnnngtcacctccgaaaccttcagaatctcgtgggcagacctgcctatgagagcctgtgacttgcactgtggatgtctgcgggtgccatcacatctccaaatcctggttggcgagatccaagttgaccttgccctatgaatgggcaaggtgcgcaccccggcatgggttacatgcgggagcgacagcgcaggcatccgtgatatcagaccgatgaaagctcctcaactcatgcaagccgggagtaggttcggtgaaggagttcacagcaagatgttactacttcgatgacccgagtcctttttattcacagtattcagcctgtttctcgcttgtctcctgactcgtcgcaggcgannnnnnnnnngcacagcaagatgtcactacttcgatgacccgagtcccctttattcacggtattcagcctgtcactcgcttgtctcctgactcgtcgcaggcgacgggtgtcgagattttagctctatcggaaacactcccagcacgctcagcatgaggtccccatcattttgcaacctgcattcttgccaaactgagcagacctcgggaaactgcaacttagactctccattcgcatttccatacaatgcccacagctggacgcttggctgacaggctcaagcgctgcaaagctcattagcaattgctgtactttgggaggggtgcaacacagccccaatgcctcagtggatcattgtccccacttcagctttgagaagctgcacagcggcgtccagtcctgttgcattatgatgcactgtatttggtggtggtggtggggggggtcccttgttggaggggggcttgagggacattggatacagtgcaactgaatggtttgagcattgcagttgagaggggcctcctggtgtccaagaatggatcaacctcacattccgaagcaagagccccatcctatctctacaaaagcaagctcaccttcacacacagccctggacgctcgtgattttcgtgtttttgagatcctagctgtcttgtctctgccacctttccatctgnnnnnnnnnntggagggggccttgagggacattggatacagtgcagctgaatggtttgagcattgcagttgagaggnnnnnnnnnnttgacggtgctccctgtgtagctggctgggtgcacggggaatcctcttgggctcctccgtaggtcctggccattgattccaaggagccatgggcagcatgcctgcgtttctttcctggtcccagcnnnnnnnnnncaaagcaagctcaccttcacatacagccctggacgctcgtgattttcttgtttttgagcccctggctgtcttgtctctgccacctttccatctgttaatccggtgcagtctggctcaggctttgccgatgatcagtgggactccagggggcaaaggtgggtggactgaatagagaattctttgccggagtcggcagcgaagaacacggaagagaagcttgaggctgacggtgctccctgtgtagctggcggggtgcttggagattcctcttgggctcctccttaggtcctggccatcgattccaaggagccatgggcggcatgcctgcgtttctttcctggtcccagccagacctgactgtgagggaaggatcagttggccggaacgatgagcggcgctggcctctcttcctgtggctgtgccgccggacctctgcagagacctcctcccagggatggcctgggagttggccatgctctgcagacagatcccgcctccggcctgcattctcagtgctggcctcagtctgcctttggagaatgcggttcctccctgcccgagtgtcccactcgctcaacagcctctcgatgcgtccggcctctgcctgggcagcctccagtcgtgcagtgagggaggagtggagactctccagacgctgacaggctagtgtcacatcttgacaagtgggctcctctgagcaacggctgtgaggaggagaaaattaatggatcaatagtgacattgtaccgtaggtgaaccccgcactgtggcacttgttgcatatgcgtacattcatccctcacgtttcttttggtgaggcgtctggaactggctcctcaggcgccctattctctgcttccaacctacctgggagaccagccaatctgcgcagcagggggaattcactcttcagatgatgcatttgaagttatgctgagcctgcactgcatcaagaaccctctgcacctccagtccttgccatgccgtggtccctggcccctcatcgactcactgcccaatgatctgtctgcgaaagtctgcccaggcacggtccaatgactccatcagtgtactttttactcaattcgaattcggggagtctggtccatgccgattggcatcgcagcgatgggtgggaaggcgtcccctctcagttctcccttccttcgtctaaattcgcgccctagttctcagctgtgcggcgcgctcgcggacacagcgacttcaagccaccaccagctaagcaccatgcgatacattactcatgttgctaaaagccatttcactaatttctgccctccagtagagctgccgctagtgtctgccgtccctcacatccaccctcgcgacacgccagtgggcgcagcagtgccaccgcggagcgcttgcctggccacatccgcggcagcgtatccgccacagaatataggtgggcactgcctgctcccgcccgggcatcgagtactggaaactttctctgccaggaccggcgacacatccctcccagttccgtttgcagcctttcgtacttagacatgggtaaggcaaagcctgcacatcacaccagcgctgaactcagggccaaggccagggcggccacccagaatgtcggtggtggggcagcaggcaaggtggaccggttaggaggtcaggcaggacaccagaagtttaggtgggtgggagggatcaatgcttgccggaggaggggtagacacatgcgagcacaacagaaatcaggtggctttatacctgactggatgacatgttcaatcgcccatgactctcgcagtgcagcctggggccttccctgttgtgccctgcagtgcctggactgaccacagctcttctgacagccgtcactcaatctcctcaggtgcaccgtctgcggtcagagcgcccccgacatcaagaccgctcagattcacttcgaggcaaagcacccgaagatgccctgggaccccgtggcggccgtcgcaaatgtgcacgagctccatggcggagttaccacaaaggtgacgttttgttgttgtgggcaagcttctctgacagtgggagagtttgcactgtgctttggccttcacatgctgtgggcgtgattgccactcacccctctagatggcacaaggccatgccggagtgcctcaacgtctgttggtctttctgctgcccgacagctcaagggccgaaactcatatcgtgcactctaatgcacgctccatcatccctttctttccagggggtcgctgtccgtggaagcatgaagaagtgagaaggtcttgatggagacctctttcatgcacccaacaagcattgtaggcagtgtcctttagaccctcgacacttgctgagggtgcactgtccatcgtttaaactnnnnnnnnnncgagacctcattcatgcacccaacaagcatagtaggcagtgtcctttagaccctcgacactcgctgagggtgcactgtccatcgtttaaactgttccaggctatttttatccatggagatgctggtccttggcatggacttgcatcctgcaaaggcgtgcttaggcactgtaagcaccctggtgagccgccggattggtgggtagggtttccatggccggccgtacaccgtctcgcggcaacatctgggaggtgtcgcggacatgagcccgcagacatgcgcgattggaccccgatgtaccatcgtgcgagcccgtctgacatgggcaggctggcgcgggaatttcaggaacgttcgcgcaatgttcaaagcttccaactaaggaggtgttttcctaagtgccaggatcgtgctccgggtttcagggtacacgctgggaggaagctgctcatggtaagagaatgagatccgggcgcacgtgcacggcggtgcggccgtcggaccagattcccgtggtggccagggcctctgcaggccataaatgatgagggttcgggtccctgctgagtagcatcttcgtcgaggccacctcccaacaatcagtcctctttacggaagcggagagcgacggtgtcctcggccccgacgcgtaaggtggtgcctccgcatactagggcaatacttaaattttcagcccaccagatccagcccattccacaccaaagtcgcccatcattagatatcagacattagagcagtatggcttccccgccggtggcgnnnnnnnnnnattacagcccaccagatccagcccattccccaccaaagtcaccgatcattagatatcggacactagagcagtatggcttccccgccggtggcgtacgaggtggacaagtccggccacgacaaggagcagctgtcgggagtctgggagcgtgatacagacctggacgctcgagttgccatggcccagaacagggtgagaagggagaatttctcacccttgcaggaggaaattacaatgtacaccccagtactagatcctggaggtgctgggagtgcgcatttggctttgcaagaacaggatgcaacccaccctgttatccactccactctccatcctacaggagaagaagagacggggctggcccatgctgttgctggcgtggtcctccttgggcgtcatctatggaggcaagtgtggacagccttctttcccgggttggagagcatgtgtggcagacaggaatgggagttggagcatgtgcgcttccatcgggaaactcgcctctccaaaccgctcatcaaatgaatgtcctacaaccccatcgcatccttctccaccatgcagacattggtacatcgcccctatgtaagtcactgcagtcatgctgagagggacgagtttgtttgctctcgcccactggattctttgcgattgacactttacaacatcctaatgactccatgctcaagcccatactttgctcagacnnnnnnnnnntgagtttgtttgctctcacccactggattctttgcgattgacaatttacaacatcctactgattccatgctcaagcccatactttgctcagacacgttggggactctctttgctgacggtgctcctgatgatgaagaggagatcatggggaccttttcgatggtgtgccaccagggagggcgtgcaagctgtgaatccagagcaaagtgtctgctccacttccccttgccgtgctgcctggcaacatgtcgcatccttggtctcttgcctctcccagattttctggtacctgaccatcattgtgctgatcaagtacgtaacatttgccctacgtgccgacgacaacggagaaggtgagccaaggtgcctagctggcacgcggtgccttttcccatggaccatgtcgcagacagcccatttcctcgctggttagctggaaagggaggtggcctgaaatagatccttctgccgacctcgatccgccctccaatcccttgtaggtggtacnnnnnnnnnntctcactggtcagcaggaaagggaggaggcctgaaatagatccttctgccgacctcaatccgccctccaatcccttgtaggtggtacattcgcgctgtacgccatcataagccgcgcctgcaacctgaggtctggcggcgcgacccacacctccgactttgagctctcaggctacgaccccctggcatcggccaccgctccccagggctcagacgtggcacccgccccaaatgcgaatgtgaaagtgaggagcggcgccaatgcgcgtgtcaagagtgagtcgtgcccggagggtgcgctggtaccattctccatggcttcaggagggcatgctgcagaattgcgctactcacaactgccacgcccacccatcgtgtgagcaggggcgctggccacgagctctttcctgcaggttctcctgctctccatcacactgtctgctgtgtgcctcatcctgagcgatggcgtgctcacccccgcgatctcggtcgtgtcggctgcgcagggcatccagtaccagtcccacatatccaacggcgagttagggtctgttgggtgcaccttgagagatctcatgtggattgcgacggagggcagggtcggtgtgccatgcttcgagctgctcctgtagagacacattgcacccatgccttgtctttcaacttgatggtagcggcccccaagggtctgagtacttgccgctcgacatcaagcaggccatcaggaagattgtagactcatcattcccctctacaacagatgctgtggtggggattagcatcggtatcattgtcatcatcttctcagttcagcagtttggcaccaagaagatcaggtgtggtggtccatctgtactgtggccaggaagtaacccatgaccagtctctgcatgatgatggctgaaacaacatgcgagtcccctgtagtttgcatgctaccacggtctcgggtgtcttgctggacattcacagaatttgcagcttgctggtctccaagctcggtcaaccagaccctcaagctcccctcctgacccaccctgcagctacctctttgctcctgtcaccaccatctggttcctcgccatcgcggccgtaggcctgtacaatatcttcaaattcaggcccgcagttttcgcagccatctcgccacactacctgtactactactggaaggtgggtctgctgagaaggagcgtggaagagggctccgtgtgtgtttggcagatatttgcacaccagccgacaggacatactacagtatcgctgttgaaactccagactcaagtgcattgctttggcctcttctccatgccaggctggtgctcatgaggcatgggtgaagctggggggcgtcaccctggctctcaccggcgcggaggcgctgtttgccgacctgggtgagtttccggggcaggggaggtgagacggatgctgctcgtgtggtttggcattgagtatgtggggcatgccaggtggttgctcagcaagattggaggtctctgtctacacggtcttcttgcagaatgaggggcatttcagtcctttgataaacccattcactcctcaacaaaccgccaggtcatttcaatgctccggcgatccgggtgcgcagatacccgggcacctaagatatcactgagaatgagtgtcccgttccaaccagcgggcgtactgcaccagactccgccaaactgatgcgccctggccccgtgcctgcccctcnnnnnnnnnnaaatgagtgtcccgttccaaccagcgagcacactgcaccagactcagccaaattgatgcgccctggccccgtgcctgcccctcccaaaccacaacccccaccccttgctccctcccaagcgcagaccagcttcatcgcgttcgtctacccctctctggtgtgtgcctacctgggtcaaacggccttcatcatccacgaccgctcggcggcgcccaccgccttctggtcttccgtgcccaagccgatctactggcccatggtggtgagtcgccctgcattgaggaggggcatggttttgcccaggattacggtggggggcctggggttgcatgatctgacgagcnnnnnnnnnnattctgcccaggattacggacgggggcctggggttgcatgatctgacgagctggaggcgcttcgccatcccagggccgccgggacgcctctttgctcagagaggtcccggcgaccactccctccgctcccacctcccctccaggtcattgccactctnnnnnnnnnngctcctctttgctcagagaggtcctggcgaccactccctccgcccccacctcccctccaggtcattgccactctcgcggccattctcgcatctcaggccatgatcacaggctgtttctccatcgtgcagcaggtgccgggtcaggcagggatgcacctggtgtgatgaagtgtgttcaagggaggccttgcccgtgcggcatggccatccccccttggaatcgcagcaactccttttgccccaagatcatggtggcatgccagcctatgaggcacaatgacccctcacctacaggccgtggccctaaactgcttcccaagggtcaccattcggcacaccgaggcgacgcaccgggggcaggtacctgggccacttccttggtagaccccgggttggccactggcctgaccctgccatgtgcatcacaagcctcccccgaatccagtgccgcccacagatgctcaccctggggaacacgcatgcccgcagatctatgccccacaagtcaactgggtgctgatggcagggacggtgatcgtcatcggcatattccagnnnnnnnnnnagcccacagatgctcaccctgaggacacgcatgcccgcagatctatgccccccaagtcaactgggtgctgatggcggggacggtgatcgtcatcggcatattccagaccgggcccggcatcggcgcagcctacggtgagaggggatcgttcatgtgcctggctggcgtgacgcagccaggcaaagggccatgggctcttccctgcccagcagacccatacccttgcgcactggcaccccagcagcctccgacccctgcccctcaccaccatccctctccaggtctggccgtggtttccaccttcttcctcaccacctccctcctgtcactggtcatgctcgtggcatgggagtggaattggggctgggtgctcctcttctggctgccgctctctacgctggagggcatgctcctctccgccaacgccctcaaggtgtgtgttggcggcgagcattgtttttgtgatcgctggggcagcgtggctcagcaggcacctggcggactcgagcgagggtcgacgtgcttgagcggaatggcagaccatgggatgtggacagactgatgagcctctgggtctagaatgtagggcccagcagctctgagcaaggaaccccagacacccagcagcgctgcgctttctcacgacagactatgcggatgcattcaacactccaaatctcttccaacaggttcccnnnnnnnnnntggactcaagcgagggtcgatgtgcttgagcggaatggcagaccatgggacgtggacagactgatgagcctctggatctagaatgcagggcccagcagctctgagcaaggagctccagacattcagcagctctgcgctttctcacgacagactatgcgaatgcattgaacactccaaatctcttccaacaggttcccgatggcgcatggttctccttgggcgtcacagcgatcctcgtgaccatcctcgccacctggacctatggtaggcttgacaggggtgactggcttatgggaaggatgtgtcagggctaggctgaggtcatggctccttgggttctgcgcagaggctatggagggcgccacatgcatgcgctccttcacatccagtccgccagaaattgtaccatacaactgaatttacacaaagcaagccccgcgccatcctccaacccatcccgcatgccgcgccttgcaggccagaagctgaagagggggtaccaggaccagcaccgctcctacctgctcgacctcctccagcccgccgatgggccaggggccgggcccaccccggccctgcagctggcggggtccaggcagcggctgggcgtcgcgcccggcatcggcctgtactacaccgagagcctggcgggcgtgccccccgtcctggccttcctcctcccccgcatccctgccatccacgaggtgaccgtcttcctgaccgtgcgccacgtccccctccccactgtccacgcctcggagcgcctgctgctcaggtgggctgcaggtggcacgcgctgttgctgagaaagaggggatgggttcgtgtcagatgatgactcctctagcccagagatagtgagaatggaaaaagggcgcttggttccgtgtgtcccaatggctagaccccggtgtaaagcacggcagcctgctgtgacgccactctcttccctactacttgccgcaggaagctgcactnnnnnnnnnnggcaggtggcacgcgctgttgctgaggaagaggggatgggtttgtgtcagatgatgactcctgtagcccagggatagtgagaatgggaaaaggacgcttggttccgtgtgtcccaatggctagaccccggtgcaaagcacggcagcctgctgtgaggccacttttctccctactacttgccgcaggaagctgcactaccagggtttctaccatgctgtcgtaaggtgagccctggtcttgcaagcactgcctgcgttcctggccaagggggacagagaaaacctgaggggtcacgtccaaccaagcaaactctcagcccatccatccctttggtacatatctccaaggtacggctacatggaagctgtggaccacgacaagcagtttgtcgacaccttggtgcaggtatggacttgttccatgttannnnnnnnnngaggtgagccctggtcttgcaagtaccgcctgcgttcctggccaagggggacagaggaaacctgaggggtcgcgtccaaccaagcaaactctcagcccatccnnnnnnnnnnagttgaaggcagctgggtcacgccgaccttctaacaccatgcaaatttggaggctgtcgggttggcttcgcatggcattggactgaagtttcagcgctgtacagcgtgtggtcaactttccattcacattcattcaaaggaggttccccttacttccnnnnnnnnnntatcgaaggcagctgggtcacgccgaccttttaataccatgcaaatttggaggctgtcgggttggctttgcatggtattggactggagtttcagcgctgtacaacgtgtggtcaactatccattcatattcattcaaaggaggttccccttacttccggcctccttccatcacaacttccccaggagctgctggacttcctgtccccggaggtgatcaaggagtccgaggcggcggcggcagacgagggctcgccctccgacgtcaccctggggtccgccacgggccgcgctcgtcgcagcctggccgcagccgccaaggccatcgcggcggcccatcgcgccgcgacggcactcaaggccgtggatgaggacgcctccaccaagcaggcgggcaaggagctggtggggcaggacggcaaggacactccaggcctggccctgcatgtggaggagagggagggcgcaccctccccctgggtccagcagccctcacagttcaggtgagggaggaagaggggttcgtgggaaggacgcctgcgcatgtgtggggctatcctcttggggcacctgccgttgccacgctggtcgctcacaagcctgaattgagctctggcacccccctcacagggcctcgctgaggaagaggcacggcgccagcctgtcgaccgacacattccccacaaatggtactgtgcagggcagaaagggtgcatgcgtgaaaggaccagctggcacgtggctcctctgcaacgtcgctgggtgcattgccacaccctcgaccgtcccctgtctcaacctctccacccctccccggtcccatccttgcagcccccgcccagagcgagcgggcactggtgggcgcggcggctgggcacggcacgcgcttcatcttgggaaatacgcacctcacccctggcacagactgcggctggatcaaggtacgtgcagctggagccggggatgatttgcatcattatttgggatgcacatggcaagtattaccctccagcatgctggatccgataccacagaacacaagcgtgctggtggtctgtcaggcgctttctcaccgcatcctcagnnnnnnnnnnagcacagactgcggctggatcaaggcacgtgcagctggagccagggatgagttgcatcattgtttgggatgcacatggcaagtattgccctccagcatgctggacccgataacacagaacacaagcgtgctggtgacctgtcaggcgctttctcaccgcatcctcagccccgctctccgtcctcacaccaggcatttgtggtggagaccatgtacggcgtcctctccaggaacattcagagcaccgcccagacgtaccgcctggaccccgatgccgcggtggaggtggggatcaacatgagggtttagagccggcagcctggtgccaagcactcgtcgtcgctgtgcgccctggcagcgcaccaccacacccagccttggcccgcaccactttcagtattctgcacctgctctgtggcacaccgaatacctaccctcccatcatcatacctctatgctgtacccnnnnnnnnnnaagccttggcccgcaccactttcagtatactgcacctgctgtgtggcacaccgaatacctacactcccatcatcatacctctatgctgtaccccactgtagctctgctgccaatgcctttgcccttgcatgcccttgtgtagattcttcgagaccagcttgtgacatttgagatacgcgtgtgcagtgagactggcgactggtgatacatgtctttccgctgagtacccccctccccatgcacatgcgcatgcggtaaccattcacgagatgaacatgtcaaacacctccttgccctccttgcccagttccgtgaatgtgtactgcgctcccagctcggcgatgcaggtctggagcagcgccgnnnnnnnnnncttgagatacgcgtgtgcagtgagaagggcgactagtgatacatgtcttttcgctgagtaccccctccccatgcccatgcgcatgcggcaaccattcacgagatgaacatgtcaaacacnnnnnnnnnnagtcctcgggcgggacctgcagccccagcaggaccccagacgattgccggcctgcaagggggagaggtggggtggggtgtgggcggagctccctcacaggctccagccgacacattcctgcggcggcatgcgcccatcacacggtgcgcacgacccctcccacggtcaggagcagcatgtgccccggcggaccctctcagccgcccacctgtcctccggtagtggaagagcgtgatgttccagatgggggacaggcggcgcaggaagcggtacagcgcccccggcacctcggggaagtccacctggaagatgcgctcgtgcaccaactggcggccgccctcgatgcgcgcccgcccgcccaccaggtgccgcaggtggagctgcgatagggtgtttgatggggaggaaaggcggaatggacgggggccctgagtcctggtaagttgcagtgcacagacctggcagtggaatcactctgcgattcccagatcatcaggccgagcttgacgaatgcgctgtgcctgtcagcgctgccccctgcctcccatccttcagcccccccctccatgtccacacccccccacccccccacccacccacacacctgggccacctccaggttgctgatgtcccgcgtcgccaacccggcgtcgttcagccgctggacgacggccgtgcactccggggagtgcggcgccagggagatggagaacaggatgtgggcggcgtcggcgctcgagtgcctgggtgggtggcgacgggtggtttagagacatggggaacaggcatgctgggagcaagctgcagctcatgaggcgagccatcaacagccccggttgtgctttggcctgcagcagtacccagcattcctccgtagtcaggcccccctcaaaggcctcaccggtacttgaactcggtgacgnnnnnnnnnngcgagatgggagggagggggttgagtatgatggtgttgattgtggaggaccaagttgcgcacacatcgggcagccctcccacacggttttccactcccatccatgagttccctcgacacttgatctcccgatcacaacaccccctgccaccccaccacccattccctacacaggccccccatcaaacccacctgacacgacccgtagctggtcgaagttcatgttggcccctgaggtcaccgccaccaccgtggcccccctgcccnnnnnnnnnnctgtgcttttgcttgcagcagtccccagcattcctccgtagtcagccccccctcagaggcctcaccggtacttgaactcggtgacggacaccgggctgccccccagcgcaatctccatgaagtttaaaaaggctccgcggtcctctgggatggtggtgaccagcatggcctccgccccgcccccgatgtcagccatctctgtgcacgagatgggagggagggggtcgagtacgatggtgttgatcgtggaggaccaaggtgcgcacacatcgggcagccctcccgcacggttctccactcccatccatgaaatccctcgacacttgatcttacgatcacaatagcccccgccaccgcaccacccattccctacacagcccccccatcaaacccacctgacacaacccgtagctggtcaaagttcatgttggcccccgaagtcaccgccaccaccgtggcccccctgccctcgggccggcgcaggaaggccttggcccctgccaccgccaccgcgcccgccggctcaaggatggaccgcgtctcgttgaacacgtccttgatggcggtgctgatggccgcgttgtccaccaggagcacgccatccaccagggcccggcacaggcggaaggtctccgcgcccacctgcttcaccgccacgccgtccgcgaagccgtccacgcgcgacaactgtacgcgccggcctcgcgccaggctctgcgccatggcgttggcccccgccggctccaccccgtacaccctgatcccaggcttgaccgccttgacgtaggcggcgatgcccgcgatcagcccaccgccgcctgggaggggtgtgtgtgtgtgttgatgtgtggggtgggtaagtgggtggaagtgtggagagtctgccttcatgcatgcctgagggtgtgtggtagaaagggcaccggaagaccacggtcacgaacggagccggcgatgcagggccggttcatgggggggggggcctgcacctcgaacgcgcccccggtttcccattcaccctcggccccccccgcctcacccacggcgacgaagatggcgtccagggagtccatgtcggtctggcgcaggatctcggcggccaccgtgccctggccggcgatgacgtaggggtcgtcgaagggcgggacaaaggtacggccctccgccgccgcgcgcgcctgggcgtgtgtgttggtttcgccaaacgtctcgcccaccagctccacgcccgcgcccagggcacgcaccgccgccaccttgatggcgggggtggtcactggcatgcagatgatggcctcgcagccctggaaaggagggaaggggggaagagggagtctgggagagggatgggtcaggaggggggggctgagggcaggatcagcagagaccgaaaagacttggggctagaaatacgcggccagggaatgggagtcatgatggcactgggccgcatgcggcaagcgtgtgatccagggcatgggtgccttcatctggactcccgacgatctttcagccggcccccttgggccacctcccccttcctcctcgccctgcacacccctcaccannnnnnnnnnatggactcccgacaatctttcagccggcccccttgggccacttccctcttcctcctcgccctgcacacccctcaccagctgcttggcggagaatgcgacgccctgcgcgtggttcccggcgctggcggtgatcacgccggccgccagctgctctggagtcagctgcgtcatgcagttgaaggccccccgcagcttgaacgacttgacgggctgtggggtcagattggacaaggttgtgcagggctcgagtaagatgggaaagcgagaggggtcggacgagaaaagggggctccccagtcaatgctgaggatcaggagacggcgccacacgatgctccgtaccatggtcacccactaccaagcaggaacacacctgcaggtcctccctcttcaggagcagggtgctctggagtgcctggctcagctgggtggcaggctgcagtggggtctccacctgcggcgcagaggaggggacacgtcgtcctgactgcaatgccatcggctgacccttgtcctacggctaggaacctccggccatttccggcacatgagagcagaaaaaggtttggccgtgaccctcctcactgcaaaggactccaggtccactcaccacgnnnnnnnnnngggcacatgagagcagaagaaggtttggccgtggcccctctcgctgcaaaggactccaggtccactcaccacggcatcgtagaccttggccgtcaggatttcgcgcaggtatcccccaggttgatgcctccacgccgtgtcaaaatagggactctgaatcaggagatgtggtaggctgccttcggggtagagtcgttgatgccaggccctcttccgggaggcatgccgagtccaggaaacaaccccgatactcctcacagcatacacatgcacgctggggacccaccggcgtccagtcgtccttggggtgagctccaccggtgcgattcacggtgctaatctgaccgggagccagagcataatcttccggggccacagtcaccgccgcatcctcgaggacatccctacgagctgcgctgacaggcgtggcctccgagcccaccagagcggcgcacgcgcatgcacctctcactggatttgcatgccggccctgggaatgcnnnnnnnnnnctagtaaacaggagtgtcgaacagcatttatacacaatgaacgtagaggggaatagnnnnnnnnnngacaagagcggcgcacgtgcatgcacctctaactggatttgcatgccggccctgggaatgcgccagggtgcatgcgccgcttgcacgtcgggtaaggacatggtgggagttggtagtgtgcggtcgcccactgggcgccaagttcgtgctcgccaagcacaccgccatccgggcgtgcnnnnnnnnnnnnnnnnnnnnnnnnnnnnnnnnnnnnnnnnnnnnnnnnnnnnnnnnnnnnnttcctgtcctcgtgctggtgataggagcacgtgctctgtacagtccgggcgcgatgagggctttgttcaggtatgtccagtattcgtaatctcgcactgcgacgcgccatgacagaaacaccaagccccgagccaacaagtggtggtgatactctgctgttaatacatgcattatatactcttgatttttatatactcctgatattcatatcctcttggagatgctggaaagcnnnnnnnnnnggggatgtccagtattcgtaatctcgcactgcaacgcgccatgacagaaacaccaaggcccgagccaacaagtggtggtgatactctgctgctgatacatgcattatatactcttggttttttatatactcctgacattcatatcctcttggagatgctggaaagcatgtctgcattgttacaatgtccaacagcgctacttgccaatgtagcccactggccgcttggtcccgcactacactggacatgagatttttcacataccctcctctttcgaacatactagtttcatggccgctgttcgttgatccgctatcgggttcccgcacaatttaccgcatggccgtgcccagcaatcgcagcccgccacaccagcacaacagcttgccggactggcacggctgaatgaatacagttcatagatgcaccggcttgcccttttgcactatcgagaaactatttgctgatcagcatgactttgtgtcgctggcatggggtatcaagaggtcgcgatcccggtccggagacggcgcctcggcgggccgcatggaccggttcccattgattccgtcgacaccgggacacttaaagatacaaaatggctctggaacgcatgatggctgtacattgactcatctgcggaatgggaggacaatcatccacagcgcccttgtgacgttgcgcgtcgctcattctaatcgtcgccctgctcgcagggtgagtcgggnnnnnnnnnnaagtccttctcctcccgaggatcctaccccggaggaatcaccgtctccaccccccccccccccccctccccccccccccnnnnnnnnnncaacaatcatccacagcgcccatgtggcgttgcgcgtcgctcattctgatcgtcgccctgctcgcagggtgagtcggggacggagagttgacccagtcaggcctgcagcatatcctgtggtcaaatgcctgcattgcctcctgcgcctcttgttcctgcagtgtatataccaccgtccatctcgaccttcatgcagcgctgcggccgggttgccccccagtccttctccctcccgacgatcctaatccggatgaatcaccatctccagcaccccccctcccccgttcccgcgctccggcatcccaccctccatccctcactctccgtcgccctcaccctccctcactcccccatctcctccagccccagctcccaatgccttgggatcgccgccctttgnnnnnnnnnncctttcccgcgcctcggcatcccaccgtccatcccttactttccatcgccctcaccctcccctactcccccatttcctccagccccaactcccaatgccttgggatcgccgccctttggttccccacctccttccccaccaccgccacacccctcctcaccaccacccactttcccaccattatcccctgagtttccacctcccaccgagcctccatcgccgagcccaccacctccacccagcccggctgtggcaccccagcccttcccagacacccttgcctcccccagtctctgccagcnnnnnnnnnnaccttccccaccaccgccacacccctccccaccaccccccacattcctaccattaacccctgagtctccacctccccccgagcctccatcgctgagcccaccgcctccacccagcccggctgtggcacccagccctgcccaaacacccttgcctcccccagtctctgccagcagatgcccgggagtggcctacgacggcttcctgttgggctgcctggtgtggatggacaccgacggcgaccgcgccccctccctgggcgaggagcagaccctcgtccggcgcggatccttcgtcctgggcaccgcccagcccagcggcaccctgcgaatcgtgccggcttcagtgtcgggcaacctgaccctggcgagagcaagggttggggtcagggaccagcaggattgaccctgggtgggnnnnnnnnnnggtgtcgggcaacctgacccaggcgagagcaaggggtggggccagggaccagcaggattgaccctgggtgggcctgctgcatggtgaaggggactgagtcacacaaggacccggtcctgctggtatggcgtgtgcactgatgccctattcccaggccccctccgtcccacgcaataggtggacagctacaacagcctggacacctgctttgacaccgccaccctctggccggagacgctgcccctggcggcgccccagccctccgactgcagagccaacatcaccatcagccccctctccacccttgctgtctacgccaactccagcagggccgcgctgcgcgacgacctgggcctggtgccggcccccatggacgcctacaacgcctactcggtgtgttggccggggatgagtcattcagcgctgcaggttgccgtcccgcaggggctacaggatgcccaggctctgcagctgccgtactccctgcttaagctagaaaaccagaaaacgtagtcatctctcgtgcgtcaggcgccaatcttatgcccaccctctgttcatgtgaaccttgctctcagcgcccgctccttgccggcccccattcctcaggcggcgctgctgggcaacagcgacgctcgcgccgagctggcaaaagaggtggaggtcaagatgctcatcctcacgtccctgcagctgctggtccccggcgcaagcgacgccgagtacaagcaggtagagggtggtggaaggaaagccaagagaaaattgaaagcaggagaggggtgcatcggcgcgactcatgcgctgaggtggagcgtgccccgagcgccgccgccgtccgagctccaccttggcacatgcgcgcgtgcctgggagccgcagggtttgggtccttttgctggtggctggggtggccacggcccagcgccccccccccttccccacccaccccacaacccctcatcgcggcccctcgcagagcgccatccccctgttcgagatgctgggcaacatgatccttgatcggccgcggcggcggcgcagtctgctgaccggcggctccctggatctcaccgacgccgacagcattgccagcttcctgagccaggcgcaaggcatgctgagcagcaccgccgccaccagcagcatgagggcggtgggttgggtaccctgctcttgggacgccacgcgtctggccttgacgttacgtgcacgtccctgtccagttgcgggccccgaggattctggacatgcattggctcctgctgcagccgccgcaagtcctcgaaacacgttcaccgccttcgcttccatcacaaccccctcttgcagtcggtggccaaggcggtggcggtgctgatcaagtacaccgactacctcctgtcggtgaccgacgtccagaaggcgtcctccctggcgcagtccctgctcctcccggccaccgccgcgctgcaggagggcagtctgacgccggccgagtttgcgcgagccaccaacgccacagccattgcactcgcgctcagcggcgccacgctggaccgcacgctgtggggcaaccccacgccgggcgaggacgccaccggcgagcccgggatcatggnnnnnnnnnnagcgctcagtggcgccacgctggacggcacgctgtggggcaaccccacgccgggcaaggacgccaccggcgagcccgggatcatggaggggggacaggggggtggcaaccacgccaagctggtgggaggcctgctgggaggtgatgcgcttggatggtggtggtgtgtgtggcgtatgaggcttgagaaagggtgcccccctgcttgactttggcgcgagaaccattttttccccccgacgcacagacttccaactacgcgactcatcgaggccgccacccactcccgcaggcattnnnnnnnnnncggaggtgaggcgcttggatggtggtggttatgtgtggggcgtatgaggcttgagaaagggtgcccccgtgcttgactttggtgcgggaaccattgttcccccccgacgcacagacttccaactttgcgactcgtcgaggccgccacccactcccgcaggcattctaggcggtgcagtggtgctactggccgccgtggcggcgcacctggccctccagctgtggcatgcgcagcgcaggcagcagcaagggcccccggcgtcgccggcgagtgctgcacccgtcgcctccttcaccctggccgccgggcagccagcgctgctgaccagcgccaagctggcgcaggggccggaggccacgagcaagacctccctcggcgccctgatgccacggccgcccggcccagatgcgtccccttcggccgcggccggcggagttggcgcggaggagagcgcatgaggaggagccccgtgaggtggttttggcgaggaggtcgcctgttctcgcttccatnnnnnnnnnngcgaggaggagtcccatgaggtggtttcggcgaggaggtcgcctgttctcgcttccatggaatcttgcaggagaaaacattgccctgccctcgaaacacaacctgctcgccaggcttctggccctctggccaagtgcctctcttaaacccacgcccccccccttgtgcctgccgtaagcgcatgcatgcatgactgtcacagaggnnnnnnnnnnttggccctctggcgaagtgcctctcttagacccatgcccccccccttgtgcctgctgcaagcgcatgcatgcatgactgtcacagaggtttcgccttgaacacggcgatgggtgtgaaaagtgcagtcaaggaccgtcaggtggtggcaatggtcgtcatagagaaagagtatcagacagggatggcggccaggtggtcgaggggacggcctcattcctgctccagggcagggtgtgctggctcgtcgcgtctgccctagcgcccctcggacagctggcccgcgatctgggcgaggtcgacgcccatgaagcgacgcgtctccgccaggccagtcacgcagacctcgtccacggcagaccctggccatgtgtcgcgcagggacagcgccacgttccctccctgtgacggggtgggagagtgtgcatgcatggggagggctcttgaaattacagcaaggcacctgcaaagcggcaaagcagcacggcaccnnnnnnnnnntgcccatgaagcgtcgtgtccccgccgggccagtcacgcagacctcgtccacggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcgcagacacacccctgccaggctgaggctcgcgtcgacgagagcggtgtccgtcgaggaggctgcnnnnnnnnnncgatggggtgggcgtgaagggagcagtcagtccagagggatttccagatgtccagagagcccctgtcggtgcgcttcagcctgcaggcagctgnnnnnnnnnntaaaggcccggccagcgcagacatacccctgccaggctgaggctcgcgttgacgagagcggtgtccgtcgaggaggctgccgggcagctgctgagcaagtggcgtctgtggccatgcccagccacggtccgcatgatctcctggacctgggatggggtgggtgtgaagggagcagtcagtccagggggatttccagaggtccagagagcccttgtcggtgcgcttcagcctgcaggcagctgcttgccgtccctccactcgctaagcacgcccctgcccggcgacccctcaccatactcgatctcctgaccccccaccagcagtattcccaagcgcctaccgctgcagggagaggcatgccggccagtgtctcgggcaggggcacgccgggcggctccagcgtcgcctgtgtcacgcgcatcgcgccgtccagacggagctccgcctcgtgggtcgcggtgcggcagggcagggcgccgaggtcgtgcttgaggccgacggcgacggtcgggtatgcggtgaccagtcgtaggcggatgctgccctcccggaagcccaacacgctgacgccagacagggcgcagcacagctcggttgcggcggccgccctgcgtggatgggtggttggcaggctctttggtgctttgtagggaagaggaggttgggtgtacgtgatcggaggggcgggggcggcaatccgggccaggagcatgccaacgaagcaccctcttgcctccgtgtcatccagacgatcgaaagtatctctgtctaggaccacggaatccctgccaggcacactagggtgcctgtcgagaccaggaccgctcccattgacaaaaaaaaaacccacccctgccctcacgttgacacacgaccccaacnnnnnnnnnnacaggcacactggggtgcctgtcaagaccaggaacgctcccattgacacaaaatctccccacacctgccctcacgttgacacacgaccccaacagccccctcaccagcggaccaggtcggcgcagtggtcggggccggcgcgctcttgaccccggcgcgttcggcgcgccgccaggtcgccggcacgcgcgctcaggccggaggcctcgtcgcgcgccgcctgtgtggccgccagcgcgtcctccgacgcggaggccgcggaggccagctccgcctccagccgccgcgcctcctcggaggcgacggccagctcgcgcgacaggcgctccagctcggcccccacctcctctgcccccccggcggcgccggcatcggggtccgccgggccgggcgcaggggggagagcggccaggcgccccgccaggtcagcgccgcgcgacaggagctcggcccgccctgcacagacctcctcgatcagcccctcgatctccgcggtcagtgccttgttccccgccttgaccgcctgcaggcgggccacagtggcctccacctcggcctcgaagtcggcgagctggtcggcctcagtcccggtggggagaccctcgatcagggctgcgagggagggcgccattttggaaggcatgtgagagggttgtggggggggtcctgagcatcctcctggaggaacaaagtggaagttgctgcggacagtacatgtccgcactggccgctggtcgagtcgggaaggatgaccagctcctggacattcctaccgcgaggccctccatccaaaaatcaagtgcctacatgtgatgaaggactccttnnnnnnnnnncatgaccagctcctgcacattgctaccgcgaggccctccatccaaaaaccaagtgcctacatgtgatgaaggactccttgacctcaaagtgcaggaagctgttcttgaggctgccgaactggcgcttgaggcgacgaagatctgcctcgcccacctcatccgtcctggcccgggcggcggcctctacctcgtcaaacctctgtgccgtcgttgcgagcagtgacgtcagggccctgcgcggtacagcggagggggatgtggctcactggaggttttcccggcaaagtcactggccttgggagtactataactttcacaggcagaattgtattcctaggcgctaaaatgaaacatgcatcggacttgcctctcgatggcctccccactgagctggttggatgcctctgccatcccgtcgggcccatctggtgacagggaagcttggtgcgaggcatgcccaaagnnnnnnnnnntgggaggttttcccggcaaagtcactagccttgggagtactttaactatcacaggcagaattgtattcctaggcgctgaaatcaaccatgcatcggacttgcctctcgatagcctccccactgagctggttggacgcctctgctatcccgtcgggcccatctggtgaaagggaagcttggtgcgaggcatgcccaaagctgagcctttttgtcaccgcggggcctatgacttgcgccatatcttgagcgttgatgaaatgagatggtcgccctgcgccttgaggggaaaggtcgtcttttagtgagtcgaccaattcgacagccagcgagtttccaatttgcgcgccctgaaatctggccggccgcgaaatgacatgcacacttccgtaatcccaacgtaccgagtctcagtctcccaacttcgttgcggacatcatcggcggtctccactcaaacacagggcatatcacagcaccaacatcctcaagcgtgtccccaggaacatcacagcatgggcatcgactgcaacctgcgtgaccagcttaccttctatggcagctttcacacgaacaagtggaaccagctcattcactttgtgtttgtgcccgtcatcttttggtcgttcttagtgtggctggcctacaccccggaactgattgcttatgacgtttacaagcacctgccttccgggacccccgcctgggcgctgactgtcgcgaggtgagcctgcccgggtccgggaagtgctaaggaattggacgtcactattcaaggctcaggatggcgtgccatggaataaagaactgtgacgctgatcgacctctgcctcgtgtaccggtcacgaggagaggctgactgatcgtcctgagctcctccccttataccatgtagnnnnnnnnnnatggacgtcactattcaaggctcaggacggcgtgccagggaataagaaactgtgacgctgatcgacctctgcatcgtgtaccggtcatgaggagaggctgactgattgtcctgagctcctccccttataccatgtaggtacctctcattcaacggggccttcgtcatcaccgccctgtatggaacctactacaccatcctggatgcctttgccggcctgagctggagcctgtgcgtcggcctccccgcctgggcaggggcggtggcgttccgcacccgtgtgccaaatgcgtgggcctgggccatcctcatccacgtgctcagctgggtcatgcagatcctgcccggccacatctgggccgagaagcggcgtcccgctttgctcacatccttcttccaggttggttgcaggggtgcctgagattgggggggccagtggcaggtgcagaagcactcttcgcccatcgcagcattgtataacgtgtcccttcccattcaccaacatgcccttcactaccctttacannnnnnnnnncggcaggtccagaagcactcttcgcccatcgcaacattgtaaaacgtgtcccttcccagtcaccaacatgcccttcactaccctttacatctcccccaatcgtcttcctgcaacccatgcgcagagcgtagtgctggcgcccctcttcgtctggtatgagcttctgttcctcctgggctaccgaccacagctctatgccgacatcaacgcccgcatccagaggaatgtggcggagtacagggccgcacagcggccgctgctagcatccgggcagtagctgtgattgcgtgacaccagaacactatgtttttgtcattttttacgtgcatgaatccaaagtgacacttgaatccggccatgtggcagatgccgatgcgagcgagggcaccccagtgccaaatcacagtttcctttttttgtcttgatggaggcactcttgaccttagctttgcctttcagaatgctttttcgcctatgccctgcccatctctgtcagagtactgtgctcagattgtgtagcacccgctggcatgccacatacagtcaccgagtggaatgccaatgacaaggggcaggccaccccactcatgccacactcactgcaaaccccaggctctccacggcttccaccagctctgcctcgctggtgctgctgtcgaccacaacctccgccagccctgcctcgagattcacgctggcctgccatacaggttgggcggtgcgctgactcagcggcggactcctggagacgagcggcaggacatcattatactttgcaatgcagaagcctgatgcaagggaaccttccggtaccaaccagccacgcttgccatgccctcaccgtttccacatctgagcgctggaccagggtgttctcggtgcggctgnnnnnnnnnngttgccatgccctcaccgtctccacatcggaccgctggaccagggtgttctcggtgcggctgctgcaggcatcgcacaccatgccctccacctgaggataggagaagggtagcaaggcaggtattgaacatgtgctgggagtatgcatcccacagatcccattgcacagcataagttatgtgtagtgagcagagcacccccctcatgcaggcctgcttgccttgaggaccaccgttttcttgggtgcatccgaggtgactgcatccttgggacctgaggcatgcacgatcatcgacgcatgcctgggcacggtatagcggacagagcaaggcgaggagtggggccggggtgtggggttnnnnnnnnnnaacctgaggcatgcacggtcatcgacgcatgcctgggcacggtacagcggacagagcgaggcgaggagtggggccggggtgtggggttcgccatgcgcgccggtgagggtgtgggcatgttgcccacagggacccccctggcatgggatgggatgcagacgcgcgcgtgcgtgtgcatcatgtcgaagtctgcgcttgctgttcgtggctttgatcaagagtatagggccaggcaatacattgtatacccgcgtcctgatgctggtcagtgacgggatggcnnnnnnnnnnacgcgtgcatgtgcatcttgtcgaagtctgcgcttgccgtttgtgactttgatcaagaggatagggccagacaatacattgtatacccacgtcctgatgctggtcagtgacgggatggccatgcaggtaccagtcggatgtcgtcatgaggcccatgctgccggtatcggcatttcggtcgcgtgcaccgacagcatagtgcatccacgattgcgccggtatgatacttctccagtcgaatacccttagagggcctgtgcaggccgtgatgtaggcccaggtactcccgacggccatgttcctgaggcccaggcgctcgcaggtgggagtctccacctcacacaagcgacgcctgctccggctcagcaacccccggaacctggtggcggccctgaccctggtgaggctggccgaatgtgtagctgcatgtcgactcaagggcttgtaacgtgcgatcaagtatcaaccaccacacatgaggggccccacatttttccaaaatagacgctggtgggcgcctacctcacctggagcctgtctgccggcctcgcctgcgtcggagactgcccccgcgctggcccagcctctggcccttcgcccccggagggcggggtctccgccttctgcgacgaacactttggatatggctggctgcggcgctggaacgccaccgccgcgccccggtgctggacggcggagggccacctgccagggtcgagggtgacctgccgcagcgtgcgggatgagcacatgcccgcggcctcggccccgcacgccatgtgcgatgtgcagggcctggtggtggacacctcacgcatggtgggccggcgccaccggtgggaggaggtcgagacttggccctggcgccgaccccttgccagggcgtccagggaaaggactggatgtgtagccctgggcccccctccacctcccatcaacaccaccagtgaccacccccgcttatggtgtcacaatctttgctccccaccctatcgcagacccgcgcccgctgcccccggcaccgccccggctacctgtgcgagacgcccacctaccatcgatacgggcagggcgcctttgagctgggctgcgactggccctccttctccctggccgaccacagccccgaccacggtcgagacatcttccaggccatggccgccggggcgcgcggctggctctcgcccctggtcctgcgcgacacggcgcccgagccgcggcccacgctgtttgtgacgcgcgaggtacgggagcacgccaacctgttccactgcctcacggacctcttgaacgccttcctcacgctgcgcatgctgggctggcagacctggggcgtgctcctcctggacgaccacccgccggggccctttgacgagctctgggcccgcctgcatgcgcgggggggcggggaaggaggggacctggtcctgactggcggagcaaagttggcccccgtgccacgcctgtccgacatcacggcaagcaaggagggagagggtttggggactgaagggtgcgggggggctgcatgctggggcgatggggtggctgcgcgccgcttccaactcgaggccatgctccagtgcccaaacatgccggccagcgacaccctggcctggcaggcggggaggctcttggaggctcaccgaccctcccaccactgccgttgaaggccctctccccccacattccaaaatcctcacagggccccaagcggccgctgtacacggccgccgccttcccgcccccggggtacacctcgctgctctttgcccacctctacgagcccagcagctgcccgcaccccaccccgctcttcgccgacttccgcgccttcctgctgggcctcttcgaccccgcccggcgcaccctcggtcggccactcgccgccgcggcatccgacgcgctcgacgtcctggtggtcagccggcgccccgggcnnnnnnnnnnccggcccctcgccgccgcggcatccgacgcgttcaacgtcctggtggtcagccggcgccccgggcagggccgacgccgcgtggcgcgccaactggccaacgaggaggagctggtggacgcgctgcgcgcgctagatgggctggaggggcgggcggtggcggtgcacctgctggacctggcggggctggccctggagcagcagctggcgcggatagcgcagaccgacctgctggtgggcatgcatggggcggggctggcgcacgccctcctggcgcggccggggacggcgctgctggagctctggccgcagcccgagggcatctggcgctgctatgagcactttgcggagtgggcgggcctgcactacgggtgaggcacgggggcctggttgtttgcggagtgtttgtggatgcaaggagggagggagggatagggtccgggagcggtgcaggcggcctggtgattcaaaacgcagcgtcaacccaaggtgccgggtcatgtgccgggcgaggtccagagattcacatccatggcaaggatccctggcaagaaccccacaacccccattccctccccacgccaggcgctgggccaaccccgaccccagcaagcaccagaagaggggccccaccggtgacacgacggaggtggatgtggccgctgtggcagagctggcgcgacagctcctcacccaggtggtcgcctcgtcgggtgctcgccagggcagctgaccagatcggttatggtgcattgttgatctgtattcgatgatgttgctctggccatccatgctctcagtattctcacaaggaagctctgagactgtatgcgttcagcatgaaacccagcaattcagtcagcaaggagaatggacgtcggagtatcatatttcgggaaagggggaggggaagaagtcagcatgtaaactcgaggtcttggagccagcatggctctgtctggtgcacagggnnnnnnnnnncaaggaggaggggaagaagtcagcgtgtaaactcgaggtgttgaagccagcatggctctgtctggtgcacagggtcagcagggcacgcttgtgggcaactttgtcgcgcccggcagttcgacgcacgcaccctgcagccagccgagcgagctgccctcggccctgctccaggcggtgaaggcatctgggtgcgcccggacctcccggaccagatcctcccgggcgatccagcgagtgcccgccacttcagcggggtccacctcaagcctgtcgccccgccaccctgccagcaggtagctctgtaccagctcccgatcgtggaagtcgtgcagcttgaggtcccgcaggtgcgtcggtgccaggggaccctggaggtccgccctgtcaacactgatgcccagctcctccttcaggccccgcacagcagcctgcaggtgtgccgaccaggtcacgcataattatcatattgtatttggacggcagatatcaatgcctaggtcccgcagtgcctggcagtgtcccaccaagccctgctcacctccacatacacctcccccggctgcaagtgttctgcgaccgacaggtcccactgccccggccccattttcttggcgaggctacgctgctgcagcaggatcttgccctcggggtccgtcacccagcagtacacagcgcggtgcagcaggccccgggagtggcactcagcgcgaggggcggtgcccaccacccggtcgtcctcatccaccagctcgaatatctcgtcctcggcatctgcctgacccaccattattctgcaggggtaattaccatatttgtgaccgagtgtaagcccgccttgcccttttcaggatcccactgatctgagatgtcttgtcagcgcgctgtcggcattggcgtgaatgcgcgcaaggcacacacgagatgagcaggaacaacaattagaacagcacgagcgcggtcgacatgctgttaccagagtttcgtgtttatacaatcatcgaggatgggcgaggaggccgaccaccgactccctattacgaacgggcagaagtggtccaagaggggtccgtaaacattccaagatctcatgcacatggactcaatcttacggtattaaatcacccatgtgcatcagggactggggtagggnnnnnnnnnnagaggcacacacgagatgagcaggaacaacaagtacagcagcacgagcccggtcgacatgctgttaccaaagtttcgtgtgtatacaatcatcgaggatgggcgaggaggcnnnnnnnnnnccagccgagaagaggtttggtggccaatgtcatgcggcatgtcattatccaggtggcaacctcctcctccgagttacccatgctggggcagctgacagaagcactcgtgcgcaagacacatccctggccagccatgcaatcaatatattacaaacaaattctgagaatgaaagaatgcaacaaaaacattaagcaagacacttagaggggaaaacctaagtcgttgacttatttggggcaatgtagggggaaaggtgatgtcacnnnnnnnnnngttcaacaaaaacattaagcaagacacttagcggggaaaacctaagtcgttgacttattcggggcaatgtagggggaaaggtgatgtcacgatgtacatattcagtcagagccagctgggcgccatcttaggcgttggttcagtagggcacgcactggcgctggtctgtcatggtcggtagctggccacacgcaccctgcagccagctgagcgagctgccctcggacctgagccaggggttataggcctctgggttcgcctgggtgtcccnnnnnnnnnnccagtcagagccagctggacgccatcttaggcgttggttcagcaggacacgcactggcgctggtccgtcatggtcggcagcttgccacacgcaccctgcagccagccgagcgagctaccctcggacctgagccaaggggtataggcctctgggttcgcctgggtgtccctgatcagatcctcccgggagatccagcgagtgccctccacctcaacggggtcaactgtgagctggtcaccccgccatcctggcagcaggtagttctgcacgagttcgcggtcgtggaagttgggcagcttgaggtcccgcaggtgcgcgggagccaagggccggaggtctgcccggctgacactgatgcccagctcctcctgcagcccccgcacagcagcctgcaagcgatgtgaccagggtgacttgagccttgctgacacaatttgaaaccagagaggtcaagacctcgtcctcgccatggcccagcannnnnnnnnnacgcacagcagcctgtaagcgatgtgaccagggtgatttgagccttgctgacacattttgaaaccagagacttcaagacctcgtcctcgccatggcccagcaccgtccttcaagctccgatctcacctccgcatactcctctcccggctgcaagtgttctgcgaccgacaggnnnnnnnnnngccccgccccaacttcttggccagactacgctgctgcagcaggatgttgccctcggggtccatcacccagcagaagacagacttgtgcagcaggccgcgagcgtgacagtcgccgcgaggggcggtacccactacccggccgtcctcgtccaccagctcgaaggtctcgtcctcggcacctgccggagccaagatggtcactgagctgttgaaaccatacttgtcaccgatgggaagcaggtttggtaactttcggtgtgtgtaccgatgatctgaaatgtgtcctggtcgcgccgtcgcgtgcagggcgagggttgcgtacgaggccctctgcccccaaggccctcgaacaccggtatgagtcctgaagcttgccattgaaagatcaggctactggaatgatgggggaatgatgtctcaacggagtacatcgtgcgaatatatgtacgtggccagtttcagggatccctcccacccaccacgcgtccgcgctgtggcgcagggggcactacgggtgtccggagctgctgccgaagccggggcctggggaaggccacgatgcacataaggagttgcnnnnnnnnnncgtgtgtgccgatggtctgaaatgtgtcctgatcgcgctgtcgcgggttgggcgagggttgcgtacgaggccctctgccccgaaggccctcgaacaccgatatgagtcctgaagcttgccatcgaaaggtcaggttactggaatgatgtctcaatggagtacaccgtgcgaatatatgtacgtggccagtttcggggatccctgccacccaccacgcgtccgcgctgtagcgcagggggcaatacgggtgtccggagctgctgctgaagccgggacctgggaaggccacgatgcacataaggagttgcataagcagctggtgacatacaatcggagggactggggaaggttcgccttgggattagtgatgtgcgtaacgatatttgggttgtcattgcgagttgtcattggacgcaccctgccttccggttctcgccgaaagtgagcggccttattctgccaatgtgcaacataccctacaggctgtcgagtagtacaccattaaaacgtcacaaatggttttccaagaatcggatcgacaaggtttggttgaggaccgcggaagattcggttacacgaggagtgtgctgcccaagatgggcaacttccttctggagcaacgnnnnnnnnnntactgcggaagattcggttacacaaggagtgtgctgcacaagatgggcaacttccttctggagcaacgcagatgcttctgagaagggcacagcgaccgagggtgtcgatcaagcatggaaaaggcatgcggtgtacaggctgttgggatttgaccgttgggcacatgggtcctctggaggacgttttcatcgaggaaggccggccgtctgggtaagtaacctaggacactaggtctccgagaccggaaatcctgatgcccgcacaagggttggatattgtctcgaagatgagaggctacgcctccctagggtggttaccttctcgcgaatgacaacaacagccatcgcgcggtctcagcaaacaaagccctcagaggtaggcgagagtcacggcgacgnnnnnnnnnngagatgagaggctacgcctctctagggtggttaccgtctcgcgaatgacaacagtagccatcgcgcggtcctcagcaaacagaggcctcagaggtaggcgagagtcacggcgacggatcccttctctggtgggtgcagggtgaggcgcaagcttacagggttcagttttcatgagaatatgacagaatctgagaaaacggaatagcgggagtgttgctgtacttttacaagattgcaagtgacggggtttgggcgtcctgctttcatggcgaattgagggtcaggcttacacagcgttacgattctcaggtatctgatgtnnnnnnnnnntggaacagcgggagtgttgctgtagttttacaagattgaaagtgacggggtttaggcgtactgctctcgtggcgaattgagggtcagggttatacagcgttacgattctcaggtatctgatgtggccttactccggcaacatacaatattcattgaggagtgggcagattagagccaatgaatcggcgttccatgagcttcaatccagatcgatcacggctggactgcccttgcacagagaactgttcgagaggggtgtgctgtgcatgcggggccacctcccgttaaagcatcggcgatggcgtgtacatgcgaggcctgtggtgggtctcacgcgcaactaccattacaacagcacgatagcgattacccagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgaggtatgaagcatatcaattcgagcgtatggtacattgtcactcatgcatatcaggaaatggggtagagacagctgaagaggagctggcagccactgtggacagaaaggggaaaggtaaggcagctgttgacgacgaagcccctgcagaagaggctggggatgaggacgacgacgatgaggaggccgactttgaggtatgatttgcacctcggagatcccattcatgggtgcgagcatgtccctggaggcgaactttgctggcaatctcccaaactttagcccggaactcattgtcacaggaagaggatgaagatgaggaggatgacagcgaggccggcggnnnnnnnnnnagctcgagttgatatgcttcatatctcggagaggtggcgcgtgcctttcgatcacttgtgctcaccttcagcagggagttggtgctcggcctcctcactcatcctcgacgattgaatgcacgagagcttcctctgagagtctgggtaatcgctatcgtgctgttgtaatnnnnnnnnnngaggcttggaggaccaggcgtacgagttgctgtgagcggtggatgggagagaagtgcaggaagcggctccaagtctgggcctctctggacatcaggcagtacttgacaaaacaacgcctgcccacatgaccaataagcgatcctcttgaacaattcatgcacagggtctgatgcggagnnnnnnnnnntggctccaagtctgggcctctctggacatgagacagtatttgataaaacaacgcttgccctcatgaccaataagtgatcctcttaacaattcatgcacagggtctgatgcggagagtgacggagaggatgcggcagaagtgagaaattctggtgcttatgtttgttcaaggctttactgtgtctttgtatcctcaacctcgatacaggctgccatggccccttgcagttatgatgtgggcctgatgcttgcatcttaagcacaagcagcgagcctcaaattcccctcaaaccacgttacaggaggccggcacatcatctggcggcccgaggaagcgctccaggctggcagccgaggaggatgtggaggaggaggtcatcgcgggcatgtcaggtgatggcacggcatgttgctttgggcgactgggtacgatggctcgtcttggaatggtggaaaggtctcgagaacagggacgtcaccggatcccagctgcaggcgcacggcgtgacaccgctgcaccacctcctctcgcctgatcgtccacacaccgagtgcatccccaggtgacgaggtggaccccggcctgatcatccctgggggcaggcgagcccggcgaggccgcccctccagctccggcgccgcagcggggccaaagtaccgggccgcgcccgccctcgactctgatgaggacgagtggtgactgtcgcagcgtgcgttccctgcgtgctccacgccaggcctgacgccgacactcggcatgaatttcgaaccagacccggcttcaaaataggcagcctggtggctgccatgcgcgagcagatcaatttaccgaggagtcagggaggtgtccacacaagtctgtccctctgggacggtgggtggaaaacggtcccaagaccaagagtcacgagcggcagtttggaagccaagtgggagggatgcctgttggcagcgactcccgtccgccccccagcacaggctcacccgtacagccccctgcggaagatgagacccagcgcggcggcgcgggcgcccaggcccagcgcccccagcgcggcgaggcaggccccgaagcgccgcacatcgtaccgcagcgaggcgaggtccgcgcagcgcgccagcagccacacgccggtcaggcggttgctctcgctcaccaccatgccctccagcgcccagcgcgcgaagctgaagccttgcagcaggcgcaccgcgcccgagggattgccctgccgcgcgatcatggtggagagcagggagaagaccgccgccgccagctgggcggtgccgggctccagcacctgcgggagtgggatgcgcaagagggggtggggggtggttctagcagcagccacgggttgttgtgatgggtcagcaaggcgccgcaaaggctgtcgtccagtgaaagcaggcattgctcgtccccagagacttccccctccccgcatccttcaccctgcagcnnnnnnnnnntgcaggagggggtgggggttggttctagcagcagccacgggttcttgtgatgggtcagcaaggcgccgcgaaggctgtcgtccagtgagagcaggcattgctcgtccccagagacatccccctccccgcatccttcaccctgcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacggtggctgcggtgacggcgtacatctgccagaccacagcgcggggtaccgcgaaggagtaccacatgaccaggtagaccgccgagtggatgagcgacagcaccgcatccacgctgtccagcgccaggaagaaggcgaggcggttcaggccttgaagatgattgggaggnnnnnnnnnnnnnnnnnnnnnnnnnnnnnnnnnnntacagagctgggcacctccctcagtcgaccccccaagtgtcactcacccaccccaccccacacnnnnnnnnnnatacaaagctgggcacctctctcagtcaacccctcaagtgtcactcacccaccccaccccacacctggatcaaaaccaaacaacccactcacacacctgccgccgcctcgcgctgcgcgatgaggcggcgcgtgccaaaggtggagagcccgcccacggtggccatgagtccgacggccaccacggagtaggtggtggacacggcgtagtgcatgatggtctcccgcccgcggtcgctcagcaggcccagcgtcatccccgtcacggcgatgatcaccgtgtccaccagcacgcccacggggtcgcggctgcgctgcagtgcagcccgacccaagcaccatcggtactggcgcaggaagccggggaccgcacgtgtagccagacgcaccctttgggaagatagtgtgggggggtggggcgggggggaagggggaaagggccgcaaggacttgttcagatggctgacaggacagcgaggtgctggcgatgcaggcgttgctataatgtagcccgggcgcccatacctggtgcaggtcctctcgtcacccctcccacccccaaacatgtcttcccatgacaaccacctaccgttcgcgctgggagcgtgaggtggggcgacccccgctgttcaccatcacgccgtccagccggcccacggcctccaccatgccgctccagaagtcggccagggtggcgtgcgcctggtccagcccgtagctggaggcctgcgagggggtgtgggttgaaggagacgctttcaggcatgcgtgccagagaggaagagggcccggagcatcagtgggacgcaaccggatgctgctctcannnnnnnnnnggaaagggccgcaaggacttgttcggatggctgacaggacgacgaggtgctggcagtgcaggcgttgctatcatgcagcccgggcgcccacacctggtgcaggtcctctcctcacccctcccaaccccaaccatgtcttcccaagacaaccacccaccgttcgcgctgggagcgtgaggtgggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtgggttaaagagacgctttcaggcatgcgtgccggagaggaagagggcccggagcgtcagtgggacgcaaccggatgctgctctcactcccccgtgtacagtctgctgctgcgatcctggccggcagggcgtgcgctctgctggtcccgcatgtgcggaccgcacttcaagcagatgtcctggtgagtggcactctgcaccgccctctgcaaactgggcagccaaccgttattccttccctctcgccgcccacagccctccagtaacacccacnnnnnnnnnncatgcggaccgcacttcaagcaggtttcctggtgagcggcaccctgcaccgccctgtgcaaactgggcagccaaccgttcttccctccctcccgccgcccacagccctccagtaacacccacccactcccacgcacctcccagaccctacggcgccacagccgcagcgcgggccaggtgaccttcttccctggggacgagagcggcccagcgggggacgagcagctgtcgagtgcgtgcggcgagccctctccacagcggcccgaggggctggcgacaagcccctcctcgggatcacagaggcgtgccggccggcgccatcccgcgggctctcctccccgctccgagatgccgtccccgcggccatacactccgccccagtccggcccagcctccgcaccgccgccggcttcgcgcgccgcccaggcctcggccaggaaacccggcgccacggcgtccaggccctccggccccctcccccggtcgccggtgatgatgtccaggaacgcgtcggcggggttcagccgcggcggcagcacgtagcccaggccctcgaagtgggcctgcaccccctgcgccggcccgtagaagacggtgcggccgccggcgcccagcagcagcacgtcgtccagcatggccagcacttgggcggagggctggtgcaccacggcggcggccgtgaccccgcgacgcacgatgccgcgcagcgccgccaccagcgcgcgtgaggcggaggcgtccagcccgctggtgggctcgtccagcaggagcagggcggggtcggccacgagctccagcccgatggacacgcgcttcttctgcccgccggagatgccgcgcgcgtcggggtcgccgatcaggctgtcggccacgccctccagccccagcgcgcgcagcgtgcgctccactgccgcctcgtgctgggcggggtgggtnnnnnnnnnnaatcaggctgtcggccacgccctccagtcccagcgcgcgcagcgtgcgcttcactgccgcctcgtgctgggcggggtgtgtgtgggagggcaggcggaaccgcgccgcgaaggccagcgcctccgccacggtgaggtcggggtgcatgatgtcatcctgcgcgtgtgttttggaaagggcgtatgggtgcgcgggaaggcgggggggggggtgcacatgagcggcagaacgtgctgggatggccccttccatctccagagcgtcaggttggcagtgaaggcccgcacagccggcggccacgagggcaccaggtgctgatcaaggctccaggaggcctctgctcgcaccacgaccatgaaccacagtgctgcctccacccccacctcccgggccctcacctgcggtacaaagcccgtgacgcgcttgtaccgctccagccggtctacgaccccgttgacccggacctcgccgctgcgccgccccttctgcgccctgcccgccagtacattcaggagggtggttttgcctgcggcggcgatggacggtgcgacaaggctggcacacagcctcgctgtcggaggtgatccggtgcctgaatcccccccaaaggactgctgctgtggctccaagtgtccatcacacgacaacctcacgactccattcaacaccccggagctgccattgcagccaggtcctgctcacctgccccggagnnnnnnnnnngcgactccattcaacaccccggagctggcgtcgcagccaggtcctgctcacctgccccggagggacccatgatggccgtcagccgcgacgccgccaggcagccagtcacgccctggagcaccgccttgcggcggggacccagggccagacccagcgcaaagaactcgatgtgcagctggggccgtggagaagggggaggggccggccccgcctccccagccccgtctggcggctgcgcgcccgcgccgtttgcatggtctgccattgacgagagggatggcgtcgagcctgagggcgtcgcggggaaggtcccgggggggggcatcgtctcgccaggcaggattggagcaccggcttgggcggcgccaatcggtccatcccgcccatccgctgccccgtcggtcggcgcctcggcctgcaaatgttcnnnnnnnnnnggggggggggcatcgtctcgccaggcgggatcggagcaccggcttgggcggcgcggatcggtccatcccgcccgtccgccgccctgtcggtcggcgcctcggcctgcaaatgttccagcagcgggttggaccccttgttccaaccccgccgcagccacttgccccaacgcttgccgggcgatgtgctctgagccatgagaaaccggagggggggatgtctggtgaggtgcagaggcaaaggagacggcgcatcctctcggccagggatccattgaggcaggactccttcgttcaacatggcctccttgcgcctctggcggacctggcccgtgtgcaagcatcgccgcacggctggaggacgtcaagcctcctggcaccactgccactgacccccagcgtccctcaccccgacgaagccagcctcacctnnnnnnnnnntgtgtgcaagcatcgccgcacggctggaggatgtcaagcctcctagcaccactgccactgacccccagcatccctcaccccgacgaagccagcctcacctctgcagcggggcccccctccgcctccccttccgccgtcgccgcaatgtcaggcgggggcagagcctgcgtgcggccccaggtcactgccaggcgctccatggaggacaggcggcgcatgagcgcgcggtaccactgcgacagctgccacacgatgcagagcaccaggatcagcaggaagtcgatggtgaagcctgcggagtggtgtcggggtgaggaggtagggggtgcagctccaatcaagtcgatgtacatctgcctgattccaccagcgaaagaaacccaattcagccgaggcgaggcccatacgcatgcgctcgtgcccnnnnnnnnnntaatgtacatctgcctgcttccaccagcggaagaaacccaagtcagccgcggcgaggcccatacgcatgcgctcgtgcccatggcgagcacttctgcggaccaaataccctgccggccggcggctgcgcaagcgcaaggacaatcggtctcccccgctggtttccggcaggcgcacctgtgaagttgtcgtcgaagatctcggtgcccggcgggcagacggcgccgggggggcaagtctccggctcagtggtgccttggcggcagaagtgccgggcggggcagggcacgctgcgcagggtggtggggcagtaggaaccccccctgcagtacaccgatccggtgccctcgctccagtcggccacggggaaagcgtgctcgggcggaacgatgccccacttgtcggcgccgccgcagcccagccccgcccggcgcttgtaggcgtagggcgcgcaccacatgtccaggtcctcgccagggtgcccggtgcggtagggaggcggcggcggcgctgggacggccctgtgcatgggtgatttggtgtggcgggagccacggtgagtcgaggcggtgtgggtgagggtgttcatgagagcattgtccgtgttgggggactcccgtgtgcaaagccctgcccagccggccctgctggaacggcccgggagcccttcccctgaaccccaccccccaccaagcacacctggggcagtaggcgcccagcggacagggcatgacgcaatccaggcccgaggggcagaagtagccctcgcagcaggggtgggtggcggccgcggcggccgaccaggcatgggcctcgtcacggtgggcggggtttgcgtcgaagaagccgggggagcaggcggagnnnnnnnnnnatgctggccggcctgtacctcggggtgcggtgaccaccggctcaccctggcataggactctatctcnnnnnnnnnngcgggcctcgtcacggtgggcggggttggcgtcgaagaagccgggggaacaggcggaggatgcgttccccgctcggcagtggggcgtgtcgggcaccttctccggattctccgtcggcagcatgtactgtgtgggtgtttggggggttgaggacatcaagggggaaccccgagagcgcacgcgtatgcaggcgcgagccatgtgcatgcacagcaggggcttgaccttcaccgagagattagaccagcaggggctggcaaatgtaagccgtgcaggtcgcgctggccggcctgtgccacggggtgcggtgaactccggctcaccctggcataggactctatctctgcagggcggcacaggaaggtctccagcccctggctgctggcgcacaccggctcgctggcgggccctgagggcaggggccaggggaaggaggcggccagcaggcccagcgccggctcacgcctgtcccctacgcagaaggcgacctgcgcccgggtggcattccacagccggtccacggtccgggaccagggggtgtccggcacctccggccttcgatgggagggtcccagaggagtccatggcacccagtccgggccccaggccctggactgcaccgcgaggaggagggtgagcgcgaggaggtggcgacgaagcatggagcctggcaggtgctcagctcgggctggggtgttccatgacgattggcatgccggggccgatccaggcccagtatgtcatgacaatttccctcgaaaagacaatcgctggatccctgctgcctcgggactctgtgccgagcgtccttcaggatttgaacatggttgcgttccgggggtcagggttttccggaccccccgtcggccggtggtggacgctggctcagggctgtcttacagcaagagcatggtggcaagatgggcccgtcttcatgcactattgctcactcagcacgtccagcgcacacctccctgtggagccgcgttccggcagcaggcctgcaagggacgcccgcagcgccatcagcgcagccacgcccggctccgcccctgnnnnnnnnnncgctcattcagcacgtccagcgcacacctccctgtcgagccgtgttctggcaacaggcctgcaagggacgcccgcagcgccgtcagcgcagccacgcccggctccgcccctgcggcctccaccgccacgccacccgcctcgcaccccgccagcgcggcgccggcgaggctgtgcccgcccagcacgccccatagcacgccggccgtgaaggcgtcgcccgcgcccacggtgtccgccacctggcgcggccgggcgcggcccctggcctcgtcgccgctccgggcgcgcatcatgcagccatcctcccccaggctgaccacggccagcctgcaccgaccgctcaggaaggcgagcaccgcctgcagggggtcgctgtggtcggcgaccgtgtcgcctccgagctgggccatctgcggacaggtgttgtgggtggtaggtttgcctggggcctgctcctccgaggaaggatcgacacccactcgcccaacaaaccagcctccgcccgctccctcactcccacgctgttcccccaaccaaaacagataaaaacctcaaacgcgccttgtacaccaccgccgcctcctgctcgttgcagaagacaatgtccaccagccccgcctccagtatgcggaggatggcgggccaggcgccccggaccagctccagggaggctaagtcgagcgaggcgagggcgccggcgcgctgcgccgcccgcagcaccccctctgcaaagcccccacggtacaggcagtatccctcgcagnnnnnnnnnncccccggaccagctccagggaggccaagtcgagcgaggcgagggcgccggcgcgccgcgccgcccgcagcaccccctctgcaaaacccccacggtacaggcagtatccctcgcagtgcacgaggcgcgcgccctccagcaggccgcccggcaccaaggccgggtcttgcagctgcgcggcagctgccaggcaggtccgcatcgtgcgctggccgtcgggcgtcacctggtgggtgagggcccagggcgcggagattatgggaccacaggctcttgatagtgagattagatcctcgtgttatgctctggcagggtgcacgagcgaggccgccgagtccaccatagatacaatcatgaaagacaccttcacagagtcatggaggctcccagcacctgttctcaccaggcagaggcaggctgcggtgggctggggggtggagaggagggcgggcaacacgtcatactccttcaggccggaggacaccagttgggcttccgcatcctccccgaccatgccgcagaagcagacgctggtgtcgccgtcccccgagagcactgccagcgtcttggcaacattggccgcagagcctcccagcgccctgtcgggcagtgtgaaggagacaagaaaggcttaatagcacctgatgatcgctatctactcagatgacagttaatggagggcgagtcacccatcatacatgctccccagtagcatggcgacccgggcgccggtacaccccgacccacctgcgtgccgttgcctggactgnnnnnnnnnntgcttaatagcacctgatgatcactatctactcgggtgacagttaatggagggcgagtcgcccaacatacatgctccccagtagcatggcgccggtacacctcgacccacctgcgtgccgttgcctggactgaggggatggaaaggagaccttcaagctcctcagaactcaccaaggagcagccacctggttctgcgccgatatcatccagcacagatgcgggtacatgggccacaatgtccacgatggggtcaccgaacaggaccactttagtgccgaccatgccagtcagtccaggccttcacatcagtgggcgtgcaacctatcaaatttgcatcgacatatgctggaatcatccttcgaaaagttctgcacgaggcacagaccctcaagtgatcattcgcaggttctggcgcccgactttcggggtgcccagcaggtcctccgcagggggatccctcgcacttcagtctctctcacggacgctagcgaatactctgggacctaaatgtacattaaggtttgtcatagcccaccgcagcacatcagtttctcccgcactgtatcagtagcctatagctggtagatcactccagccgaacgcgnnnnnnnnnntgtcctccgcagggagatccctcgcacttcagtctctcttacggatgctagcgaatactctgggacctaaatgcacattaaggtttgccatagcccaccgcagctcatcagtttctcacgcactgtatcagtagcccatagctggtagatcactccagccgaacgcgccccggcatcgcgcaaggatgttatagatgcccggaatatactcgttatggattgttggacggaacggaggactgctttacaacagggtgagcgccagatctagcgtgtgtcgtggaagtgccctgccttaaggagacctgttcatttctccacctagcctggcccccatttggtcnnnnnnnnnntaggtgccctgtcttaaggagacctgttcaattctccacctagcctggcccccatttggtcaggatctgctgccgctccccggtctagacttcaatgacaagctacgccttgcgagcagctggtacgtacttgtgtgtggtgaaaagatgcactggctgtagggatgaagccacctcctctgttgacctccttcctggctttgtctggcactgcaggtttggcatgtgcagcatcgccacccagctttctccggtgaagggcagctcaggtattggatggctggacacgtatggcacgaagagtcacgatgacgagattgggaagtatgggctatccgagcgcttgccttatggcatgctgtgggtcagtgcttgtaccaatcacgagcccttgacgcccaccatgcgccagagatcaagctgatgcaggccgacaacttcgatttgcacagcttccagaccctgaccgggacgatgttcatgatgatcacccagcccaacaccccggaatcagcagagacattgcgaggcccgtgagtgtgcaacacatacgattacgggcaggcgtggtcttggctatgtctggagttgctgtggggcctcgtgcaatggccggcctcctcctgcattacaactccctctgcgcacacccagccgtcctcctcatacccacgtgaggtgggtgcctcaccccagctccatcgctgtgtttgcagggtgtacgagctgtatgcagactatgtgctgaagaatcctttccatgagatggaccaggtcatcaaggcagaactgttcgacagccacttggtagccaccctgtcggccagcaataggaaatggggggccgcttgatgaccgatgctcattgcagaggcgctcaggatgagtgggcctcttgtcctttgacgtgctgtaacactgagtgccctccactcaggggcccaggtctccctttccctccgtgatactactggctgttgatggatcaaggtctcctttgccctgccccaggcgagtctcaagcgtgcgcttgcatttcctgattaaagtatcgcacaaaatccggcagaacaggcacccggaaagtccttctaagttacactcaaaccagaattgggccattgacaccgcatatccagcgggccgggccgaaactgtacgacaattcaacgggctacttcaccacggcagactgagatgcagccggcgtcgctgtgaagcctgtataccatggaagccctctacacaagcggtgtccccttacgaatcgcatggatgcctacctgcacggcggaagccgtaagtacaggacctctatcatgcgcgagaatagccctccctacaggtcacgaatccaaatcgagcccccatcggactcgcgtttgctgctctcagcagggcttgcgacatatatggggtctcattcagaatttgaatcctggatggaagggtaaactctcccatatgaaggagccctgcatttacaaccctcttcgtgcaggaattcagctatgcgactcgtgagaacgtcgcttgggtagaggctctccgtcacagagagccttcacagcgatgccggcggccttcaagtcggccaaggtcatgtaagccggcgcaggatcacacacactgggcccgtccagcatggtatgcggtctcaatgggagtttgtgctttattaatagtttgaaatacattccggggtgtttattttggcagcattgttagctaaacagaagcgggaagagcgggtgctacgacaagccacgtggacttttgctgggcgcgcccatcccctgcagtcgggcgttgcgcgtcagcactggatgccccaaactaagtcatacacagtgtcaagctcgagcagaataacactagagtattactcagctgaacatacatcgatagcgagaagcttggtggactcgaggcgtagctggacatctgcatctacgcccaacatggaggacacccatcacgcgcacagttcttccatggtttggggggatcacgaccagctcttgggcgctggacaggcgacagggcgcgggtttggcggccgacacgcggtgttctctttcaagacgtcctggcgggtcctgaaaatcaaactgtcgacttggaagcggtgaggcgcagggtgtttcatgtgggtcggtcctggcatattcgccgtcatgcagaatttagaggacacattcaaggcggtgcaacgcggcaatcgctgcactcgcgcgctgcaatggagcactctccctgccgcaccggctcatctcctcggaccgtccaacccctgttcgccaggcggacggagacctggtttgacgagctgagcatcagcagcaggcgcagggggggtgccccgctgctcgcctgagatcctagcctccccaatgcatacccgcgcagcattctggccttgtacaatgtcacccttgcagctctttgcttccctgctccacctgggccttcccgcggaatggcgcgtatcgattcttaattctgggctggtgcctgcccggcacctacttgctgtttgcgaccgcacctttgtttgtaagcagtggcttctgggttgtggaaccaacatggtgggtgtggctgcgtccaatgtacaggggcaaccccatgcatgatcaccgggcagtccaggccagcttcaagcacctgccccggcttcaaggcactccgagcaactgccacccaaacccctgcgccagctgcggccgcgccggcgcctcggccgcccgcaccggccgcttcatcaccgcccaccttccgtcctgctcctggctctggcgcgcgcgcgccgcaggggcccccccctcaccagagggggggggcggctgcgccagtgccatgctgctccagctggggccgcgagtgtcgtccccggcgcgctcggccctcggcgccgccccagcccagcccctgccgccggaagccgcgtccccggcgctcgcgggggctgccccgtaccgggtccaggaccggtcgatcttgaacaggccgcggatgccgccgccaaacgcatccagcacctctgccgggagcgcagtgtcggaaggggtccagtatcaaggccagtgcttgcacatttcannnnnnnnnngaggccgcggatgccgccgccaaaagcatccagcacctctgccaggagcgcagtgttggaagggggtcagtatcaaggccagtgcttgcacatttcatggccatcgaaggcatgcaccggcaccctggccccgcaggccgtgccgtcgattgtgcccggcagcgaggggaagaagacgggcaccgtcgcagcgacaggccacatcacggccacagtgccggagcgcaagggcaacactgggcgcacaccgttctgcccgggcaagtcccgatcccagacaccttcccccccaacgcgcaccccacctttctggtcagcggcggcggggaactgggcgatggccacgnnnnnnnnnncccccccccccgcgtgcaccccacctttctggtcggcggcggcggggaactgggcgatggccacgtccgcaccctcccagtccagccggtatgccccctcccagcgccgcaggtagtagtgcaggtcggcggacagggccacctccgtgaagcggacggggtggtcggcctctgccgcctccatcgccgccagctcggcaggcgtgacccccggcgcgaccctggggatgcgggggatgggcggggcgtcgagcgcttgaaaaggcatgcgggttcgaggggatatccatacgactgcttctctcgggcctttccccctcctcacacgccaagaaacatcgaccaacctcgaaagggggcgcaggggcagggccgcgccgggcgtgcgcagcagttggacacagcgctgnnnnnnnnnngaaggcatgcggggtcgaggggatgtccgtacgactgcttctccggggccctccccctcctcacacaccaagaaacatcgaccaacctcgacagcgggcgcaggggcagggccgcgctgggcgtgcgcagcagttggacacagcgctgcggctcctggcccacgcccacgctgacgaggccgtagcgccccgccagcgcgtgcgccacggcgcgctgcccgtgcggcatgggccacagcgtgcgccgctgcgggccgccgccggccacgaagtcggccagcgcggcctccaggcgcgatatggcggcggggtcgcgctgcgcggcagagatcagggccgcgtcgtagcggacctcgcggccggccgcgctccc

SEQ ID NO: 45582 - DNA, 79 bp, Chlorella protothecoides
aaacattgtacatttgcatttgcaacatacaccaaaagtacatgctggagagccctgtccccattcctgtcgtggcggg

SEQ ID NO: 45583 - DNA, 61 bp, Chlorella protothecoides
ggcatctagccccacatcctccccatcccctgcagccagccctgctacctccccatccccg

SEQ ID NO: 45584 - DNA, 61 bp, Chlorella protothecoides
agccttcacagagcctgcgcagggacggggggatataacaggtttcacggacgccacgcat

SEQ ID NO: 45585 - DNA, 61 bp, Chlorella protothecoides
caaatgacaccgtcgcctcccgtatcctcgtggatcatggacagtgagcatgagcgtgctt

SEQ ID NO: 45586 - DNA, 109 bp, Chlorella protothecoides
ccacacagagcgcacagactctcctagttcactcaatccatgccctctccacgcaatgtgcccccatgtcacagacgctggcgctctacacgctgcacactgtgctggg

SEQ ID NO: 45587 - DNA, 63 bp, Chlorella protothecoides
ctaggggaatggtggtccgtcttgctggcactgtggcaaacagaggctgatctttgctggtcg

SEQ ID NO: 45588 - DNA, 61 bp, Chlorella protothecoides
aaatgggtgcatgcttgtgcagcagaaaatactgccgccacctgctacgtgtctgcgctga

SEQ ID NO: 45589 - DNA, 61 bp, Chlorella protothecoides
cgagcttacggggggcaatcaaggatggtaccctggctgacgcctgtgactgttctaacga

SEQ ID NO: 45590 - DNA, 127 bp, Chlorella protothecoides
ttcgccaccgcaagcaatccctccgcatgtatcttgcagggatggtctcgagcagtcgcactgtcctgaagaagaatgaatattcagggtaatctatagcccatgcggtttggcatctaagcctgag

SEQ ID NO: 45591 - DNA, 68 bp, Chlorella protothecoides
tgtacatgagagaaggggcatcttgatggcataacgtacgatctcagggttggcgcgggtgaaggcac

SEQ ID NO: 45592 - DNA, 14989 bp, Chlorella protothecoides
  modified_base (662)..(671): a, c, t, g, unknown or other
  modified_base (734)..(743): a, c, t, g, unknown or other
  modified_base (921)..(930): a, c, t, g, unknown or other
  modified_base (1697)..(1706): a, c, t, g, unknown or other
  modified_base (2153)..(2162): a, c, t, g, unknown or other
  modified_base (2573)..(2582): a, c, t, g, unknown or other
  modified_base (3233)..(3242): a, c, t, g, unknown or other
  modified_base (4015)..(4024): a, c, t, g, unknown or other
  modified_base (4264)..(4273): a, c, t, g, unknown or other
  modified_base (4526)..(4535): a, c, t, g, unknown or other
  modified_base (5288)..(5297): a, c, t, g, unknown or other
  modified_base (6714)..(6723): a, c, t, g, unknown or other
  modified_base (6974)..(6983): a, c, t, g, unknown or other
  modified_base (9914)..(9923): a, c, t, g, unknown or other
  modified_base (10549)..(10558): a, c, t, g, unknown or other
  modified_base (11623)..(11632): a, c, t, g, unknown or other
  modified_base (11897)..(11906): a, c, t, g, unknown or other
  modified_base (12317)..(12326): a, c, t, g, unknown or other
  modified_base (13312)..(13321): a, c, t, g, unknown or other
  modified_base (13634)..(13643): a, c, t, g, unknown or other
atgcgcggcgcacgcacgtcgccgggctgcgcatcgtgtccgggcgcctggcggggctgcgcctggccgcgccgcgcggcgacgccacgcggcccatgatggggcgggtgcggggcgcggccttcgacatgctggctgcgctggcggggacgcccgggcgcctggccccggggtccacttggctggacctcttcgccggcacgggggcagtggggctggaggcactgtcccgcggcgcggccggcgccaccttcgtggaggccgacggctggactgcacggcgcgtgctgggcaggaacctggcggcggcaggggcggaggacgccgccgacgtgcacgtcgcgcgcgtggaggacttcctcaagcgcagcggccgcaggagcgcgcaacgaccctacgactttgtctccgtctgcccgccctacgagctggtggactactcgctcctgtatgagctgctgggcgagtcgcccctcctgcacgaggtgtgcctctggggatttggagaggtttttggtgtgtgtgggggtgaagggagacgggtggtgtgggtggcacgtcattgcggccccccacttggccgggaagtacttgaatagatcagtatgcagtccgcgagcagcgcgtttggagcccaaacctggtcagtcaaacctgcctcnnnnnnnnnnacacccacgaacctcagagcttggaacaggcgagcatctatcgttgcctctgcaaggctggcnnnnnnnnnntgctgggcccgctgaccaagctgcgggacaggcggtatgggaggaccttcctggcgctgtacggccccgtgcatgcggacggttgaacgacgcttccttcgatggaccctggattgcggatgtggtgtcaaaagcatcaaaccttagtctgaatgacctttgccagcacttgtttgcnnnnnnnnnncctcgaccacgcaggagacgtttgtgctgatggagtacccgctgcggctgcgccacctcatcctgcccacgctgggcccgctggccaagctgcgggacaggcggtacgggaggaccttcctggcgctatacggccccgtgcatgcggacggttgatcgacgcttccttctgtggaccctgtgttgcggatgtggtgtcaaaagcatcaagccttactctgaatgacctttgccagcacttgtttgcccatttgttgcagaacagcatgtttactgcacccacgaacctcagagcttggaacaggcaagcatctatcgttgcctctgcaaggctggctggttgacgtggagggcagtgagaaacgtgatgccgatattcttgcatcatccatgttttcctcaatgcagctgcccatgcatcaagagggccagcagtccacttcctagctcctcactcctcctccagcatcttggccagctgaaagcgctgcgcctcgcgcgctttgctggccgccttgagcccggccgtcatgctggggctgtcctccagccccagctggaggctgcacacagccagccgccgctcgccggtggccagccgccgcctcagctgtgcgcgccggccgtccagctgcagcatggggagcagaggggattgaaggaaaaaagcggtgtaattcaatgttggtggtgataatacctcgcacaccaaacacagtcgggccgcaattcccacagtgtcgctccccccgtctgttgcaggcagcnnnnnnnnnnaggagcagaggggattgaagaagaaaagcggtgcaactcaatgttggtggtgataatgcctcgcacaccacacacagtcgggccgcacttcccatggtgtcgctccccccgtctgttgcaggcagccttcgccaccttgacccgcttgccgccagcacgcagcccgtacctgctccaggtcggccatcagggtctgggtctgggctgccacgggctggccaaggtctcggctggcctccatcctgactgtgtgagccttcgggcggtaatgcggtggggaagtagtaatggggggggtgcggggatgtggtggggagctgggcctgtttgttaggcagtttgagtgggaggacagatgagccacctgtcggcattttgcctgccgcatggcctgctgggagaggtggggggccaagcgatgcatgcgctcccaatttgcatcacaannnnnnnnnntacagatgagccacctgtcggcaatttgcctgccgcatggcctgctgggagagatggggtcccaaacgatgcatgcgctcccaatttgcatcacaagaggtctgctacctgcagcagttcctcgagccgtgcccacggcttgggcatcgccagcagcggggtatcctacagggtccaacggtgggaacctgggatgtgttgccagcccgaaccccacccccatctcaccccgcccatgcaggcaggacctggtcagaggcacgccacccagtgacggtctgctcaccacgcaagggggggccgcggtctcagctggggcgggacgcttgcgggacggcgggtccttgcacccaccgggcagcccctgcgcgtgctgcacgtggggggggtgcacatgtctgacctgccccnnnnnnnnnntgcgggtccttgcacccaccgggcagctcctgtgcgtgctgcacatggggggggtgcacatgtctgacctgcccctgagcatggtgccatggcacattcccatccatgagcaggctgcagagacgctacttccaagcagcccatcccggttcccagcacacgtcgacgtctccatcttcgactgatctgttgatgcctcctcttgccccaggtgggctgaccagaggggccggtgggccttgatgctgggtctcgtgtgcgtcgtccatcccctgcacgcaggtctcgccggtcaggggcaggagctccactgcaccaccgatcagtgcatcaggacccagctcctctgcatccaagccatggcatgcaccctcttggcgagctgatggagccgcttgctgaatgctttgaaaagcaggtggagttactgccagccggatcccaccatgctgagtgagtggggaacgatgctgactcccctgcagtacctgtgttactggatggggagcgagccattgactggttctgcggtaagatcaaattcgtacagtggtgggacaaatagctgtgcaggtggtgggacagatcaccgcgccataggttgaacccctgcactcaacttcatgcagggcgcgcggctagagttgcggnnnnnnnnnntgcgccataggttgaacccctgcactcaatttcatgcagggcgcgcggctagagttgcggccaaggtgaatatcaagccgtctgtttagctttggacatcaacccagagtctcagggacccaccttggtgggaacactcgcagggatgccacttccaatggtgactgggggggccaactcgtgtttgcctacgcctttccaagcgcgcaggaagccagtgcgtgcctgtcaacatgcatggatggtgactcccacggtgctctttaaccttcaaagcaagctcccggaggaatcatggatctgctctggagtcgaccactgactgtggcctatgcctatcgccaccacaccttgatccaagccgtaacaggagcggagagcttgggctcaggtacaggggttgtcgagtcgttgtgtagtgctccagtcgattgctcatggccctcgccatccatgctgtggatcctgtgtaatgatgtttgaggagtagggcgggtgtgagtagtcagcacaggagagggtatgactgagcggtatgcatggcctcgaacagcacatgccacgggcacgaagacaagccgatggtacatacccgacgctgcgactattttccgtcattttccttgcggttgggaaatggcagggccaattgatgaagcaattttggacatgccaatcagccagccagtgctcatgaggatgttacccggtatcacggggacaagcaacccataccttgtatctctacaacgctatcacgtcccttggaactnnnnnnnnnntctgcggttgggaaatggcagggccagttgatgaagcaattgtggacatgccaatcagccagccggtgctcatgaggatgttacccaacatcacggggacaagcaacccatacctctacaacgctatcacgtcccttggaactaatcatcatgatatttgctttgtaactgtttacgaaatggaaaggcacatgagtcttccctctgaattcatgatagcggggtggctgctgacttcgnnnnnnnnnntcatgaggtatttgctttgtatctgtttacgaaatggacatgagtcttgaatttttctctcgttcatgatagcggggtggctgctgacttcgaattcttcccggatcgaaagatgagcaactgatttacaaaattgcagatgtacactccagaggtacacactcccattcacacgctttcaagggggtaagaggcaacatgaacattgaaaagagactcgcatacaaaaatacaacacgatgaggcatgcagnnnnnnnnnntgcttccaaaggggtaagaggcaacatgaacattggcaagagactcgcttacaaaaatacaacacgatgaggcatgcagggtactgggaagtgcgacagcaaggccatccctagatgtacgagaacacatcctcagtccgctgcaggtcgacgggcaccaccacctccgtgtgccggtggcgcagctgctggggagggctgtagctggccaggaagaacaactgagaaagggagggggtggagaaggcgccacgcacaggatggttggattttgagaccagtagcatcttttggggggctcaagggctaccattctcttggagggataccattccgaagcatggatgtctatgtcagccgtccctcctccctttcccaacattattccccatatctcacctctctgtggaaccgaatgtcagactcggagtcctcgagggctctccacagactgcgcagctcccgcaacaccttccagggcttggggaatccgttgaaggaccgcaccgccacagagtactcggatgtcttgaccagacgcacattcgtgccattgctgggcttgggagccttgccctgtggggaggatggacgccattgaggtggaggccaggctctgcagcccctcttaggggcttgggagtggcaaccgaccattcctgcattcgatactcgtcagcggaaggcggggttgcgggtgtatccgccccatcaggctttcctgctccagctcagcacagccctgatccctcnnnnnnnnnntccaggctctgcagcccctcttaggtgcttgggagtggcaaccaaccattcctccattcgatactcgatatccgaaggcggggttgcgggtgtatccgccccagcaggctttcgtgctccagctcagcacagccctgatccctcacctggaggtcacgggggatgtagagggcaaacacgtagtcatgctgacggtggcggcggtggtgaggagggtccccatcgcgcccatgcttgcgatggtggtggccgccatgctcatggaatgggaggtggaaggcctgaacaaagggaacggtgccctcgatcgtctggttggcctcgttcgcgccagcaaagtaactcacgaggttctgggttttgagttggaggggggcaagggagatatcttgaatgacgtcggccaccccgcacaagaagcagactcagtacaagaatgtactcatggggccgggcacagccaagaggtcccaagtgtaatcctgtccaagaagacaaaatgagatgcgctatgcccttcacaccccagcctcaccccgatgccggcgaacaaagcggcgatgggctcatgctccttgccaacagtggtcatcgcccattccgcagcctcataggtccgcagctcgaagccgtcgccatcatgcagctccttgtagcgtggacactccttctcactgcgaaatcaggattcggcgtcagatggtaggattgatcgctcatgcacaccctccttagcgccgctccatcacaatgcgggcctgccgcatggaatcgatcgtggctattgcggtcgcgtcacggcatgtacaacaatgcatccacgcacttgcagaatgacggaggtttccattcgatcggaccggaggagtccccctggcgtgcggcatcggaactaccacacgcctgaagcgcgatggccgacagaactaagaggactcggcacatcgaccccatagcgaatatataccggggaattggatgaaggtgtatgatctgatttgcaccgccacaagcgtgctggatgataggtcgggaagctggtcgcctgcccagctcccatgacgtcatgaagttcttcaagcgcgcgaatccgcagccacggcttccacccagctaccttcgattcctccatcaagttgcctccgtcagacacagagctacacagaggagcaaaattcatatcctacgaacagttcccaagcagtttgagatttgcagggttcatagcaatacgcagaatgtcgagcacgactccctccaaaggtgagagcgtcgtggaacacgaatccacccccctggctcgatgctaagtggtaccgactgcaacgcatatcctgcttctacatgacctttaacagctcgatatcgtgcagggtctggaaagactgctgaagatgcggccactgccgcccgctcnnnnnnnnnngcatgaccttttaccgctcgataccgtgcagggtctggaaagagtgctgaagatgcggccactgccgcccgctccagcgctcccgctgcaggtttgttggtatgatgatcgggcttaaatcgaacatgtgtttgtctgtgccagacaccatcccacgcggtcgaggcgcctgaacattcacgtttgacattgctttctaggtggagaccatgccgaggctgtgacgggagtcgcaggccccgccggtgccnnnnnnnnnnacgcctgaacattcacgtttgacattcatttctaggtggagaccatgctgaggcggtgacgggagtcgcaggccccgccggtgccgtgctccatgacggcctagctgacaccggagcgacattgaaagagctgaaggatcagggcgttgcaggtatgcaatggagatgctagggatgctcatgtgggtggttgtcatgagtgggagggttcttcatgggtgacaagtcatctctttcatagtatgcggatggtccatctgccatgcacactcgcttacaaggtcccttcactgccatgtacagacccaaaattgggcaagtgaacagcatttaaatggcatgtgagtccttcagcgtggcagctaccctgaatatagccatcatgagcggctagcgcttggtgtagaggtatcctgaaacgtcacgcccattttgccattgggcaaggccgccacggaatccccatcatcctacctccagctctctgtgcatctgagtttgtaacccatgtgattcgctctcacacaaagagcgtgagcaaaagggcgagtgcaggcatccacgcgacccccggcgaaaaccagagggaggaggggcccagaaagacgggcatgcgcctgtagagcagcaccgtgttgagcgccacgacgccgcagaatgccaggccctgggccgccgtcacccgcaggaggggcaagggggcgtctggcctggcagttcgggcaggcgtccccctgcccgctcccgcgaggggctgccgctcctcctccgttgtgcccttgccgcccacgccttccctgctgccgctgcgccgccgcacggcagacagcctggaccgacgggcgggggagccgccgctctcgccgcagctgtcgctgctgccgcttggattctgagcgagttggtcgctctccacgggccccagcgccgcccgtcgcctgccccgcagcgcccttcccccgaccacgcaggacacccagaggagcagaggcagggcccccgtgagcgtgtgcaggagccccacgaagaaggggtcgggcgtggagaggacgaggcggcctccctcgggcagcagcgtcgccacaccccctggtagcaggaggccagggggtgcatcccccagccacctccccgctgcccagggtccgagctggaggtaggatgcatacaccagctgggaaagtgggaaggagggaggggacagagtgctgtagtcgatgctgtcaattcagcgggaaagtggcactcacctgtgaactttgaccccccccatgtcactcctacgatcgccctacacacagaaggcacatgtgcgtgcggtgtgagcctgcgccctttacccaccaccctagcctcatcacaggctcaggagagcggcagagcctccacaagcgaccccagcctgcccaagaacctcaccactgcggtccaggcgcgggtgtggccggcaagcaggaccagggacgccaagggccaagtgagggtcccggccagggcctggccccaggtcgcagggccggcgtacagggggctggcggcgatgcgctcaccccagcccctggtgtgcaggaaccggggtagaatgaggccgcccaggacgatgcccgcccacgccagagcaaacagcctgtggtcgtgtgatagagagtgaggggttggcaggagggtgggtgcaagtgagcagggcatgccgtcgatcaagggactgttgacaggatgaccggcctacacgctgcaaccctgcggccttcctccgaacaaacgacgccgccactccccacgcaccggaaggccagcaccgcaaagtcgacgcgcaggcctatcgtctcgaggaggccgaggtccaggggcagcggctcgggcaggggagcaacggtccagccgccgccggcgaggcgctcgagacgcacgtgttgacgtggcgaggccccgcccccgcccggcgcgccgccggagacttcgatctgcagccaggcccggtccgcggtcccggggcagccccggtccagccgcaccacgccctggaagagcgtcgggcccggcgcctccggttccagcgcctgcagcgcctggcgcgccagctccacgtcaggcccacttcccctggcgccgcacgtgaggcgggcgtgcaccaggcccggccctgcgccctccaggtcgtacaccagcgctcggacggtgccccggtcaaaggggagcgcggcgcgggcgtgctgcggcacgggcgcgtaccgcgcgtctggggggaaggtgatcagggcggcggcgccatggactcttgcgctggcatccaaggctgtcacgccccagccccgccgcctgtaggcgactgcccaccctgaggcagggtttgggggaaggtgaggtgtcgtgagaagtgagacaagtcctgcacggcatgggacagaggatgcatcctctggagagttcgaccgtgagcaagctgatggacctgggaggactacggcgatcctcgtcgcaacaggcagacgtgagacccccggctcctccctcccagccagggattcccccgtggtgagggacgtgcaggaccagcctcccacacgcctggcgccgtcgaggaactcaccggggtcaaggcgggcggccgcgtccggcctgcgaggctgcccggggctgccgggggcatggaagaacaagtcctggaaggacaggagcccgccgtccacggccagcaggcggaacctgcggtcgtccttccacgccgcggtttccagctctgccaggtggccgctgggccctgcgatggggttgtccatccgcaaaagggttttggtatctgcctctcgggcccggcacgctcctgggcacccggcgccaggccgcctgatgtgcgctacacgttgcaatgggacagggcatcccccccgctcccagcaaactacgctcgcaccctgccgcacctccccnnnnnnnnnntgctacacgttgcaatgagacagggcatccccaccgctcccagcgaactacgctcgcaccctgccgcacctcccccccccgcgtgcatggcgtgcaggcgctgcccaaaggcgccgtgcaggtgcccggaaaggtaggccgtcacgttcaggcgcagcagctccgccagcaggcccgtgggctggagcaggggccgggccaggcggcgcagcgtgcccagcggccaggcgccggcctccgcgtccaccgtgctcagcgggtagtggccgaaggccaccaccggcggcgcgggggaggatgccgagcagcgtcggggcggcgccccggggcccagccacgccgcctcggcgccgacgcgcagcgcgcgcaggaggctgggccctgcgacgcccacgaagttggaggggctgcgcaggcccacgcggggcgccaggtccaggctcagcaggacgacggcggggcaggacccggctgagtgtgcacagaagggaagaaaggaggggggggaggggtatgagaggttgacgagagaggattgttcaccagcgccatggggcgtaggttcggaagacgcggcgagaggggagatggaacatgaccgaaacacctatccctggcggtccttnnnnnnnnnncgatcaccagcgccatggggcgtaggtgcggaagacgcggcgagaggggagatgcaacgtgaccgaaacacctatccctggcggtccttggtgtggtgccctgctggcctctgaagccctctggccctggcaacgcgaggcggccgtgcaaaactgcacacgcccctgcgcgtgcggcccttacccctccagcttacaccatcccaccttgctggtccggctccgacgcccatagcggctgggcatagacacgctgcgccgggtcccggcgccgcgccgacgccgcgctggccgcgaagaggtcggccgcgccgccacgtcggggcacgtcaaacgtgtcgtggttgccgcgcacgtcgtgcacatcgggcacccccgcggcctcgacgtctgccaggaagctgcggtagctggcccactccgcgggctgctgctggcccctgcccccggcctgtttgccgtcagtgaggtcccccgtaaccagcagggctcgggggcggagccggggcagcaggtgcgccgtgaaggcgcgcaggtcgccctcccggtcgccgaaggcggcccaggcgccggaggagttgggggcggccaggtgcaggtctgaaagctggagcagggtcacgggaggggagacagcggcacctgggatgggaaggcaaagttggggggggggggaaaacattcaggagcaggggagcgtcaggcatgcattcagcagctgggcatggggggtggaggatgcagtggaatggcacatattcatcagtccagatccctgttcatatactgaggtgcacgccatgctccacggtcgtcgtgacaccgcacatttcaggcacacctgcgaccagtgcgaggagccaagtcccgaccaggaggtggggcaacctgctcatgagatcacttccgagcgcctcacccagacctcgggcagtcaccgtagataagccaccatcgtgatctgcttgatatttgtgatggtatagtatgaatggaacaatgctacgctgaggatccattctcttacgtgatgtcacgagcaagcatctggggtcccggaggcannnnnnnnnncgatctgcttgatatttgtgatggtgtagtatgaatggaacaatgccacgctgaggatccattctcttatgtgatgccacgagcaagcatctggggtcccggaggcactggagatgcctcgcgccccccgttcagaaaatatcgcttggacagcgttcgccgtcctgtgactctgtcaggaaccctctatagttttgattgataatgtcagtacttgtactgtacgccttcccttttttggcctccgtttaccatcattcccacnnnnnnnnnngtagtttcgattgataatgtcaatacttgtactgtacgccttcccatttttggcctccgtttaccatcattcccaccctgaacagggattggcagcagcatgaaagcctccatttccactccagcacctgcaagtgtcagaccttgccatggcgcatggttgtctggaacggtgttcattgggtggaatctgcgaccttgttctgtgaacagcatcgctgcatctcaggaaatgacacagcaaacccccctggacatgccccttggccgccgggacagactccatcgccattccatttagggcgaatagagaattagcaacttaagcctggcattctctgtattgttcaggcggatattctcagctcaactctggaccgtgccccgcttgcccctgttctcgacaaagcgnnnnnnnnnngattagcaacttaagcctggcaatctctgtatggttcaggcggaaattctcagctcaactctggaccgggccccgcttgcccctgttctcgacaaagcgacactccaaacgcaacaagggtcccaattcaagggcagcagacgcccaacctttcaacaatgcactcgttagatttgacacatccacctccaagaggacaaattttgcagagtgtggaggtcatccctcatagtcggaagccaaaccctcgccacccggggtcgatctgggcttcaaggcccctcgcctacccacacgcaccgctcgccccgacttgtccctctcgaagagtatgtgttgggtataacatgacggtaaccaacgagcagttctaggggcaggtacaggcaataagaaggggagcagagcgataacgagagggggggtgggggaaaaggaggttcgtcgcaagaagccatggaaaaatttgctggcacttggggtccgcgcgttcaaataccgcgacaccaagtccagtcctcagaagtccagagcacgctggtaatagtttcggtgcgaccgcgggatgactggaggacatacagaaacctgcgtcgcgggccgctgcctacgctgcgccggagcgggagggctgctcaccaacggccgcatgaggaccacttcaacctccaaagcctcgttgctgtgctccgaagaagacgccatcccacagtggggctcgttccagctccgtccgtctggtgacgcggtgaagttatagctgaagtcggggtgaaccaccacgatgggtatcgggctggaggccttcgagtgggtctgagtcgccatattgactgatctccggctgttcatgggcgggaggcagcgtgtgaggcggggcgacacggccggtgtagtttatgggaagcgagagcccgggatacggcgaaaatgcggggtgacgtggaccggctgttgccaagggggggtcaacggccgaccggggnnnnnnnnnngtacggcgacgatgcggggtgacgtggaccggttgctgccaagggggggtcaacggccgaccgggggggtgcgtactttcgccatcagacggagataatgcattcccaaaccatgatttgacggcagcgagatggttggccacagtcaccacggggattatgcgctccggaatatcccgaagcggcagcgacgtcccgtacataagattcctcaatcggaagcctggcgccctcacggtgaaatttgccaagcaacagcacccgacgctctcccttctggtgtgaatgtgttgtaggcagaccaagacctctnnnnnnnnnncaaaattagccaagcaacagctcccgacgctctcccttctggtactgaatgtgttgtaggcagaccaagacctcttcatcagtcgcaaaccctcatcacgagggtcgatcgatgaggtcagggctgtttttgtcggagggatgaggcgtggtgtggaaccctgaaaagagggctgcagcaggtggccccggggccccctccgatggacgtcacagcgtccatcgacagtattggattcgggaggttccaatggttgctcctcgcatacacggggctggcatggctggccgacgcctgcgagaccatgctgctgtcgttcctgggcctcgccgtgaagtgaggcccggcgtgggcagctgggagggtgatttcttgattgggggcgtccgagagctgatccaaattagctgggcacgcgggattgatgtttgccgacgatgcagactggcccgctgagcgtgtctgttaccaccccgccacccgaaaaggtgcgactggggcctgacctcgtcgcaggccgcggccctgaccagcgtggtctttgccgggatgatggccggggtatacaccctcggcgccctggccgaccagctgggcaggcggcgcggcttcctcacctcggccctgctcctgggcgtagcgggcctggccagcgccttttccccaaactactcggtgagacgcagcaggcgtgcacttcccccctggcatggctgagggggtgtcgactctgatgcgtgtcccactacaccatcggtccaagccccctccgcatgcgccgcaagtggtctctcgtctgctccatttgctctcgcatctgcgttgatgctctctccccacatctccctgcacccttggctgcctctctcatcgctcagagacaaccttctcccacaatcctcaccccacccccaaaaggtgctgctgggcctgcgctgcgtcgtgggctttgcgctgggcggcacgcccatcgctgtcaccctgtttgccgagttcctgcccagccgcgggcgcggcggctggctcctggcgctgcaggcctggtggacgctgggcacggtggtcatggcctgcatcgcctggcgcaccgtgtccacgcccggcctgggctggcgatggatgctgggcctgggctccgcgccgctcttcctcctgctcgcgctctacccggcgctgccggagtcgccgcactggctggccagccggggggaggaggccgcggcgcgtgccgtcctcctccgcgtcgctcggaccaacggccgtgccggcgccggctgggcgccgctgccaacgcgggacgccggcgaggcgggcgcgggggtggtgatcgggtcgtggcccgcgac

SEQ ID NO: 45593 - DNA, 71 bp, Chlorella protothecoides
cctccgcgccagccgccgtcaagtcccacggatggccccctcctcccatccggcgccctgcgcaggaggcg

SEQ ID NO: 45594 - DNA, 61 bp, Chlorella protothecoides
tccgccacccttcctcctcgagagcaggccacttgcggctctacgttcatcgcaatgccca

SEQ ID NO: 45595 - DNA, 6488 bp, Chlorella protothecoides
  modified_base (213)..(268): a, c, t, g, unknown or other
  modified_base (3895)..(3904): a, c, t, g, unknown or other
  modified_base (4338)..(4489): a, c, t, g, unknown or other
  modified_base (4934)..(4943): a, c, t, g, unknown or other
  modified_base (5022)..(5031): a, c, t, g, unknown or other
  modified_base (5318)..(5327): a, c, t, g, unknown or other
  modified_base (6211)..(6220): a, c, t, g, unknown or other
gcatggtgctggccgacagcgtgccgctgctacccgcgcgctccagcggcacggcggcgccgcgcggaggcgcgctctgggccgccgcgtcgccgcccgcggcgcggtcatccccggagccgtctatggcgtccagcagcaggtccagcccgcacgagctcgtctcggggctggcagcccggcatgtggccggctgggggccggcgggccgcnnnnnnnnnnnnnnnnnnnnnnnnnnnnnnnnnnnnnnnnnnnnnnnnnnnnnnnnggtgtctgcgatgggatgcggcgtgtcgcccaactgcatgggggacgcgaggagcgggggcggtggggggtcgggggtcgacggtgttggccatgggtcgacggtgctgggtgtgggttgggggcatgccagtcgcggtccgcgccactgcccgcgccactcacctcatacttgtactgcttgcggtagggccaggcggccacgccgtgggcgcggcagatgcgcttgaggatggtcaggcccacccccaggcggccacaggcgacctgggccggctgcggaattgagggggaagggggggtggcccgaggcgagtgaggacctgctcaaagtcgaggaggagactcggccgggccttgtcggtcccaaccggcgggccgcccgtggggaactgggcgcataagggtcgacatccgtacaagccaaccgctcgcggcgtgggttcaactgccatcgcccgggctccaactcaccaagtgataacaagcttcgagttccttcaaggtaatctcgctggagaagcggcctgcggtggggccacacgggtggggggaaggatcagtggtcgggccgcgggggaactgtcgcaccgagttatcaccttcccatgacgctcttcggggtaggtccatcggtacgaacatccgacgcggccccgtcatataaaccacgttaaggaccacaccgggcaccacgcgacatgagacatcagcctgctcaccggcacgagtgcgcttgcgactccgtttgagagcgccgaagccggtgtcgccctcgcccatgatcatgaggagcgtccaaggttgcgagtcagggtcaggcgaggcagattaccacggaatccgacacgattagctgcagatgtcagctgtgtgcgcgtccacggacgcggcacgggccaggggagcctgccgtcaaatttgaggccaacttcacgttgtgcggctaccagtcgtcgcgcgtaggatcaagcgccgagaaggtgaccggcgacgtcctcaccgagctcaatatgcgtcttaaatccaaggtgacataagtggaggtcacggttccgcacctggcaacttcgccgatggcttcgaggtgctcactgtaaaagtccggagatttggcggatctaccaacccttcgaccccggcgatttccggggtatccccgactgaagtacgtcacctcaattcagatgccctgcaggttcgtaaacggccatcgtggccatgatgtcgtccctggggcgtaagaaactatgtcgatcggccgtttctttttttaaattgcttacagtggagggatgcaaaagacaagggccatccgccgaaggacgcgaccgccatgggtggctcgaaggaatgtggtccccagaaatagtgcgcactgccgagtatggcagcaacctagtacgccatccgttcggggccgcgagggcatcatggtgggtcatatcagttaatttcgatgagttaccagaggagggacccccatccggaccttccgcggcgggtaacccgctttccgaagtgggcctatcggcaaatacaatgctcggatatgccacgcaagctcatactcgcacacatcctcgcgtcgtccgaggctcacgtgctcgcaagaaacttccatacgcatgacatatctgcagtttgggatggaacatgggttgaaacaggctcgtaaacgtggtactgctttcacaacaccccgaatcaatgcccgcgagccgtcatgccacgccgacaccgcgtaatctcacagttcacgaggctccagaccgccaggaatgcggccagccacaggaccgcgagagcccctaggaccagtgcgtgcagccctgtgaagggttgtgtgggctcgatgagtaatcgccattttccggtgcacagggcacctgccaccagcttcgagaggtgctcgtctccgggcgagggtttccctgcgcagcacggtcccatgattcccggccacacccccgcggccccctctcaccggattcgtagccaggtcctaggatcaggtctgcatgtcgcagaacgagcagggccgtcatggcgaccatttgcagcgcggtcttccatttaccaagggagttgaccttgactgcctgcaaggtggtgggtggatgggggccatggcctgactggcaaagggcctgagttaaaaagggcggctgccagggccgactgcgcccctcacctcgtgtgccaagctcacagggatgggagagcatgtctcccccaggctccatgtccaccacccccgacaccagcccaccttgtgcgcctcgttgctccacgccgccgcccactcccgcagcgccgacatggtgagctcgcgtgccgtcatgatgaccaccggcacgaccatggcgggcagcgagatgggcgggggcgggtcgctggccaggaggatgagcgccgtggataccctggactcgcagcgcgggcaaggagggggatcgacgggggaacggggacgttgctgcagctcgtgccagtgatgaccaccacctggacctggggagtgagccatgcagttctccccacttccccccatgccccgatgccagtcacactcacatgatcttgtccgccactgggtccaggaatgcgccaaaagcgctggtgagctgcagccgtcgagccaggtacccgtccaaccagtctgtagaaggaggcagcagagagcttggggtggctttcttgttggggggcaacactcgggtatggagcggcggcatgggcgggagggtgtcccgtggtcccccccctcccccctctctgcgcacacacacacacctgtcagcgcagcaatggtgaagagggctgcggtggtggcgggtgctgcggtgctggtccagaaccatgtgaccacaaacatgggcaccatgaacacccggctgatggtgagcaggtttggcaggttcaggaaggggctgaccgtccctgtggacctcttgcgcagaccctccagtgcagtgagacggtagtagtcggcccgtcggtcgatgggagagtccagcgactcctggggaggacgaaggattttggggcctggtgggaggcacacacagctggtggaaggggggggtgaagggggcgcgcgggagcgacgggtatcccgacgcggcactgtatctagatatgtcccctggatcaccacttaccattgtagatacccggaacaggggcacccccctgattgcccgctcactgccccgtcgcttcatcgtgccgcttgacccagcccaaggcgcgacaacacagggcaacgctgctttgcaaagtatctcttaatgatgtagacccgggattctggttcctccatgcactcagagtctagaccgcagggtgcgctgagatcttcccccccccgctgagacacctgttccgcccagatttcctgggggggcctcatcccacgacccttcaccctttgtccatggctggggctgggatcgacgcatgccatgcacaccaatgacaagcaaggagaggaaaacgatcgcatcagcgcgtggggggggagaggaccacctgggacctcgtgttcacggagagggtgaggaacagtgcagcagcagcgtggactttttccctcgggtcctcacccaggcacggaacgacaccnnnnnnnnnnatgggacctcgtgttcacggagagggtgagggacagtgcagcagcagcttggactttgtcccacgggtcctcacccaggcacggaacgacaccattcatcagaagcactggttactcctgcaataaacacaccgactgatcgtggatggggctgatgaatcggtcgggaaatccgctggctccctcactggggctgggacaggtccatgccgccctcctcggccagacgcaccccccgcacccaggcccggcactcctcggcggtccccggcctggcccaggcctcggcctcccgcagccccggccccaggtccgcccccgcagcggccagcgtgcgcagcgcgcccacgtggccccagcgcgcggccagcagcacggcccgcgccaggtgagggacgcaggtccccggccccgccgccagcagcgcgcgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcggccagcagcccgccgtcggcggccagcgcggccgtcgcagccgagtgcccgaactgggcggccagcatgagcgccgtcaggccctcgccgcagcgctgcgcgggggaggcccccgccgccagcagcgcgcgcaccacctccacgtgcccgcgggccgcggcccggtgcagggccggcttcgcgcctggtggtgaaatcgatggtaaaagggggggttagtcatcgtcccatgggcaccagagcgccgaggctgtgcgcgccagctggggtgggggggcgtcgcgccgctggagccacagcccgcctggcctggacccgaacccacgctgcccggcccacctggttcgtcggccacctccaggctggccccggcctcgagcaggagacggacggcgggcaggcgaccataccccgcggcaaactggagcgcggtctggcnnnnnnnnnngtttagtcatcgccccatgggcaccggagcgccgaggctgcgcgcgccagctccgggggggtggggggggggggggggnnnnnnnnnnaaacatgcagcgtcggggtgtttgtacccacacctcgcgccacaccctcgccacacaacgaggttccctcgaacgtgcacgtgcgcctaccatcattgctcaggccccggccccgcacctccggccccgcacctccacacgtcgacgtcaaggcccgaggcggccccacgcacctccgcgtagcgctgcgcgcgccgcgcctcccgctggtcgtgccggcgggcgtactcgccggggggtgcggtgcggcgggcacacccctccgcgctccggcacggtgtcccacnnnnnnnnnnggcggccaggaaggaggcgatggcagcggtgtcccccagccaggcggcccttgcatggaggtgaggggatcgggaggaagggggggggataaatatggtgcagcgagtgacagaggcggcgacgctccttgcagggtcctctggggatgcggcccctggggatcgaacatgcagggtcggggtattcgaacccgcacctcgctccacaccctcgccacacagcgaggatccctcgaacgcgcgcgtgcgcctaccatcatttgctcaggcccctcccccgcccctccggccccgcacctccacacgtcgacctcgaggcccgaggcggatccacgcaccgccgcgtagcgctgcgcacgctgcgcctcccgctggtcgtgccggcgggcgtgctcgcccgggggggcggtgcggcgggcaaacccctccgcgctccggcacggtgtcccaccagcgccgccttccccccctgcgtcgccgcgttccccttccacgccatcctccctccctgcgccgccaccctccccgctcacccagacggccagcgcccggcccaggccgcctgccctggcctcgagcaggcaccactccaggcgcagcccgcaggccgcgccccgctccgccaggtcctgggcgcgcgcggcgtggcgcggcagccacagcgccagcctgccgcccggcaccagggcgtgccgcgccaggtccagcaggccacgcaggatggggccgaggtggtcgtcggtgtcggcggcggcggccacggccttgcaggtgcccgtatcgcgccgcactttggggctgggtgccaaacaggatgcgtcttgatcatcgacctgacacagtgggcaatcgacccccgctgcagcacgcaaggcatcgacgcnnnnnnnnnnttcggcggcggcggccacggcctggcagtcgcccgtatcgcgccgcactttggggctggttgccaaacaggatgcgtcttggtcatcgacctgacacagtggggcatcagcccccgctgcagcacgcaaggcatcgacgcccggcgcagcgcccgtcgggcgcccgtcgccgccgtgccgcacggcacgcacgccgtagggcgggtctgccaggagcgcgtccagccagcgcccgcgctgcgcgcgacgcgcggcgccgaccgcgtcc

SEQ ID NO: 45596 - DNA, 61 bp, Chlorella protothecoides
accccgcggcaaactggagcgcggtctggctgcgcaagtcccgggcgtccacgtcgccgcc

SEQ ID NO: 45597 - DNA, 107 bp, Chlorella protothecoides
ggatgggggcggtgtgaggggggggcgggatgtgggactggggggcatttgcatcgaagtcaaccctccgctaacaaaacacgttggggtcggggatcgtgatgtgc

SEQ ID NO: 45598 - DNA, 62 bp, Chlorella protothecoides
cattgcgtatcagggtgtacaaatgctgctcactcacagtcctttgggccccacctctcccc

SEQ ID NO: 45599 - DNA, 61 bp, Chlorella protothecoides
accagggactattgagtgcttccagtggcgtacacaacgatctcggtcattttggccaggt

SEQ ID NO: 45600 - DNA, 61 bp, Chlorella protothecoides
tgcgatagctccatggcatggctgcaggggtgccggtttgcgccggcatcccggcctgcac

SEQ ID NO: 45601 - DNA, 15190 bp, Chlorella protothecoides
  modified_base (1557)..(1566): a, c, t, g, unknown or other
  modified_base (1638)..(1647): a, c, t, g, unknown or other
cgtcggtggagcgcagcgcgtcgggcgcggcgtccgcgaccccggcgccccccggcagcgccgccgcctggtacaccaccgcctgggggaaggagggcaggccgaccagcagggccaggggctcgcctgcggccggcgccgcgccgcgcgcgccctcggccgccagctcgtcgatggcgcgcagggtcaggccgtccagccagggcacactttccagctcgccccgctcgaagcgcttgagcacctgctccacccgcctgggggggttgagggagtcgcagtgaccggagggtgcgtgcggcggtgggcaaggaggaaggaggatgtgtctgtgtgtgtgacagcagccagacaaccactgcgatcgttggtctgggcatgccgtgtttgggttggagtccaggttcatcccggctctgcccagccgcagcagcacagacggcgtggcacagtgcagcaaggcgccatgcgttttgccgaggggcccaggtgcggggacccccatcccatccccacctggcacaccaaacatgagcgcacccccctccccctccatccgctcttgtcccccacacacgatgcctcgcccctcacccgcgctccccccgctccttcagggggaccttgcccggggttttcgacggccagcccccatctgcggggcccggggtcaacagccgcagcgtgtgcgccccggtcttcagccgccctttcttgctgaagaagcgcagcgtggcgcccgccagggcgcgctgcggcacgccttcccgcacctcccacaccgtcagcgccagctgggccgtgtggtccaggtcgcggtactgtgaagaaaccgggggcatggagggaggccatgtgggggggacagggtgtgtgcatggtcagccgtcggcgattgacgaggtccccggcccacctccgcagggtgcaaacacggcacggggggctacattcacagatcccatgctggccccaacaagtgtatcgcagatatccaggccaggccctccccatgccagccagcgtgaggccatcccagctcacccgggtggcaaaggtcagggtggtgtcccaggtgcagccggagaaggtggcctcggcgtaggaggtacgcacggggatgcccagggtgtcgtaccggtcggcaagcacggcttccacccacagggcggaggggcgcaccgtgggaagggccagatgctgggcatccctgtacaccggcaggcagcctaccacgctgtccaccaacacctggacctgcgggcagcgaggggggacccgggggcacataggatattcaaaaaggttcatcgtcacccatagggcacatcggatgcgcctccgtatgttcaggggctctcatacctggaggtccagatcacatgacaacacgaaggaaaaggtgggcgtcctcctcgaagccccattgctgtgcaggctggagctcatttcagagtgggtaatttagaacccagcgtagccgggcacggcttattctgcaaatacgcccgcgcctcgcgacatgacgtgacaagcactccccggcaatctacttannnnnnnnnngcccattgtccacatctcgagaactagttaccagccgaacatacttagcgagtgtcatcaccgagtgtagcnnnnnnnnnnaattcggcgaatacgcccgcgcctcacgacatgccgtgacaagcactccccggcaatctacttacgtaagggctcgatagtatcaagacccctcaccccaggagagcttttagctcgacatcaatgtcctagattgagtttgacatttccaaaaatcatttcgagggcatcatgtcctatcgcatgtgccgctgcgcttgggtctaaggcgcacatgttgccctggttgactcggtactcatccaagtcgaaaccgcagctgctaccattgtccacatctcgagaactaggtaccagccgaacgtacttagcgagtgtcatcaccgagtgtagcgtcccggtggcactcatgagggtgtctcccagaaacaccaccctgaagaggccccacccaagctccattgacacatccttattcggagcattggggggttcgaggactcagtcacggaaggggaggaccgctagccaggatgtggcatctggacttgcacagatcaccatttccaaagaacgtttggcaagtttgaagaaaccctgcgctattccttcagcctctgagctggcggaggcacgaaaggctgagctggaacgagtcattgagaacctatccagcgcacgagctggcacagaagaatccctggacgagcgaaaggtgatttctcattctcgaggtgcttgttaggggctgccggggagctgtctgcggtgtgctataatgaactcctgctggaagtgctccctatgatgaggagagattcctgcaacttgtagatgcacagctctcagtccgggttttgtaccagtcctataaagttcaagatggcgtatcgataccccaatgtgcaggactttggtgcccatgtgccgagcccaatggatgagaagaggcaaaaggaaaggcaggcagttgttgccagagcccaaagacaccaattggaggcgcgtccagaagctcgcctggtagggtggcatggggctaagaggagaatggactgcagcattgacatgcccaaagctgcaagcctgtgcatcccctgccatgcttcagattgcgctgcagggcagggacggccgtgacgagtcagattttggtaccgagcttgcaattaaatgcaatcgctgctctgcaccacgcccttcggcgcagatgaatcagatggtgcaatcttcgatcaccatggcggccctggacgatcaggtggcaaggagggcagcagcccgagagaaggacgccatggatgcagccgaggcacaccgacgagctgctgcagactgggcgctcaaggcagcaatggaggaggtgagaggagctaagaccatcacagttcctatggatagcgaggaccacacgtccaggcatcttgcgtccacctctatacttctgccgctgattgctctcaaactttgtctgccagtggatttgacactccagggaatggctcgtcccttgccgacgacagccatccatgtccaatgtcccaccctccaagatacaacaccccttcaaggcatgcaccctgcttccatgcccctcctgtcccacaggagagggagcaagagaagctgctcatgtataaggccggcgaggctcagttgctgggccagctggccgagagacgggaagcggcagcggccgccttggcagcgactctcgctgaaggcaccgcgcagcggctggccgccgagcggatggccaggcaggaggtagaaggggagagggagcggcgcgctgcgggcgctgccctgctggaggaggtggcggcgttcaacgccctgcgcctgggtcgaaaggaggccgcccagcgcgcccagcgtgcagaggacgaggccatcgtgcgcttccacatggagaaggacgcccaggagcaggtgaagggggcgactgtcacttgatggctaggatcgacaaggaggctctgctggccatcggtgcagggttacattatattgctcctggggtgacaggcaccgcattacacacatcactgtcctccaggctgcctttgaggagaggcaggctgctgtccgtgcctccgagcagctgctggcagcacactggtccagcaccagaagggtgcaggatgggcgcagagcggcagaggacgctcgaatccgtctgtaccaggcgagggaggggccctggcattgggtacaggcagcttccatcagtcgcaacagctcacttgaaaggttgcaggagaaaggccctcatttttaagtgctcacagttcaatcaaaggctccctgcacaacctcaatgctcgctgtccaggatgagagggaggctgccgagcttgcaaaggaggaggctgcagaggcgctgaaggcccagtcaaagtcagcgcagctcgcaaccatgaagcagcaactggagtacaaggcagaggcggccagacgggcagccgaggaggaggctgcagaggctgtcaaagtctctgccgcagccgaggcggcgaagctggctgccgcagaagaggcgaggggaattaattttggatggagtttgctctttgcgcaccgataatcgtccttagactctcatgatgcgatgtcgtatgttccgatcatgcgccttttggcaaaggcacgagggaggtgacgaccattgttaaatttggcctcatgccgcaatgcaacccaccacactgcaggaagcgaagaagaaggctgctgctgctgcactgaggacgaccctggagtcccagctgcgggagcttgcagccttgaccgaggctgggaggttgaaggaggttcaggaggcacaagcgcaagccgccgctgcagaggccgagcggaatgcgctggagcgtcttaaacgagagaagctggcattgctgagtcatgtgccagccaagtatagagtggatctggaacggctgcaagtggcatgagtctgggatctggaatattgtggccctgataacctgcattggtagggtttcaaattgcccaaccaccgcaagacaagatactaattcataacacgcgcccgtcggcttcaaaatctgctgtcagatacaccaaactcatgagcagtcgtcgaggccttccattcctaaggtcgtcattttatataggatggacaccatagcgactcaccttgggtcttgacgtaacctccttgggccgtcgtcatgacgacttcttctccaccagcaaaacgtcagctcacactgcgcaaggcctgcgctgggcctcgcacatctggcgagaccgaacgccagacccaatatgctattttcaatgagcacaagatccaggagctccatggccttgccgatggctacgtccaggcctggacggcgcggtgcagtgccctctcgatgacgggggacagggcgccggtgcgaccaggcaccaccatgaaacccgatccagaggcgcatgagcaacatttggacaccgctgagatgctggataccgctggtgtgtattgtcgcgcccccactggcttctcgcgcacacatgagaggctcttggcttgggcatctggcatgatgttcttcgtccgagaatgtggcctgaaatggacgccagcggtacagagtgatgtgctcacccgccatcccctcaatgcaggtttcaggtacgtcgaggcttgtcagcgctgtctggaccaagccattcccaagaaccaggtcctggacaggtgtgagggcttgccagcacagtgtttggagcgagcattgcacgggatggggccgagccctccctggtatgcctgctgccagcagctgagcccggtggcacctccttgcttggctgcaggcactcgattgagcacctggtcctcgtgctacggtgtgacggcctgcacggctctcgcgccgtgtcagcgggtgctgccagggtcctggcctcggccgccctcgcctttcccccagccaacctgtgttggcacacccagggcccccattcggggcagccctttgtagccgtctcagatgctggggtctggtcccccgtgggattgtgagtcggagcgggaggggcatgatcaggggaggggcatgatcaggggtgtggcctgagggtgaccaaggtgtgcgggagcccctctgcagcaggtcacctgctagtaaacccatgcccgggctctcaaggagtgcgtagatgggactggctctacatgcaccttcagcccccacccttgagctgttgctctcagaatagagtgcgggaatcaccacactgtcagccccttgcccagcgccgccctcgatcaccctgctgtctctctcctggtgctgagtttgatgcatgcttcctccttcactcggtcaacctcccacctgccaccccggccaacgacccctacgcccattcattcaccagagaactggcgggcttcagctggaagcggctgatgtgggcggacatggcggccagtggggcgaggctgggcgagggcgaccgcgcacagcacaggcaaggcccgccaggcgcccggcggctgcattcgcccctggagctcctggtgcaccttttcgaggtggccagcggcccgcccgtgccggggcgggccggcgaggtggcattcctgcagtatcttttcgtggtactgcgcgttgacctggacgcgcgcttgcaggtggggcgcaggtgggggagggaaggatgagcggtggggatgcatgttctgatgcgagggcaacacggtttgatgctcatacatggccaggggattggctcctcttggtgaaaacacacgtgcgtctgggtgtcaacgagatcgacagcagcaaagactgtttgcagttggacccttctgcatgtgcacaaacccaagccaacctcaggcggccagacctgcccacaaaccctccaggcgtttgagaagatggcgacggtggagtctgagggcttgaagggacgccgcgcggctctgctggagcactccctgctcgcccgcatctactccggcgagctccatgtgtgctgggcgcggctgggggctgtgaggggttgtacttgaagggccaccatggcggggatgtgctctacccactgcgccacgacgtgccatcaccgtcgccacccgcgccgccgcgtgcagctgacttccaacgacacgcgcgcggcgctggtggggctgctggtgcgctgcatggccgcgccgcacgacgacgtggagggccgaacgacacgatcaggcgccgcggtgcaggtggctgacatggggcccctgctgcccgtagaactggccggcctggccgccgagatgctgcgcgccctgctttctttgtgcggtgccatggagggcgcaggcctcttccaccgaatacacaggggcaggtgggtgcaccgccatggtggcaggatgcatgagcgaggcatcgggtccggcggccgtcagactgttctgccccgcgcgcccaaccacggatgatcaaaaggtgcgcctggctcacggcaccccgccctgccgcccgcaggaccggcgcgcaccagaaccaccgcatggggctggacagggcgctgctggctgcggcctgggagggcggggcgggctgcagcgacgccggggcgtgcgccgtgctggcggccctcccgccccgcgaccgcctgcgcctgctgggactggtgggtgggaggctgggaggacgcctgaaccaggctgcatgccgccgggatgtgcggcggggccggcctcgtggactcgcactcttcgacgcctacgaaccctgcgatttccccatccaccccctgcgcccccctcccgccgcacgcagctcgtggctcgccagttccagcgcagcacgatccagggccaggtgcccgagggccccagcgccgcgctttcaaaggcctcgcacctcctggaggacggcgcggacgcttgggggtacgtggacgttgaccccggcgcggcgctggccttcatcctctccgacctggccgcccccacggcgcgctccttccagagcctcagccggctggcggtggtggtgggcggcctggccagcgccctcgccgggcagccgggcctgctggcgaggggcgccggcgtggagcgggtgccggccgacgtgcctgccgccctccaggcggccctgcgcggcatcgtcgacaagtgagcggggatgggcggttgggagggcttttgcacgtgcaaagcaccatcccttgtccctggaggtgcatgcgtttcgaggcacccacgccaccccaatctgagtacgcatgtcccctgcacagggccgggcggacatcgctgggtgcctcccaggacctgtcgaggacggccctgtttcagctcatgcactcccagatggctgtggagtcgctggcggcacgcatgcagacggcggcatgacagagccgagaagctttgtgtgtgtcatggttgagttggcaggtgccggctgcagtgtgacaataaccccccaccatctcatttcataacccggcaggctttggcctctccattcatctattcaagcaggtctggcagcatgccatggcctttaggaacctgatgacactctgataagagcagggcagcctctgcctcacagcctgaccccaagagcattccgtcagaggaaggtgcgggcgccgctgcccgcacccctgccccccccggcgccgccgaagcgggaggaaagggcgggcagggccgcgatgcgctgctgggcagactgcacgtccccgcgcccacccacgaggtctttttcgcggtcaaagggccgccagggctgggtggcagggtcccagtccgcgggcgcctgggccggggctggggctccgtccctcgtcttcttcttccctttcttcttggtcgcggcggccagccgctcggcgtgctgctccaccaggctgcgcttcctggtcgcggcattgtaggcgtcgaccgccgaggcggtgacggccgccgccccgccccctgaggcagggcccagcagcgtgccgccgccggccgcgccgccgccctccagctgcagagcccgctgctgcggcgtcagggtccagccggaggtgtccccccggggcttgatcccggactgcgagaagccgcggtgggtggagccaggcgccaccgcggctactgtcgcgctggccgaccgctcgggtggcagctccgtcatccaggcctcgcgcgccggaccagccgcgcccggcgccgggccggccaggtcggccggtgtggcttcgccccgggcgatgcgccaggcacgctgccgctccgccacggcctgctcggcttcaaactcgcgacgcagcgcggcctcttcccgccgggcgtccaccgcggccctcaggcccaggtcctaggggcaaggagtgtttgttttttttgggggggggggttgatgcggtggaggcgggatggacagggcatgttccaggttggattcctcttcgccagcacatgcaaggtccgtttggtcgggttgaccccccttccatctccaccgccctgcccgtccaaggctgcacaacaaacagcagccgccagaactcatggcgatccaaacacccccacccccgccatccccctcggcaccgcggcccaacctgcaactccttggccgcccgggccacggcctggaaggcgtccgccgcgcccgggtggtcgcatttgtccgggtggatgagcagggaggtgcgcatgtaccgccgcttaacctccgccggagtggcctccggccccaggcccagcacctcgtaggggtcgagcgggtcgcgcgcggcgtcggcggccgccacgcccgccagccgcgcctcccgctcccgggccaggcccaggatgcgggccacctcggcgctgcggtcgtcgctgctggccaggtccagctcgcccgccaggtcaggaggcacggggcccaccaagaaggcatcctcgtcgtcatcgtcagcacccggcacacccggctccggggagggcgggagggggagcagcgcggcagctgccaggaactcgggcggcggcgcggcggggcccagcaccctgcgtgggccctgcgccgagtcgtgatgaggcgggcgccccgcgtcctcctcctcctcctcctccgaggcaggtcccgggggggctgatggatctgtggggcgcgccacgggggcttccggtggcggagggaccgcgctgttgggaagcgaagctcccccctcaacaagcctggacgctgtggggtcatcgacccttgaaacggcgctcacagcgggaccttggggtgcataggctgccacctgcccagcgctctcggcgagcagaggagccagaaagccgatgatggcatcgccctccttgctcctcttatagtactgaccctgcaccggtggtggcgaggctgggctgggacggcgcagtggattcggtgcttggctgcaaaggccctgcattcactgcaacaggccgctgcacacaggtgcttcccgatatttgccacccgggcaactcttactcatcagcactcactgcggatgtcttccggacttgagacaggtttgtgaagagtgtgtcgaggcgggacttcaggtacgagtcctccaccccatctatcgccagtgcctccccagcatccagctgccggatgagctgcgtaggcaaggcgcgtggaaacagtcaatgtggaggtgtccaggagactggtagtgctgcaccaagaagcaatgctgccatcataagcaacgagatcggtgggcggtgcaagactcccatgccgatgtgcctctccacaccaccctacctctcgcagttcgctcttcagctcgtacttatacgctagtatctcccgcgtggcctgtgcgaccgccctacttttgaatagctgtgtattcacatcaggactggcgtcgctgtcgctgctgtccccccgattcttgcgggatttgtgctccttgtgcctcttgtgtttctgtttcttatgcttcttgctcttccgagaggatggagagtgggagcccatctttgcggtactgagctcatctaaaattatcagctgacatcgacgacactgtcctgcttgaggtgctgtagcttggttgtcctctttgatgtgattgctttcggatgtgttggtgcgcgcgcggaagccgttcacctggcgccttgcatcaggcgcccgaacatcggaggtagcaggagacggggttactgccaccgcttacacgtgcacatgcatattctatttgtttttggcaactaaactggtgatgagcataccagcgctgtgcctcgacctcttgaagcagtcttgatagggcgcctacaggccgcaggacgcagtctccgctactcctctgaaggaagaagggccatggccaaggtcaggtcatattttgagggtcttattgccacacttagtcatgctgaacgccctttttgcgtacttctgtcggtcatatctgggctgtgtgggagggcatgctgctcaacaagccacacacgcgcgacccacgataggagtccaagaaccgcgtgaagacccgggatgagcaggttgtagacgaggtggtcatcgcgtccacacccaaggtatggatggcggagctggagtcctgagcacccttgcatgtgctcaattcatgtatggccagggagttccttatatcgggaagaatctccacagcactttggggtcaacatgagccatgcctcaaaatcatcgacaggagaagaagacgaaggagaagaaagagaagaagcgcaaggtatgatagtgggacggttggcactcaagctcgcactccctgctgccaacgcagtatctgggggactcgagctgcccctcatgccgccatattgcaactgcgcagcaggttgaggaggctcagtcagtggtgccagaggtagcctcgccagtggtagagccgcccaagaagaagaagcggaaggcgagcgaagccgagacgtctgctgctccggtacctgcagaatctgcaccagctgtcaagaagaagagcaaggccaaagctgcggaagcggctgcctctccggtaccagtgaccaagcctgcagcaccagcagccgtctctcaggagaaggaggagaagaagaagaagaagaagaagaaggcggaggcggaggcgtctgcggccatggagaaggctgcgcctgtggaaaccgttggagcccctgtgaccgaggagaagaggaagaagaagaagaagggtgcaagtgtggaggacagccctgccgggactgccttgccggcagctggtatggcggaggagcctgagcccctcgctccggggtctagcacccgccaaggcattgaggagatgcaggcggtggaggaggctgcgccacgccaaggcaccgctgccaaggccttccagagggtgaaggcggaggagtggattgacaagcgaggatcgtgggacaactcctacgtcggcacttttggcgaacaaggctggggcttcaaggcgcagcaaatcctcggacaggtgggaagaagggatggcgtgcggcagtgggctcaggggaaagtggaaggtcatctatgtaagggttgggtgatgctgtgggagttggtatgcagcatactgagggccaccggcaaatgaggatgctccaagccacattgcatgctctcatgccctcctgctccccatcccccaacccttccaggtacgtggcaaggacttccgtcatgagaagacgaagaagaagcggggctcatacaagggagggctcattgactcccacaccgtgagcagctacaagtttgacagcgatggcgagtaaagtcatgcctgaaactgagaccctagcagcccttagcattgttcagatacattggccacccaaacattgctctggtgggcatgttccctaagtgacctgtaaccaccgatgctgatagattgcagattgagggggccgcagagaatgcgtcccttgttgctcctcttagcgtcggagtgtgacagaattatagtatcgtttctacttctagcgttggcaagttcctgcgtgatctttcaaggtggcatgctaaagcaggagcaagtgcctttcctctgctgcattagtggccaggatgtatggcgggccagattgatggatacactgtgtagcataccaaacaagagaacgtacactatcgagcgctggaccagcctaatctctgcccgcacatgcgctggtatgagaggcgtcgcttttacattctcagtcgaagctgagtgagcaaagcagagcatgccagtttgatttctaatggtgacctgtcacatatggaacagtgtggatgatagcgaccccaaacgcgatgtatacaagtgttcacatcttccaagtggataacaaatcaaaaatgagtgttgtaagctctctgatgccggggcgtgttcccttcaaactgctcaatgacttactggtgagatacaatgtcggtccctcatgggctccagccgccgccaatattccggagccttccctgcatgagctgcgtgcccggatcttctctggcatagggtatgtgtatgtggccatatcacaacatatcgatctctgttgaaatgtggagcatgaagtactggttaaacgtgctactccgggttcagtagaggctcccatcctttctgtcattgcctacgccatggagcatcggggcttctcatgacggagcaccccggtcaacccatgcgaccgacacttccgagtcgactgcaatcgtcacagtgtgttcgctgtgaaccctttatgatcctgaagatatctcgctccgatccacatcgcggtggacgacgtcgcaactccccttgtcgtgacagacggtcaccaagcaggtcctccccgtcttcggcgagtcggggcccagccgatgatcttcctcacgctcctggctcccttcttcgctccttacatcctgggatggcctgccctcgccactctcgtcacgctggcagccgatctcggcatcaccttgggtctaggggtggcggcgggtaacccgggcctcccggattacctgtccctgtccctgaccatcaccctggtgggagcgtggctgggcctgaccctggccaccgccctgtggcgcaacctggagtcctccttcgacaggatgccctggctgcgccacacccaggagctgcagtcccgcaaggggggcaggacataccagaccaagtgccccttcaccggtgcgcccagggatggttggcgtggtgtgtggtgcatagaggactcaccggggcagcatgcagtcgtggcaaggccacgggcggggacgggagaggcccgcacaaccaggctgagcaccatgcctcgctttccacctacacacctcctcccgccaaccccttcccccaatctctcacacgcgtgatttccagggttgcggcccaccgcccgctgccccagctgcagctgccgtgtgcacgacattgcgctgcagcccccagaccggtgggtggagtcgctgcccgtctgcgacgtccccctgcgctgggacttggccaaggaagccctggcaggcgccgagaaccccatccaggtgggtgggatggcgaggggggggatggcagggcacaggcacggcggccaccgcacaccacgcatcttcccccctccccttggccccaagtctgcaggtgtctcaccctggccccctcccttccccacccctcaatcgaaggcccgcgagtcgctggatcgggcgctggacttccgcggcaacgtgctgctggcgggcgtgaccacctgctgcgtgggctgcgcggcctggcagaagaactgccacctccgcccccgcctggccctgggcatgacctcggtgtccgtcacctttgtcatcctaccctgggccttctcaggcttctccgacaccatcggcgtcgcaggtgtggggccctggccacgtgtggggtggggtgcctgacctgtgggacttcaccttgccgtgctcggcgcaggtcgccgttcccatgccggtgcgatcatccatcggtggccgtgcaggcccctccggatcaaacccacccaccaacatgccccatcgcccaggcacggcgctgcaggtggccaccgaggcgctggcggtgagctactccaccctggccctgctggtgcagatccaggcggtgctgagggccaatgccttcctggtggagtatgccgccgccgtgccggagctgctccccctgttccggccgcccaccgccggggtgctggcccacctgcatgccctgtttcttcgcacgccgtgggaggggtgaggggctctgtcatgaccccattgccggaatgtggcccttccctgacctcctcgacccggtctgccattggatactcgctctgttgatgggtctacagtcttgcactgtgtgtgatttccagggaagcagcagccacggtgccgcaataaacaccaagcaaacgacaaagcgaagaccgctatggaaggagggggtcgggccggcagaatagattatctcatacactggagagaaaatggcaagatgctttcctgagtcaagggtactgccaggggggaagttttgagcgggtgctccatttaagaagatttgcagcggagaggggtctttggtggttggggcaggggggggggggggggggggggga

SEQ ID NO: 45602 - DNA, 67 bp, Chlorella protothecoides
cctcctggcataccttctccatccccagtctccccgtcccccacagcactcccaacccctcctggca

SEQ ID NO: 45603 - DNA, 73 bp, Chlorella protothecoides
accgattcttgatggtggccttggtccgtgcaaggtagtcgatgcacatccgctgcgacccatccttcttgcc

SEQ ID NO: 45604 - DNA, 73 bp, Chlorella protothecoides
ttcatgcgttttgggatgctgaaatgttccagcatgtactgcctgcttccgacaccctccagcaccgtccccg

SEQ ID NO: 45605 - DNA, 18368 bp, Chlorella protothecoides
  modified_base (4051)..(4060): a, c, t, g, unknown or other
  modified_base (4365)..(4374): a, c, t, g, unknown or other
  modified_base (4755)..(4764): a, c, t, g, unknown or other
  modified_base (5386)..(5395): a, c, t, g, unknown or other
  modified_base (6959)..(6968): a, c, t, g, unknown or other
  modified_base (7113)..(7122): a, c, t, g, unknown or other
  modified_base (7331)..(7340): a, c, t, g, unknown or other
  modified_base (7770)..(7779): a, c, t, g, unknown or other
  modified_base (8287)..(8296): a, c, t, g, unknown or other
  modified_base (8844)..(8853): a, c, t, g, unknown or other
  modified_base (9327)..(9336): a, c, t, g, unknown or other
  modified_base (9507)..(9516): a, c, t, g, unknown or other
  modified_base (9571)..(9580): a, c, t, g, unknown or other
  modified_base (9662)..(9844): a, c, t, g, unknown or other
  modified_base (9909)..(9918): a, c, t, g, unknown or other
  modified_base (10057)..(10066): a, c, t, g, unknown or other
  modified_base (10307)..(10316): a, c, t, g, unknown or other
  modified_base (12757)..(12766): a, c, t, g, unknown or other
  modified_base (14350)..(14359): a, c, t, g, unknown or other
  modified_base (14690)..(14714): a, c, t, g, unknown or other
  modified_base (14843)..(14852): a, c, t, g, unknown or other
  modified_base (15279)..(15288): a, c, t, g, unknown or other
  modified_base (15796)..(15805): a, c, t, g, unknown or other
  modified_base (16424)..(16433): a, c, t, g, unknown or other
  modified_base (17504)..(17513): a, c, t, g, unknown or other
  modified_base (17677)..(17822): a, c, t, g, unknown or other
  modified_base (17927)..(17936): a, c, t, g, unknown or other
cctgaactggtgatcatgcagactgatgtttttgcatggcacagaagcacgtgatagcttgttgacccatcccgcataacaacggtcgcggggggtgcgcggaccctgctcttctactcgttgacccaacgggcagcgcctcattttgataaatataagagcgcttggtctaatctgaaggggggcccttttggcacgcagcccacccgcacgagcgtcgaggacagcctcgagggcggggtgcactgctagactgcacagactgacatgcaggagccacgagggcaacgttctgccacctccgatacacatgtacgtggaccatgctgccggctcctccctgcacattggctgggcagtgcggacctgttggcatctgttgtcacccaagagttcggaatggattaggaacattgtcaggaccgggccctctctctcgcacaggatgccgacttgaagctggcgatgatcctccaggcacaggagcaagccttcctcaatttgatgggggaggaccaggccatgatgtgcgtgggtggatggaaacctgcttgagctgcacccctcaagttgattggggtgaagcccaacttcaggctgcatagggctgggccaagtctcaagctgcatgctcgccatgttcacctgcaggagtgggacgtcattcgaatccatgggctcccactttgagcacgctggggaagaggcgcggccaggcatgagcgatgaagattttgctctgctcatgcagcagcaagagctagtcaggggctttggaggcgttcccggtgagtcgctcggcccgtcatcgcatggatttttacaaaatgttgtctaggactggtcggcaaggcgcatagcctaactttaagagcatttggctatccatgcccagcacccggccacccactgtattgcccatcttacatgcccacttgcagtgggggagccgggcggctacacatctgcaacagagtctgcagagaacgagggcgactaccatgacgaggagtacacatacgaggagctctccgctctgggggaggttgcagggaccatcagcaagggcctgagtgcggaggccttggcggccctgcccagaatgtcatgggcggaggcggcagattcgcgaagtggagccctggacaccatgtgaggaggatggcagatcgggattcgggctgggaggtggttacgccaagctatgcgtgattctgtatgcaagggaagcatatcatcttaggatgctgcgtgtgtgaggtgcacacacgccttgtcaaccctccaggtgcacgatttgccagctcgaccttgaggcagaggaggaagtgtgcctgttgccgtgtggccatacttttcacagcgagtgtgtggagcagtggctcagcttgaacaaggcgagcaggaagagggaagtggaaagattgatgtgctgcaatgaccgccatgtctggccactcccgttccttccggcagcttgcatatgaatctctttctcctccacaggcttgtccgttgtgcagcaaggaaatcgagtgtccatctgccggctgaggttcgatggaagaagctttgtcatgcggcgctggagcggctggctatctgtggccacgatcagaccgcacggaagatgaagggcaggtggcccattcaaacagagaaaagccatgcagacccgcgcgccctccaacaaatccctgagcgatcagctacgtttatcatgcggtgttgacattgattttcgaatatgcaagttgagcaacttctgatcgtgcagagtgggaaggtctaggggtcgcgcaaactcgcatcgtccgtcgcacgacatcatgccccgaggaacctcgccagcgtgatgcccgccatgggaacgtccgatggggacaatgagtacgagaggcagcgccaagagcgtgtgaagcgcaacagggagcgcctgagtgccttggagatcccagtattggcggctcgagtggctcccaaacctgccagaccgagggtgagttgatactccatctggccggtgtataggtgctccaaggtccccattatgttgcataaagtgagcagattttctgcaaagcactcatggctctgtggtctcccatgcagcctgctgttaggccagccaagaggagaccaactgtggagagtgcgggtcccaagcgacgatcggcccgggtggccaagctggaagcagatggcaatcagatagagtcaggtgggttgacatgaatgtaagggcatggtcagaagcagtgcaccccgggtcatctcccctgccagcgctgtgcaccagtatccctgatttcttgcacacacagtattggaaacgaacgtcacttgtccatttttgtgtctccatgcagaggagcgagggcgaatcgtgacctccatcatgcttcccaaaccagatcccgtaccagcagaacgtcaccccaaacgtgagcttggattaggaagtattacatttgctgaggtgctgggtgtagaacattggagatgtctcacctcgcgtcctttggctcactggcaagcactgctgcaatctgacctgctacctctcaatgaccttttctgtgcaaatcaaggatcctgctgacaagtatctcccgggtctctccccaggggacctcgccatgcaggagatcgacggcctggcggccacagatgcggcatacatcagcgcatggagctctcggttgggcacaggacctggggttggcatggagaagccagagcccagcctgccctggctagcctccctgcagctggatgccgttgatgtggccaaggtcacacgaagcgccaccacgcacctcgccttccaccccaccagtgagaccctgctgctggcagcgggggacaaggagggcaacctctccctctggtactgcgccgaagcggcgcaggccctcgacagagcgtcgtcgcgaggggatgcagggtcaagcgagggtgagctcagagtctgggcgaaagagggagccgagcttgcacgtttgcacacggtgcatagctgcccggggaagtcgtcttgcttggcatttccgctgataaaaccctagccacaccttcccaccctctcacactctggtaggggagggcgggtcgagcgaggcagcgacgtcaggcacagcggagagcgaggcggagtttgacggtctggtgagcctggggtaccaccggcagtacatctccggcctgcgatgggcaggagggccagggcacggcgccggcctgttctctgcctcgtacgacggctcgctgcgtcggtttgaccctggcgcgggggcggccatcctgctgacctcctctgaagacctgggtttctctgccatggacatcaccctggatggcaggtgggggctgtgggctggctcttcagcagacagagatggggaggggagggaatcatggtgggaaagtagggaaatgtgaggccaggcgcactcactgccatcatatattgctgtccatgctcttgatgcgaggggcggctgctgtttccatgtgaaacagggagcgaggatttggtaggcatacccggtctcctgatcggaccggtggcacatgctctcacaaaaggcctgccttctcggtcacagcccccactcaccacccggcctactttctcgctccacagaaccgctgtgctgggcaccaacaggggcgacctcctggtggtcgactgcagggccaaagggcctggggtattgagcgaggatggccacgccaagaagataaataccgtgcactttgaccctggcgacgagcatgtgcgtggaggggcaggggggccatgttttgtgccttgccatggggaggtgctgtgcggaggcgtcggcccctcacaccgagagccctcaactaattatcctctgcgacccctgccagccccccttctctccaccccgggtgcaggtctttgccacatcctccaccgacacctgtgtcagagtgtgggacgtgcggcgcctgggcccgaccccaaaacccgtcgcggagggcgcacaccgttccagctgccaggcagcgcactttgcgcccnnnnnnnnnngttttcctctgcgacccctgccagcccctcttcttgcctccccgggtgcaggtctttgccacatcctccacagacacctgtgtcagagtgtgggatgtgcggcgcctgggcccgaccccgaaacccatcgcggagggcgcacaccgctccagctgccaggcagcgcactttgcgcccgacggtgcggagggactggggtggaggtcgtgggtgcatgtgatggagtggtgggagggcctgtgttgagtgcctctcccacatgccagaactgtcaagattttgactgcgctgcactcaacacaggnnnnnnnnnnccccacgccccagtaactgtcaagatgtcgactgcgctgcactcaacacaggatcccaccgcctggtctccacgtcctttgacaacacggtgggggtgtgggagcgcagggggaagaaggagctggcgtgcacgctttccatcaggcacgacaacgacacgggccggtgggtgacacccttccgggctgtatggagccccagcggcgacgccatcctcgttggtgagtgtgggggtgaggagggagtgctgtgcgagagggccgccttggagagcgtgtattgaacgcacaggctgcccaccatcttgtgtctgagcagaccaggtgaagcacagatcagggcgacggcagtggccaagcatgcagcattcagatcaggannnnnnnnnngttgggtctgagcagaccaggtgcagcgcagatcagggcgacggcggtggccaagcatgcagcattcagatcaggaaggaggcccgggttgctacagcagccaggcactggggctggccccagctgcttgcccagcgatccctactctcgagctccaaccaatgctctacccctgcccgccgtccaacagggaacatgaggcgagccgtggacatcatcgacgcctcgacaggccagctgtcgacgcagcttcgcagcgaagacatgaccgccatcccgtccaggaaccttgtgcaccccagcgttgaggtgttggcagctgccacctcttcaggccgcatccacctctatcgttgaacagtcggcttgatgtgccatctgatcggtgtgcggctgggcgactgccctcccttctgatagccaggcttgaccaccaagagctgtctaggcagaccacacatgccattcaaggcgacgatgatggttgggaatgccgtctcggtgtccttcgaaggtttgaaaatgtgtcctatgacaggcggtgtcatgtgatgtgaacatcccccctcgcgacatcccccccagcgcgtacatgttcccaaatggtgcaagtagacatgcnnnnnnnnnnacctgtgacaggcggtgtcatgtgatgtgaacgtccccccctcgcgacatcccccccagcgcgtgcatgttcccaaatggtgcaagtagacatgcctcccacctcgtgcactcctgtcacaacttgatgtagcaatatctcaggaaacttttgtctgtggcgtgctcatacatccgccggtcattggtgtttccctaaagtgcctctcgaaccagaacttgcgatggccaccgacacccctcccaaacgccaggtgcgtgtgcatgctcaaattaagtgtcacaggagacttgtgtgatgcgcaaccgcgaatgcgggcgtaaccgatgaggtgccgtttgccactgccccctttcgaaactcaccaagatgccaagatgccgacagcctgtggggcgcctcatgaaccattcctgtcacacgatgcgcagctgtccaatgggataccagatgatcgtcccgccgtgaaggcaaagccccgagtggagaccaaccgggtgctggtcaccgggggcgcgggcttcgtgggaagccacctgtgcgattacctcgtggcccggggcgatcatgtgagcatgacattcgctttagtgagatgaagtgggtgatgtgtcgtccaagggtggccagcatcgcagctggtgccccagcgcatcgcactatgctcgtggcccccggccaaccacctggacatgtcctcaccatgcacctgctcctgggcctgcccaggtcatctgcgtggacaacttcttcacggggagcaaggacaacatcgcccacctcctggacaagcccaactttgagctgctgaggtgaggagacgcagagcgtcgagtgtttgttcggggctggccggctgcgtgtgatgagctcggggcctgaccacggtcccctctcccacccttctccccgcccaggcatgacgtggtggagcggctgctgctggaggtggaccagatctaccacctggcctgccccgcctcgcccgtgcactacaagtataaccccatcaagacgctgaagaccagcttcatcggcacgctgaacatgctgggcctggccaagcgctgccgcgcgcgcttcctcatcacctccacctccgaggtctacggcgaccccctggagcacccccagaccgaggcctactggggcaacgtgaaccccatcggcgagcgctcctgctacgacgagggcaagcgcgccgcggagacgctgacgatggactaccaccgcgagcataacctggaggtgaggtggcgcgaatagtgggggttgggcggggggggaggggaggaggggagggaagaggaagacgatgagggagggggcgattggatggattggcgtcgtcgggccttgcttgtgagacgccacacaggggatcagcgattggcagaggagtgggaggggtgttgaaggaatctgccctaacacctggcgccacagatttgagcgtgtgcagcgggcagaccccgccctccgcccctgaggcacgctggatcgtccaccggcgtgctcctttccccccaaaacaaacaggtccgcatcgtgcgcatcttcaacnnnnnnnnnngcgctggatcgtccaccggcgttctcctctccccaaaataaacaggtccgcatcgtgcgcatcttcaacacctatggcccacgcatggctctggacgacgggcgcgtggtctccaattttgtggcccaggccttgaagaacgagnnnnnnnnnncggcccacgcatggccctggacgacgggcgcgtcgtctcaaattttgtggcccaggccttgaagaacgagccgttgacgctgtacggcgatgggcagcagacgcggtccttccagtatgtcgaggacctggtcaggggtgagcgggggtgtgcatgtggcgggggtggtggttgggggagtagcgtctggtgggtgtggggcgtggtgnnnnnnnnnnctgacgctgtacggcgacgggcagcagacgcggtccttccagtacgtcgaggacctggtcaggggtgagcggggttgtgcatgtggcggggggtgtggttggggaagtagcgtctggtgggtgtggggcgtggtgcatctgccgggcgggggagtacgagggggtggggtgaggagagaggaagtgggatgcagctacgagctgtaccccgcctcctcgggtgcgtgtgcgaatcgcatcccagaggcgatgcacgaggcttgacactgtgggcggccctggcagagccgtctcacagacggccgcatcagtgcctgcctggcacccctcgtcgtcgacggacccctcctcctgttgccctgtcattccctcatgtacaagctccccctgcccctgccataggcatggtgacggtgatggacaacgacgnnnnnnnnnnccctcaggtgcgtgtgcgaatcgcatcccagaggcggtgcacgaggctcgacactgtgggcggccctggcggagccgtcccacagacggccgcatcagtgccttccgggcacccctcgtcggcggcggacccctcctcctgttgccccgtcattccctcgtgtacaagctccccctgcccctggcgtaggcatggtgacggtgatggacaacgacgagcacaaggggcccttcaatgtgggcaacccgggggagttcaccatggtggagctggccgagatggtgaaggaggtcatcaacccccaggccgaggtgggctcgatgtgtgtggccttgttttggcgggtggggtacacaggcttggtgcactgggcgagggcgcgtctcgagagggcaggtgccgaggcgacagcctcggagctgggcctggtgcgggggcagactgctcgaccatgtggccgcacgccggcaggacctccttgacgggagaaagggcagagcattgcctnnnnnnnnnnagagctgggactggtgcgggggcagactggtcgactatgtggccgcacgccggcaggaccttcttgacgggagaaagggcagagcattgcctctcccatgtgcattgacatgcgatagtcactctggcctgtggccagacgggcaggcaaaaggcccaggcagccccctcaccaaaaaggggcctgcccccccccaccttccccttcccccgctcagatcgtgttcgtggaaaacacggccgacgacccggcgaggcgcaagccagacatctccaagatcacctcgctgctggggtggtcgcccaaggtccccctgcgtgagggcctaccccgcatggtggaggatttcaagaggtgcggggatgggaggagggggagtggtatctggggcagcccgttcaattatccatcagggcttggggaaaaatgatgggaggtggtgtcggcaaattatggcaagggcaggagcggcggggctttgtggtcatcacaccgtcgtcagcgtcactcgagcgccgagccatgcgtcgaccccgcttcacaggcgnnnnnnnnnnaaagaaagatgggaggtggtgtcggcaaattatagccagggcaggagcggcggggctttgtggtcacagcatcaccccgtcgtcagcgtcactcgagagctgagccatgcgtcgaccccgcttcacaggcggttgcggctggaggagccctcgccctgatctcagcatgggacggtgcaccccggagcaggaaatccgggactccccccacttggccgcaaaggcaacacccgcagcgccctccaaatccgatcgacaggatcccgcgacatgtgcactgataagaatgaattgcttttaaatctcgtgagcaacacgtcaagctgggtcacggggtgcgggggcggaaaccgccacctgcggacgatccggcacgtgcatgcgtccggacggcgcagaaaagaagcggtgcgcccgcgttgcgagtgcagaccataccaggacggggggccgacagggcccccaaaccacctnnnnnnnnnngaaagaagcggtacgcccgcgttgcgagtgcagaccatatcagggcggggggccgacagggcccccaaaccacctcgaagcgcaattaaagcctaattgaacgacatgcgctcttcctcaatgaagtgggcggcggtatttttggcagcctgggccatggtggcagtacgnnnnnnnnnnacctggtgcgacacctcgatgcccaccccaaaccccgccgcccacgccttcctgnnnnnnnnnnggccgaattgaacgacatgcgctcttccgcaatgaagtgggcggcagtgtgtttggcagcctgggccatggtggcagtacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcgaagaataatgtgtacagtgtaggggaagggcccgcagggcatccacatacggaccaggtnnnnnnnnnnccctgcctccgccctgacaaccgaccgtgagtccaacccgagtgcaaggggacctgcagtttacagtggagcttattcgaagaataatgtgtacagtgtagggaaagtgcccgcagggcatccacataaggaccaggtnnnnnnnnnncctatgcgcgaccggagcaggtctggcgaaagtatcgccgggcccatgattccggagccgaggagtctctgcgcagcaaacgcccaggcccctcatttttcccttcctcacaggacaccaactccgacgcgccgcttaccgtccagtccatggctgaggatgtcaagaacctagcagtggtgtgtatgtggagtgctgggcttgggcggggagcagggtgtccagagtgccatgacacgcnnnnnnnnnnttctggtgcaacacctcgatgcctaccccaaaccccgccgcccacgccttcctgggtgggttgcagtacttggagatccccaatgccgacatagcctactaccgcttcggcaacaacgagaccggacgccccgccctcatgttggtgaacggcctaaactccgtcatgggcggttggcccttgcgcctcctccgtgccctggccgaggagcaggaggttttgatcttcgacaacagggggcagggcctgtccgtggtgagtaggggtttctatgcgcgaccggagcaggttcggcgaaaggatcgcctggcccatgattccggagccgagtactctatgtgcagcaaacgcccaggcccctcattttccctccctcacaggacaccaactccgccgcgccgctgaccgtccagtccatggctgaggatgtcaaaaacctagcagtggtgtgtatgtagtgtgctgggcttgggcggagagcagggtgtccagagtgccatgacacgctggagcaggatccctcctgggatcgtaacctgcccttacgtgccctcttccccgctgcaccgcacaggctctgggcttcgagacccctcccaacctcatgggagtctccatgggcggcatgatcacgatcaccgccgctgcgttgcacggcgacaccttcaaccgtttcatccccatctccggcagcgccggcggcaactcctccctgggcttcagtgaaaagatgatgcactccctcacccacctcgcccagatggacctgtacgacctgatggacatgtacttccccatgccccacccactgggtgagcagtcgagggaggggggaggggggccaggcatgtggccggcggggcatgggttcctctattgcggagatcttgtgccggcattgcagtgcaccagtcttgtggctggggctcgagtaccccactccaacgacagcccacaagaatcgctccccctccctttcccgccttccccgccaggcctgctgaccgcctgctggtacaccatggaggccttcgaccgccccatgatcccgaccaacgccaccaccaccgcacgccagatggaggccatcctggacttcttccaggacgaccaggtgtacgacctgctgcccagcatcaacagccgcgtgctggtggtgggcggcgccctggaccctgtcatccggccccagaaccagaagctgatggccaagcgcctgccggcggcctggatgaccatgttccctgagggtgggcatgccacctacgtcgagtactggtccacactggtggacgtgctgaatgtgttcctggggcgggacgcagacgagctttaatcggggcgggtgcactgcacgccgtttcggagggtgtcgcttcccttggcactaacctgtccctcccgtcctgctcaccacattgaagcccgccacagggatgtgcattttgtgtcagattcccgaccacgcagccccctgcagaatcacccacgcaccatccattcactctgccatccctgtaatctagcctggcgagcatgcaaacttggggaagggaagggggcctggacactgtagccatcgatggtcggcatcacctctgtcgctcatgctcaaatagcccggcctacggccagtccgacccgcgtgcgtccttctgcgccagacacgacccctccctgcactctgggtaccaggctagccctatttcggttcctcctgtgggtttggttggccttcgaaaccgcaaatgcatgggaggtgcgcctcaccatccatgccaggctcagctatccactgacatcccaaacgaagggggtttggaatgacaacgaagggggcggtgatgggttattgctccaagggtccacctccgcgtattccagacacgtcccatttgttgaaggatcataccttctctccacaccccagacaggaaagaagggcgaatagagcacagagcatatcagaaagggtagatcagtagaataaagaccattcaatctggtataaccaatgagaggattctgacagggcagagtaaataggaggatgtacctggatcatccccgtcatgatccagtccgccgagacccggcggactgtacagttccccagcttccgtccggagggccaccggcgaggatgctctacgcgccccagacttgatgtaaagtgtcgtacccggtttgacatctataccataaactagtcacggcaagagcctaggagctggtacgaaggacccatcatgcggtcggcggtgttcttttgtgcggcactggcgctggccatgctttgcccgtctcaagccaccagcgccccaggtgaggacaaaaccatggctgccatgccagatggtttgcatagatattctacgtgtgaaaatgatggcttgtggacggggcgtacgttgtgggcgtttgtcgctgattgccggcannnnnnnnnntgtctgtgtccccccaacccctgatgcccttactaaccccacgaccctgccgcaaccttcccatgcagtactttgacgactccaccatagacgcgctggtcgacaccgagcgtcacatcctggtcattggtgggctgttggacatcgtggtccccgcccagaaccagaagcttgttggccaggtcctgccttccgcctggatggccatcttccaggatagctcccacgccaccttcttccagcactggggcacgatccgcgagctgctcgaggtcttcctgcagagggaggagtaggaggatggagagtggggaccctacacaattcagcatgcgcccacgaccaaaccccttctgggcgccacacaactcatgggcaacccctgcgatgggacgttgcacgtgatgcacagtattcttcccagctccgattttttcgggttcctcacccacatgatcccacatttttgagcgattccatgcgcccatcgtggcccacctcgggcttcactgcccgtctcccttggaaacttaggtaccttcccccacaggccaggtgtgactacctgcatttttgtggtctaggtttacaccataatcctcatgaatccagttcttgggcgtttgaaggattgtggaggagtatgtgcccgtgtgggaaggcacccaggggcgaagagtatcctcacgccgcctcgaccaggccgcacttctttcacctcccgttgcaccgtaaggtgaccggacttgcgtcgccggcttgcaatgggaggctgctcgtcatccacagcacactcccgatgacctcgccgtcaacgcccggttatccttcctgcgccgatctgatacgagatgccatggagcaccagtgtaaggacctgaccctgggcaatctaaggttaaactgtacattggtagagtcaggtcctgaaatatacctgagacccattaggtctagtgtcctgatcgcttacttcgcaagcagtacccctggccctctcgcggcttccgtccggagggtggccggggggatggttcacgcgccataaccttaactcgatacacgttgaaacatacccagaatcagtttaccgcggcaatcgtctctaagaaggtgaatagggtccgccatgcggtccgcggtgttcttttgtgcggcactggcgctggccatgctttgcccgtctcaagccaccagcgccccaggtgaggacaaaagcatggctgccatgccagatggtttgcatggatattccacgtgtgaaaatgatggcttgtggactgggcgtatgttgtgggcgtttgtcgctgattgccggcagcgccacacctcaacgtccaccgaagcacccctccccgcagaggtgtggccgggggagaccctggaggagctgtgcggctccaactacacagactacgacactgccaccgagttctacggccccctgcagtacctggagatccctgatgtgatcgtggcctactaccgcttcggcaatgcctcctcagagctggcccctgtcgtcatggtcatggggttctccggaaccatgaagggctggcccatcagcgtccttgctgaccnnnnnnnnnntccctgtggtcatggtcatggggttctccgggaccatggagggctggcccatcagcgtccttgctgacctggcagaggacagggaagttatcatcttcgacaaccgcgggcagggcttctccacggtgagaaggctgggtggcgtggggggtctgtgctctgttccggtgtcttccttgccccaggggcgacatgatgtgtcggaggccaactggctgtacttcaggcctgctcaatcctggaccatccccaactatgacgcaggacaccagccccgacgtgcccctgagcatcctctcaatggccaacgacaccaagaactttgttgagnnnnnnnnnnnnnnnnnnnnnnnnntggcaggggaggcgggctgggtggacatcaaggtgcatgtgactagggattgaagggggagcgccctgatgaagcatgggcgtcaccacggcaaattgcacctgcccctggtgcaaacactggaaggcnnnnnnnnnncagggggggcgccctgatgaaccatgggcgtcaacacggcaaattacacctgcccctggtgcaaacactggaaggcaggatcaaggctgtgacctcccctgcacctagaccaccaccttgatcagcatctttcaccgagaaccccagtccattaatgcaccccgggtgtcgacccgcgcgcattgcaacctcccacctcccaaccctgcccccaccgctccccaggccctggacctggccaggccgccccacctcttcggctggtccatggggggcatgatcaccctggaggccgccgcagtgtacggtgattccttcgaccgcttcgccgtcttctctggcagcgcgggatccctccgctctcagctgccctccaccacaatcctggcggagtttcttgccgacacccctgtgagtcaggtggagnnnnnnnnnnaccacgatcctggcggagttccttgccgacacccctgtgagtcaggtggagaggcttggcaccttcttccccctgaacaccacagccggtgagtggcaggccccagggtggaaagggcataggctgtgcagcaggtggtaggcagctggcgggacccagccaccaccctgtgacctccccacaggcgtggaggcggcctgcaagtacgccaaggagatgcagttctcccctgacgaccccgaaaacaagctggccagcaagaagcagctggcagccctgaccgactacgtgagtgcgggcctgtgggagtgtcaactccagctgcctcctggtcttgggctctgggcgatatatgttccgcttccaagcccgcgctgcgcccacccagcccacccaccccctccctgaggattttaacgcagcgctgcacgcctgaggaccctctacccatccctctgaaactcaacccccgcgccccacccctatcatgtagtactttgaggacacnnnnnnnnnnacgctgtgcccacgctgtgcccacccaccccctccctgaggattttgaggcagcgctgcatgcctgaggaccctttacccatccctctgaaaactcaacccccgcgccgcacccctatcatgtagtactttgaggacaccaccatcgacatgctggccgacaccgaacggcacatcctggtggtgggcgggctctgggatgcggtggtcccagcccagaaccaaaagctggtggggcaggtgctgccctccgcgtggatggccatcttcgaggacggcgcccacgccaccttcatccagcactgggacacggtccgcgagctgctcaaggtcttcctgcacagggaggagtacgaggatggaaagcgggggccctacacggggcagggtacgccctcgtgacagaatccccttccagctggccatgatacatgtgcaaaccctgcgataggacgctgcacgtcatccacagtgctccactcccaacgaagcctcattcaggctctcctcccacattttaccgcatattttaacaactccacatgtctatcgtggccacctcggcctcaatttacaccctcctttggaactcagggtcctctgcccctggccaggagtgnnnnnnnnnncgatacatgtgcaaaccctgcgaaagggcgctgcacgtcatgcacagtgctccactcccaacgaagcctcattcaggctctcttcccacattttaccgcaaattttagcaattccacatgtccatcgtggccacctcggcctcattttacactctcctttggacctcagggtcctctgcccctggccaggagtggttgcccgcatctctgtagtccatcgtaacacctcaccctcgtatttcagcagcctggcccttgaatgatccgtggaagagcatgtgccggtgtgggagggcaccccgggcggagtatctccgcacgctgcctttcccaggccgcgcttccatcaccttctggtgcaccggggcatgaccggatttgcgtcgtcggcttccgaccgcaggattaccgggggggatgtttcacgcgccatggcctctataaatagtagagtgcacttagaagatcttccacaatcaatttaccacaacaatattcagagaggaggtgtataggatccgcgatgaggtcggccttgctcttcggagccgctctggcgctcatcctgctgataccaactcaagtcaccagcgcacaaggtgaggacgctctccagggtactatgcctcagacttttctatggatttacaacgtaccaattgcaatggccaagttgttgctgcatactgtttcgggatgcatgctgcaggcgtacgccgcacaacgccatttccgtcgacatacccctttccatagacgcgttgtcgtgggagaccctggaggagctgtgcggcacaaactactcgagttacgagccagccttggaattatatggccccatgcaattcttggagatcccggatgtggtgatagcctattaccgtttcggaaatgcatcaaccgagctcccccctattgtccttgtcgtgggtttctccggcacaatgaaggactggcccatcaccatcctatctgatctggcagaggacagggaggtcatcatcttcgacaaccgtgggcagggctcctccagggtatgaaggttgtgtgggtgcacaccactcgtccaannnnnnnnnnttcttctatggatgtacaacgtaccgattgcaatggccaagttgttgctgcacactgtttcgggatgcatcctgcaggcgttcggcgcacaacgctatttccgtcgacttacccctttccatagacgcgttgccgtgggagaccctggaggagctgtgcggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaaatgcatcatctgagctcccccctgtcgtccttgtcgtgggtttctccaacaccatgaaggactggcccctcaccatcctatctgatctggcagaggacannnnnnnnnnggaacggggatggggggtctcatgcccctgcaccaacaccaccacctcgattgcccacaacctccacgggtgcattgagttgcctggggcgccccacccctcatcctgcacgcctcgccacctccctgtccaccttcgccactgccaaaccccaggccctggacctggccaggccgccccacctcttcggctggtccatggggggcatgatcaccctgaaggccgccgcgatgtttgccgactcctttgaccgctttgccgtcttctctggtggtcctgggtccctccgctcccagctgccctcccttgagatcctggagaagttcctcctcgaagacaccatgactgaggtgtacaggctcggcacgctgtttcccctgaatacgacatccggtgagtggcagcaggaggggggagggggaagggggcggg

SEQ ID NO: 45606 - DNA, 78 bp, Chlorella protothecoides
gcctgcctggcaccgcgagagctggcgctcaggggccatcgagcttcatgcaagactcctcaccgcaactcacctttt

SEQ ID NO: 45607 - DNA, 70 bp, Chlorella protothecoides
cacatgcccatcccctgtcccctgctgctggatgccagctaaacaaccagtgcatgtctgtaagtgacaa

SEQ ID NO: 45608 - DNA, 61 bp, Chlorella protothecoides
cctgggccaatggaatggggagactggccgaccccttcctgtcgaggccctgcagtcgata

SEQ ID NO: 45609 - DNA, 64 bp, Chlorella protothecoides
ggccaggtcagacgtaagaatgtccataggggaaaaaaggagtctgctcagggacccaagcaca

SEQ ID NO: 45610 - DNA, 100 bp, Chlorella protothecoides
cgcgaggtggtgccgctgaagctgctcaacccctcaccacgtcctccgggagccgcccctccaccaccaaaatttgggtctatcagtggaaccgccactc

SEQ ID NO: 45611 - DNA, 61 bp, Chlorella protothecoides
accgcttcaccacagtccgcccaccgatggtgggttgccgagcctgcgtattccgaggaaa

SEQ ID NO: 45612 - DNA, 66 bp, Chlorella protothecoides
cgatgcgcagcatgcacagcatcccgtggtgggtcgagatcggtcggaaactcccgctgtcagccg

SEQ ID NO: 45613 - DNA, 7315 bp, Chlorella protothecoides
  modified_base (103)..(112): a, c, t, g, unknown or other
  modified_base (535)..(544): a, c, t, g, unknown or other
  modified_base (925)..(934): a, c, t, g, unknown or other
  modified_base (1380)..(1389): a, c, t, g, unknown or other
  modified_base (1532)..(1541): a, c, t, g, unknown or other
  modified_base (1620)..(1629): a, c, t, g, unknown or other
  modified_base (1769)..(1778): a, c, t, g, unknown or other
  modified_base (1830)..(1839): a, c, t, g, unknown or other
  modified_base (3105)..(3114): a, c, t, g, unknown or other
  modified_base (3597)..(3606): a, c, t, g, unknown or other
  modified_base (4835)..(4844): a, c, t, g, unknown or other
  modified_base (5030)..(5039): a, c, t, g, unknown or other
  modified_base (5225)..(5234): a, c, t, g, unknown or other
  modified_base (5647)..(5656): a, c, t, g, unknown or other
  modified_base (5906)..(5961): a, c, t, g, unknown or other
ccctcccccaccccccaccccccaatggagtccctcaccctcgtggttccgtggacgcacaccgccagatccttggtgtactctccccccctgatcacggtcnnnnnnnnnnatggagcccctcaccctcgtggttccgtgcacgcacaccgccagatctttggtgtactctccccccctgatcacggtcagcacgctgtcctccaggtcggtggtgaacttggccagctcctcgttgccgtccagcttggcgcggtgtgccagtccccgcgtccaggcaaagatggaggccacggggttggtggaggtggggttgcccttctggtactcgcgccagtggcgggtgaccgtgcctgttggttttccccgtgtgtgtgtgtgtgtgtgtgttagggtaggggccgtgagtgggcaaggtacatgtcgggaagaaagcaggaaggacgaagtgacaagggtcgagccgctcctgtgcatgattcagagagccaggagggtgcgcatgccgctgcaaccctcaggctggggcacgtcnnnnnnnnnnagaaggacgaagtgagaagggtcgagccgcccctgtgcatgattcagagagctaggagggtgcgcacgccgctgcaaccctcaggctggggcacgtctcctggggtggccagggtttgattcttgccccgcgcccctcatcccatggatgtcctctacaagcaaccccccatgtaccaaccccaggaagaagacaatcccctgataccctcaccgtgcgcggcctcggcctccatggtcttgccgtcgggggtgaccaggacggaggtcatgagacccagggagccgtacccctgcgccacaatgtccgactgcacgtcgccatcgtagttcttgcatgcccacacaaaaccgcccgaggacttgagggcctgggccaccnnnnnnnnnnagaggtcatgagacccagggagccatacccctgcgccacgatgtccgactgcacgtcgccgtcgtagttcttgcatgcccacacgaagccgcccgaggacttgagggcctgggccaccatgtcgtcgatcaggcggtgctcataccagatgcctgcggcctcaaagtccgaccgatacttggcctcgtagatctcggcaaagatctttgtggggggggcagagaagggaggcatccgatatggagggtgggttgacggcgcgaggggtgactttcctggagagaaggggctcccagccatgccgagcctggcatgttgcatggccagcgtcacatgcacacatcagctcttggggtcctgcacgcagtgcaatgcacccgcctggccctccatcgtggcacgcacctgcaggaaacggccgtcgtacttcttcaggatggtgttcnnnnnnnnnnaagccctgcatgctgcatggccagcgtcacatgcacacatcatcccttggggtcctgcacgcagtgcaatgcatccgcctgcccctccatcgtggcacgcacctgcaggaagcggccgtcgtacttcttcaggatggtgttcnnnnnnnnnngtgtgggagggggcagagaagggaggcatccgatttggagggtgggtcgacggcgcgaggggtgactttcctggagagnnnnnnnnnnttggtggacaggtaaagtggcctggcgaggaggaggggaaggaggttggaggcagggcgaccagcgtctcgcgcggctcagaaacggtggtgccatgcagatccgtgtacaatgctgagcaggagacgtatcccgcagannnnnnnnnntgaggccaggcagtcgactgctgctgcctgcacagacaccagcacacctggnnnnnnnnnngacagtggtgcaatgcagacccgtgtgcaatgctgagcaggagacgtatcccgcagacccaggccgccaccagtcccatggcgccatcaggcatgcgcgcaactcgccgaccgaggccaggcagtcaagtgttgctgcctgcacagacaccagcacacctggcccacaatacagtgccactcgaaacccgtccccctcaccccacccctgacgcaccacttgcgagacagggcatactggaagcaggactgggcaaagccgcggatggactcctccgtgttgtacatggccaggccgacacccgggcctgcgtgtggcagagcgggtactcacacatactaataatcacggcatccactcgagcatcatgcactcagcttcaagcgccctgtgtcccctccccacacccctccccttccaggccatccccctcttccaaacccacagaccaactcgccctggaacttgaagacctcaaagttctgcacctccccgccgtcgtctggcgtgaagcgcagctccagcttgcctgccccggggacaaccaggtcggtggccttgtactggtcgccaaaggcgtgcctgcccaccacgatgggcttgcgccagcccgggacaatgcgcgggatgttctcgatcacgatgggctcacggaacacggtgccattcaggatgttgcggatggtgccgttgggggagcgccacatctgcttcaggccaaactccctgacgcgggcctcgtcgggggtgatggtagcgcacttgatgcccacattgtacttctgtgggggggaagcggggtgaagaggagcggtgtgcctctcagggcacagctagggggccgaccctgcacggtgagcgagtaggggcgccgcccacacaacacccaaatcccaccttgatggcctcggcggcgtcgacggtgatctgatcgttggtggcgtccctgctctccacgctcaggtcgtagtatttgatgtcgaggtcgatgtaggggaagatcagcttctccttgatctggtcccaaatgacgcgggtcatctcgtcgccgtccaggtcgacgatggggttcaacaccgcaatcctggctgctgccattgcagaaccggagaagtaacgatctacacagcgaggtggagggaaaggggtgaggggcgcggggtctgctccatgagaaacaagcaaaggatggcgatgacaaaccccaccccatgaagccccagcccttcatgtacggcgaggagtggacaaacccattccaatctnnnnnnnnnnacgcggggtctgctccatgagagacaagcaaaggatggcgatgacaacccccaccccatgatgccccagcccttcatgtatggcgaggagtggacaaacccattccaatctccaaattgctatttggagcacttgcaaagcaatgtgtcagccactcacgctctccgtgcttggcactcctcagtgagttgggtccggagcggctgactgcaagtctcgcgatttgtcggattccgttcattctgtaatactgagaagcattccaggatatgccacgctgtgccgtggtgagttggtaaactcaacatcccacgtggacttagggtggggggccagtcctccgcaacggcgcgcgctcttggccaaggatatctgccggaccaagtcctcctgggggcgggctcccgtcgagcactcgtaactcatggcgagacaacagcgagcaaaatacaagactatcattcagggaatctgtcagagaannnnnnnnnnggggttggggggcagtcctccgcaacggcgcgcgctcgaggccatggatatctgccggactgagtcctctcgggggcgggctcccgtcgagccctcgtaactcatggcgagacaatagcgagcaaaatacgagactatcattcagggaatctgtcagagaatgcgaaagttttaccaagtatgaccttcgtttcaatggaccgtcttcccgatgctcgtttgccccattactctgcccgagtgacactgtgctgcttgactggccgcctggtaccctgaacatgattgcatgcagagtggcctgaagagtctgtactcccacaagtctccgattacctcttgatgacgggacgcctatcttgagagaagaaccaaaactagtaggttggtggcaccacaggtaaaagggaagaaggggaatctggtgtttctggcttccaatcccatcctggcatccggatcccaccccaggcagcaaaccactgcagcaagagtggtccagccatgcagtgtcagtaacgtcaacctctcctcacgacgtacctcagtggttgataccagtgtgggctcccctcgtcaaaggtggatctcgggacaaccttggaaactagactcattgctggcacccacccctcggccatgccatctccaccactcctcactggcctgctccaggtattcctcagctgaaaatcccgaggcagacgtcacatccggggccaacctgactgttaccatgtgcaggttccttgtctgctcccgagcgattctctcactacagggtgggtgcagcgggttagtagatctactgttctgcaaggaacgagcgtgttgcggaggttttgcatgccacaaggtctggaaggacggtgatggaatgcaggctgatgcaccgagtttctgcagcaggtgtcggggtctggcttcagggactatgaagctgtttgcccttttgtaccacaaaatcaacatgaaacttgcactgtaatagattcatatcagagagtggggctttgggatctgaattctgaggtagagcctgggtggaggggcagcgtggtagcagggcagccttgaaatggcaggcccaaggagctgttctactgaagacctgatgcagatcggactggccacactcgcctatcaccggaggagtaatcaagttgcagtgggaccctctctgcaagatccatccctctggtgaggccagcgcaatgcacctgccaggnnnnnnnnnncatccttaaggaatttcatcgaaggtttcggatcaacatatactgcctgcaaatcatcgtaatatttgagctggagttctcctcgtatcttccatgcagttgtatcacgtcgactccaacgcctttcatccgttagtgacactcccactcagaaacctggcaggtgcattgcgctggcctcaccannnnnnnnnncttctgagtgggagtgtcaccaacggatgaaaggcgttggagtcgacgtggcacaactgcatggaagatacgaggacaactccagctcaaatattacgatgatttgcacgcggtatttgttgatccgaaacctttgatggaatttcttaaggactatcatgctctgcacgatacattgcacggggnnnnnnnnnnattatcagctcgaaaatttccggtaactcacataatcgaaatttttcattttcggtaaccctgtccgcaagacttgacacgtgaggcagctggaggttcgtcaggatgcggagttgccatttctgaggcggcattaaggggttccaaagctgccatcgccatcgggtaacttgtcctggatccaatggtacatgaggcctgggataaagatgtagagtgctgggaatcggtcatcactcccttgcgagtcaagtgaatgaatccaacgccgctctcatcctgcatcatttaaaaatggggaccggtagggttactccggattcccgcgaggagcatcaagcgcgtcgctcatgttacccctgcaactataaatgctacaagtgcaggggcccagtagattattttcaacactnnnnnnnnnntcgccgctttcatcctgcatcgttttaccatggggatctgcaggatctctccggattcccaccaggagcatcaagggcgccgctcatactcccctgcgcctatacatgctgcaggcgcaggggcccagtagattattttcaacacttgcagcgtgatattcgaccgacgtccagcaaagaaaaggcgtaccgacgcaaggcaacatatctcatcctgatcgcgcacacgtcaacagggacagtgacgcgnnnnnnnnnnnnnnnnnnnnnnnnnnnnnnnnnnnnnnnnnnnnnnnnnnnnnnnncccgcaagaccccatatcttaatatctggcctcgtcctgctgctgaccagatgtgccttcgcggtgggttggattgctccctggtggatgtcgatctcacgtcagctccccttcgcgagtgacccatcttcgctcttttccccgctttcgcgcaccccgcaggccacatgcagctccacattcttagctctacccagtggaatgtgagacgtgagctgtaatgattcgggggggtcctacgtgcgaccccggtgacattactttccgcacgtgccctagcacacattcctccggtcggacccgggtccctactcgctgctccccaggggtgacagacctgcttgtttgaacacgcacgtacagattgtatgcgatttggctcactagctcttgtctattaccgatgctttttcaacatctcgcatatgttcgatcccttgccgtctgggagcccacgtgtatctgatgacggtcgatagtgcggatgccatttgcaagtgagtaccacatgggtgggtttgcgcatgagatcatgtgcttgcacgccactgagccggcccaggtaaaaccatcatcaagctgaagcaccatcacatgtgtcatgatatgcacacctcaatctgtgtacgcccccctctcacaaatcaaaggcacaagggcttcagtagggtgggatcaatccgcacctcgacccttcacatcgtgggactctccgtgtcagccatccgtgtgagcaaccatgagatcctgtcggatcgatccacggagatcctggtggctgtggagtgcttcaagccggcctagaaggcatgcacggcagacagcaacggcaacattggcaccggcaacaagggcaaaaacaactttggcaccaagaatgtcgggaatagtaacatcggtgagcatggattggcatgtgcattcgcatccaagatgtgcagagccactgcaatctttacagagaccgactcaaaagtgaattggtgctgccctcttgcaggtaactccaatgtgggcgccgccaactggggaaacaataataagggcacgggcaatcgctgctccaacaaaactggagaccgcaaaattctgaacgactgcagcctgcaagaaatttgtaactacgcatgggtccttagcttcctgcccccacccgccaagaagtcgcccccacccgccaagaagtcgccaccgcccccatctaagaagtcgccaccgccctcatctaagacgtcgccaccgccctcatctaagaagtcgccaccggtcccatctaagattcctcctccgccgccagtcagcccctctcctccgcctagtcccattccctcaccccccccaccaagcccctcac

SEQ ID NO: 45614 - DNA, 64 bp, Chlorella protothecoides
cctcctgtttgcacgccttgctggcctcgctggcctgggtctccattgcctgccactgtctcaa

SEQ ID NO: 45615 - DNA, 62 bp, Chlorella protothecoides
agccggagagcgagacgcccctggagcccgccacggagaccacagcccccggcgcagccgtc

SEQ ID NO: 45616 - DNA, 11345 bp, Chlorella protothecoides
  modified_base (468)..(523): a, c, t, g, unknown or other
  modified_base (1015)..(1024): a, c, t, g, unknown or other
  modified_base (1210)..(1219): a, c, t, g, unknown or other
  modified_base (1309)..(1318): a, c, t, g, unknown or other
  modified_base (1396)..(1405): a, c, t, g, unknown or other
  modified_base (1473)..(1482): a, c, t, g, unknown or other
  modified_base (2043)..(2052): a, c, t, g, unknown or other
  modified_base (2784)..(2793): a, c, t, g, unknown or other
  modified_base (2871)..(2880): a, c, t, g, unknown or other
  modified_base (3508)..(3517): a, c, t, g, unknown or other
  modified_base (3876)..(3885): a, c, t, g, unknown or other
  modified_base (4662)..(4671): a, c, t, g, unknown or other
  modified_base (4916)..(4925): a, c, t, g, unknown or other
  modified_base (5388)..(5397): a, c, t, g, unknown or other
  modified_base (5826)..(5835): a, c, t, g, unknown or other
  modified_base (6025)..(6034): a, c, t, g, unknown or other
  modified_base (6121)..(6130): a, c, t, g, unknown or other
  modified_base (6727)..(6736): a, c, t, g, unknown or other
  modified_base (7073)..(7225): a, c, t, g, unknown or other
  modified_base (7631)..(7640): a, c, t, g, unknown or other
  modified_base (8067)..(8076): a, c, t, g, unknown or other
  modified_base (8554)..(8563): a, c, t, g, unknown or other
  modified_base (9483)..(9492): a, c, t, g, unknown or other
  modified_base (9650)..(9659): a, c, t, g, unknown or other
  modified_base (9721)..(9730): a, c, t, g, unknown or other
  modified_base (9928)..(9937): a, c, t, g, unknown or other
  modified_base (10141)..(10150): a, c, t, g, unknown or other
  modified_base (10355)..(10369): a, c, t, g, unknown or other
  modified_base (10480)..(10489): a, c, t, g, unknown or other
  modified_base (10607)..(10616): a, c, t, g, unknown or other
ggagagggcgctggagctggagcggctgggcccgacgcgcagcccctactcggacgtggcgcggcggcgcctggcgctggtggagggcgccacgtcggtgctggccacgctgctgcccgcgatcgagcccgtgaccaaggccacgatcgtggtgcgcgaaacgtaccccctgggccacaccgtggtggagaacagcgagcagcgggagctgacgcacgtgtacacgcggcgctacctggaggagcagatgctgctggtgctggcggggcgcgccgcggaggaggcggcctacggcgccgagggcatgagcacgctgtgccaacgccgcgtggccatggcgcgccgcatcgccaacaagatggtggtcagcaacgccatgacatccgcggtggggccgcgcctggtggcccaccccgacgggtgagctgtggatgttgttgtttggggggggggggggggggggggggnnnnnnnnnnnnnnnnnnnnnnnnnnnnnnnnnnnnnnnnnnnnnnnnnnnnnnnnttctgagagggggtggtaactgaatgtgatccattgggaaagacagcaatctcccatctctgcgtgccttcaggacacccttgttccttcccctctcgttaccaatcacaggcccggcgacgagatggacctgtttgtcacccgcttcatccccgtggacgtggcggagacggtggaccgcaccatctccgaggtcatgaccagggcctacacggccagcctggccatggtgcgccgcaactttgcggccatcgaagcgtgcgtaccggggcgactggtggagtttgttggcagggaggtgtgcgtgcgcgtgtgtgtgtctccgccgtcgtgcgctgtggtcagcgcaagtcggcacccgctgcactcgcgaacgaaatccaggatgcgctgtcgtaccctgtggcctgatgaataacattcatccacacccatccccccccataatacacaaaaaatcctctgcgcagggtggcggacctgctgatggannnnnnnnnncgcgcgcgtgtgtgtctccgccgccgtgcgctgtggtcggcgcaagtcggcacccgctgcactcgcgaacgaaatccaggacgcgctgtctcaccccgtggcctgatgaataacattcatccagacccattccccccctaatacacaaaaaatcatctgcgcagggtggcggacctgctgatggannnnnnnnnngagggtcatgccacctgtggcaagcattaggccggcctcaaggggctcacccctcgataagcttgaccctggcaccctgggcgctggtcnnnnnnnnnntatgtgatcccggtgcctccaggtggacaccaccacacctggccccggcgactgtgggtgggactgagaaagttgcannnnnnnnnnggctggtacaacaatggaatcaccaacacccaccaggctgggcggcacgatgagcttgcgctggccgnnnnnnnnnnctgaagcatggctgtgccgaggacctggccttcagggagaaggaggtggcgcccttcatgtgatcccggggcctgcaggtggacaccaccacacctggccccagcgactgtgggtgggactgagaaagttgcacacagttcttcgttcatctccgggcatcaccccctctctgcgatggctcagatgtatgtacaagcaagcacacagcagaactgtacagcgccggaaagggtcacgccacctgtggcaagcattgggccggcctcaaggggctcacccctcgatgagcttgaccctggcaccctgggcgctggtcttgatgtacagcagctccacgtcgatttcgagcgtggcgccccccggcacctcaccgacgccccggtcaccgtacgcctatgtgttagtgggggagggattgggaaaggggttgaaggggggttgcacagaaaacgcagctgggagtgcccagcgcagacctctggtgacctcgaggccttcaaggtatatccatttgcagtgccgtcctgttgcaatggcaggcctgttacatatgggagtannnnnnnnnnaacgccccggtcaccgtacgcctatgttttagtgggggagggattgggagaggggttgaagggaggttgcacagaaaacgcggctgggagtgcccagtgcagacctctggcgacctcgaggcctcgcaggtatacccatgtgcagtgccgtcccgtcgcaatggcaggcctgttacatatgggagtagcctctccaccagctggtacaacgctggaatcaccaacacccaccagactgggcggcacgatgagcttgcgctggccgcccacccgcatgcctcgaacacccaggtccagacccctcagggtcccgccagcgccccgcgcgcccacatcaaaccccaggggattgccgccagtcacccccagcccctggctgtgtggagggtttgcagggaggtgggtgcgatgtgtgttggcgacagtccaccagctgccgggctgagtcactgctccctgcacaagagattcaggacccctgacccccacaaagacaccgaggacgcaccggctggtgatgaaggtgatgccacgccacctgtttcgtgggaaggtatggggaggtgatgtcgactgctggggcccactgctcgagaggaacatgcaggcagtgggcagcatggaacaggcggccaagaatcaatgtttgcggcttgcaacatccaaaacgccagagccacacccccaaccccagttccataccccagaaacacacttggcatcaaagtggannnnnnnnnntagggcccgtgctggtacacaattcctttgctgagccttggccgctaaattccggtgacaatgccagggatcggtgcnnnnnnnnnnatgcggcttgcaacatccaaaaagccagagccacaccaccaaccccagttccatcccccagaaacacacttggcatcaaagtggacgacgactcgctggccttcatgcgcctcaggccccttgccgggcgagacgtcgtagtacttgaggccttcagggccggccttgaattcggactcggggatcttgacccgccgcttggaggtgagatccttcttgaagccggggaaggcgtgggaggagctgggagcggccaactgggccagtagaaaggctgcaggggctgccatggcatgcttgatggcctgcctcctgctcgggtccctgcctcctagataagggcccgtgctggtacacaatttctttgctgagccttggctgctgaattccggtgacaatgccagggatcggtgcagccgaggggtgctctgtccactcgcgcatgacgaggttcgacatgggatatgcatggtcgggcccttgcacagactgcacgatcctatcatggcatggagctgccaagcaccatactccattttatgcagaacttgtgcaccaaggggtgcaccagatgctccatggacaagattggccatggtcgatcttggtgatgaatgaacttttaaannnnnnnnnntaagatgctccacggacatgactggccatgtcgatcttggtgatgaatgaacttttaaacgtatcaaccatgatcgcgacggatcctacccagcgggcagcacttcctggcagtctctccttcctggagtaactcttcgtaacattcagcgcatcggtcgggggacaataacggcacatgggagcggacgactgggcatggatgctggacatggtgctcgttggtcttgcactcttctcactttgaaggcctgaaaatatcgtctgtgatctgacccttcctgcagagagcaagtgaggatcactgctgagattcagtggtgtagataatgcattgtgttccagatttcaacaccaggnnnnnnnnnnggagagcacgctaggatcactgctgagattcagtggtgtaggtcatgcattgtgttccagatttcaacaccaggtttctatatattgaaagatgtgatcactttacaacccaaggggttcccaccaagcatcttgcaagcttcccctccctcaccttgtgtattggacccccgcctgtgcggctgctgggcagggcctgtatgccttgagtggaaaccaggagaagccaggcactgagcccaagccacccactatgcggcccatgcggtcacagctgtaagagggatggtatggtaaggtggagctggttgagaccctgactgaggctgcggggcaacctcgccggtagtgagcaagatcactccaatggcgaggtgactcacccagaaggaattgcgtcagtaggagcaccgcacgtctcgcatcggttggaggtaccctcagtggcgctctgcagcaagggtgagaggatgtccaatgaggcgtccaggtttgcgaggggattcaatcaagctgaccttcatgccggctcgcattgaacagcacggctaccatttacctcttcagttggctctggggacccttctacagcttttcggggacccacatggcggcttcgcgtactgggtgtcaggtgaagtcggtgctggcgcgatgtgaaaagggtaggggtggggttgatggcgatggagtgcatggctagcgtagcgcggtaaatgcaggatttgaagagtctggaggttaatggtatgggtcgccacgaggtgcttggagatnnnnnnnnnnagtggcgcggtaaatgcaggatatgaagagtctggaggttaacggtatgggtcgccacgaggtgcttggagatggtttgcaacgtgagctcaccacttcaaccgcaatcagagctcagcatgctccatgtcatgcaagcctccatgcaacaggtacctgcattgacttgatgaaacacagtctggcctgagcccaatcgcgcacgtcatctctaacaaacagctgagtacacgcagaaggaaagnnnnnnnnnncaatgaaacacagtctggctgagcccaatcacgcacgtcatctcttacaaacagctgagtacacgcagaaggaaagagtcggtctttgcgaggcatgcaaaccgtcctgctcattcttgctgggagaagggggtaccagggggaggatgcaaaaagaacatgcttggcgtgctggagtcgggcactaggttcaagcgagaggcaaagccaatctgagaggctgaatagagactggaaaactcacacagaatgatgtgcggccaaggtggtgcctcgggacatggcaaagaccatcaggaggacactgagggtgctccttgatgtgacaggcacttgccgctggggtacatggaaaagtcaatcatggaggagggtacttggtaggtttgggggtacagcagaatgtacggatgcacaaggaagggggctgtggtaccctcgggcaccccgcccgagggtaccnnnnnnnnnntgcagaatgtacggatgcacaaggaaaagggctgtagtaccctcgggcaccccgcccgagggtaccacagtcagatgctgacatgttggcccctgccagctccaccccgctcagttgtagctcgcgtcgctggaggagtcgggggagcagacgccgttggcgctggctgacctgctgcccccactccctccctcggaggaccgagcctccgagggccgggcctggcggcaggcctcggccatgaactcgtgggtgcgcagctgggcctcgatcctggccatgagctcgaagcagccaaacggcttgggcaggtagtcgttggcgccggcctggaagggtaggggcgcctgtttgatggagcgtacttctgtgggagcccagcgcacccccagggatcacgccggcttgccgcagaggcatgctgggtgnnnnnnnnnnattctgtgggcgcccagtgcacccccagggatcgcgccggcttgccgcagaggcatgctgggtggcgcggtgggcctctgtgatgagcaaaacagggtgtaatgcatccaacatatgccaaccctgcatcctgcacggccatccagagcccaagcaccgccactcgcctggagaccctcgaccacggccnnnnnnnnnncgctgcccccactccctccctcggaggaccgggcctccgaaggccgggcctggcgacaggcctcggccatgaactcgtgggtgcgcnnnnnnnnnngtaccaaccctgcatcctgcacggcgatccagagcccaagcaccaccactcgcctggagaccctcgaccacggccttctcccagcaggaggccgacaggatgatgacggggagcatgaggcctggccagcgggatcggatggtgcggatgacgtcgaacctgcggagacgaggggtcaaggggatgccgagtgttgcagggtggaggtatgtgcaggtacctgcggccccagagagttctctgcatggccacctgccctccgcttcgagctccctcccccccaccccccacccgctggtcttgggcatcatgaggttgatgaggacgatgtgcggtggccggccggccagaatgccgccctccagcacgtccaacgcgcgctcgccgtcggcggccttgctgacctggaacccgctgcgcgacagcatgccctgcaccaccgtctgcgtcagcgggtcgtcgtccaccgacagcacacggatggccccgcgctggcgcatgtcctccacgctctgccacgcgcgctgccagtcgggacgggactcggcgcccccggccccacgcgtcggcagcaccagcgggccgcggtcggagccnnnnnnnnnngcgggactcggcgcccccgcccccgcgcagcggcagcaccagcgggccgcggtcggagccgctgggggggccgccagactccgccgtgctggcgctgggcaggaggaagggcgacatggcctggtcgcccgaggcgccgcccgcgccgcaggcgccggcgtcggccgccgcccagtcgccctgcgccccgggccagccggggctcggtccggcggcgctggtgaaggcgctggcggcggcctccgggctgagctgctgcggcgccttgcgctgcgtctcgcgctccgtggccaggaagtaggtggaccggctctccagcgacaggcggtccagcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcgcacgccggggtccaggcccgcctgccccagcagcagctggagcaggtcctcgcccgcggccccgccgtcgggctgggcgcccaggcccagcgcgccggcctcctcctccagcatgtcgtcgatgcgcggcgggttgcgcagcgtgcgcccctggctgatcacgcccgccacggcggcggccttggagtcggcgtcggtgtacacctgcgggaggaggtgggtgggtgggcagtcgttcgaatggtcgagggggccgatgtcagactggtcgtgcggcagcgggcctacagggcatgcgtgccatgaacaaccctgggctcgccgggatgatccatccagacgacgtcacaacccaggcctttgatacaaggcaggcaagccgcctccagcacccccccagnnnnnnnnnngagcgcatgcgtgccatgaacaaccctatgctcgccgggatgatccatccagacgacgacacaacccaggcctttgatacaatgcaggcaagccgcctccagcacccccccagagtccggcccactggcagggtgaaggtgaaggtggagcccttgttctggtgtgaggtagcgtggatggttcccccctgagcggccagcagctggcgggccaggtgcaggcccagccccgtaccgctgtaccgcctcgtgtagctcatgtccgcctgcagcaggggtggtggtttgttactgtgggggatggacatcattggtgcaaaacatgcatgctttgcagggtcacaggggcgattgcagactgaacatgtagcgtgccaaacccccatttcacccttccctgccagccgcccgggagctcccgcgctcnnnnnnnnnnaagcgtgccaaccccccctttcacactttcctgccagccgcccgggagctcccgcgctcaccaccccactcccaaaccaagcctcctgcctgggcaaaagggccgaagatgaggtccagcttgcttggcgggatgccgatgcccgtgtccgacaccgagatggacaccatgttttctctctccgggccagcggtgagcatgatgcagccctggcggtgctcgggataggagtgggggagaagtctgtgcagacacaaggcgcactggagtcggtccagtggttgagtgccatgccctggatgttgatttcaggggcccagcacccctcttcctcagcatctaacgctggctgccctccttgccaaacgcgtgcgggtagggggtggcggcagctgtctgcagtgcgcgtgccgctggaggccacgagatttgtgccctcctgtgccaccttctcccagggcaccctccccaccaagcnnnnnnnnnncgcagcgcacgtgccgctggaggccacgagatttgtggcctcctgtgcccccttctcccagggcaccctccccaccaagcaccacgccccatcccccttggaccccccaccccaccaccaccaccaccagctcgccttgtcggtgaacttgcaggcgttgccgatgaggttatacatgacctggatgaggcgccccgtgtcggccttggcggcggggaggtcggacgggatgtcgttcaggatgaccacccccggcgccgccagctgccgcaccagcgccagcacgtcctcggccacacggcgcacgtccacgcgctccagcttcaccgccagcttgccctcgcgaagcgcggaggcatccaggatgtcgttcaccaggttgagcaggcgcacgccggaggagcggatggctgccacgtcgtgggtgaccgcggggccgcggccgcgcagcggctcccccgccaggtccaggagcagtgtggaggacaggccgatgatgccgttgagcggcgtgcgcaactcgtggctcatcaccgaaatgaagtgctcgcgctgctccagcagcgtgcgcagctcctgaatgacgcgcaccctggtggagagagagtgtgtggatgtgtgtgtgctgtcgggatgggaaggggctgtgctgctttggtgcatgcaggttccagggccaaatgaaggcatggttgggtcagggcgtgtgcacgagcgcactccacagtgtgtgcggaggcagggcaggcagctatgaggcgcgaggcttcagagatctgtgccggtacaggacacaggaaagcccctcccctcacaagttgttgctagtccattgatgtccccatttatttccttggaaagtacccccccacacacaacaaaacaccagacacaacacacctgttggactcgatgacctnnnnnnnnnntgcgaggcttcaaagatctgtgccagtacagaacacgggaagacccctccccttccaagttgctagtccattgatgtttccattatctccttggaaagtaccccccccacacacaacaaaaccccaaacacaacacacctgttggactcgatgacctnnnnnnnnnnttggaccacggtccacacgaaaggaaaaagggtccagaagacggcagtggaggcacgcagcnnnnnnnnnncgcgcatggcgcgcatcttgcggtcgtcgatggtcaggaagttggagtgcaggagggaggtggagaagatgatcttgccccccagatcgcagcaggtccacagcagctcctcccaggcggtgctcacgccgcgtgcctgggccacggtccacacgaagggaaagagcgtccagaagacggcagtggaggcacgcagcnnnnnnnnnnatcgagcggggtgaggggcggagaggggggtcagcagtcagtgttgaggagttgggaggttctgctcctgatggaggtgttcactgtggcaagctccccttcccttccccatgaccctccgctggacagcttcaatggctgcaggcatgatgccagggccccccatgcgcatcccattcgcgaggccaacccacctggaggcannnnnnnnnngtcgagcggggtggggggcggagaggggggtcagcagtcggtgtcgaggagttgggaggttctgctcttgatggaggtgttcactgtggcaagctcctcttcccctccccatgaccctccgctggacagcttcaatggctgcaagcatgataccagggcccccccctgcgcattccattcgcgaggccaacccacctggaggcannnnnnnnnnnnnnnagcttgccaggccatgcgtctgccatctgtacatctcctggctggccatgcagatcacatggacaccccccacctcttctacacacacaaacatcttgccccgcccaccgnnnnnnnnnntatgaggttcagaaaggagggggtgttgctgttgaaggggggtgcaactgtgtcaacatcaatagtgccttccggggggcagggccgttgcatcctgaagcaggtcaggggataccannnnnnnnnntggatggcggaggaatacatggcccacagctcggagcaaatgtaggggaacacggcaaaagagatgatgttccagatccaccggtgccaggctgcatgagtttcagagaagagggggtgttgcggttggaggggggtgaaactgcgtcaacatcaatagtgcctttggggggcagggccattgcatcctgaagcaggtcaggggataccagcacctgcgcagtcccgaggagcttgccaggccatgcgtctcccatctgtacatctcctgactagccatgcagaccatattgacaccccccacctcttccacacacacaaacatcttgccccgcccaccgtccacgagctcccccgggatgatggtgacgatcatgacgaggtccaccagtaccaggcgccagacccggagcgaatcgaagtccgagatcatggacagggtatagatgatgacgggggtggcgtgggcccacatgacgtagcgcaggagggagacagggcgccccgacacgctccagaagatgggcgcccggccccgggcggccagcgcctcaaagacgagggccgtggcggtgatgtaggcagccaggaagcagagctggcgcttgatggggcgcagctccaggcaggcagaggccaggttcaggacggtggccgtggcaaaggccaccatgggccagatatagatgcctgggggacctgtggcgggtgggtggggggtggcggggtt

SEQ ID NO: 45617 - DNA, 127 bp, Chlorella protothecoides
cgtgcgtcgctacatcgactacaggtgcgtgtggcctggatgcaggagggcgagaggtttggcggaggggtgtaccgtcgtatgtccgagccaggggagttgatgtgtcagcttgctgatgtggagc

SEQ ID NO: 45618 - DNA, 72 bp, Chlorella protothecoides
cagctggcggaagggcgggcactggggcgagtgcggcgttctcgccgctggccgagtccgtcgccctctttc

SEQ ID NO: 45619 - DNA, 139 bp, Chlorella protothecoides
gcgaagcaatgcagtcctgtctcttgctggtactgagatccatctttgactagagtgatatgtcgaaggatgccttcgaaagatcattagaagctgtcccactaaactgcccttgacacctttatgggacgaatttacc

SEQ ID NO: 45620 - DNA, 3248 bp, Chlorella protothecoides
  modified_base (145)..(154): a, c, t, g, unknown or other
  modified_base (579)..(588): a, c, t, g, unknown or other
  modified_base (763)..(772): a, c, t, g, unknown or other
  modified_base (1215)..(1224): a, c, t, g, unknown or other
  modified_base (1370)..(1379): a, c, t, g, unknown or other
  modified_base (1708)..(1717): a, c, t, g, unknown or other
  modified_base (2081)..(2090): a, c, t, g, unknown or other
  modified_base (2702)..(2711): a, c, t, g, unknown or other
  modified_base (2808)..(2974): a, c, t, g, unknown or other
gggggggatggtggggcatctggggggatgcatgcatgggagcaggtcctgagcgcaaggtgggtggagagggacggcacgaatgccctcccccaccgcggcagcgctgatatctggcacatgcacttggtggcggcgtgccacnnnnnnnnnnagatgcatgcatgggagcaggtcctgagcacaagggggtttgggagggacggcgctaatgccctcccccaccgcgacagcgcttgtatgtggcacatgcacttggtggcggcgtgccacatctggtcattctccccaggttactgccacttggttggctggcaatgataaagtgtctcctaggcaaacacttccccacacacgaacccccctcccgcagaggtggagatcgtgaagcggcccgacggctcgccctggcagctgggcagcggcgggtttggcaccgtctacaaggccctgcgcaacggggtgcagcctgtggcggtgaagatgctctcggtgagcttcggagggcatttgcgttcaatcctgggtgctcagggtctcctgccagacatggggtcggtctgtgcggttctgggtaannnnnnnnnngtgcgttcaatcctgggtgctcagggtctcttgccgggcatggggtcggtctgtgcggttctgggtaaggcgcgagtggctttctccagccctatgcctgagtgacagctgtgaatgtcggcggcaggatgtcgtggtgcacacgcgcctacaagcggcgcatctgtccctttcnnnnnnnnnntctatgcctgagtgacagctgtggatgtcggcagcagaatgtcgtggtgcacaagcgcctacaagcggcgcatctgtccctttcccgatttttttcctgaaagtatcttggctacatcatcagccatccctcacggatgctctccaaacctatactgccaccaatcttatccctcaaccccctctttggctgctgtcaggctgtgtccggggatgtccgccaggcagccctggaggatttccgcaaggaaatctccatccttaaggcttgccgtgacctcaacatcgtccagtttgtggtgagttggcggacggagggtgaaggggaggggcatgtggtgacagcacagtacctccagtcatgggctcgctgccgcctgcatgaacctcgcaccgagctgagggagtttgtacccctggctgcaagaccattgagcttgaccnnnnnnnnnngaccacccaccgagctgagggagtttgtgcccctggctgcaagaccattgagcttgaccaagtggccagaaccgtgatcaatcaaccaaacatgtacctcgaccccctggctgttgtctgctcctttgtgcagggcgcctcgttannnnnnnnnnccaatcaagcaatcatgtacctcgaccccctggctgtcgtctgctcctttgtgcagggcgcctcgttagggccggacaataccatgctggtgacagagtactgcgagggtggcaacctgtgcaacaacattgcagcgggccgcgtgacatggttccggaggggtcgaaaggtgggtggagtggtcgttggggggggccctgggagggcgaggcggtgtgacactcacacaggccctactctgccaaccaacgactccccatgtttgtcacacctgcctcgggtgcatgggtggggccgccagctcagcaatgatgcgcaagagagaagnnnnnnnnnngcacacctgcctcggttgcatgtgtggggtcaccagctcagcaatgatgcgcaagagagaaggacctttccaggtgtcccatgcagtttcagttgcacactgccaatcttaaccaggcatgcataccaggcacatcctggagggttccatcacccctgccctgtgccggtgcccattccttagccagcccaatcttcgctgggtgcagatcgccctggacgttgcaaaggcgcttgtgtttttacacagtcggagaattgtgcattttgacttgaagtctcccaacattctactggccaggtgagtgttcgggtcttggggggaggggggggggtgcgttggagcaccgagtgtttggcattcnnnnnnnnnngctggccaggtgagtgttctggtcttgggggagggggggggttgtgcgttggagcaccgagtgtttggcattcaactcacagttccggcgcatcacccgccccacctaacgacctctcttctccccacgacagggatggcacggcaaagatcagcgatgttgggatggccaagattttgaatagagactacatcactggcgctgttggtaccttagcctggtgagcatgagagagaggggttgagcctgcgagagaggggtcgagcatgagagagaggggttgagcatgagagagaggggttgagcctgagagagagggggcgggaggaggggcgcgagactcaccttgtctggctttgcctggttgttgttgtgtaccgcttccaaccctgctcctctccttcctaactcaccaacagggctgcccccgagatgttgtggggggagcgctgctcggagaaggctgacatttattcttatggtgcggcggcggggatgcggggcacagcctgggttctattcatctacggtctgactcggtgcttgcaagcgcaacctaaccccacgccacttctccacccgctcgcaggcattgttctgtgggagatgtgnnnnnnnnnnatgagagagagggggcggaaggaggggcgcgagactcacctggtctggctttgcctggttgttgtggtgtaccgcttccaaccctgctcctctcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatccccacaccacttctccacctgctcgcaggcattgttctgtgggagatgtgcaccggggagaagcctgtacgcggccagctgcgagatgtcgtgtgcgttggggtggctgcgcggcagctgctcggggccgcttgtagtcctggggcgtggatggtgtggcgcccggggggggacaattcctgtctggtccgctgcctgcccacacccagcccccccgcccacgctccaacccccgccccccccttctctcctttcctcttcgccagggtc

SEQ ID NO: 45621 - DNA, 88 bp, Chlorella protothecoides
agcagcgtattttggctcgtcattacccatttagttcctttcctttacccctgtaggagcgccaggctgcccaaaccctgcgaggagc

SEQ ID NO: 45622 - DNA, 79 bp, Chlorella protothecoides
attgtcaaatttgttaatatcatagaaacgcaatagtatcgagtacagcgcgatagaacgccgtcacccacacatcggt

SEQ ID NO: 45623 - DNA, 61 bp, Chlorella protothecoides
gcgctggagaccttggcaggatacgggaggtgtatgagcgcgccatcgccaatgtgccccc

SEQ ID NO: 45624 - DNA, 61 bp, Chlorella protothecoides
gcagaaggagagcttcaggagtgagtagggtgcggtgccgcccttgcccctgcatgtgcag

SEQ ID NO: 45625 - DNA, 61 bp, Chlorella protothecoides
caaggccgacgcacgtagaggcggacgcacaccttgtgctcagcaacatccgcaagcatcg

SEQ ID NO: 45626 - DNA, 366 bp, Chlorella protothecoides
  modified_base (121)..(290): a, c, t, g, unknown or other
gcagcagaccagcttccgcatcctcgtgcaccacaaggtgagaagtatgcagtgtgcaagcgtagcctgctcgccgctccaaagagctaccatcctcatgggtgaaggggtgccatggtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatcttcgtcatgtacatgctccattgcaggacacttgggatgaggatgcagaaccgctgaggtgggagatccgg

SEQ ID NO: 45627 - DNA, 76 bp, Chlorella protothecoides
tcccttgttgtagctccctgcgcatgatggaactgggatgttatagccgagcaacgtcatggtcatgtatggcaca

SEQ ID NO: 45628 - DNA, 61 bp, Chlorella protothecoides
tggcgaattgaatgggaccagaacggctgggcaatgatgacgactcaagccagtccaaggg

SEQ ID NO: 45629 - DNA, 64 bp, Chlorella protothecoides
tggttgaagggatgcaggagcagtgcggccgccctgtgcgcattccttgcctgccattcgagag

SEQ ID NO: 45630 - DNA, 90 bp, Chlorella protothecoides
tgaatagtatcgggggagctgttacaggagagagcggattcggtaaagtttcgcgcctgtactgctcgtgtgatccgctccgcccaggca

SEQ ID NO: 45631 - DNA, 61 bp, Chlorella protothecoides
cccggagaacgccagcgacaccagcagcgacggcatgtctggcccagaggaggtatctggc

SEQ ID NO: 45632 - DNA, 61 bp, Chlorella protothecoides
tgcaaggttcatgctcgctgcggcaggtggaggagcctgaaagcctgtttgttgagtagta

SEQ ID NO: 45633 - DNA, 61 bp, Chlorella protothecoides
tccgcgatggcggggtatggcatggggggggatgtaggcaacacccatgacaaggcccgca

SEQ ID NO: 45634 - DNA, 99 bp, Chlorella protothecoides
ccccccccttgcatgaagcgcctgatgtaataaagtccgaaaaattttgatatagcggggtttccagcttgaaaatttccggaaattcacataatcgaa

SEQ ID NO: 45635 - DNA, 61 bp, Chlorella protothecoides
tagcaacgcaactaaggctagtaatgacggaccatccactgaataagcgacaatggattct

SEQ ID NO: 45636 - DNA, 76 bp, Chlorella protothecoides
aggggtggggagttgccctgagagggagtgtggcagcatggtaggtggatctgtgggcggatggcatgcaaaggaa

SEQ ID NO: 45637 - DNA, 81 bp, Chlorella protothecoides
tgcacatggcagagggtgtctgcccaacattatcgtgcctcccatcacccaaacccccaaagccttgccttgtcccagatc

SEQ ID NO: 45638 - DNA, 7431 bp, Chlorella protothecoides
  modified_base (188)..(317): a, c, t, g, unknown or other
  modified_base (382)..(391): a, c, t, g, unknown or other
  modified_base (578)..(627): a, c, t, g, unknown or other
  modified_base (1710)..(1719): a, c, t, g, unknown or other
  modified_base (1937)..(1946): a, c, t, g, unknown or other
  modified_base (2107)..(2116): a, c, t, g, unknown or other
  modified_base (2192)..(2427): a, c, t, g, unknown or other
  modified_base (2486)..(2599): a, c, t, g, unknown or other
  modified_base (3247)..(3256): a, c, t, g, unknown or other
  modified_base (4416)..(4425): a, c, t, g, unknown or other
  modified_base (4781)..(4790): a, c, t, g, unknown or other
  modified_base (4893)..(4902): a, c, t, g, unknown or other
  modified_base (5059)..(5068): a, c, t, g, unknown or other
  modified_base (5296)..(5305): a, c, t, g, unknown or other
  modified_base (5461)..(5470): a, c, t, g, unknown or other
  modified_base (5925)..(5934): a, c, t, g, unknown or other
  modified_base (6926)..(6935): a, c, t, g, unknown or other
tgggcgccgcgctgggctgccggccgccgctgctcgcctccgcggcgagcgcggcgggcccgacgtcggccctgatgcgcttgccagtcttgctggcggcttccaccgcgctcgtcgtcgcctttgctggggagggacccgctggctgcgagtggacacacaggggagttgggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccctcttctccccaagacacaaaccatcatcaaatctccagtactcgcacacatgatgttgtnnnnnnnnnnctcccccttccccccaagacacaaaccattatcaatctccagtactcgcacacatgatgttgtagagtacagtgccgctggggtccccaaccagcaccaaagccatcccggagtccttcccgccctcaagatcagccacggcccctccctgcccccccttccgccctcccccactactcccccaccnnnnnnnnnnnnnnnnnnnnnnnnnnnnnnnnnnnnnnnnnnnnnnnnnnctgttcacctggtctgtgccgctcatggaggcaaggaggggctgggctactttgaagaacagtgcccccagcaggaccgcggatgtggtggaggcccatccatgctccatcgcgttgtggacccacatctccaccaccgacagcagcatcatgactccaatggcggttcccaggagaaaggagaggagtgcatcgtctggtgggcggatgatctgacggggaggtgggtggagggagttggccgggtccatctgagcctggaacaactcagtgctttggcgaccgggacttccccaagctcaccgccagtgccgcgccgagggtggtggacatgcccgcaaaggttgagagtaagagcgcccatcgctcttcctccgaaaacatggcgagcccgggtgtcgagggtgcccctgcgggagggcggcccctctcctccggtcgaggccgaaatgaaattcaggcagggccctgagcttccacgaagggcatccttgtgtacaattggatttcggacgtgcagaatataacaattgcgattgaagtaatgctgggtaccgtcgctttgttagaacgcttgcgcgcgtgagcttgacacacgccgaaattcgacactgctggtatggcagtcaacatgtttgtatgaatcacccagacattgagcattggagtcacacagtagtcccacatctgcgaaagtgtgcaacttggatgaaagtgaagaaccatcttttgacatggaccgctgtgtcaggtttgtacgttttgtggtctgcgtatgtccaactaggtgagttgagaagacgacactggcaaaacatcattgagcagactgtgcgcctagtgtatcgcaagaatagcgagaaacccttgcacactgtccttacatgccccaaggatagctcacctgcacatgtctgcaatgcaatgatatacaggcaggcctaccatcaccagaccttgagtcaatgtccatgcaaaactcaccatgtcaaagcgcatgattgagctgcatcatcacgacgatgtatcaaggatgtttgataagttatcctcgaacttttaaatgtcgctgtgcaggagcgnnnnnnnnnngctggcagaccatcattgtacagactgtgagcctagcgtatcgaaagaatagcgagaaacccttgcacactgtccttacatgccccaaggatagctcacctgcacatgtctgcaatgcaatgatacacaggcaggtctaccatcaccagattttgagccaatgtccatgcaaaactcaccatgtcagagcgcatgattgagctgcatcatcacgacgnnnnnnnnnngcccgtaataatcaagggtagcccaccccggcatacttcgacgccaatcggcaagcggaccacagctagcaacaactagtgtttattcaagcagactgagcaatagctcgaccttggcttcgctcatacgttgggcaagcaagaactggtcgtggcgcctnnnnnnnnnntaaccattttttgacatggaccgctgtgtcaggtttgcaagtttggtggtctgcgtatgtccaactaggtgagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataccaaggatgtctaataagttatgcccgaacttttaaatgtcgctgtgcaggagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagtgtttattcaagcagactggacagtagctcgactttggcttggctcatacattgggcaagcaagaactggtcgtggcgcctttccctccatggacaccctttctacctagccttgtgccaaggcggcttctgtaacatacaccccccaggccccctgcctcgccctcttccccgacccctgcactcgcgcgacagggctcgacagcatggctgaccaacgcggtaacgatgtggcgctgctgctggccgctcagagccacctgggcaccaagaactgcaccgcgcacatggagcgctatgtgcacaagcgccgcagcgatggcatcttcgtgttcaacctgggccgcacctacgagaagctccagctggccgctcgcgtcatcgtggccatcgagaacccccaggacgtggttgccatctccgcccggccatacggccagcgcggtgtgctgaagttcgccacctacaccggtgcccgcgccaccgtgggtcgccatacacccggtgcgtgtggggcagtattgggacgtggggcgtaggctgggggaacagtcttgcgggccctctcggcaggcttggtccgatagggcatgcctaggatggaggaggcctgcctcccagcggagcatggggaccctctggcnnnnnnnnnngccgagagggcatgcccaggatggagggggcctacctcccagcggagcatggggaccctctggccgggggagccatccttctcatgtcaagatcagttgatggtttctgggagggctggcagctacacgctgtgctttcggtctaggacatggcgagcacctcctgctgaactttgccgtctggagtcctttacctcgccatcccattgaaactacaacccctcttcccagcaagacctcctttcccccatcttacccacccaaaaagttgcacccacccagccccactcacttttttgctccaggtgcgttcaccaaccagctgcagaagggtttcgaggagccccgcctgctgattgtgaccgacccccgcaccgaccaccaggccatcaaggaggcggcgtacatgaacatccccgtcatcgccttcaccgacaccgactccgacctggccggcatcgacatcgccatccccgccaacaacaagggcaagcactccatcggcgtgctcttctacctgctcacccgtctggtgctgcaggcgcgcggcaccgtgtccgccgcctccccctgggacgtcatggtcgacatgttcttctaccgcgagcctgaggaggccaaggaggaggccgcccccgaggccgaggccgcggccgagtacgtcgccgacgccgccttccccggtgcggaggagggcgccggcttcgacgcctcctacaacaccggcttcccggcggctgcgccggagttcgccaccggctttgacgccgcgccgtcctttgagcccgcagccgcgcccgcggccggcggcgacgccgcgtttgcacaggcccaggactttggcggcggcttctgagtgtcggacggggtacccgtgtgatgtgcggcgccgcgggatgcacttgctgtcaaagcacggtcagcaggagcgggtcaggagggccagcgaggagggaagagggttcaaaggggtggggcctctggcggagtgctactcatgtggtgctcttgctgagtgctggaatttgctatgctacaagcgacgaggtggtgtccaagtgagagcggcagcaggctatgcatgattctctgcagcggtccatagtaggcacagcgaaggtgaccgacgagtgcatgcaacgcgtggtggagggagtcgnnnnnnnnnntggcagcaggctatgcatgattctctctgcagcggtccatagcaggcacagcgcaggtgaccgacaagtgcatgcaacgcgtggtggagggagtcgggggaggagctccccgtcaagacgggatctgatcagtcgtcgctcaagactcgaagactgctccaaacctagagatggaatgcggtgacactggcgtcctccagcagcgccagctggcgacggcccttgcggatgaggtgctcgatcagctggtagttcttggggctgacgccacggtggctgtagtacagtgggccggcgcagggattagggggctccacccatacaaggtgacacattgcccggacagcagtgatcgnnnnnnnnnnctgggatctgatcagtcgtcgctcaagaccagaagaccgctccaaacctagagacggaatgcggtgacactcgcgtcctccagcagcgccagctggcgacggnnnnnnnnnngcctgcttctgtgttggggtggaggaggcgggcagggtgtggatggcgtcgagggcgccctggcttcatgaagcttggacgccagtcgcaggagccccatatgcctccccggtgcagcctgaccaccccgcacacctgcaggccggacagtcttcgnnnnnnnnnnaagtaatgacaccgccaactccctcggtcaagtagtttccataacctcggagacccgagtccttcgtgccaacccgccagctccccctgactcagagaacatacaccctgtccccagcaaccatcacgcacctctcgatggatgccctggcatgggccgccaggtccttccgctgcccaggaggtttctgtgcggcgacacgaagagcggcacgatacagactcagcnnnnnnnnnncagtaatgacaccgccaactgcctcggtcatgtagtttccacaacctcggagacccgagtccttcgtgcccgtccgccagctccccctgactcagagaacatgcaccccctccccagcaaccattacgcacctctcgatggatgccctggcatggnnnnnnnnnnacctgcttctgtatcggggtggaggaggcgggcagggtgtagatggcgtcgagggcgccctggctgtatgaagcttggacgccagtcgcaggagccccacatgccttcccggtgcagcctggccatcccgcacacctgcaggccggacagtcttcgaggtgccattgcagcctcagaccgcatgcaagctcatcatgccacttatttgacgccagcacacaagttctttccgctttgatgccggtaatgggtggtgtgggtccgtagatattccagcacgagggtgtgtggctcccagcaatttcaagtcgatccctcgcctcctaattctctatatatcaatgaaagatactggagaagccccttatgttgtcggcatactgtagactagctttcgtgcagcatcgagagtctttgtcgtgaatttgagggcgcgctttcctgagacgcgcccnnnnnnnnnnttacatcaatgaaagatactggagaagccgcttatgttgtcggcatactttagactagctttcgtgcagcatcgagagcctttgtcgtgagtttgagggcgcgctttcctgagacgcgcccgggaagaagaatgctcgccaggtgtgggtcggccacatccaaaaaagtaccttggacctgggccttcaacacaccgtaaacactcgtctagaaaagtaatcgtggcggcaccccccgcgcctgtcattcctcctctgagcgggcgaggacgaccgtctcggctgcgagcacggccaacccgccatggggcccgccatccccaaaacattggacgacatatacaacgactacaccatcaggagggaagccctgctgactgcgctgacggatggtgaggggccatgcggatgcttcgcccgttgccagcacctggggttttgagtgcgcgaccgctcgacggagcttcgaccgtggctgcaccagccccgccccattccgcaccctctgcagatgcaacagaattctacgaggcttgtgatcctgggaaggacaacctctgtttgtatggtgcgctgccgcatttatcccccggggccacattctctccgtaacacaacggccccacctgcgagctcaaatccagggaagtcctgcacgccttggacatgagaccagactctcagcctcgtatctgattctgcacaggtcatgccgacgggaactggaccgtggacctgcccgccgacgaggtgccgcccgagctgccggagcccgtgttgggcataaattttgccagggatggtgaggccagggagcccaggtggctttgaatggtgcttcacagaggctttgcacggcgaactgcgaagctggatgttgggggggggcctagggcctttgaggaggccgtgcagggtccctgcacttgtcctctgctgctcatggtggtcagcttcccccctttcctcctggggccagggatggagcgacnnnnnnnnnngtgtggctttgaatggtgcttcacaggggctttgcacggcgaactccgaagctggatgtcggggcggggcctagggcctttgaggtggccatgcagggtccctgcacttgtccactgctgctcatgatggtcagctccccctctttcctcctggggccagggatggagcgacgagactggatggccctctgcgccgtgcacagcgacgcctggctcatgagcgtcctcttcttctacgccgcccgcttcgacgacagcggcaggtgtgggtctgcgggggcgtccaggcctgggtgctgggggggggggcctgggtgctgggggaggacttgggtgctggggggtagtgggtgcaggtctcgggtgctggattcacaggtgcgagcgccccagggactgccccaccctggtttccatgactccatcctacgattcgatcggagtgaaacacagcactcctccgtttttaccccccatgccaccccccacccaccca

SEQ ID NO: 45639 - DNA, 61 bp, Chlorella protothecoides
atgcaaggcatcaccgagatatagcccgcgacctgccgccacatcgcaacctcaggcaacc

SEQ ID NO: 45640 - DNA, 144 bp, Chlorella protothecoides
ccataatgcatgtgctcattgagaaaaagctgtgcggcacatgtgtgttgcttgaggcgactctcgagggatgtgtggaatggccatcagtgaatgctcttaacaggttgctcatgatgccagtcgtgcacagcatttaacaaa

SEQ ID NO: 45641 - DNA, 72 bp, Chlorella protothecoides
ggtggaggcggcggacgaggacaactcatcaaagtcgactcctgctcttgctgccacgtcgccctgcaaccc

SEQ ID NO: 45642 - DNA, 69 bp, Chlorella protothecoides
tggcgcccgctccaaaggcgtcccatccctttggtaaagccctcctgcctacttgaccaccaccttgcg

SEQ ID NO: 45643 - DNA, 63 bp, Chlorella protothecoides
ccgttccaggtcgtcttgacagaggttgtggcatagtcatccatcacctacagtttgtgatag

SEQ ID NO: 45644 - DNA, 69 bp, Chlorella protothecoides
ataacaaaggatcacacgggaataccagtggagaatgaccggtcggcccacaggctggacaagcagact

SEQ ID NO: 45645 - DNA, 101 bp, Chlorella protothecoides
gtgcacccttggactgccctcctggcatccgcaccgcatggacccctgcccctcgcccctgctcaacacccccccctcacctattcgggtggtctgggcgc

SEQ ID NO: 45646 - DNA, 68 bp, Chlorella protothecoides
gtggccgaggtgtcctcgtcgatcagcagcgcagtcgcgccggcctccaccgcctcctggatgttggc

SEQ ID NO: 45647 - DNA, 138 bp, Chlorella protothecoides
ttcagctcatattgataacgactacggcacggtatggtacgctacaggcatgccgaaaagtgggcacagggaagggagggagggtcctgaagtgcaaaacgtgacgcacgcctgggggagacaaaaaagcatctgtcc

SEQ ID NO: 45648 - DNA, 130 bp, Chlorella protothecoides
tggaacatccgtgctggtgaatgtgctgttgggatttccatgtttgttcagctgctcatacatggtgatgggaaggggctcttatgcctcgcggaatgcagaccctttcagttatgtttcctttgcccac

SEQ ID NO: 45649 - DNA, 97 bp, Chlorella protothecoides
agctctccgactacctgaagctggcctgaaagtggctacaagagttcagggcaacctccttttcctactgatcccctggacggccacacattgccag

SEQ ID NO: 45650 - DNA, 61 bp, Chlorella protothecoides
gtgacaccggagatgcggtgttgcttgaaactggaggcagagaatgggaagacaatgtcca

SEQ ID NO: 45651 - DNA, 76 bp, Chlorella protothecoides
ccaggcagccctggaggtgggaaggatgggggactgagagtgagagtttgggggggggggggggccgggggggggg

SEQ ID NO: 45652 - DNA, 66 bp, Chlorella protothecoides
gttacatcacatccagcagaaggtaacgacagtccatcggatgaccctggatccgctctggccagg

SEQ ID NO: 45653 - DNA, 105 bp, Chlorella protothecoides
acgacccatgcgccgccgtcctgccacattgtggtctgagtgcaaagaattgacttaacaccccccccaccaccccacacagacactaacatgaacatgcacccc

SEQ ID NO: 45654 - DNA, 116 bp, Chlorella protothecoides
gaggggaggggcacaggatctggccttctgcctgctgccgtagacctttctcactctcttcattttcattctcatgtcttacacctgtatcaaaccgcagggccgagggatacagg

SEQ ID NO: 45655 - DNA, 61 bp, Chlorella protothecoides
agcggccaccatcacatacgatagcaggggtgcctctcctggcaggaatgcagcggtcaac

SEQ ID NO: 45656 - DNA, 61 bp, Chlorella protothecoides
ttacaagtcacactgagactgtgcagaaaaatgtccctgctggggcgtccgagaagacggg

SEQ ID NO: 45657 - DNA, 75 bp, Chlorella protothecoides
gtaggcatagtcgtggtcctgtgcttgcgtggggagcgggccgggtggcaggtggatgggtggggtgtggaggtg

SEQ ID NO: 45658 - DNA, 182 bp, Chlorella protothecoides
gcgcctcatgcgactcctcgccgcatgacgagtaggtttcaatcctgaggcaccgatcctctgctcaaacagcgtgaaaagaatgcacgcgctttctcgcaaatgtgaatatctcttataccggaaattggtcgacactctggtattgggcactgcttagccatgtgatccgacgggcaccg

SEQ ID NO: 45659 - DNA, 3981 bp, Chlorella protothecoides
  modified_base (518)..(527): a, c, t, g, unknown or other
  modified_base (740)..(749): a, c, t, g, unknown or other
  modified_base (1668)..(1677): a, c, t, g, unknown or other
  modified_base (2488)..(2497): a, c, t, g, unknown or other
gcgcgccgcgcccagcagcgccgccaggccattggtgcgcgaggcggtgagcgagccccagcgcgcgcccagcgcggccagggccgaggcgttgaaggcgagcacggcctcgggggccaggccgtccagcgcggagaggaccacgttggcaaggccggcgtgcagcgcggagtcggcgccggcacgcaggcgcagcgcgccggtccccggctccacgctcgacgccagccagacctgggcggtgcagcccagcacgcggttggcgtcggtgcggtccgcggcgtccagtggggacgcacgccgcgcgacgtccagcagcagtgccgaccgcgcgcggtcgtcgggcgcggcctcgaacgcggccatcaggtcggcaaaaccggggcggggggcggccacggtcgcctgtgtgcgattgcgagtgaaaaagggggaagctgatgaggtcagcttcgttacggggagaaagggagcggggcagcgacacggtcgaaatggcgagagggtgtgagccgtgnnnnnnnnnnggggggaagctgatggggtcagcttcgttacgggaagagaaagggagcggggcagcgacagggtcgaaatggcgagagggtgtgagccgtgcggtgcactctctgcgggagtctggagcgctgcagacccaggggcaggcgggggcacatgctatgcaccctgtcactcaggctgacaccctcagcttgactcgtggcccacacccaaccagnnnnnnnnnnacgggggcacatgctatgcaccatgtcactcagactgacacccgcagcttgactcgtggcccacacccaaccagccatgatcatccacctggaggggggcggcctgcaccgccacacgcccacggtgcggcctgggcaggcaccctgcagctctagcgagggacacgtgcgaaggcggagccttgactgatggcatgtggtgtccagaggacagatacaaagcgggaaacggggccatcttgcaggcccagcgggggagaaggggtcgaggtgtgaccgccagcgcacggatgctctttcagaggccctcggaacgggccagtgccgggtactgcatttgcaataggaagagtttggtgagttccgtctctgtcggagacggctcatctcgggctgccatggaaagttgcgtcaggagggttgcgtcaaagtctgacgcggaagcaacccaccttcttgttatagctccagctggtcttcgcacggcgtctcgtcagagccatagagtgtgcatggaacacttcgcggggaggtgggctggggtgtgggcctcacgcggcaccggggattgcccttatagccagcgagtgggggagtgggcgcgttgggaccttggcgcccccacgtgaagagggcgagcccagggattacgaggttcatgcccggctctcacgtttcacctaagccctccaagaccaccctgcacctcttccacggcgcttgccttcttggcaagcggtctcggtccattgttgcacgctcggttcctgctcacatgccgccggcgggaggctcctcacacggtgcataccccatctcttgtgatgcactggcttctcccttctcccttccctttccctcataccccacaccagacctcctttcctacccttctgatgcccctggccctgccgtgcannnnnnnnnnccataccgccacgccagacctcctttcctccccttctgatgcccctggccctgccgtgcatggttacatgcggcttgggggggggttggcagcatctagtggcccttgatgacgggcttggccaggaagtctgtgaactcctggaagggtcccttctggaacacggtctccttccacagctccggggtgaggaagccgtaggtggcggccagcgcggcgtaggtggccttcaccgtgttgcccagggtgcgggtggtgccgcgggaggaggtgtagcagtccacgatgcccgccatctgcagcaccttcttgggcgtgcgtgccgccacgatgcccgcgccgcgcggcgcggggatcaggcgcaccgacacggagccgcaggtgcccgtgaccttgccggggacggtgtgcaccggcccgatcttgttgccccagtagccgcggcgcacggggacgatggccatcttggccaggatgatggcgccgcggatggcggtggcaacctccttggcgcacttcacgcccagccccacgtgcccgttgtagtcgcccaccaccacaaaggccttgaagcgcgtgcgctgccccgcgcgcgtctgcttctgcaccggcatgatcttcatcacctcgtccttcagcgcggagcccaggaaggtgtccacgatctgatactccttgatgggcagggagaacaggaagatctgctccagggacttgatcttgccctgcatgggtccgaggcagggcgtgtgtgacttgggtgaggagaaggagaccgaccaatcggagtgtggcgaaacagcatggcagnnnnnnnnnntcgagggagggggtgtgcgacccaggtgaggagaaggagaccgaacaatcggagtgtggcgaaacagcatggcaggatgagatttcaccagccatgggcagtcctcacatgcaatgcccacatgccaggccagccgtctgacatccaccagcctgagcaccagcgagcagcagctgtcatgcttccttgttcccttgatgtacataagcactgagccggcgtcagtgtaacaacccagtacctgctggaccaggcggccgagcttggtcacgggggtccacttctcctcgccatcgtcgcggcgcccacggccacggccgcgcccgcggtcgccaccgcgcccgcggtcgcctccacgaccccgaccgccgaagccgcgctcgaagccgccccgctctgctggtgctgcgtcagccatggtctgcgggggcagaaacggaaccggggtggtgtcacccgggagtgcacaggccagccacgggctgtgcaggaatgccagtcccaattgggtacaagtccagatgtatattcaaggcatctgtgcaaccccgctgggccgacacatgtcctgccctggatgtcagtccctgggctcgccagtgccgccgctccccgcacgccctgctgcccgctccctggccacacccgccatactcactgtaatcagctgcactccgccgtggggatgcaactgttacgtgcttgaaagagggaggtcccgggccatcggggcggcttgtgagagccccagggggcgactgctttgattccggtaccaccggtccgatggtaccgctcggccaatcacccatgcgaatgagcgaggggggcaagcggtgcaagcccaccttggtgccacgcttgggccattatttcggcacatatatcacaccaaacaatccaattaaggtctgggccgtcgatccctggtccacgcacgaccagggttgtcgctgccaccctcggcaggagctgtgcaagggagcagcatcgtagtcagcagtcccccccagtcctgggaggaggaataatccctgcacagcgcacatggcgtgtgctcaggcgcaagcgagacgggttagccaggcctgtttccgacacgcctggagctggacggcaggtgacacacaggctcacgcgctgcccctcgcatgcacgccattgttggtgcttggcatggctctagtacgctgcaacagattcaggagctctgacgacccctcgcagatgctggacgatcagcatgcagctcccaggcaggcatggtgaggcccacacatggtggggctgggatctacggtgtccttgcctcgagagagtgcccatcacccgatggctcaaagctcaccccccgctcatcatccctcccccccaccagccgcctgccgccgcgcagctgacgtgctggcgcgggctggcggtgagcgccccggccgtcgactgccccgccgcctcctccgccgccgccggcccccccgccgccg

SEQ ID NO: 45660 - DNA, 104 bp, Chlorella protothecoides
atggtgtgcgaggattctggactccctctttcaatacgccggcctagcaaatagctcccgacactaggggacactcagtctccctcttcccctccctggcacct

SEQ ID NO: 45661 - DNA, 61 bp, Chlorella protothecoides
gacgtggaccagagttcgcaaccttccgagactcaaattatgtttcggagtggatcagcgt

SEQ ID NO: 45662 - DNA, 61 bp, Chlorella protothecoides
cgcggtgtgccagctgctcctagaggagggtgcggatgtggagcagcggaatgtggtgagg

SEQ ID NO: 45663 - DNA, 61 bp, Chlorella protothecoides
tcctgacgccaagcagaaaccttgcaaaggcaattcaccacacaactctgcaacctggttg

SEQ ID NO: 45664 - DNA, 136 bp, Chlorella protothecoides
caagttgcgcgccgtccgggactggcccgctccctgcaacatcagggagctgcgtggcttcttgggcctcactaattattaccgccgcttcgtcaaggactacgctcgcctggcgcaccccctgaccgagctgctc

SEQ ID NO: 45665 - DNA, 69 bp, Chlorella protothecoides
aatgacgtcgactaccaggggcgaagtgacggatgggcttgctctccctattgcaggactggctggtcg

SEQ ID NO: 45666 - DNA, 78 bp, Chlorella protothecoides
ctcactcacgatgtactttgcctttgcttgagtgcccaacaacaagcgagatgaattggtgtcggaaatgtctcctgc

SEQ ID NO: 45667 - DNA, 74 bp, Chlorella protothecoides
agctactgcatgaccttgttgagcatctgagacaacgcctgtggatggggtctcgagcgccttgatacgctgag

SEQ ID NO: 45668 - DNA, 36923 bp, Chlorella protothecoides
  modified_base (621)..(630): a, c, t, g, unknown or other
  modified_base (1051)..(1060): a, c, t, g, unknown or other
  modified_base (1408)..(1417): a, c, t, g, unknown or other
  modified_base (2557)..(2615): a, c, t, g, unknown or other
  modified_base (4631)..(4753): a, c, t, g, unknown or other
  modified_base (5083)..(5092): a, c, t, g, unknown or other
  modified_base (5311)..(5320): a, c, t, g, unknown or other
  modified_base (5398)..(5407): a, c, t, g, unknown or other
  modified_base (5785)..(5794): a, c, t, g, unknown or other
  modified_base (5893)..(5902): a, c, t, g, unknown or other
  modified_base (7032)..(7041): a, c, t, g, unknown or other
  modified_base (7672)..(7681): a, c, t, g, unknown or other
  modified_base (8204)..(8213): a, c, t, g, unknown or other
  modified_base (8662)..(8838): a, c, t, g, unknown or other
  modified_base (9559)..(9568): a, c, t, g, unknown or other
  modified_base (10865)..(10874): a, c, t, g, unknown or other
  modified_base (11283)..(11292): a, c, t, g, unknown or other
  modified_base (11642)..(11651): a, c, t, g, unknown or other
  modified_base (12003)..(12012): a, c, t, g, unknown or other
  modified_base (12105)..(12321): a, c, t, g, unknown or other
  modified_base (12483)..(12492): a, c, t, g, unknown or other
  modified_base (12734)..(12743): a, c, t, g, unknown or other
  modified_base (13202)..(13211): a, c, t, g, unknown or other
  modified_base (15505)..(15514): a, c, t, g, unknown or other
  modified_base (16018)..(16027): a, c, t, g, unknown or other
  modified_base (16309)..(16318): a, c, t, g, unknown or other
  modified_base (18121)..(18130): a, c, t, g, unknown or other
  modified_base (18523)..(18532): a, c, t, g, unknown or other
  modified_base (19545)..(19554): a, c, t, g, unknown or other
  modified_base (19642)..(19651): a, c, t, g, unknown or other
  modified_base (19742)..(19751): a, c, t, g, unknown or other
  modified_base (20235)..(20244): a, c, t, g, unknown or other
  modified_base (20837)..(20846): a, c, t, g, unknown or other
  modified_base (21263)..(21272): a, c, t, g, unknown or other
  modified_base (22291)..(22300): a, c, t, g, unknown or other
  modified_base (22648)..(22657): a, c, t, g, unknown or other
  modified_base (24719)..(24817): a, c, t, g, unknown or other
  modified_base (25337)..(25346): a, c, t, g, unknown or other
  modified_base (25538)..(25547): a, c, t, g, unknown or other
  modified_base (25612)..(25860): a, c, t, g, unknown or other
  modified_base (25962)..(26186): a, c, t, g, unknown or other
  modified_base (26371)..(26380): a, c, t, g, unknown or other
  modified_base (26738)..(26747): a, c, t, g, unknown or other
  modified_base (26833)..(26842): a, c, t, g, unknown or other
  modified_base (26905)..(26914): a, c, t, g, unknown or other
  modified_base (27440)..(27449): a, c, t, g, unknown or other
  modified_base (27748)..(27757): a, c, t, g, unknown or other
  modified_base (28328)..(28337): a, c, t, g, unknown or other
  modified_base (29150)..(29159): a, c, t, g, unknown or other
  modified_base (29677)..(29686): a, c, t, g, unknown or other
  modified_base (30708)..(30717): a, c, t, g, unknown or other
  modified_base (30779)..(30911): a, c, t, g, unknown or other
  modified_base (31286)..(31295): a, c, t, g, unknown or other
  modified_base (31918)..(31927): a, c, t, g, unknown or other
  modified_base (31989)..(31998): a, c, t, g, unknown or other
  modified_base (35792)..(35801): a, c, t, g, unknown or other
  modified_base (36336)..(36345): a, c, t, g, unknown or other
  modified_base (36573)..(36582): a, c, t, g, unknown or other
gctggtcggcgcggcgcgcaccagcggcggcagcagcgcgcggagcagcgccgcgagcggtgctgcgtggcaggccagcagcgccagctcgttggccaggccggggacggctgccagcgcctctagcgccccagcgggtagcaccgccaggtgcggctggcggctggccagggacatgagcaggagcagggtggagggcagcgtgctggccgtggccgccttgcacaggtcggtcgccagggctgtggagggggaagggaggagggcggtgggtgtgcgactgtcggagaggcactgggtggcgctctttgtggctttacttggacaggggtgtcccctgcctggcagtggacacggccagtgcaaacccacacaaacaaatgacacccaagggggggtccatcatcatcgctcggcaggcgtcagggaatacaaactgtaagtcgctcagggggcccgtcgcgcagcagccctcccgagggagagagccgtgcggcggccgcttcgctctcttcatagcttctcatcacccgccagccgaggcaataatgtcgtagcctcttgcctcatcacccaagggcggaagcctaccgccaggtcacatgcacgtgctgggcctcnnnnnnnnnntttctcatcacccgccagccgaggcatcactgtcgtagcctcttgcctcatcacccgagggcggaagcctgccgccaggtcacatgcacgtgctgggcctcgcagcctcagacccgccccatcaacacaatcttcacacacgctcacacctgtcacgaggtcggttcccagggcggcgcgcgccgacagctggccgatgatcatgagggtggcggcacggtagtcgggcagggcctcaggccccagccccgccaccaggtacggcagcaggaggttggcggtgtcctcggtgacctaccaagggggggtgagtggcgaacagaatggtatgatcaccgcatggtgtatgcagaggacgtcgcggaacctggggtccaggccacggtgatgcacagctctgcacaccatggacacgacaatnnnnnnnnnnagaacagaatggtatgattaccgcatggtgtatgcagaggacgtcacggaacctggggtccaggccacagtgatacacagctctgcacaccatggacacgacaatcgcactcagactgagacgaagtaacccccttcacagcctgcacacccacctgcttgaggccggcgagatactcacacaccactgctgcgtagaaggggagggcgccgcggctagcgtagctgcccgaccccgtcttctggcccagctccagcacgaatcggatcagtgcctttggttttgtgtgggatggtggggagagtgggtgttggtgctgctcctccatggagatgtggagttgaccannnnnnnnnncgcctttggttttgtgggggatggtggggggagtgggtgttggtgttgctcctccatggagatgtggagttgaccatgcgattagggagtagcactggttgcactcaggattccaagggcctgactgtagtccaaggggtcttgaacccactacaggctgtacagcagacatcacgcaagatgcatggtgcaagtgaaccaccctggcgcaccctcacccaacatgcgggacaccatcaccccaagaacccatcgccccaaacccgctgggccaccttgtctgtgatgcagcgcaggacgagggtggagcgcggcagggccgctccgctctcctgcatgggctccaggaactcgaagagggtgccccgcaggcgcagcagctgcaccaggcgcacaaactggttggtggcgtggaaaggcagcgcggccagcatcaggctgtccacgttgtgctcgtgcacggcgtagcggcgcagcaggtactccagcacggggaaggcggggggcaggaggaaggaggaggacaggagcgtgcacagccgggtgacggcggcatcgatgccggcccctacccccacgctctgctggctccggtccagggtgatggagctggggctgaacagggtggactggaaggcctcgtatcgcttgtccagctcgcagagctggcggaaggctgcgcgtgggtgggtacgtggagggatgggatgaagcggcgcgggctcaagaggccaagaggggtgcgcgtggagcgcggcatcagcacgcatagggtccagcagggtgttaggcaatccatggcccaaaacagggtcgtgggcgcaacccatggcgcatgcccggcacccacttcaccagtcaccagcccgacggctgcattccggacagccaagcccctcaccttcccgtcctatgctgtacacggtctccacatccacatcggcagcctcctgtgtcgaccatatcaagcttggcttcccgcgcaggcgcttgcccccggcaggctggccagacgctacggccagctgcctgagctgctgtgtgagagcggtggccatgcctggaaaggcaatggttcccgcgtgaaaggagtgatgctaaattttgtatcgatgacaaatgtacatgcatatgtcgggnnnnnnnnnnnnnnnnnnnnnnnnnnnnnnnnnnnnnnnnnnnnnnnnnnnnnnnnnnnggcgccccccaggctcgcgcgcgctcggggccaagtcagtaacaagaagaaaccgggagcgcaaatcaatcgggtcgcctcgggttctggctgtcgacaggctgcgccatgggggttcgattggacgatgtgcaatcgaggctgcgctgattgtgacaaatctcctcggcgattccagtccgacccaccaaaagcatgctcgggacacaggcttcgctcgcgtgccctctcaacacgccgagccaccccgggaaacccgacatgctctgagttgcactggagaccaggcctccagctccatcctcaccctctcattagaatcgagtggacggtcaacaaacaaaaatgtccgccgtgaccggcctgtcatggagcggagacagcctcgagggcctgggctggggcagccgggtctgggtcctggccgatggcacctggtgccccggcactctcgcctctacgggccgcgactccgcgacgctggaggtctttctggagggcgccgggaagtcgcggtccttcccggcgcgggacgtggcccctgccaacccggtggaccaggagtccagcgacgacctcaccaccctgccctttgtcaccgagccgggcctcctgcgctgcctgcagagccggtttgaccacgacgcggtctacaccactgccgggcctgtgctggtggctgtgaaccccttcaagcccgtgcctctgtatgatgtggaggcccaccggaaggcagccacgcccggcaccccccacgtttacaccgtggcccagcacgcattctcccaggtgactgtcgagcgcactggagctgagtggggttggcaacgtgtggctctggatgcagctcatgtcaacctgcagttgcattttcctggtcaaatgtggtggctgtatctcctgccacactctctctctgccttgtggaatgtgcaaatccctttcgcacatccctccctccgcctgctcaacaacacttttcattacagatgaaggagacgggcaattctcagagcatcctcatcactggcgaatctggggcagggaagacggagaccaccaagtttgcaatgcagtacctagccgttctggctgggggttccggcatggaggtatattgttatgtttcggtgatgggcgcatcatctggctccccgcgactcagacgggacatgacgcatcagttctcccatgttgggttttgagcgtgaccgatgcatttgacatgggccccagagccaacctgtcatgcctgtccaccaatgtgagcgcaaaggtcggcagttcgctcccctttcccttcatccaccccttgttccactccaccaccttgcagcgccgcgtcctggactccaacccgctgctggaggcctttggcaacgcctccacgctgcacaacgccaactcctcccgcttcggcaagctgaccaccatccactttgacgaccggcacgccatcgcgggcgccaccatccagacctacttgctggagaagtcgcgcgtggtgtcccacaccgtcggcgagcgcagcttccacgctttctaccagctctgcgcgggcgctggccccgaggagcgcgccgcgctggggctcccggatgccgcggcctgccgcttcgcctacctttcaggcggcgagagcaccccccccgcgctgggccccagcgacgcggccggcttcgcccaggtgaaggccgccatggaggcgctgggcgtgcccgcgccgcccgtgctgcgcctgctggccgccgtgctgtggctgggcgacgtcgccttctgcgacgatggccagggcgcggcgggggtggtggggggcccacgctccccagcgctgcgccacgcctgccgcctgctgggcgtggcgcccgaggccctggccgccgcgctgacgacgcgcgagctggcggcggggggcgaacgcgtcagccggcgcctgagtcccgcggcggccgctgaggggcgggatgcgctggccaaggccctgtacgcccgcctcttcgactggctggggcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcctttgccaccaactccttcgagcagctttgcatcaactacgccaacgaacgcctgcaccagcagttcaacgcccacctgttcaagctggagcaggcggtgtatcgcgacgaaggcatcgactggaccgacgtcgagttcgtggacaaccaggtgagggattgtgggacttcttgtttgtggggggggcaatgttgctatggcatgggagagctgggactgtggcagagcagagggccatcgacatgataatggaagaaacaaagaggtgaaaaggtgggttaccgtgggttcattaatggctggctcgccggatgcccaaatcctnnnnnnnnnntcagagggccatcaacctgataatggaagaacaaagaggttaaaaggtgggttaccgtgggttcatcaatggctggctcgccggatgcccaaatcctgggcgaaaacccaaccgcatgggcttgggcaggtatgccatgctgtccaggtatgcacaacctctcgcctactcgagccatgtactgctgaaccagcgttccctccatcccaaccccgcccnnnnnnnnnntgctcgtattgaatcatgtgctcaagcaccctcccaggcccaatgcagtgcagagagtgcccttgttcgacacccacnnnnnnnnnncatgcacaacctctcgcctgctcagagccatgtactgctggaccagcgttccctccatcccaaccccgcccacgtgcaggactgcgtggacttgctggaggcacggccgccagcgggtgtgggggtgctgtcccttctggacgaggagtgcctcttcccccaggtgccgctgcgcgttcgggcatgggggccacctgagcttgggcatgcgcatcccagctcgtattgaatcatgtgttaaagcgccctcccaggcccaatgcggtgcagagagtgcccttgttcgacacccacacctgccaccttccgtatccatgtacattcttcccctctccatctcttcccctccccgcctctcgctactgtcctgcagggcannnnnnnnnngtggaggggggtgttgcctcagcacttccggggctgggttgccagacctcaggagcgttgtgacaccattgcttggggggtccaagtcctcaatcatgnnnnnnnnnnatacattcttcccctgtccacctcttccccccccccgcctctcgctactgtcctgcagggcaacgacaccacctttggggagaagctgcgcaaggaggccggctggcacccgcgcttctccttcgatgctcgggcccccggcacggacttttgcatccaccactcctctggcagcgtggtctactcctgcgccgccatgctggacaagaaccgcgacacgctgagccagggtgagtgagagcctggggcatggggctggaggggggtgttgcctcagtacttccggggctgggttgccagacctcagcagcgttgtgacaccgttgcttggggggtccaagtcctcaatcatgccctcgccacagtcacgcaccccttccccaccctctgaggccccccaacccctttccccaccctcagacccgttgctggtgctcaccgacagcagcgaacccctggtcgccgagctggcttcgggcctgcgagcccgcgagggcgagcgccgcgccgcggccggcaccgtgggcgcccgcttccgggaccagctgcgcggcctggtggccggcctggacgcgacccagctccacttcatccgctgcctgaagcccaacgccgcgcagcgcgccgacgccttcgacccacgcgccgtgctgcaccagctgcgctgctgcggcgtgctggaggtggtgcgcctggcgcgcgccgggttccccgcccgccacgcgcacgccgactttgccgccgcctacgcgcacctgctggggccagcgctgggcagcgagcgggcgagcacgcagcgcgcgcatccaggcacgcccccgcccggcgccctggacacctgcctggacctggtgcgagccttcgacatccccgccgccgacttccgcgcggggcgcacccgcctcttcttccgggcgggggtgctggcccggctgcaggaccgcgccgatcgcgtgctcaggtgggtgggctgcctcgctggctcggggatgaggaccgaggagggaaggctgctggggcactcatccatcgctctggaagcaccggcggccgcgccgggtgctgagtgatcccgaagcccggcccagcttgggcggttctcgcagccaccaccctctgcgccacggtgnnnnnnnnnngtggctcggggatgaggacccaggagggaaggctgctgggcactcatccatcgctctggaagcacaggcggcctcgccgagtgctgagtgatcccgaagcccggcccagcctgggcggtcctcgcagccaccaccctctgcgccacggtgcgtgagcacggcgcgccaggtcaccggattcaccgctttcttccccacacccaacaatcgcagggccactgtcctgatccagagctgggcgcgcatggcgcggcagcgccgcgctttcctgcgccacgtccgcgccgccacgctcctgcaggcggcctggcgcagcgcgaccgcgcgccgactggtgcgccagctccgcgcccggcgcgcgcgttccgccattctcgtgcaagccgccttcaggggccacgctgcgcgcgctgcgctgcgggcgcagcgcgctgcggccctcaggattcaggccgcctgggccgcccatcaggtgggcgggaggatggggttgggtggggaatctgtgtcgcatgctggggtggtggcagtcggggggcattctaggattgggaccgcagtgggaaccgcgtgtgaagatggctttgaagctcgacgtgtaaaggcggatcagtaccgtctcgcgccatcnnnnnnnnnnagggatggggttgggtggggaaatctgtgacgcatgctggggtggtggccgttggggggcattccaggattgggattgcagtgagaagcgcgtgtgaagatggttttgaagcttgacatgcaaaggcggatcagtaccgtctcgcgccatcgttgctgagcgccggatgccgtgccacgcaggccgagaaggagcgcgccgcggacgtggcggccgccagctgcctcatcctcaccggcgaggtgtctttcggcgcccgccgcaccgagagcctcccctgcgctgagcccagcctcccctcagcagatctgcatgcacaggtttgtcgggtaggaatgggtctgtgggtgatcctgaagagtgattgaattgctgaggatgatgcagttcggtactgcagcaggaggcacttgtgtgtgccatccgccgcctctccattgcgacaaggtgctgcactccatctcccccccctctccaccacacgttcatcctttcccacctactccctgcagctgcaagaggnnnnnnnnnncaggcacttgtgtgtgccatccgccccctctccattgcgacaagttgctgcactccatctttccccctctccaccacacgttcatcccttcccacctactccctgcagctgcaagaggcgctcgcggggcggcgcgaggcggagaccgacgcccagctgctgcgtgccgagctggagcagctgcagcagtctctgacagggacgggggggctatcccccgcctgggcaggcgaccggggccgcggtgggttcaaggcagcgccgcaccccgacgctgccctggccgccgcccgggccagcgtccgcagcggcggcacccagccggggctgtccacctccctggacgacgtcagcttcatgtccgtgagcgagggtggcgagggcgcatcgcccgactcccagttcacgccctcgcccccgcacccggggcgcccagaggtgcgtggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcctcaaaatgcttggtgcccccgggccactccaaatgtgcctctccacgtccatacacgccccaagctctggacccttttcacccctgttacggaacccaccccttgacaacacccacccgcggcaaaccacgcaggccgcctcgccgcccacggcgcagcgcatgctggcctcgctggcccgcgacttccggcgcaaggccacgctcttcgacgacgacgtggccttcatcatggaggtgcacagcggcgcctcggaggccccaggcatggaccccgacgccgagctggcggcgctgcagcagcgctaccgcgtgtggaagacggcgttcaagggcaagctggcggcggcggagcgcgcgctgcgctccggcaagaaggcccggcgtgggttcaaacccttcggcaggtgacgcggccgcgtgatgacctcggcgcatggtggccgcgccgccgacgcagtccgtatgcagccaggttctcgaccctggcatgtacgtgcaagagctttgcccctgctctggtgaccgctctcctcagggatgtgaaagggcttgcagcgaggtgtaagggtgatcaatggcctcaggctcagctcatcttcatgcatcccttcatgctgttccatgttccatcccccaaaatgcagtcctccactgtggcacactcaccctactgcccatgcttcgtggactgggttacagcttatcgtcattgtnnnnnnnnnnacccccaagatgccgtcatccactgtggcacactcaccctactgctcatgctctgtggactgggttacagcttatcgtcattgtacactggggcacatcacagattgggggtgggacatacgtgtgtgtgcatcaaagttcgctaagtactacccggccatttgggctacgctacagcataaggaaggggggggggggggatcgctaaggggcgctagaatagcagatcaggagggcagtctcggagttctgcgggaaagacggtctagtgagggcatctcggcagtctggtgctctaaaggaagagacgcgctgtatcgaaaatcggggctcggggggactgcgggcggcgaggcgaccgagcaattgctcggcggccccccacccacacccgccacagcgtccgtacaggctatgactcaggcgacgtcaaattcgactattgcaaaaagggactgctgtgacagtgtcaaaaatacggcgccctgggcgcgcccctgggggggcgcgcccagcggcggcacgctcggccgctggctcgctgagttctctgtgcgcgacgcacgcctcaggcgcatgccgctcgcgatcggacaggcagcgtcgggtaagcgctttattgggaggggggagctccgactcaggcctcccgcgtctctcggcatccattcgctcatgagcgggggacatactgagcctcgttggtctggtgggaggcctgctccagggcggagcgcatgcgcatgggcatgcccagtggcggggtagccggcgcgtccctctccttggcctcctccgtcacgcgggcgcccgctgcaagggcggcggcagccgcggcggcactcagcttgcgcacctgctccacgctctgcgccgcggcgccctcggccatcaccttcatactggccgcgaggtcggactgcagcagggcctgcagggcctcgctgggggagctgctgggcttgggctgcggcgagggggagcccgagtaggtgctgaaggcccgcatgggggcggacacatgctggtggtggcggaatgccacctgctgcggccgctgggaagggagacgggccgcgaggacgggctggatggctgagaagagggagttcatctgcggggcgacggggatgcgggtgagaagcgagcttacggggcagctgccacaggtttcggaagggtctccgacatacacactcatcattgttgatggtatttaaggcggtatgggcatcctgggggccggagcatggcaaacactcggggcgcaacacacgttttcgagtggccctagggnnnnnnnnnngtcattgttgatggtatttaaggcggtgtgggcatcccgggggccggagcatggcaaacactcgggccgcaacacacgttttcgagtggccctagggcaaccgacggaccttgttgttgctcggaaagtgaggggacgagaaccacgcgaaagaaaactttctctcagctggaaggtgaatgagcaagctgcgggaacgttggtggtcagaggtgggaatgtggtcggctgagatgccccacgccttgtttaatccagccggcgaaatcacgacgtcctgggtcgatcgatgcccaggcacgtgtgccagtccgaatagggcgcgcccgggggttggcaagggctcctctgaactcatgaactcatccttccttggcaaaaggctcaccgtacccatccaaaatctccnnnnnnnnnnagaattcatccttctttggcgaaaggctcaccgtacccatccaaaatctcccgacttgcatctcgcatgctttagatctcggggtttgatcgtcgagtgcggcatgtcggcttccatccagggaacccacctggtgggtggcatctccaggggatggacccccgtccgcccgatccataggcacaaccctcccttcctgcgcgctgggaggtgtctatcacaggcgcttcggtgtcagggagcaagcactgcggcagaaaccatcgccaaggcacgtgttgtgagggatggtggaactagggatgcttccatgcaccatttggaggtctgagccccaaggggggccagcnnnnnnnnnnggctagggatgcctccatgcaccagttggaggtctgagccccaaggggggccagccccaacctcattgccttcctgggcttgagattcagacgcaggagcatccacagtgtgccggcctgcgaccgccgctcattctttcttcccgcagacggagcgcttctcggccctggaccgcgtgtccatcctatcggaggcgctgccctacctgcagcgattccggggcaagaccgtggtcatcaagtacggcggggccgcaatgaaggaccccaccctcaaggtgagggggcgggcgtggatatgatggggagtctgttcttgtggcttcagtgatccgtggtgcccaggcgatgnnnnnnnnnnagcgcttctcggcccttgaccgcgtgtccatcctgtcggaggcgctgccctacctgcagcggttccggggcaagaccgtggtcatcaagtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttgcatcactgtctcctcccggatccagccacgatcacaccctcacctttctcgcaccctcacatccccccccccttgactgattccacatcaccaattcccgtaccattacactcatgccctgctttcttgtcaggccggcgtcgtggcggacctggtnnnnnnnnnntggcatggatctgatggggagtctgttcttgtagcttcagtgatccgtggtgcccaggcgatggtagcgattcatagaattcggctgcagccagggattggccggcgtggtgaaatggcttggaacatgctagacactctggacagagtatccaaggggtttgcatcagtgtcccctcccagatccagccacgatcacaccctcaccttcctcgcaccctcacaccccccccccccctttgnnnnnnnnnngactgagtccacatcactaattcccgtaccatcacactcatgccctgcttgattgtcaggccggcgtcgtggcggacctggtgctgctggccactgtgggcatccgacccgtgctggtgcatggaggcggcccggaaatcaacatctggctcaccaagctggggatcgagcccaacttcaagaacggactgcgcgtcaccgacggtgggacaagcatgggaggaaagggggaggagaggagcagccggtcggtgcatggtcgctccccctgggcgccccgcagccacccccttgtatgctcatgttccactaccccgcgggacaggcctggggctgctgtcctgtgcgttcatgagcccagcccaagttcctcctcaatcctcatcttccagttcccacccagttcccgtgcacccgtcctgtcctcgcagaggcgaccatggatgtggtggagatggnnnnnnnnnntgcagccacccgcttgtatgctcatgttccactacccctcgggacaggcctgggctgctgtcctgtgcgttcatgagcccagcccatttccctcctcaatcctaatcttccagttcccacccaattccgcgcacccaccctgtcctcacagaggcgaccatggatgtggtggagatggtgctggggggccgcgtgaacaagtccctggtgaccctcatccagcagtctggggggcgggcggtgggcctgtgcggcaaggattccgacatcatcctggcccggcagatggtggagaaggagatcggcttcgtgggcgaggtcaccggcgtccgctcagacctgatcaaggtgcgcttgtgaggcgagcatggggctgggtgacagagtctgccttgcagtagactgcgacactttggtaacagtggtcaggataccatgcactcgacgctcgaggtccaggagtgagatttggcaccgcatggaggttgagcaagttaaagatccgttgcgtccatcccccctgacctccttgccaagcatccctgtgcccactgcagacgctggtggcggacgactacatcccggtcgtggcgtcggtcgcctcaaacggcgcaggccaggccctgaacgtgaatgccgacacagctgccggagaggtgtgcgggtggcgagggcaggtatctcctggctgtttgtgccggaagacaccctcggctcatcggctcatgaggcatcacctgccgtccggaaacggctggcatgcttgatgttgcttgtttcccacgacggacgccccaggccttcaccatccatgcctcctcccctacttgtctccctcgacatacatgccttggcatgccgcacatgccatgggccagagtacaatacctcccagcctccctcatcgcacaccctgccacgcagatcgcggccgcgctgcaggcggagaagttgatcctcatgaccgacgtggccggcatcctgcacgaccgcaacgacccgtcctccatctaccgcgtgctgacactgcgcggctgcgccgagctggtcggccagggcatcatcgccggcggcatgatccccaaggtggagggaggggtttggggggtgatgagggcatgagggagtacgtcgagcagggcggccctgccctggggtgccaggctctggtcgatgtgcgtgcacatccctcgagacgagagctgccctctgagcgctcagcccccctccttccttccccgctcccctataacaggtggactgctgcatcaggtcgctgtcccagggcgtcagggccacccacatcatcgacgggcggcagaagcactccctcctcatggagctcctgaccgatgagggtgtgggcaccatgatcaccgggtgagaagcgaacgaccccgtgccttctttcccacttgctctggccccccctgttgtaacgctgatcaatgtaacgccaatcattgcaacgccgagcacggtccagtacgaaagaggaggcaacacacaggatgagagattgtggtggtagaaaggggctatgtcgtcagtgtcgggtctcgcacgcgcacaggggcccagtgcacagcggctgctgttttcttgcgacggccagcgcatacctcaaggcctcgacggcgcgccggcctcggtcagcagcgtgcgccgggctccgggcgccgagctggcatcctgcccggcatcattctgcgccccccccgctccccgcgagccgatggcctgcaggagcaggcggcccccgcgcgtctccaccgccctcttcccggagagcggtggcgcgtggtcggcgccggggcccatgcgctccctcttcacaaacaggggggagagcgaggcgttggcgcgcaggagcaggcgcgcgccatacgagccgccgccgcctggcaggcgcgggggtgccgccgcggggctcaccacgccgctcggtcgggcgggggtggatccggggtcgcgctggatcgcggtggtcgccagcgcgtcggactgcaccgccggctcggcgcagtcgtccatcggaccgtctcgtcctctcgcctccgcgcctggcgccccacgctggctggcgctctgaccagcgcctttacgagcttcactcacgcctgctggatctgccctcagcgtctgaggcgatttgaggatgccgcgcacctgccagggtgggaagacagcggattcagtgtttgtgccaaggggatttcgtgatcatgcactggggagcaacttgcatgtggcaggccgcgctagagccgagctggctctcctccatgcgggcnnnnnnnnnngcagcggattcagtgtttgtgccgaggggatttcgtgatcatgcactggggagcgactcgcatgtgacaggccgcgccagagccgagctggctctcctccatgcgggcacggccatgcaaccgcagctctccccctcccatccatcaaaactcgtgagcaccccacagcctaccagggggcacggcgagcgtcgggcccagcaccgggtgcgcacggccacgagctcagcccaggcgccctccagctgcgcggcgacggcgacgcaggcctgcccgtgcaggccgcccagcgcggcgtccacggcgcgcgcagcgcccgcctccgcctccagcgcctggtccagggtgggcgggtagggcatgccgcgccggtccaggcgcgcccagccctcgcccgacacccagtgccgcagcagcttcaggtccagagccagggacaccgcctcctccaccaggtgctcctgggaaagcgcggcgcaggaggccccgccgccgggccccggnnnnnnnnnnggccagggacaccgcctcctccacttggtgctcctgggaaagcgtggcgcaggaggccccgccgccgggccccggcacgccgccccacagtctgcgacagggggccggaccctcgccgggctgggtgcccgaggggaagatgggcggacgcccgcgcggggggcggggactcctggaccccgccagggagggtgggcgtggcgcgcgcctgcatgcggggaggagggggtgcggggggtgaggcctgggctggaagtcctgggagtggagaggagcatggcnnnnnnnnnnaccgaggggaagatgggcggacgcccgcgcacggggcgggggctcctggaccccgccagggagggcgggcgtggcgcgcgcctgcatgcgggcaggagggggtgcggggggtgaggcccggtcaggaagtcctgggagtggagaggagcatggcacatgcacgtgctggagagtgcagtacgcacatcctggcacaggtgcagccctccctggagcaggcaggcggattgtgtgacgctggggagacatgtgaaacgtggagcaggagggtggcacagctagggggacgatgccggtagtgcacagacacaagcccacgacgcacggcgggctggtggaggggtcggtccatgccgcaggctccggagcggggggcgaggctcgccggcccgggttgatcccatcctcaaaggacacctgcgctttggagggtggggagggcgggtcctcggtgccgtatccagaggtgggtgtatgtgtgagcagctccccgtgggtccgctgctgctagagtaactctactggccccacgggctgctaggccgcgctcgagcgccccacagcaggacattgggcttgcccacatgtagagcaatctcgaggcagaagcagcgcccaacaagcactcgatccccctcaccctgcggctcaggggccgtggcgtgctcgactcctgggagagaatgcacgcagaggctgtgaatgacgccggagaggcagggctggtcgggtctgtcgtgctgccgggcgctgaaacgcggtgggagggcgaggcggggtcgctcgccgcgcgcatgatgccaggggagccaggcggcggcgcctgtgtctctccctccacggccccgggaggagaacgaggctggccccgattccctgcccccccatcaccacattcttggcgcatgcctgcgggcgacggggacatgcgtgtgggctcggataaagcatgggggtcggaacaactcactggcgccctagcagactacaggatcaagctctgccttcgcgcataccccaccaccatgacaaataatcccacctgagatcggcagcctgccgagggagcagacctcggcctcgccccttgcgctgcaggcggcgcgctgcaccgaccagctgtcggcgggcagctggtccaggagctgggacaccttggccagcgcccgcgtcagcgatcccggggaacccaccccctcgaacggcgagccctcaggccctaggccggggagaaccccgtgcgtgggagaggggtctggactccggctcgtcaggaccggccttgccggcgacagcaggccatcgggcggcaggcgcaggggctcatcgcacggtccctgccctgcagactccaggctggcggtgtcggtcaagagccccgcgacgacgtcgagcttgtccagctggaaattctggcagtcgctccggccggcctgggcgccctcgccgtgggcctcagcaggcgagggcccgctgagtggcctccgaggggggtccttgggatcgcacatcacgctgtctgctcgtcgagaaagaggcaagttgtccgaggcttgcggcgcggcggccgcgcacggaaacgtgcgtggagggccatctgccagaggggggctgttgggtctgctcctcttccggggcgtgctgtgcgtgggcgactgccggggtggtggtggaggcctggcctccctgcaccatggatagtgaccctgcagccaacaacagggagttggggggtgtgaagcgagcgtctcggagtcagtgatccagttggccctcgcagcagcatcgccaggtcggccacannnnnnnnnnaggatgtcaagcgagcgtttcggagtcagtgatccagttggacctcgcagcagcatcgccaggtcggccacagtccccaaggccttggagcccccatccccaccagtacgcaagccgtgcagaaggccaggccgaggaggacgtgcctatcgcgggccccggcctcctccaccgcagccaatgtagtcggtgaagtttcgggcatcgtctgatttcagggccctctcgaagggtccccaccgctgcacggctcgccgttggagttttcgcggcggtgtcgacgcggagcccgggaagtgcaccactcgtgggatgaaaagcgtgctcccacgcaatcgcttgacagagagactgcttatccggatatgtatatcctcttcgacgcagcctcannnnnnnnnncaggatgaaaagcgtgcacccacgcaatcgctcgacagagaggctgcttatccagatatgtatatcctcttcgacgcagcctcaaagctccatgatgggcccttaagggcaccgattgatgtcttggtgggcaatcgatttcgtccgcgcagtttcactttttcgaggcctggcgcattacaggtactcacggcagcttcccgaccatatcagagcaccgatcggccctggagcgtcatctatgcctggagtccaggtccagctccaattgcgaaacttggaagccgatctgtccgaagccataccgtagatggcaaagcatgcacggcacgcgcatctcccaccctgagatagttgcatatgttggtcgtgggacagcgccagtgccagagcctatcaggatgctgtaggcgagttacacaaattccaaacatttttaatgttgtatgctggcttggaggcttccgtgccgcacttgtcaccgtttacgtcggctcggccccatgtgccacgctgcaggatccgcagacccacatgctcggccctcacagaacggatcaccagcctccagaatgagacgagtaggaacatttggctcggtttggggacctgtactgcttccagtgaccacttgatgtgaggctcgtggcccatgcaagattggtccataccccacgctgcctgcagtcaagcactgcgtgaagctgcgctcctcggcctcctaccgtggggagcagggccgcatgctcctcgtcagcaggactctggtgctggacctcgccccacatgtgcacacctccaacctgttcgccctgtccccggaagacgtccctgaaggtgcagcaaagcagggggggaaaaggatcgtgccggagatacccctacgtatagtttagatgcttgctcaaccagcatgtgccaggctccagctggcgtgctcagactgtccaacaccatccaccaggccttgaaccccatccctcatcccttgctgcccccaccgccaggcacannnnnnnnnngaggggggggaagtcgtgccggagatacccctgcgtaaagtttagatgcttgctcagccagcatgtgccaggctccagctggcgtgcnnnnnnnnnnatgggagggctgtggggacgtggggcagggaggtcgctgggtggggccggctgcgtacttgggagccaaccaaggcccgagtaccgccgcnnnnnnnnnngcatccaccaggccttgaaacccaccccccatcccttgctgcccccaccgccaggcacaccgcacagcaatctgacgctggtgaccccgcctgtcatgcgcaagctgacggggctccagagcgtggggcccgggacattggcggcggaggtactgcgcaacgtctactcccacgaccttgcctcctgcgggccacgccagctggtgctggacggagtgcaggacccgggcaacatggtgggagggtgggagggctgtggggacagggggcagggaggtctctgggtggggccgactgcatactcgggagccaaccaaggcccgagtaccgccgctgccctttcccacccacgcgctctcgaccccccttttgtcgcagggcaccctgctgcgcacggcgctggccctgggctggaccgacgtcgcgctgttgcctggctgctgcgacccaggcaacgacaagtgcctgcgggcgagccagggcnnnnnnnnnnactgctgcctggctgctgcgaccccgggaacgacaagtgcctgcgggcgagccagggcgcctcgctccgcctgcgcctcgtggcgacggaagacgttgagctggcggcgtcctggaaggccaccggccgcatggccttcgcggccatggtgccggaggggacggcggtggggcggggtgggggcgcagggaagaaaggacgagccctcccctccctggatgtcgccaacggctaccccgacggcgtcgcgctggtgctgggggcggaggggcgcggcctgtctgccagcctggcacgcgcgtgcctccacctgagcgtccccatggtgcctgggtcggtgcagtccctgaacgtggcggtggcgggggccatcctcatggccgcctgctccggcgcatggccgcacctgggagagccccaggacggccggtgagggtggccaggctgcgtgcgaatgtgcccaaaccctggacggtgtaaacgaatctatatctcccgagaaggggattgaacccagcctcctttggctggtgcgggatccaccaccgtctcgggcatgcggcgcttgctgcgggaatcttaaccttcccgannnnnnnnnncgaacccagcctcctttggctggtgcgggaaccaccgccgtctcgggcatgcgacgcttgctgcgggaatcttaaccttcccgacgaatatttctgcatggtcgatatgccctcccacccaccctagcactagtgaacgcatcctggcatctggatgcgcagttccagggccccgactccaattcgctgggtctttgcagcaaagtcacgaggtgccagaacaaccctcgacaccccgcgcgcttcttgccgagctccaacgccggcagtctcagtgcgcgagaacaccatcgacagtgtgcggaactgaaagggtcgggtttctgacgaactaagctcgacaggggccaccttgggcgctcaggtccaatatgaaggtgagtgggggttcgcacctctggtccttgccatgcagtnnnnnnnnnnttaagctccacaggggccaccttgggcgctcgggtccaatatgaaggtgagtggaggttcgcacctctggtccttgccatgcagtacggcccctgtgacccagcccggacccagaacatcgggcgctcccctccgcagttcggaaaatacctggatgagaagaaacgggccctgtgggccccacattacgtcgactacaaggccctgaaggatctcatcaaggactgtgcggctgctgccgagctggtgggcaggcagtgaaggagggaaggggaggtgtcacctgaacgcaaccacctgtgcacgaaaagctgcatcccctgggtgtcaccgagcccctctcaacctggaatgcacgccttgcccctgatgcccgcctcgcagaacgatggctggcaatcatcccaggtgacttcgctgtccgtcactcgcttcagctcccgggacctacccgaggagcagttcttcaagcgcctggaccaggaagtgtccaaggtgggcaaattcaccgcccagctggtgaccacgctgcgtggccgcctgcagaagctacaggactcggtgcataaggaccttaagcccggcgagagggacgagctgctggaggtgagaaagatggggcaaatttctgagggcaagaccctggaaatggtcgtttatagggtgatattacaaacgtccaaccagagtactccctgggagctgggcacaatcattgagacccggtgctcccccaccctatccccatccaagcaggaggccaaggccatcggcgacgagttcctgcagctcgaaaagtacgtcaacctgaactacatgggcttccacaagatcctgaagaagcacgacaaggcgctgccccagactccctgccgccagttctacatctcccacctgcaccagcagccctgggtccaggtgggcgccgtggccatgggcttgtgggcattggcagcttcagctcgggcactctgagattgcgcaacactcgaggactgcctgcctgtcttggggacagnnnnnnnnnnctgtgggcattggcagcttcagcttgggcactctgaggttgcacaacagtcgaggactgcctgcctgtcttggggacagagcaatgtggggcacctccaggcatctgcccctgtgctatcctcaccctcctcccccctctcccaccctcaatcaccagggcaactactctgaactcatggttgtcctctccaacatcttctctgaggttcgaggcgataccctggccgaggcccagggcggatccgctcaggtcaggaagaaagggaggaacgagctgctgggtcgcaaggtctatactcattgacagtagtgcaacaacacagagtggctgcggcgcggcgatgaannnnnnnnnnccaggtcaggaagaaagggaggaacaagctgctgggtcgcaaggtctatacttgttgacagtagtgcaagaacacagagtggctgcggcgcggcgatgaaatgggccgcagcagcttgccgaattttcttgttcccagcgcactctggcactgataatggcatatacacctcgacgcatgcttgccaggattcccgcttccccttcccagactcggcctcacctcaatgttcatccctcaacctccacccacacccacccaccaggcgttcaaccgctccaccaccaagtactggatccgcacctccgacgtgtcggccgtcaagcgcaccatcatcgagaacatgccggtgttcgtgttcaacgccgagaactactcgggcgacgcgcagctggtcaactcggtgtactttgacaatgacagcctggagctgtaccacgggcgcctggacaagaagcccggcgcactggccatccgcgtgcgctggtacggccccaacgacccctccctctgcttcgtggagcgcaagatccacaaggagtcgtggaagggggagaagagcgtgaaggagcgcttcacgctgcccgaggcgaaagtggtgccctacatcgagggcgagtacacggcggaggagtatgaggagggcctccgagccaaggtgtgttgtgcgggggccggggctgggctcccctgtcagtgggttttcggggaggagatgggtgtgaggaagggcagggagcttggtcgccgggtgtgatgtggatgaccagggagaagacgagctgaaggtggagtgtgaatgtggctggcaaccccactcacactcccgctcctgccaaccaaacgtacagggcaagtcggaggatgacatcgccaaggcatccaagctcttccgcgagatccagctgaccatcgacagcaagcagctgaagccgtttgtgcgcacgcagtacatgcgttccgccttccagatggggcacgaccgctccgtctccttcaccctggacaccaacctggtgatgctgaaggagaaccccgagggcgcgcccacctgcgccatctcggggcggtggttccgcgaccccgcgctccccgtctcgcgcactgagatcacgcgcttcccgcacgccgtgctggagatcaagctggcgctgccggagggcgagtcgccgccggagtgggtggcggacctcatggagtcggacctcatcaccgaggtgcacaagatgagcaagttcatccacggcactgccaccctcttcccggagatggtcagggtgcgttcgaagaaagggggaagggggtgtttgtcctgtggggtgtgtgatgccgttggacgagtagttctgagtacgtgccttcaaaagtgcatggagggtagcccgggctacgcatatcaatttgagcctctgtcagagcacccagcctcaccccctcctgctccatcaccccaccaggctgtgccttactggatggacgacgagtccatccgtgcctccatcctcaactcggccccagatgccaagcagatcgactccaggtgggcgacgcatgcaggcttgctggacacgggggaccctggatgtgggagtggagagttggctgggcgagggcagggagattttagaggattgtgagcaggattcaggcagcggcaggctgcagtgcccaggggagcagtctccaccagtgctcaggctgccgcagcttcattctcacgagtagaactcccatgcccacctggaccaaccaccgcttggccgtagggcgcgcgacgcccagatcgtggccgaggagaagccgcgcaagcggcggggccccgagcctgcggccggcgacgaggacagcacgctgcaccaccccctgctgggggagggccccacgctgcagctcatggacgagggcggggcggcgggggttgggcgctcgctgcggcgcgtcggcgccccgcccgccgagcggccctgggacaaggtgctggcctggctgccgggttcaaagaacaagaagcccatggccaccaccattccccaggtgcgtcgatgaggaaggccggcagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacccccccctcacccgggagtatatgctcctctgacctgtcgccgccctgcaccaccgcaaacctattacctcctacacctatcacagcgcctggagcccaagacattcctggcatcggagcggaccttcctgtcctggatgcacatggccatcaccctggcgtccatcgccaccgcgctgctggcctttgcggggtccagcaaggacaagctcgaccccctgcacaaggcaagttgtgtgaggctggcctggggccggtggaagctgggaggggtcctcgtgacgagagcttgagggattgtggggagctgctcttcccactgcctggctgccacaccccgtgctgccacagaccaatgggccaggaggagatccagcattggcgcctttaagccaacgcgccttgtcatacaaacagcccagctcttccacgcttgttgtgcacagtcttgaagcaccctgcttacaccatttttgaccctcaatccttgattccctgcaggtcggcggcaacctnnnnnnnnnncgcaaacgtgccttgtcatacagacagcccagctcttccacgcttgctgtgcacagtcttgaaggtccctgctcacaccaattttgaccctcaacccttgattccctgcaggtcggcggcaacctggtgctcttcgtggccttcatcctgctgcccctgtccatcctcatcgtggcctatgctgcaatggtnnnnnnnnnnagtttggggtggcggggtatgctgtaccctcgtggaccctgcgtgggtccatacagatccccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggggtcctcgtgaagagagcttgagggattgtgggggagctgctcttcccgaggcctggctgccacacaccgtgctgccacagaccaatgggccaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgccgctgggaatcggtcgctgtttgcggcatgtgtgcggttattgcccggggcgggggggtgctataggtgtttgcacacgtactactggatacaaggctgctgttcatcatgaagtcgcctccggtctagaccctcctcccacttcccttaccacaacaggtgtttgtctggcgcagcaacnnnnnnnnnngcgccgctgggaatcggtcgctggttgcggcatttgtgcggttattgcccggggctggggggtgctataggtgcttgcacacgtactactggatacaaggctgctgttctttataaagtcgcctcgggtctagaccctccccccactcccccttgccacaacaggtgtttgtctggcgcagcaaccagatcgcgctgaagcaggcgtcatacattgacgaccggaggtcagtgggggttgtaactgtcgtttgccgtgccgatcagagagggagtctatggtttggtgtgcagcgcaggtgtacctggcctcctgtatgcaacagtcctgaagtcgctgggcacacccgcaccaatgnnnnnnnnnnggtctaaggtttggtgtgcagtgcaggtgtacctggcctcatgtatgcaatagttctgaagtcgctgggcacacccgcaccaatgnnnnnnnnnncttttcatcctcctcccccccacgaaccattatagggctataaggcgcccgtccacactgcgnnnnnnnnnnttcctcactacttgtgcaggggcccatatctgctcgtgaccctggtggtgctggcgctgaccgccatcttcgtggcttccagcgtggacctcgtcacggcctggaaggagacccactccagcgtaagtcgggcaggcgggtgggatgccgcgggtgcgggctggctctgggacgtgttgggcgattgttcctgtgctgcacgagatgagatgacaagtttgagccctcctgtgcctggactgagagctgcaatgatctgcaagctcccctgtatacgtttgcatcctcctccccccaacgaaccattttagggctataaggcgcccgtccacactgcggtccacaaacagctctttgataacttgggctcacagctggggcgggtatgatggctggcaccatgggggcgccctcccaagcctggtagctgcttttatgccctagaacgttccgtgcaacttgtgtctcatcttgccagtgtgctgcagctccgtaaagtttcagtgtcgcctggtgtaagtttgannnnnnnnnnatatgatggccggcaccatggtggcgcgctcccaagcctggtggctgcttttatgccctagaatgttccgtgcaacttgtgtctcatcttgccattgtgctgcagctccgtgaagtttcagtgtcgcctggtgtaagtttgaatatccatcacctatgacgtgagccattacattatggacgatgaagctgaagccagaggcgcgatcctaccgagcccatgaagctgagatgggtcatctaaaataaacattgcatattggtaccaatcaggcataggaaggcagcagaggcgtctgnnnnnnnnnncgggtcatctaaactaaccattgcatattggtaccattcaggcataggaaggcagcagaggcgtctgccaccaggagatctgtgggctgaaggggtcccgctcgtgccaccccggaggtcccacccaccatgtttcccttctccctgacgacgtctgcccaccctttcgtggattccttctgcgatccagagtgaggagtaaagcatgcgggggcatgcatgcacgcctcggttgcgcccgcatcgatgctggaataagattccgcccagctcgactcccacccatctcgtcgcaggggggccggtcaccacttcacaaactggctgggaccctttacccccgtgagcgatgggcttggaattaagtgcacctgtttttgaccgcagtccgcattcgatctggcctgcaaaatgccgtagtcgggctggggccagcaccgcctcgttgagcatcagcagcctggccgtcaggaggggccccactctaatctacgtcgcgtccctgtcctccaccccccccctcgcaccccacgattccacccctgcacagtgcttcacggacatcgtggtnnnnnnnnnngatctacctcgcgtccctgccctccaccccctccctcgcaccccacgattccaccctgcacagtgcttcacggacatcgtggtcatcggcgcggcacatgccctggccatcgtctgcagcctggccagcctccatgcctcgctcctggattccaggacctccaagtaccgcctgggcacgagtgaccgccggcgacatgtcgcggccgcggtcctggccggcgtcgccctcctggtcctcgccctgcagctcaacgcccgcctggcagcgcacgcgctgcccctggtgcagggcgccgccgcgcccttcgagtgggcggcctacactctggccgcgctttcctgggcgctcctcgtcgcgctgttcgcgacgcacgccagggcctttgcccccgcctcgtcgccggccctgtggcggttccctcctttccttgtgctcaccggcaacctggccaagctccgcttcgtgctgcagtcggaggagcgcagcgactactttgcggccctgttctacgcctacgtcgggctgcaggtcgccctgtgcctgctcctactctggctggcgccagattgccggaagatggtcctcgtggagcagggcacggggccggaccccgacaccgcggcctacttggtgggtgggctggaggagagcgggctccctaacgcagatgctggtgtgctctggaatagcccttccgatgcatgcttggtgaccatgaggggcacatggggttaatttatttggcaagagccggcagccaggctgcatatgcggcagatttattggctccgcatcaccgggcctgcctcnnnnnnnnnnaagtttatttggcaagagccagcagccaggctgcatctgcggcagattattggctccgcatcaccgggcctgcctccatcacctcgtttgtgcgttttcctccccatcatggaggcccccaacccctcttccccctctcacgcccgtcccccaatggcagccgctgcatgacgacgaggacgtctgccccgaggtccgcgccggccccctctcgcggctcaccttcagctggatggggccgttgatgaagcgaggctaccgcgcccccctcacctttgccgacgtctggcgcctgccgccggcagacaggtcggccaccctggaccagcgctttgcccacttctgggcggccgagcggcagcggaacccagagaaccccagcctggtgagggtggcgggggtagattgttgggcggctgggagtctggagagctgtggtgacgcagggaccgtgcatggaggttggactcgtagaagtggggatgggcagaggtgtacagccttgtggacactcaggnnnnnnnnnngggttggactcgtcgaagtggggatggtcagaggtgtacagccttgtggacactcagtatgccatgtggatcctccaagctctgtgatatccaactctttgttcatgcccatcaaacctccctcccactttcaaaaacccctcccccacaaacagacactcgtgtgctggcaggcggtgtcccacctcttcctgcccgccatcccagtgaagatgatctccgatgcagcccagttcgtggccccagtcttcatcaacctgctgctgagcgccgtgtccagtggtgcccccgaccgcaccggctacctactgtccctggggctgctggcggggctgctcacgggaaccctggccgacaaccagcaattccagctcacaatgcgtgcaggtgggggcgctgttggactgtttggtaggggccgggagaggcaggaaagggcagggagtggagtattcagcctggcacttgaagaatttgtgtctggatggttcgaggagctagccgctgggttgcttcatccctgcgctgttgatttgtagtgtcgaacgctggagttttgccgatgacggggcttgttgtgacccatgaacgcctgaatacacgtcagccatccatgccctccctccacaggctaccaagtccgctccatgctgacacacgctgtgtaccacaagatcctcttcctgacacccaatgcccgggcccagttctccagcggtgagttgtgcgctggggagtgaggtagggcctgttcatcaatgaggtccagaacacctcactcactcatcgccagcaatgcaggccgtctctactctgccattgggtcggatgtggacacgctgcagaacctgagccagggcatcctgggcttcatcagcaggtaggaggctggcaggacttgcctagggaccatgcccgggtagatgggctccttgcctgggtggaaagcgtgcgcctcgcgatgccctgccacgcccaactcctgctccgcccccctgcatcggcctcatccctcatccgcnnnnnnnnnngtcaatgaggtccagaatatctcactcacttatcgccagcaatgcaggccgtctctactctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggaccatgcccgggtggatgggctccttgcctgggtgggaagcgtgcgcctcgcgatgcccctgccacgcccaagtcctgctccgccccctgcatcggcctcatccctcatccgccgcccattcttcagcccggtccgaatcatcggcgccctggtcctgctctacttccagctcggcattgctgccatcaccgccgtcgcctttctggtcctgctcctcccggtccaggtgattgtgtggctgggtgtgttccaagatgcccttttgtcactgctgggtgtcagattgcaagggtagaggctcaccccccatctcggcacttgcagtccccctttccacaacaaccatccgtccctggccacaacacgcaggnnnnnnnnnngtgcactccttgtcactgtcgggtgtcagattgcaggggtagaggctcacctcccatctcagcacttgcagttcccctttccataattaaccatccgtccctggccacaacacgcaggcctggctggtgaggcgtcagcgcgccatcctgcgcgactccctggccgccaccgacgagcgcgccaagctggagtcggagctgctgggcggcgtggacgtggtcaagtgctacgtctgggaggacagcttcctggaccgcatccgcggcgtgcgggaccgggagctgtggatgctgtggcgtgccttcttcatcgcctcctccaacaccgtcatcatgctggcagtgcccgcggccgcggcggtgggcgcctttggcacctacgcgctgctgacgcacaaggccctgaccccctcccaaggtgcgttgaaagttttggtatgttatgagggtgatgagtcctgcatgacatgtatcttggaaagcttgcgtggcttctaacatcactcctccgtcttcttggacatgcacctgtgcattccgttgcccccctcgctgagcaccacctcctgagccccttcctggcccacaccaatacatcctccccccccccccccccccccccnnnnnnnnnnaaccccctcccaaggtgcgttgaaagtcctagtatgttatgagggtgatgagtcctgcatgnnnnnnnnnnaaaaaacctcactcctccagccttcacctccctgagcctgcttgcggtgctgcgctttcccatcgccagcctgccgcagctggtggcctcagctgtgcaggccagcgtggcccttggcaggctgcaggccatcctagccagccccgagcagggcgaggtggagcacctccctcctgccggccccggcgaggcggcggtgtccctgcacggcgactttgcctgggccttggacctgccccccagcctgcgcgacctacacctggacctccgagccggccagctggtggcggtggtgggtgccaccggctccggcaagtcttcgctcctctccgccgcattgggtttgctagagcggctgggcgagtcccccccgcgtgtgcgcggccgcatcgcgctcgtcccccagaccgccttcatcaccgccgagtcggtgcgaggcaacgtgctgttcggcgcgccccacgaccccgtgcgctacgcggccgcgctgcgcgccgccgcgctggagccggacctcgcccgcttcccggccggggacgagaccgaggtgggcgagcgcggggtcacggtgtcgggcgggcagaagcagcgcatcgcgctggcgcgggcggtctacgccgacgcagacgtcgtgtttctggatgacccgctgtcggccctggacgcgcgggtgggccgccgcgtcttccgcgactgcgtgcagggcgcgctggcggggcgcacgcgggtcctggtcaccaaccagctgcagtatgtcagctccgcggaccgcatcctgctcatgcgcgacgggcggatcgtggaggacggtacctacgcggagctgatggcggcggggggggagtttgtgggcatcatgtcgcgggccgagaccgagaaggaggcgggcgaggaggaggtggaggagggcgcggggggggaggagagtggggaagaggagcatgtgcaggacggggaacagtccgacgccaagaatggcgaggcagtggcgcgctccaagctgtccacctcgacgaaggcaaggggggttgggggttgatgaggagggagtggggaggggtggggtcaagtgtgtgtgcgtgcacaccgcatttgatagcaggccccctgactttggcgcggacgacaggtgtgttctccttacataaccaatgggcatccgctgtacagcccacccctagcatctccaagatccccccacccgtaacaacccctgcagtctgagagcagcctcggagctcgccggccaacgcgagccgagcaggcggaggcaccgggggcccgtctggtggaggaggagggacgcagcaccggcaaggtgtcctggggcatcatgcgtggctacatcaccgcactcggcgggccactcctcgttctcgtcctcctcgccgtcttcattgccgtggaggcggcgcgtgtggctgcccagctctggctgcagcactggacgggggaagtggaccggacgcatggtgggccggggtgtgggtttggggtgctgcggctccagtgaatagtgcaaggggggatgatcaacgcgatggaggtccgtgagtgtatgtagacaacttgtgccgctccacactacatgtcacaagagtttgctggagccctcgagtgcacatgccttgcgatgactttgggatgcaatgttgatgagctgacttctgacactcttccaccgcttaacggtgcgcaggtcacaccaagcgctccattggcttctacctgggtgcgtatgaagagtatttttcaaggcttgccctcggtgacttctgcgctgtcgatgtgctgatcccagagctgtccccgcaagtgtctgacaccatgcatttgggtagctggcccggggtctcaacaggcgtcatgctgtgggaaaccattgcagtgatcagcccagcatgttctctagtttacaccccccacagaaggcatgatccactcttccacctctcctgccggcccaaacccctatactgcccccagatttctcccctcctgtcactattatcaggcatgtacgccgcgctgagcgcgacccaggtcgtcttcacggccatctcgcagtacctggcgcggtacatgtccctgctcgcttcacgacgcctgcacgatgcgatgatcgcgcgcctggtccgcgcccccatgtccttcttcaacatcacgccgcttggtcgcatcgtcaaccgcctgaccaaggacacctcggagctggacaagaacctgaccgactactccgccttcttcatgcgctccgtgttccagctggcctccaccgtcattcttggtgggttgagaagggggggcagcacagggtccggtggagggcggcgcccactgaccgacgatggtgcagcctgtgcagctcatcctccttgctggggaggattacctgaaagggtttgcttggtgggatgcagtgctcgaccatcccctgacctgtgtccctgctgtccctgactcacggaccttccaaggcctgggaatgcctggtcaggcatgcagtatgttctcaccccccacctccactcacaccttgcagtcggcgcattgaaccccttcaccctctgggccctcacccccattctcttctcctttgtcgtcctgtaccagtacttccaggtgcggagtgggggggcgtggtgccggggtttgacctgcatgtgcacctcagccccaggcctgtgcagtgggatcgttgccgattgtgccagcaatccacttgtctgctcctcatacgctaccgtctgccccaccctccatgctcccgatcctgggacacacccgagcacaaaacacctcagaaccccgccgacacctcacctccaccgcccagactacggtgcgtgaagtgaagcgcctggactccatctcgcgctcgcccatctacacctcggtgggcgaggcgctgggtgggctggcctccatccgagcctttcgcgcggagcggcgcctgctggcgcgcaccggccgcgcgctggacggcaacgtggtcatgtccctggccaacatgagcgccaaccgctggctcagcgtgcggctggagtccctgggcgcgctggccgccgccgccgccgcgctggccgccgtcgagcagcgcggcgcggccgcgctgctgggcaacatcctgtccagcgcgctgcagatcacgagcctgaccaacatgacgctgcgcagcgccagcctggcggaggtgtccttcaacagcgtggagcgcgtgctggagtacagcgagccgccgcaggaggcggcggccgtggtccccggtgccgccccccggcgctggccctcccgcggcgcgctggccttcgaaaatgtcaccctgcgctatcgccccggcctgcccctggtgctgcggggcctcagcttccgcgtccccggcggcaccacctgtggcgtggtgggccgcacgggggccggcaagtccagcctcatcaacgccctcttccgcctggtggagctggagggcgggcgcatcacgctggacggcgtggccactgacaccctgggcctggcccagctgcgcggtgccatggccctcatcccgcagcaacccgtgctcttcacgggcagcgtccgcttcaacctctcgccctttgccgggcacagcgacgcagcgctgtgggccgcgctgcgccacgcgcacctggccaccgccgtggagtccagccccctgggcctggacatggtcatctccgagggcggcgcccccctgaggtgggacgtcggatggggatggtgcttgtgtgtggatgggtggtgggttgagggtgcgagcagcagtctttaggcgnnnnnnnnnnatcatctccgagggcggcgcgcccctgaggtgggacgtcggatggggacggtgcttgtgtgtggatgggtggtgtgttgagggtgcgagcagcagtctttaggcggccagcagagataatccaaatcactcggacccccccccccctttttccacacccaaaccttctacaccctcacagcgcggggcagcggcagctgctggcgctggcgcgcgcgctgctgcgccccaccaaggtgctcatcctggacgaagccaccgccagcgtggacgtggagaccgacgccctgatccaggacaccgttcgccgagagttcggcgagtgcacggtcgtggccatcgcgcatcgcctgcaaaccgtgatcgacgcgcacaatgtcctggtcatggacgacgggctggccgtggagtttgggtcggccgcgcagttactggccaagcaggacggcgtcttcacaggtggggtccgcttgttatctagggtctgcaggcggaacggtgtggggtctgcaggcagagtgggtgcttgtcgattnnnnnnnnnngtcgtttgttatctagggtctgcaggcggaatggtgtggggtctgcaggcggaatggtgtggtgtctgcaggcagagtgggtgcttgtcgattggcgagggtgcgcatgcactgcatcggcgagggttcttcgtgccccaggtgcgcgctggtcctagatgcctcaatcggatacccatgacgccccgtcccccctccctcccctgcacagacatggtgagggagacnnnnnnnnnngcttcgtgccccaggtgcgcgctggtcctaaatgcctcagtcggatacccatgacgccccgtccccccctcctcccctgcacagacatggtgagggagacgggccccgccagtgagcgcatgctgcgcgcgctggccgagcaggcggccgacgctgtgcaccttgccgtgccggcgcgcagcggcggctcccacctctccacgcgctccgtggacctgctggcctccccgccaccgtcgccgggcggcgcctcgccgctgcgcgcgctgggcacgcattcgcgcgagctggtggcggcggccggtggcgcagccgcgcagctgaagaaggcgctggagggg

SEQ ID NO: 45669 - DNA, 70 bp, Chlorella protothecoides
tactgcctgtgtcaatcacctcgagaggacttgtgattgctgttgcaggaggacttttacagtctgcgcc

SEQ ID NO: 45670 - DNA, 61 bp, Chlorella protothecoides
cgtccctcacctttgttcttgcctcacaacaccgcccctccacttcctccactcagtcctc

SEQ ID NO: 45671 - DNA, 80 bp, Chlorella protothecoides
cgccagagccccacccacgtggcatccccgccagagtcttcctcgctcacggtctcccgcctgctcccagccccacaccc

SEQ ID NO: 45672 - DNA, 74 bp, Chlorella protothecoides
tctcctgttcctgcccttccaagtagactttagagggatggcccggcttccgcgagtcctttgacgggggtccc

SEQ ID NO: 45673 - DNA, 90 bp, Chlorella protothecoides
ccaggctggcaacgactcctcctcagcccacactccgcagatcccttgtatatagttccttgcttaggatgcagcactcaccggatcttg

SEQ ID NO: 45674 - DNA, 61 bp, Chlorella protothecoides
gtgatgcaaggggggtccggagagaggaggtggggcatgcaaacagaaggcttggcttcaa

SEQ ID NO: 45675 - DNA, 61 bp, Chlorella protothecoides
gtcaaggcgcagcgatggttgttcgcctgaaccagcactctccgcctcatccatggcgagg

SEQ ID NO: 45676 - DNA, 61 bp, Chlorella protothecoides
tgacgtctgtgattctggtctgccgatcagagttgccagaaggttctgaagtgtcggccac

SEQ ID NO: 45677 - DNA, 66 bp, Chlorella protothecoides
tctgaatctggttgtataccccggaccaccagcatcagcggcatctccccgtgcaaggtaggaagg

SEQ ID NO: 45678 - DNA, 78 bp, Chlorella protothecoides
ctctcctcctcgagtaccccaaggtgtgtccctcatgagagttggcacccctgcatggccatccttgctcgctctatg

SEQ ID NO: 45679 - DNA, 61 bp, Chlorella protothecoides
ctttccaatacacatgcaaagagccaattccatccctcgatgacaacactgattccttcct

SEQ ID NO: 45680 - DNA, 61 bp, Chlorella protothecoides
gagccctccatcgtggacaggctgcgcgagtatgtcatggccaatggacacccccagcagg

SEQ ID NO: 45681 - DNA, 68 bp, Chlorella protothecoides
actaaaactaaaactaaaactaaaactaaacctaaccctagagcacccccttggaggggtctcaagtg

SEQ ID NO: 45682 - DNA, 79 bp, Chlorella protothecoides
cctgctccatcctcatctccacaggtgcgagaactccacgtgaggagagaggagctcagaggaagagaagggactggga

SEQ ID NO: 45683 - DNA, 74 bp, Chlorella protothecoides
catgtcgctgagccttcctctagcacccttgatttcatgcagctgccagtgccatgcgatgcagcagcatggaa

SEQ ID NO: 45684 - DNA, 75 bp, Chlorella protothecoides
atgttgccgtgagcagctggtcaggtgcagggacgagcgaatggccgtatacgcagagcctggtcccctgaaaac

SEQ ID NO: 45685 - DNA, 61 bp, Chlorella protothecoides
cattcatgcagccaagcccgggacgaggccccgcggccctgaatagggtcagggtggcctc

SEQ ID NO: 45686 - DNA, 78 bp, Chlorella protothecoides
agcttgcagcatgccactccacccctccattgcgtggtcgccaaggccatcccctgccgctgcacctcctctggtttg

SEQ ID NO: 45687 - DNA, 66 bp, Chlorella protothecoides
gatgctgtaggtggatcagctgtctggccgccctgcaacaaccggcctttccaacactgtgcatct

SEQ ID NO: 45688 - DNA, 138 bp, Chlorella protothecoides
tgctattcaaggtaggcaggatgagcaacttccctgaaagatgctttctgcgagccagctggagtctaaaatgtcattacagtgggaacaccctcccaagccatccccaaacagagtatcaaccatacctcccccctc

SEQ ID NO: 45689 - DNA, 107 bp, Chlorella protothecoides
cctcgtgatccaccctcaccatcgtccagatacaaacagtctacacacacccctcctccctcgaattcccacatcagctggaggctcaccatagccataggacgcgc

SEQ ID NO: 45690 - DNA, 61 bp, Chlorella protothecoides
acccctcctcctctcccccccccaacccaatcccaaacaggcctctgcgatggaccgactg

SEQ ID NO: 45691 - DNA, 61 bp, Chlorella protothecoides
ccctgctcgtgccatccgttgttacctgcaccaaggtgggcggtctggggaggagacaggc

SEQ ID NO: 45692 - DNA, 387 bp, Chlorella protothecoides
  modified_base (104)..(279): a, c, t, g, unknown or other
aggtccatttcaatgctggctagtggttaccttgccttccacatgttgtatggacttgcacgaaggaggcctctgcatccggacgaggatgcctgcatcatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacgtaccttgacatcgcaattatcacatggcgggatggttggccagagtgcctcccgtcctgtggtgggtgccggttggtgtagcggtgaacgactccctcgtctcc

SEQ ID NO: 45693 - DNA, 65 bp, Chlorella protothecoides
gaagtggggtatcgtcatcgtctcggcacggggttgacaatgcttctcgaaaagggcgtcaaagg

SEQ ID NO: 45694 - DNA, 63687 bp, Chlorella protothecoides
  modified_base (511)..(520): a, c, t, g, unknown or other
  modified_base (1169)..(1178): a, c, t, g, unknown or other
  modified_base (1391)..(1400): a, c, t, g, unknown or other
  modified_base (1636)..(1645): a, c, t, g, unknown or other
  modified_base (1936)..(1945): a, c, t, g, unknown or other
  modified_base (2194)..(2203): a, c, t, g, unknown or other
  modified_base (3021)..(3030): a, c, t, g, unknown or other
  modified_base (3668)..(3677): a, c, t, g, unknown or other
  modified_base (3756)..(3765): a, c, t, g, unknown or other
  modified_base (4409)..(4418): a, c, t, g, unknown or other
  modified_base (5073)..(5082): a, c, t, g, unknown or other
  modified_base (5939)..(5948): a, c, t, g, unknown or other
  modified_base (6479)..(6488): a, c, t, g, unknown or other
  modified_base (6648)..(6657): a, c, t, g, unknown or other
  modified_base (7118)..(7127): a, c, t, g, unknown or other
  modified_base (7718)..(7727): a, c, t, g, unknown or other
  modified_base (8351)..(8360): a, c, t, g, unknown or other
  modified_base (8692)..(8701): a, c, t, g, unknown or other
  modified_base (9034)..(9043): a, c, t, g, unknown or other
  modified_base (9403)..(9412): a, c, t, g, unknown or other
  modified_base (9588)..(9597): a, c, t, g, unknown or other
  modified_base (12632)..(12641): a, c, t, g, unknown or other
  modified_base (13472)..(13481): a, c, t, g, unknown or other
  modified_base (13830)..(13839): a, c, t, g, unknown or other
  modified_base (14654)..(14663): a, c, t, g, unknown or other
  modified_base (15356)..(15365): a, c, t, g, unknown or other
  modified_base (16056)..(16065): a, c, t, g, unknown or other
  modified_base (17875)..(17884): a, c, t, g, unknown or other
  modified_base (18333)..(18388): a, c, t, g, unknown or other
  modified_base (19452)..(19461): a, c, t, g, unknown or other
  modified_base (19637)..(19646): a, c, t, g, unknown or other
  modified_base (20211)..(20220): a, c, t, g, unknown or other
  modified_base (20557)..(20566): a, c, t, g, unknown or other
  modified_base (22355)..(22364): a, c, t, g, unknown or other
  modified_base (22470)..(22479): a, c, t, g, unknown or other
  modified_base (22551)..(22560): a, c, t, g, unknown or other
  modified_base (22711)..(22720): a, c, t, g, unknown or other
  modified_base (23648)..(23657): a, c, t, g, unknown or other
  modified_base (24322)..(24331): a, c, t, g, unknown or other
  modified_base (24749)..(24758): a, c, t, g, unknown or other
  modified_base (27076)..(27085): a, c, t, g, unknown or other
  modified_base (27495)..(27504): a, c, t, g, unknown or other
  modified_base (27583)..(27626): a, c, t, g, unknown or other
  modified_base (27679)..(27688): a, c, t, g, unknown or other
  modified_base (28252)..(28261): a, c, t, g, unknown or other
  modified_base (29251)..(29366): a, c, t, g, unknown or other
  modified_base (30145)..(30154): a, c, t, g, unknown or other
  modified_base (30310)..(30319): a, c, t, g, unknown or other
  modified_base (30879)..(30888): a, c, t, g, unknown or other
  modified_base (31290)..(31299): a, c, t, g, unknown or other
  modified_base (31386)..(31395): a, c, t, g, unknown or other
  modified_base (31463)..(31472): a, c, t, g, unknown or other
  modified_base (31745)..(31754): a, c, t, g, unknown or other
  modified_base (32687)..(32696): a, c, t, g, unknown or other
  modified_base (33985)..(33994): a, c, t, g, unknown or other
  modified_base (34252)..(34261): a, c, t, g, unknown or other
  modified_base (34661)..(34670): a, c, t, g, unknown or other
  modified_base (35092)..(35101): a, c, t, g, unknown or other
  modified_base (35521)..(35530): a, c, t, g, unknown or other
  modified_base (35643)..(35652): a, c, t, g, unknown or other
  modified_base (35815)..(35824): a, c, t, g, unknown or other
  modified_base (36216)..(36225): a, c, t, g, unknown or other
  modified_base (37061)..(37070): a, c, t, g, unknown or other
  modified_base (37141)..(37150): a, c, t, g, unknown or other
  modified_base (37248)..(37257): a, c, t, g, unknown or other
  modified_base (37321)..(37330): a, c, t, g, unknown or other
  modified_base (37760)..(37769): a, c, t, g, unknown or other
  modified_base (38103)..(38112): a, c, t, g, unknown or other
  modified_base (38580)..(38589): a, c, t, g, unknown or other
  modified_base (39192)..(39201): a, c, t, g, unknown or other
  modified_base (39763)..(39772): a, c, t, g, unknown or other
  modified_base (40141)..(40181): a, c, t, g, unknown or other
  modified_base (40586)..(40595): a, c, t, g, unknown or other
  modified_base (40963)..(40972): a, c, t, g, unknown or other
  modified_base (42534)..(42543): a, c, t, g, unknown or other
  modified_base (43462)..(43471): a, c, t, g, unknown or other
  modified_base (43656)..(43665): a, c, t, g, unknown or other
  modified_base (43723)..(43952): a, c, t, g, unknown or other
  modified_base (45154)..(45163): a, c, t, g, unknown or other
  modified_base (45789)..(45947): a, c, t, g, unknown or other
  modified_base (46085)..(46094): a, c, t, g, unknown or other
  modified_base (47560)..(47569): a, c, t, g, unknown or other
  modified_base (53377)..(53386): a, c, t, g, unknown or other
  modified_base (53964)..(53973): a, c, t, g, unknown or other
  modified_base (60668)..(60677): a, c, t, g, unknown or other
  modified_base (61488)..(61560): a, c, t, g, unknown or other
  modified_base (61810)..(61819): a, c, t, g, unknown or other
cgccgctggtcgaggcgcagggggcggtgggcgcggcccaggctgcgctggaggcggcgctgcgggagagtcgccgggcggaccaccaggcggcgctcgccgccgcggtcgccggggtggtggcgcacatggctgcacacccagcccggggcgctgcgcgggagacagggacgtccagcgacgagtcggaggggtcggaggactcgaccgactcggtggcgaccagctcctccgacgaacagaagtcgtgcgcttcgtccagcgagtcggaggcagagttgagcgctctcgagcacgcggcggcgaagtcgagcgctctcgagggcgcggcggcgaagttgagcgatctcgaggacgcggcggcgaagtcgagcgctcttgagcacgcggcggcgagcctcgggacccgcggaggggcaccgccgcaggacgtaccttgccagcacgatcatggcattatcacccacccggcgccgtccgtccgaggcctgagcgcgccgctgccgcaggnnnnnnnnnnagcactgccgcaggacgtaccttgccagcatgatcatggcactatcacccacccggcgccgcccatccgaggcctgagcgcgccgctgccgcaggctgctgaactgaacaagaagggagctggcgagacggcctcggataggccaggcagtgcgccggcgggcaaagtgcgcatgggccatggcggccaggcgcccctggcgaatggctctgtcgaccatggacgtagagaggagaggccaacggagctgtgacccggtggaaaggaggtctgcagcatcatggggcggggctggcccttggatccccggcaaacttccagggcaggaggagtggaccattggttgcccgcctcacaatctccctctctgcctccctcaaatacatgcgtgcctgcttgagcggcatgcaccagaccaccacatagacccccgctcgagccagtgttgtattgcccgcacttggcggcggatgcccctccccccattcccagcagcccaccccgcacctcactctgctcatcatcctttggattgcatgaacaccatcacactgcactgtcgacatcttcgctcctgtttccattgcgttgcgccactctccttgccctgttcagaaaaaggtggagctcttgcgtcatgctgttgaannnnnnnnnngccctgcactgtcgacatctttgctcctgtttccattgcgttgcgccactcaccttgccctgttcagaggaaggtggagctcttgcgtcatgctgttgaaattgaccatcctgtttccatgcgatgtgcccaaggttcaaagggccagtcaccccagctggcaggaaagggaaaatacgatgggtgggaccaggcacgcttcatccacgatcnnnnnnnnnngagggccagtcactccagctggcaggaaaggggaaatacgatcggtgggaccaggcacgcttcatccacgatcctgacaccgactcttatccaggctgagagcatgcacgcccagagacaggtggagcgatggccttgtgctgtctcccaggccggggtgcgacggtgggctcatgcaggacaaagcttctatgggagaccttgaagacgtgtaaaggctgcacgagatagcctannnnnnnnnngaccaggctgggagcatgcacgcccagagacgggtggagcgatgaccctgtgctgtctcccaggccggggggcggcggtgggctcatgcaggacaagcttgatggaagaccttggagacgtgtaaaggctgcacgagatagcctacaacaagtgaatttaccgtggagcagaggcaaattgcattgtcgtatgtcccggagaaattcttcgcggcccctccccagggcgtctttgcaggtgttggcccgttttcgatgctcatgcacacactgctatcatcgccgccccgnnnnnnnnnncatcatcacgcttagggcatttgtagtcgtaaccgacagctctcgctgccatgcaacctcatgctcggcggtcgcagtcagggcgcgaaatctgtccgtgagaggtgctcaaaactccagaagaccccaatcttcagcacatcgtggacccctccctctacctcactggccctcccatctcatctacggagcatgggcggatcacctccacgccgatgaacgccccgcagtccttgggtaaagatcctnnnnnnnnnnacccagggcgtctttgtagatgttggcccttttcgatgcccatgcacacactgctatcatcgccgccccgcatctccttccccttttaatcacgctaaaggcatttgtagtcggaaccgacagctctcgctgccatgcaatctcacgctcggcggtcgcggtcagggcgcgaaatctgtccgtgagaggtgctcgaacctccagaagaccccaattttctgcccatcgtggacccctccctctgcctcactggccctcccatgtcatctacggagcatgggtggatcacctccgcgccgatgaaacgccccgcagtccttgggtaaagatcctggttgctgtcgcaaccttcgagttgactaccacttgagcacggagatgtgccccacattgcaacccatcgaccaccacgcatccattttgcagattgcagggtccgtgcgcgcgtcccagggacctctacgattgccctggtcttccgtcatttaccaccttgctccatgtggtcatacatttccagaagctaatttccgcccggactgtacgtcagtgcagccagtgcaggctccctctacgattccattttgtttctctgtcgcagtaaggaagcgtgtgactacccatatctgcaaagcagcctggaagcagacctgccacgccgcagatggcacactgatagccatgagcccggagaagttggcctcagctttgctacccgcacggaactgacttgctgggtgtgaaggatccgtcagtccacaattgagcttcctcttatacagcgtcggtcatcaggactcaagcatgaggtggccgtnnnnnnnnnntagttagcctcagctttgctacccgcacggaactgccttgctgggtgtgaaggttccgtcagtccacaattgagcttcctgttatacagcgtcagtcatcaggactcaagcatgaggtggccgtaccactggcagcgttctggtgattgatgttgcgcacttgcgcgctataacgttactgctcatgggagttatctgtgcagctggacctcaaggtgccacgcatgcgcataggcatgcagccctgactctgctgactctgtcctcgttcatagcaccctcggactatggcctttgccacatgatggttttcttcgtggcacctttgggcagctcttaggcaccataaatctgtggcgcctcctgttcccatgccgcaccccctcgccatgtggcagtgaggagcgcaccagtagtataccttcttatgccgcttctttaagtcctctcgagtctgcaagtcagccttgtgcctgcccccaccttgccccaacacccttcagacctcgcaagagggcaacatcttgagcgtggaaatggtcggcagaccctcccagaggcgtactgcacccgcgccgttgagtgctgtgcaggggaagcactaagactgtgcacagtccgctgtgcctggattgtgnnnnnnnnnncataagacgtaaagggtccccgatgacacagtctgcccctccgcttggcgtgcagtggccgtcaagagggcctgttgcnnnnnnnnnnattccaaaggcgtactgcacccgcgcctttgagttctgtgcaggggaagcactgaggctgtgcacagtccgctgtgcctggattgtgaagctccctaccatccatacagaccttaccaaacaattgtcacagtgagggcttgcggtgaagaggagccagtaccagtgcctgtccaggtctgtgctcctctacttgacagcgcatcctcccgtgttcatcaggttgtggtataagacggaaagggtccccgatgatacagtctgcccctctgcttgacgtgcagtggccgtcaagagggcctgttgcagatctgtgctgtcaccagcaggctccagaggttgagccgagcctgacccatctgcaatgcctactgctgcatactgatgggggttgacctacgcactatctcaggacattgcggagctacttttgtgtcggactgcagggtgtgtgggtctgactcgtttactgcacgtgctgctgacgagggcggggaagaatgctttgaaaaacgggggtctgtcagcataaaaacgggatcccagacagcaacaccactaattctcggctgtttatcactcaagtatccaagccgtccctcactaagacatcctccaaggttccccagcccctcgagcttcaannnnnnnnnnatctcggctgtttattactcaagtatccaaaccgtccctcactaagacatcttccaaggttccccagcccctcgagcttcaagatggccaaggtgagagcatcaacagtccacacaacgccctttatggctacacatacctccccatgtctcttcaatgtgatttaaagatattagatacatgtatcacaagcctcccatgcccccatcgtgccccgtacagagtattggtgcccgggccaacggccaccagcgtcgcacttccaagccgctgaccgtcttcgtgaaggccgttatgagcgccttctccatggtctccctgcacttcggggcgaagacggcgaattctagctccaacgcgtcctccaatgcctcggtgagttgcagggtgggtgctgtccgttgccctcgttgttagcgagccacccggctctccgcgacaccgcccatgggtcgtccctgatcctccatcgctgcacttcacgcagacacctgcttcctgctccaagggcgagaacagtctggcggaaactcccaagagcctgtcgtcctccgagtcctcggctccagccactcccaccctcgcatccccagcaaccccgtacccatatcttgccgcctccaaccctgcctctccggcccccgccgcctccacnnnnnnnnnngtccccagcaaccccgtacccatatcttgccacctccacccctgcctctccgggccccgccaccgccacccctgcttctccagccccagccacctccacccctgcctctccagccccagccacctccacccctgcctctccagcccccgccacctccacccctgcctctccggcccccgccacctccatccctgcatctccagccccagccacctccacccctgcatctccagccccagccacctccacccctgcctctccagccccagccacctccacccctgcatctccagccccagccacctccatccctgcatctccagccccagccacctccatccctgcatctccagcccccaccacctccatccctgccccctccaccccccttcacactgccgatgtggccatcacacctccactgcgtcaccagcgccgcaactctgtgtcttgcgacgaggccctcttcacccccgggtgccctgcaggctaccttgccctggtaagagggcctgctgtgcgcgcaaccctacatctgccaatgcccatgcaagtctggctgccctcgtatgttgcttccccagaacaacatgcaaccccatgtccactcctcgccacctgcacaccgcagatggaggagccaacaccctctctggttcctccgagccccagggctgccaccccctttgaggtcaacctgcctgaggacctatacggctttgccaacgccgagaccacctcctcaacttcaccccactccctggagtctactgacagctacagcgcgccctcctatgctcccaccatcctcacgacaccctccgaggtggactccgatgctgacgaggcctggatgnnnnnnnnnnatcaacctgcctgaggacctgtacggctttgccaactccgagaccaactccccaacttcaccccactccctggagtctgctgacagctacagcgcgccctcctatgctcccaccgtcctcacaacgccctccgaagtggactccgatgctgacgaggcctggatgtctgggtttgccgctggcatcgccgacacgaccgcctatctgctgaagggctcctgcgcggagcgcgagcagaagctggtggcgcgtgtggcggagctgaacgcctgccagcaccagtaccagattgagctcatgcaagcgatggacatccaggcggaggtgcagcagtgggagaactacctgcaggacttgctggcccaggctgcgtgcctgttccctgatggtgaggagggggcactgcaggcggcgctccacatcttcaacagccacgaagccaaggtgagtgcgcggggttctctctgtgatgtgaccccgaccacgaccttcaatcccagggcatggcacctcccgcctcagcgcctcgcnnnnnnnnnncatgtgacctcgaccacgacctacaatcccatggcatggcacctcccgcctcagcgcctcgcaatgtctcgtccaccctcacccctgtcttccctcatattacggccataggaagcggagctgcgcaatgccagcatctaccacttcgaggaggtggctnnnnnnnnnntccataggaggtggagctgcgcaacgccagcatctaccacttcgaggaggtggctgcctgacgagcgatactgaactcacattgccatgaagcatgctccattgtacatctcccgcagcaatgcgggtgcagcatgtttcttttgtatagtattggattgaattgcattttagttgtgacagcagcgacgatgagagggttcagtcacccgaactaccacccgggatgtccgttcgggcacggcagggtgcgtgcccgaccggggtgcctgtgggccgctacaatgcttccattcattgtaagatgcctctaccacatctcaaactttgtgttgagaggtcaaatacattctggctcccctgggtccggcttgagcatgttggagcttcgagtctccccatgcggccgcctcggtgttgtgggggcgggttagaccccacaacgtggactgctgtatatgnnnnnnnnnngcaatgcttccattcattgtaagaggcctcaaacacatctcgaactttgtgttgagaggtcaaatgcatcctgcctcccctgggtccggcttgagcatgttggagcttcgagtctccctatgccgccgccctcggtgttgtgggggcggtttagaccctacaacgtggactgatgtatatgaccttaagtaggaatgttacagaacaagaccccgaatacggtgaggggcttgggtttcaagaacggtgccatgcggcatagacacgtcgcagggcacggatgcagatggaaagggtggaagactccggagagggggcccccacaacactcggtcatgattgagaacatcatgacggaactttgaacttcgttacagcctagcgttgagaagcattacataactggttaaagtgatgataaggagtattgtgatcggcccctgggtgccgggttgtgacgagctccacgagatgtcggctacaatgccgtccaacggaccgatattggatctcgcacagctttggcgccgccgccgccaaagctgtgctctgctttgacgatgtgcgtgttcacgaagctgtccatcgacnnnnnnnnnntgaatacggtgaggggcttgggttttaggcgtggtgccaggcggcataggcgcggcgcagggcccagatgcatgtggtaagggtggaagactccggaggaggggcccccacagcactcggtcatgattgagaacatcacgccggaactttggacttcgttacagcctagcattgagaagcattacgcaactggtcgaagtgatggtaaggagtattgtggtcggcccctgggtgccgggttgtgacacgagatgttggctaccattccgtccgacggactgtcattggatctcgcacagctttggcggcggctccgcgaaaggtgtgctctgctttgacaatgtgcgtgttcacgaagctgtccatcgaccacggcatcacaagcccaagtaaaactacgtgcacgatttgtcgggagatgcctgcaggctgacgtgctttgcagcagcaagactggcaagagcacagggagcatgtgcaggtctctggcttgcaatcccgcgtgatgtagtagggagcagtcaagaacttgccacagagctcggtctggggagtgaccagagatgtcctactggaacgctgcctgggcctcacaagtcctcaccatcgggggctgtgcatgcnnnnnnnnnntcacagagctcggtatgtggagtgaccagagatgtccgactggaacgctgcctgggccctctcaagtcctcaccatcgggggctgtgcatgctgcaagcctaccagtgcatagcctcagcccagtgtcgttggtgcgtcctctccgggctttcctaccctttcatccgtgcccagcgccgcgcctaggccgtctggcgcagcgcccgaaagccaagctcctcaccgtattttgggatctttgtctgtaacattcccagttcgggtcacatacagcagtccaccttcgtggggtctgacaagccccaaaacagccagggcccacccgaccccnnnnnnnnnngacagcggtccaccttcgtggggtccgaccagcccccaaaacagccagggcccacccgacccctttgcagtatggccctacgtcagcatggctcgcttgagcaccagaccgaggcacaacatggtgcagaagaggatgtgccagcgggtcgccaggagcttcaggggccgtagcgcctctgggtctgatggtatgagaggaaagcatggagtgaggcgggacggtgtgccagtgagtcgtggattacgcaggaagggcggctgcggcgattcggcggcatacaatgatgtcagtccgagacaagtgcctagggtcccacccctgaacaccctnnnnnnnnnncggtggattacgcagaaagggcggctgcggcgagtcggcggcatacaatgataccagtccgagacgagtgcctagggtcccacccctgaacaccctcccccacccctctcacttccctcctgccccaagtaccgtgcgcattcttctctgccagggacaccatggcattggcggagccgtaggccaccatggccgaggtccagcatgtgagcggcaggtagcccagcagactggtggccaggagcccgacgtgcaccagtcccaccgtcaccttgagcacctgcatgcatccagagaatggtgaaggggggaaagggggaagagggtgttcgcccagtgtgagatactcaagtgcgcggnnnnnnnnnngtgcatccagagagtggtgaagggggggtaagggggaagagggtgctcgcccagtgtgagatactcaagtgcgcggggcgcgtctggcggctgcattcgtgaaagtttggaatgtgtgcgggggtggaagggaagctcagagtgtggcatggcgacgcagccattcggacccctcnnnnnnnnnnacgtgaaagttttgaatgtatgcgggggtggaagggaagctcagagtacggcatggcgacgcagccattcggacccctcccccccttgctgccgtctgctccccaggcacctgcgcgccggtctcggtgccgaggcgtacaatgggggagcgcttgcccgccgccagatcgcccttgacttggtggaagtgggagcagaagaggatggcgctggtggagacacccaccaggaccgataggatgcaggactgggtgctgagggctggggccccctgcagacgcgtggtgaaggggaggggggaggtgattgggttggtggctcgacaggggccctgctgcgagcagggagcgatggctggctggcaggcacccggctgatgactgcagcgctccatgggatgcctgccgccacgccccatccccacttggcggcggcaaggtctgacctgtgcaagataaaatgcgttgacagccagcggcccgaatgccacaaagcagagggcctcgccaagaccttgatacgagaggcggaagggcgggccctggtacaggtagccgcagcatatcgcggcatatagcatcttgctggcaatggcaggggactgtgggttggcaggaatggcagggggggaaaagtggggttggagcgtccataaaacaaagagttgcctgaaacaccccgtaggcgcggcggccacgtgatctcaagaggccgccctcggggtctcccactctgtgcaccccagagacttctggctgcgccttgctggccactacaccccctccgtgcattcagcgaggagcacctcacctgagacaggagccagaagagcaggcctgcgccggccaggagggaggcgtgcgcagtcacgaagatggtcctgggggagcgggtgatgttgacccaggactcgtacttgtgggtgtccaccccggtgagggagtcaaagtagtcgttggacagattgagccaggcgatgataaggatggaagagaggcagaggcccagggtgcgcagcatgtcagcctgccccgtcgttgcaaacacggcagctgcgctgacctgtcgatggtggggttgggggttggatggacgggagggagggcgtggtgagttgtgcgaggtagtgcagtgcacatgtgatgaagcaccaatccttgtgtgtgggggggaaagagatcggagaccctccccatgatcagccctggcgctcaccaggatcggcatgatgcccacagaatacatgggcgccttgatggctgctctgaggagcgatgcgcggtccttgtagggactgcccccgtcctcaggtgggagggagggtgcagcatggtgaatgcccttcgcgctgtccacgaacacaggctgtatcaccgcatcggggctgacttgcggatgctcgtgtgggaaggacgtcgagctgcagcgctggcgaccagtgcgggcacatcgtgagggctgtgctgcccagggcgaacaccgtggcctagatagagcgatgagctggcacggtcgtgatgatgtgcttgcggcgcatcgaaagctgaaccccccttgcaatgattgtcgactaggcattgctacacgcagctctattgtgctggctggccttgcggtttcacgccaggctggcggagtgcggccagcacaacgccaatgccaactggaagatggaaatctcaggaagtcattctcattctgtgcaggagatgtttattgacttcacatacgatcccgtgagcttcctggggacaccatatccctccatcgatctcggacaaatttccgacgcgagcgctagaatgggggggatgtgccgtcgagcgagatcgtgcatgagatcacaacccaaggacattcttgcagcctgctctggtggtatggacaaagctatgctgacacagcaggcaacgggtttaagccagcacatacaccgtttcctggcccgggaggacacggaggctggccagcttcagtttcagcagggcattcatgaacactttggccttcaccccgactcccagctcttccagggcccgggctccaaactctgggcaggaggggcagaacgggcaggttgatggtaaggaccatgggctcagtgcggcatgcgtgcgtgttcaagatcaagaggtcgacaacatgcaggtgggcgggcagaagcccatcgtggcatgtgcacattgaatacaagccccagatcagcagtgtccagcccaagggatacttcatcctcgccatgatcaatgttccactcaccgacagaaccagtagccgccagggttgcttggagcgaggtcagggtgttgttcaggacctggagggacagctggccccggatgaatgcaggaagagtggcataggtctgctttttgtggggtggagagggtgagttaagagccggaagctggtgtttggtgaccaatgatgcagtgtgtcacatgctgtgcaggtgtcaggccacgcgcccctcatccagagtcggcggtggtgagcatgcggcctcatgcagttgtgagcgctcctcaaagtcgacacacccgacgcccaccgtttctgccacgcagccgatcctccgactgtgaggcggtgagggggctcccaggggggggctggccgccgcagagcgggctcccatggtctccgagccggccacctgcgccccgtgctgtgttgaagcaggggatctgccgctggggtccagggctgtgcttgacctcgacggcgcgtcctgcaggagacacaggttcagagatggtactggaaaaggaaggaggcacctggcacacagagcgcatgctgaagggccatggccggcgcggtgaggagagcgcgtgcagccggatggatggccgtgcctcgcacccctgcgacccagatcgccctgcaggctgtgcggcctgggcgcatcattgccggcagtgacgggatccacacaccccagcatgtccttgaggggcataatcccgcacccctcccctccaacccgaccgctccacccttcagcctcccaccacggccatcacctggcgannnnnnnnnnaagcgacgggatccccacaccccagcatgtccttgagaggcacgttcccgcacccctgccctccaacccgaccgctccaccctgcagcctcccaccacggccatcacctggcgagcatcctcgactcctgaggagatgccgcccagctcggcggcctgggccaggggctgctcaggaaagagcggaaactcgcctgcctccacggcgtaccggctcggccgctctttcttctcggccgtggccatgtatcgctccgcggacgcgatgatggcggggtaccgcgacctgtactgctccatgaaggagggggtggggccgggcgtgggtgcgccctccccctgtcctgccagaccccgggagaggtcgaggggggtggtgcttccgggctggccgcgcgaggccggcggtgggggtggcgagggcgccacggcgtgctcagccacgggatgcgaggcatgcgttgcggcatgctgggctcctagtggcgaggcattggccggcgcgctggcgggcagaggttctggggtgagggcccactgactgccggcggggaaggagagcctgccagagctggcaacagacatgctggtgtactttccaagcagctccctgtgcatcatggggaggaagggaaaggtgtggttggggcattgaggacgatcagggggacgtgggaggcagtcgccgatcatcagtcggtgagccccctggggtcatgcgtccccgcatcaagggctgaggtggacagtggcggggaagtggcgtcggcccctgtatcactgccagcagctgctcggattcccatttttcatacagcagcccacctcatgnnnnnnnnnngccctgtatcactgcttgcagctgcttggatccccatttttcatacagcagcccacctcatgctggggctgaaatcctccgcggaggccaggctggagggggtgtcctgtcgagccctggccatgcgcatggtcgtcagctggggaccctgaaggaccacactcccctgagccaggactgtgagggggtgggtatggccgtcgaggggtgctgttggtgcagtgccagccggagtgccttgcaccctgggcagcagtgagatctgatcagccacaggctatccaaacaggccctagatgacctcaggtaatcggccgccccaaccatctcaccactccctgcgggcaannnnnnnnnngaaattggccctagatgacctcaggcaatcggtcgtcccaaccatctcaccactccctgcgggcaaccaggaactcatcagcggtggcgtgccggcaaaggaggacataggactggaccccgggaagagtccaatgggcgaggctgactgtgggacccggagctgtacatcctcctgtttcacccttgcctccggctccatcaattcaagggggtccaggggcggctctggcacgtatggctcccggtagccatagtcggatagcagggactccaggtctttaatctgctggcatgctgcctggtaggtgctcacgccgtcagacacagcatcctgtcaagtcaacgaggtgacaggctgtgttggaagagctattgcgatgcaggggatgctcggacggatggcattgcctgctctgggctagagcagcacagcagccgtccccggaccgccccgtgctgggctgcgtgcgatcccgtaccccagaaccccgagcccacctggagggagcccgacctcagggactccagtccctgaacttcgatcgctgcagaatccagggattcttcgatggcacgcagtgcatgcctgtatgctgtcgctccgaccacaggtcgttgctccacatcccggcgcagggccccgagttccgcagaggcccctgcagaaaaagcccccaggtgcgcatgcagggcctggatgctggcctggactgccgtcatctcgtatctgatatcgtcgaatttaaagggtcggtatcaggaaattggtctgcttgcgaagcgatttgagtcgtgcctggcgcgccctgcacnnnnnnnnnnttctgtatcaggaaattggcctggttgcgaagtgatttgagtcgtgcctggcgcgccctgcacttgaacgcacaagttgagccatgcttggaaagcacggcgctgatttgtaccggtcgaagggttccccactgggcaggcacaccagagaatactgaccaagagaacgccagcttggtatgcatcagaattacagcagtgtgcaggggcctctggggacgggaaggtacacggcgctcctcgagaagtgtcgcttggcatgaatatgctgttggcctaggaaagaatacactccagtgccaaacagagtctccaattgacacgaggagaaagcaaggggtttaaaattgccactcaaaaggggggcgtacaggatgaggagccaggtggcgattggagggctttcctccctggcgcgcgccacccgcactcatgcgcatggagctcagaatctgaggcaggtcactgtggtcctagcctcttcctgaagaggaggtgcagcttcatgctggggttgtacaccccttctttggacatgccgaggaagagctcgtccatgagggggtgcaggatcggcctgaccccccgaggggccaccaggttctcctgcagtccaaagaatacagagtgccccgagcggtgggtgtgactggagggtgtcagcaagcgttgtgaggcacagcacaattctgnnnnnnnnnnggtccaaagaatacagagtgcccggagtggtgggtgtgactggagggtgtctgcaagcgttgtgaggcacagcacaattctgtaaagcgctcctcccagaccccctggcatgaatgggcggaaattcccggcacacttcccacccccaacccaccgccccgccagcacgacccacctcggcgacgtaggtggtcaccccccccggccgatcccgctcatccacgaggacatggtagaagggctggaacctgccctgcgacagcgcgtccacccgcatggccgccatccaggcaggggaggcgaggcaggtggggtccatgcccgccaccacgccgcggtacccatagcgacggtgcgtgaccaccgcgccgacgccgtgcgcgtaagcgccccagcgcagcgtgcggcgcatggcgccctccgccgcctcgcgcgccgccgcgctctccagccgcgcctgcttcagcaggagcagggtggcggaggcggcggcgtactcctccgcatccaactccagcttcagggcggcctccaggtctgccacccgtgtgttagactgtggagtgggcagtggcgtgggaaagcaggcatgggaggcaggggatgtatgagagatcatcactcggtcgttcctggaaggtctgtgcgtgaagtgcaagggcggggcccaccatggaccgagagtccgaannnnnnnnnnattagactgtggggtgggcagtggcgtggggaagcaggcatgggagacaggagatgtatgagagatcatcactcggtcattcctggagagtctgtgcgtgaagtgcaagtgcggggcccaccatggaccgagagtccgaagttgacacactcgcggtcccgggccgatgtggagcatggcaaagggccacctcattccggtgactgtgaaggcacgccatctacctggaggaaggcgcccagctgggcttccatgagggtctcctcggcccagacctccacctcccctgcatccgcactggcagcctttgagacaccgcccggcctggcacagcctcgctggcccatcacatgtggcttgaagggctcacatggaggtggacggatcgcccgcgtcctgtgatgggcccctccgagagggaagtgatcttggaggtgatgcctgcccagagtctgggcgtgcccgcagcacggagtccctgcaggtgccatgggatgcagtgtatgaatctagccgtgtgtcggtcaccgagctcgactcgaagggcacggagatgcgtgctgcatgctccgatgccctgtctccgtctcgtgtgatctcggatatcgaagtcggggcagtcagtcaagcaggtgcccggcaggacgacaatacatgcgattcatcatgcactggtcaagccttgcttcttcccaaaacaatggtgtgactgaaaacgttgttgcacacaggcagccatcctcatgccgcaggctttggccaccccacttccgagctgccgccccttgccaacccgccacactttccgtccgtccctgacccgtttgcggcagcctgtcataccacgaggaggattatttcatcacaagagtgctcaagctctccaggcactcccttttctgagcacggtgacgcttgtgctcggcggaagcccggtaggtctggcccccctggtgtgctggagagggaagggatcaggggtctgtgtcaccacactccccgggactccttccccccccctgcccccacagttccctgcagccaaggagaccatggagcaggtgagcgagctgtatcagaacgagcgcttcttcggcatcatctggaagggccccgtggcggccctggaccgcgcagagtggacggacggcacgggggagggcatcgctgtcaccaagccccccaccgagcaaccccaggcctgggaggtggttgtcacgcccggcacagacccggagggctggcagtacggcacggtgttcaagtgaggccagcgcggaggtggcactggctcggtgtagcacatccccgctgctctcgtgcagggcaccaggcttctggagcgccctctggcgcagccgcaggccatgactctccctacctccccggcccctgcatgacaggcacctggagtacaagcggccgggggggcgatccaccccccgcttcggcgacgtggtgcggcggcggctgtggcggcggaggcccgaggccgccgacgcggccgacgcggcctccctgggcagcagcagcggttccggcgaaagcgtggacggcacgagccagggtccaggcgccgcgcccatccctttgcgctcggattcgcggcgcaggcgagacgcacctgggtcaagaaggggaggggaggccagagggatttgggggtgtgcgatggcgttctagcggcctgcaccgaatccgtagcgctgtgaccaatgtcatcccctactacctcatgttgcctcgcaccttgggcgcctctcattcgccaggcacccccagctacggcactgccatccccaaacccccnnnnnnnnnnaggattttggggtgtgcgatggcgttctaggggcctgcaccgaatccgtagctctgtgaccaatgtcatcccctactcactcatgttgcctagcaccctgggcgcctctcattcgccaggcaccctcagctacggcactgccatccccaaacccccactccccagcgccccagctcgcgtcatccccttcaaacaccctccacagggctcaggaggatgcggcccagcgccgggcgatcaaggggttcctgaagatggtctacgatctgctggagcgccggcggtggtggtctctcgcgccctgggatccctccgcactctaccaggtataccaaaagcaccagcaggtctacgccacgctccaggtaaatgggtgagtgaggccgctgatccgccacatgtctttcgtatgtgtggacttaaagccctgtttgggccccccccccccnnnnnnnnnnnnnnnnnnnnnnnnnnnnnnnnnnnnnnnnnnnnnnnnnnnnnnnncaccctccgcctctaatccctctgccgcacctacccaggtgcaagcctacgagcggcggctgttcacggccgaggacgaggcgccgctgtccgcgctacaatcggagggcggcagaacgctgctgcaggacctgctgtgcgcgggcatgcactcccgggccgcctacggctacgccatggcggcggggcacatcagcaccgtcacggggtacatcaagctgaagaccctggcgcccttcacgtgagtcgagggggcggctgggggagatgcagatggagaggtttcgttgtacgagtggggagcatgggcagcaggcatgtatttgctcgaatgtccctggctcccatcgagccccaggaccgctgctgtgtgcgctccgcctctcgctccatgcctggcctgccagccatgccctcacctcagcagtgctgcacaaccctggccatcccactcccactccattcaccccccccctgcatcccatcccttccaccacctcccctccaggtttgatgcggtgggcggggtgtctgtggaggccaacaacgacagcgtggcggagctgacggggatcgacccgggcgacatcctcctggcggagtggagcaactccacctaccgcccatgccactatgtggccgtggaccgcgccaaccgctgcctcgtgctgagcatccggtgcgggtgtggggttggtggtgggtggggcttgagtggaggtctgaagcatcaagtgcatgcgaaggtggcacaccttgcatccatgcacggcaggggcttgcaaatgtcgaggaggtgtccatgtgcgcagcaggtgtccatcatccactctcctcttgtacagagggtccttggaggtgggggacctgctctcggacatggccgcgcatcccatggaggccagcctgggcggccgcagcggctgggtgcacgaagtgggtctgtgtagtgggaaaggtttccttctgtagggcgggtgctgggctgtgcggagtggaggggcgggtgagaccgggccctggcagcgcgatttcagggctgatgacatcaggtgtgggacatnnnnnnnnnnggggaccgggccctggcagcgcgatgtcagggctgatgacatcaggtgtgggacatggtcgcaggagcatgcttcatcagcagtccttgcatggggggccgcacatgcagtctgtctgagggtcggcaggcgcagttcggccatccctcggcccgaggatctggccacttgagtgnnnnnnnnnncgggccgcagatgcagtctgtttgagggccggcaggcgcagctcggccacgcctcggcccgaggatctggccacttgagtgcagtgcaggcccatcagaccagattttcatgccagacactccaccctcccatgcacagggcatcttttcggcggccacctacatccactgcacgacgggggagaccctggagagggcggccgagcagttcccgggctggcccctgctcatcacggggcactccctgggaggtgggctggcggggggggtgaccgctgggcatgggagtgcttgagcttgcggatgggaggatgctgacatcatacggcagatggcgtgtgtttttaaacctactctgttaacccccccccgcgcgagaacatcatggacacacagacccatctgccgacagggcgcatctcatcccaacagcaaaaatcccaaccacagtcccatctccacacgcacacagggggggtggcggccctgctcacactgctcatccacgaggcgggcgtgccgcgcggtatgggcgccgtgggctgcgtgaccatcggcaccgcgnnnnnnnnnntgtggcggccctgctcacactgctcatccatgaggcgggcgtgccgcgtggtatgggtgccgtgggctgcgtgaccatcggcaccgcggccgtgatgtcgcgcccgctggcagacgcctgccggccccacgtgacctccgtcatcctggcggccgacatcatcccccacctcagctacgcgtccgtggagaccctgctcctggagctgaaccagtccagcctgctgccccgcgcggccaagggcctgggcaagaagctgagctctgtgctggtgcgagggtggtgccctttcttgtattgtttatggtgtgtgtggtgtggtgtgtggggggggggnnnnnnnnnncgggtggtgccctttcttttattatttatgatgtgtgtggtgtggtgtgtgtgggggggagggggaagaggggcgatggtgtcccaaggacagcacgcaagcaaccaaatgactgggtgtgcgctgctctgagctgttgcaagggtggattcaggtcagttgactttgattacagccatgggcccggctgcgactgccgctgcaactcaccacaacagtgtcaccaggctgggtcccctgcatgaccctctatatctacactcgtagggattgggcaaggactctggcgacacaaaggtcagcgaggcggtggccaagcgccgctcggaggggaaaacccaggcgcagggggagtggaagagcgtgcggcgggcggcggggtcgtcgccgcgccggcctgccgatgaacgtgggtggggccctgctttactttttgggaggggggtgagggttgagtggaggtaactgagaaggagaggctggtagttgagggagtccagagtggtctggtccttgtctggggttgcagtctcgcggcctgcattcgcaggtcacctggttcttgtctgggcctcatgcaagaaaacatgagagagttcgattgcatctcccatcaaactgcgcagtgaggattttgctaaaggacgaggaggcgctggctgccgcggccgaggccacctcccacacgctggagcaaacagcgagggagggaggggcgagccaggcgcagggatctggggcggacacggccgtgtcccctcgaccctcgccgcgactcattccggtgatcgagatgtccgaccccgacgctccacctcaagccggcggggaagggtcacaggtcgaggacagcgacgctgcagaccaggagccctcgtccgccaccgacctcctgccctacctgggagggatggaggacgggggcggcgcgaccagcgccatcgcctctgcaggggtgcgcgacaaggagatgggcacctcccctcggagcgtctcgcagcccgcacacctttacccccccggtgagcctgctgtgtcgggcgtgctctggattggttcgaggggtctgtggcatgggtcagatggagggtgttggcaggtgtcttctgaggaactccccaaacatcagcatgcatacccactcatcgtgcgcgtgcgagagtaccgtgatcccagcctcgcccgtgtgagacaccccgcccgtcatcgctgtgcaggtcgcatcatctggatcttccccgcagacgaggacaagagctcgctggatggcagcactgccggggaggagcaggggccccctgctcatgccggtgagcaggacaccggaggtgaagctccaaggaaggagcctgaagccccggaaccatcacccagcaatggtgacggggctgcgcaggtctccatggaggaggcagtggaggaggtggaggccaagggccagggcccctcctccaaggaggtcgccgctgccgcaagggagagcggggaccctcgtgcctcgcggggcaaggcggtgcccgtggccgtggaagccaaggcgacgagctttgagcgcctcctcctcctgcccgactgcttcaacgaccacctgcccgatcgctacatcgaggtcctccagcagctctgattggcagactcgtgcacagactcaagtgtccacccctccatgtacccgaggggggggggggagaatggggcttgcgcagtgctgtgagccccttgcatgcctggctcctggcgccttcaggggtcctcccatgccccacctccatcagcgtcatgctttccnnnnnnnnnncggcagactcgtgcacagactcgagtgtccacccctccatgtacacgagggggtgggggaagaatggggcttgcacagtgctgtgagccccttgcatgcctggctnnnnnnnnnngatctcgcatttttgcagcgtttactgtcagatagtccccccagatcgtcaccccctgcgccctagccaatnnnnnnnnnnaatctcgcatttttgcagcgttcaccgtcagatagtcccctcagatcgtcaccccctgcgccctagccaatgtttgccgtgcatccttcaaatttgcatgtatagaggggtgaaagccattcggttcacgagtcaaacagggcggaacggnnnnnnnnnngtgcatggaggggtgagagccagtcggttcacgagtcaaacagggcggaacgggtcaaacatgcttcagagcccggcctgcctgtcctccagtcccaggcgcacacatccccgacaaaccgactgcccgatgccgtccccgctcgtcgacgcagcgctgcagccagcgccgtcctttcctgcccggcgggcgcggtgtccagggtcctggctacccggtgcaagagcatggggtacaccatggccatgctgtgcatgctgcgttccaggtgcccggcgttcagcagcgacaggcactgggccaggctggggcaggggttgggggcgtgggggttgagccccagcaccagggtccggccgcccgggcaggcatccaggggcgggagcaggtggagggcccccgcctgcgcaagcacgtccaccacctcggtctgtgatggaggaggtgggggagtgagggtcgggcatgcaccgtgacccgacagattcctgcatggccattctgatgacatggaggagcagcacagtgtcacacaacacatcccaccagggccgacatgccaccccacctcaccacccagagcccaggcttgcctggaccggcgccgggacatgtgcctggaggagcaggttgatggcggcgccaaacagtgtgtcgccgtagctttctgcggcatatgcggcggcaagtgcctgggcctggggcatcgtccatggcatggaccttgacgcctctacgtcctctgacaacgcagccagcaggccagccagagccctgcgtacggcaggctgcctccaggcaggctcagaccgttcagagtcggcgcccggtgagggcgttccaggctccaagaagacggcaggaatggcagcctggacagctgcagcaagggctggctgcaccagggatgcctgcatcgaattcctgnnnnnnnnnncatgagggcgctccaggctccaagaagacagcaggaatggcagcctggacagctgcagcgagggctggttgcaccagggatgcctgcatcgaattcctgccctccagcaaggccaggcccagggcgagggggatagagaggtcaagcgggggggcgacttctggtgacgctgggaccctggcgagccagccttgggggaggggtagtctcgaccctttgaggagaggatgggcatgaggaagggagagggagtgtgattcacggtgatgctcatcgaaacaccagccagctcaggcagcacgacgccctggagcatggatcggcaccgtacgctcagcaaacagcagtaccctcgtcacagcctctcaacccccccacctcccaccgcgccaccttggggctgcagcgccggctgaatgaggcagcggtcgggcatggggcctggaccgtcctccagtgctccctcctctgggcccctttccggctccagacccagccacgccgccgccaggccgtgcaggaggctcgcttggtcgggggaggcaaaaccccgtgctgcctcgctctctgtttccatctccagcccctccagacgtgccgccgcggggctccgcatggcgctccccgccacgcagagcacggcgcgggtcgctgcagggtcgcannnnnnnnnngttggtcggaggaggcaacacccagtgctgcctcgctctctgtttccacttccagctcctccagacgtgccgccgcggggctacgcatggcgctccccgccacgctgagcacggcgcgggtcgctgcagggtcgcacagcgcgctcaggagggcaagggcggtggggtcgtcaccggggacgacgcagcgcagccccgcgtcggcgaccctcgccgcgtcggcgggcgcgcaagctccagccgacagcaggcagggcaggagggcagcgagcagcctggtcaggtgcatgcctgggaccagctgcactgcatcctctggctggagaagcagggggtggacggccaggggcccgccgcccagcagccgcccgatggtagagagtagggctggcctggccatcgccgcacggcgcaggcnnnnnnnnnncgcactgcatcctctggctggaggagcagggggtgggcggccagggaccccccgcccagcagccgcccgatggtggagagcaggcctggcctggccatcgccgcacggcgcaggcgggccgtgccggcctcacccccggcccgcagcgtctgaattgcggccaggcctgccgagcacagggctgctgattggctgggcggggccgggtcttgtgaggtcagcttccctgtcgcgctcggctgctcctgacgctgatccacgctctcttcttcctccagcgccgcaaacacatgctcaagcatggccgccgccagggccgtgatggaggggggagcctgcgtcgatgcaccagcagccggcctgctgatcggtgtagcgctctctgcgctgccctgcgcatctgctgccacggtggcgcgcagcagcaccagggccgccgtcacggcggagagcatggcgcctatccggccatcctgcgcatccccgcctgcttgctggacggcctgcatagtggccgtcgcctcgctctccagccaggtggcagtcgctcgctgcagagacaggaggcaggcactggacgccatcgcgatcccagatccactgtggaagggatggggttctgaatgggcatgtgccggtcgctttgggagtgctgcgcacaggctctcagactgcagtatggcccgatgcacctcaaactgtacagtacctattttctcaagtcaccacaccaaagcacacaacctcactcaccttgccagggcgttctggcgagcagagtccactgccgcccagagcgcctccgcggtcgcctgccaaagccatgcgctcgcatcagcctgggcaaagaaggcatggcacagccaggggtaggcgtcgtccagagtcagagcgacctcgcagcctgaggctgctgcggcccgccagctgcgcagcgcccagacccactccttctgagcctgtgtggctcaggatgtgtggggctggcagataggggcttgaatccagtgacacaggtctcctgatacagagcgaggcaatgcaaacatgaaactcgtccacacgtcgccattctgtgcatcaggtgccagacatccacaccgacctgtccctgcagctctcggtggtctcgcagcagggccctctgcagggcctgggtgaagccagcattccagatgggcaccagggccttgggggcagtggagcccagcgtgcacagcatgcgcagggccatgcatcgcacactttcttcctcaacccctcctgcagcagggccggccagcagggtcctcatcgccgcaacgagggcggcattggccaccaggagggagcatgcgtctggacccatgcggcaaatgctgtgcggggaataagaggagcgtggggatgcttttggattctgcaaggtggggtaacacttcgagtgggattgggtcacatgagtaggcaggcagtctcactcccatcctgaaatcatcagacctgcccccacccacacccgcaaccgtgtcccaggacattgactcatccttgctccctaaatcaaaatcctcaccgcacgagcagggcaagcagggacgttgttgctcccgagaacgtggccgcctcgcggaggaggtacgccaccctatccagcaggcccatccccagcagggccgacagggggtcggcctggcccagcagctcccagtctgtgggctcctcctcgtgctcgccatccatggtctctggggtgcctgtcttggggtcgtcagcgaggggcgccgtcacccatgcagctcccagggaggggcgctgggcgtggcgaatgcccaggctcgggcagcctgacagcgggtacgcgtcgctggcctccagcaccgcatgctctgaggaggggaggagtctgggaaacttcggcgattgtcctgctcagcacgcagggcaggctctgaacacagtggatactttgccagctcctccacgctgcttgattctgccgcccattgaagccagaacaagcacgcttgcaactggctcaccacccaacacaccacacaggacctcttcccacgcacctgggggcgacagatccacgagggccagcaccgccccggcggcggcagccaccacggctggcaccgtctcgtccagggcccggcgcaggacggtggtggccctggcgccgctcagcagctcccggcccagctgtgtctgactgggcggctccaggccttcggcagccagcagcgccgccgcgtcccgcgtcagttggggaccctgccgagcccccccctgccgccctctgctcgcgcccgccagcacgttgcgcagcgtgnnnnnnnnnntcctgccgagcccccccccgcggccctctcctcgcgcccgccagcacgttgcgcagcgtgcgcagcgcggccacgcgctggggcatgctgctgctgcggcacagcctgcacgcctcgcgcagtgtcaggccgtgggcgtcggggtccggcgggccgcgcatcgccggcccgtcctcctccggccagacatcggcggccgcgggggcgaggccaacggccactccgctcacgtcgaaaaggaggcgcgcggcgggcggcaggctctcctcggccgccggatcgtgggagtctggcccgattgctgggaaggcggagggctttgggccggcctgggccgcattcccgggggccaccgatggtctggccaggctctcctggagctgcggtgcaaacctgacggccttgccgcnnnnnnnnnnggccggaccgcgcatcggcggccccttttcctccaacccgacatcgggggccgcgggggcgaggccaacggccactccnnnnnnnnnnnnnnnnnnnnnnnnnnnnnnnnnnnnnnnnnnnnacgccgcgcttgcctcctcaatgctgcccggctccagggcggcttcagggccnnnnnnnnnngggcggagggctttgggccggcttgggccgcaatcccgggggccaccgctggtctggctaggctctcctggggctgcggtgcaaacctgacggccttgccgccagccgccgtgggtctggatttatcgtcgtgcacagggcctgccatccctgcttccacactcctcttcccctcggcagcagcgggaccctgcatctgtcgacgcgcgcccctggccttcaggaatgccagcgtctcgggcttcaacctggactccagatcctgccgcgcctcctcccgctccgccaggctcatccctgacagcagcgccgcgctcgcctcctcgacgctgcccggctccagggcggcttcagggcccttgatggccggcgaggaagcccccgcaccagtcggtcctgggtcccgtcgagccctggaaaagcgtgaggccccggggcctctgtgggctgcagcaggaaaggctggagcactgacagtgctcgagcacgtggggggcggggtggggcctgccacctcccgctccacgacagaacccaccagggaattcatgcccagcatgcgcnnnnnnnnnngaaggctggagcactggcggtgctcgagcacgtggggggtggggtggggcccgccacctcccgctccacgacagaccccaccagggaattcatgcccagcatgcgctctgcatggggaggcagtgaatctggctgggaggttgacgatggggagagaccacaagcacaggcgtctgaagactccatcgactgagaatgagcccatccaattgccctgagacccatgtgcaccctctctggatgctccaccatcgcagcctctgcccgccaaaccagagcaaggaaaggggcgggctgcaccttggattccccggtccttcaatggaacagcaggaggagttttgacttcaggcgctgcttcggcggacttacggaccacgcgagtgactttggctgccagccgttcccgaggcagcgtcttcatgtcctcctgtgcgggagtgacgctcgacatgactagggaggtggtgccattctcaaaacttcgttcacggcaatgaaacaaatggtgttccattaaaattatcccatatacaatacctgcatctgcaagagctcctcctcatcccacattgcacgctgcgaagctggacttgcccctgccatgccaaacactggcagaagccagtgccactggacaaatctccacgtattttcaacaatggcgatatcgtacgaatatgattcagtctccttcaatacgatgtagatgtgcaagatccactggcagcgtttgatctcgaaacgcgacttggaggcgcccggagcgtggctcagcacatggcgccttgatgcgagtcccactgatcgagcatgatctgcccgacgctgggccaatctggacagaaccgctttgtgtactcaagcatccactcatccagcgaggtgcgcggggtgcgcaagggtttccacaccttggtcgcccggcacccgggcgtgtcctcgtgcgcgcgcggtgatcaggactgaatcctccacatgcatgcgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagggggtgatgcggcacctcctgccgctccccagcagggcagaggtcgcggtgccctgcaatccatcatacgagccgtcatgatgtggtgtgtgaaagtttattgctgcttgtctgggggtctgctgcaaggcttaaatcccaagcggctgctggccgtccatggacatgcatgcaggaccaaaatccctgggcatcccctggtcgcctgcgatgcccgtgctcaccagtcccccctgcgtcctgacccaggtacctcatgaagaccttcttcggcggccagaagagcacccccatcccctccgccacgcctggctccacagatctacctgccctgccagcagaaacactcccccgcctggcacgcagcacccctgtggatgtgcacgtctacatctcggaggcaaatgactggcaggccagtgccaagcaggggccccccctctggtccgccaccgagttcgagctgggcacgggctctacgcaagccaccgccctggtgtacgccccctcccatgccgtgcagaacaacgggagcgtcttcttccacgctgtgttcactcccagtggagcgtcgcctgaccctgccgacggcttccatgacgcagcgcttacgtttgccaagtcccagccgctcaacgtctacctgaagaagcccagggtgggtcgggcagaacgtccagggagggtgggatattgcatgaggatctggacatcatggggaaggctgcagatccgagtagatcatcctcaggccggggtgtgttgctttggtggnnnnnnnnnntattgggaaggttgcagatccgagtagatcgtcctcaggccggggtgtgttgctttggtggagaagtcaattgtgctcacacaaggaacctggcacctgcactatgtctgggcgcctttcgattgtcaagcaggccctgcttgaacgccagtgctnnnnnnnnnnttggcgcctgcaccatgtctgggcgcctttcggcgttcaagcaggccctgcttgaacgccagtgctgcgaaacggtgggcagtccccacataccctgcagccgccatgcctgaagacctgtcagcagcaccatctgtgtccaccaggtttcctgtctcataatcctccctccacaggccgggaccggaatcaacctgctgactggcaagaactcgacgggcaacgaggctgccccagaggacgtgcacaccggcaacgacacggtgatagtgtcgttcctgcgccccaacgtcaccatcgccgtcgtcgacgacttcaagaagtaccagctgcgtcagatccccccgcagtacaagggctttgtggacatggacgaggtgaccctcacctatgcaccctttgtctggtacaacaacttttggctgctgcgggactacctggtgagtttggggctgagggctgcagattctgcatccattggaatggtgaagtgggacaggttagaaggggggcagtgggcatgtggggtcgctgggaatgatggacagaccctggacatnnnnnnnnnnttgcatccattggaatggtgaactgggacaggttggaaggggggcagtgggcatgtgtgatgggtggggccgctgggaatgatggacagaccctggacatcggtgctcgagagcagacaaatgacccataaatacaaacatcccatgcgcagcatcactgcctcgatgatgtgtggaccacttctctctgccatccacatgcagattcccctgaatgagactgtgtctgaggtcaccctgcacatcagcgtggagaccatccacgcccttaagtttgcattcttcacccaggcaagtgaaggttggaggggttatctatgctggtagatcagccaagggaatactgcactgcggcagatgctgctgctggtttgtgcatgtcatcatgttacatctgccgcnnnnnnnnnnacacatacaaacaccccatgcaccgcatcactgcttcgatgatgtgtgttccactactctctgccatccacatgcagattcccctgnnnnnnnnnngctgcctacccttgtgtgctcagaaagtggatctgatctcctttgtgcgctccccgctctgacagatnnnnnnnnnnactgcctacccttgtgtgctcagaaaagtgaatctgaactcctttgtgcgctccccgctctgacagatggagcagtccttccagatgcaaaagtcgtggggatctatggcggacggagagactgacgaggtggggcaggattcgtgctgatgaagggattgcgggctgttgcagaagccttaggacttgtgcatggagacgcagtggcgggcggctgcgcattcatgcagtgtagctagcatgtgtgctgagcctccgtccccccctgcctannnnnnnnnntcaggattcgtgctgatgaagggaatgcgggctgttgcagaaggcttaggacttgtgcatggagatacagtggcgggctgctgcgcattcatgcagtgcagctggcacgtgtgctgagcctccgtccccccctgcctagccacgccatgccctgtatgcatattgcctctcatgcccctatgcgcaggtcaaacgcatcttcctggaaggcaacccattcttcctggcgctgaccatggcagtgtccctcctgcactcgcgtgagcggggggctgacccttttctaggctgatggcacgacatgatattccctgttgccaagagtgaatctgcatcttcttggggtccattggtcatcctggctagggagatagggttccaacatcctcctctggcctgcccacagtgttcgacatgctggccttcaagaacgacattggattctggaagaacaacaagtccatggtcggactgtcggtgagtggtattcatgctgcaacaggctgggaagtgatcttggtgttcttgtcaaggtagcagtcaaattgcactgtcccatggcctctgtgcactctggctttgagcaatgacctcctcacaccctagatcgctgctgatctgtccctccgcgtttcccccccacaggcgcgcaccatcatgatcaatgccggctgccagctgatcatcttcctgtaccttctggacaacgagacgtcgtacgtcatcctcttctcctccggcatggggaccgccatcgagctctggaaggtgattgatgtgtgttggccgcctggtttgcaggtgctgggcggcagccaggctgaggcgttgacctgcctggcagttggtgccctgcttgcacgcccctgccatgtgatttcaaaacaaaaatcatgaaacaacaatcgtctggagactgattgacgctgctgnnnnnnnnnntgttgacctgcctggcagtcggtgccatacttgcacgcccctgccatgtgatttcaacaccaacatcatcaaacagcaatcgtctggagactgattgacgctgctgaaccgcatgcacggatgagtctgacacctcccttcattcacccaacccaaccaagcacccccccatgtcatccaccccctgccaggtgaccaaggcgatggacatcagcgtcacgcgctcccctggcgccctcctcccccgcatcgccttcaaggaccggctgtcctacacccagtccaggacggacgagtacgacgcggaggccatgcggtacctttcctacgcgctgtaccccctgatcctggggtacgcggtctatgcgctggtctaccagacgcacaagtcctggtactcgtgggtgctcaactcgctggtgggcgcggtgtacacctttggcttcattctcatgtgcccgcagctgtacctgaactataagctcaagtccgtggcccacctgccctggtgagtcggaagggttggctttgtattggttgggtgggctggatgcgtgctttttctgggaaaccggggtagggtcatgggggcctctgggcctgcaggtgccagccgggatcagtcgtgcatcagagggatgacactacatcctggcgctgcgttgtcacatgtgatcatggtgggagcatcccagaggcagtgtgttcccttgtgcgacgggcctgaagctggtcgttaagtcactcagggtgcctcggggcatccgtgcgcatgaggctgctctcaagaatccagtgtggcgactaggtcattcctgaacttcaccaaacccctttctcaaccccatgccaggcgtcaaatgtcatacaaattcctgaacaccatcatcgatgacctctttgcctttgtgatcaagatgcccctcctgcaccggctatcaggtgctggtcgggcctgtgcagggagaggtttggtttgctggcatggcgcgatccctgccatgctggtcgggccttgtgcagttttcaaggctggacactgcgggctgcaagcaacttccgacacacctcaccccccatcctgcagtgttccgagacgatgtggtgttcctggtgtacctctaccagcgctggatctaccgggtggacaagaagcgtgcaaatgagttcgggtgggtgccccaagggtcaatacccttgtgacgtgcatgcctctcacccgtccctccaggaatgctccctactgcacgagaaagacgctgtccacggcatggaccttgttccctgcnnnnnnnnnngtgcctcccactcgtccctccaggaatgctccctacagcacgagaaagatgctgtccacggcatggaccttgttccctgcgtcgcatgacaacccaccatggctgccccaacccattgcgcagatacgtcgaggagggcgacccggccgtggatgcacaggtcgagggagtgggcgcagcgatcgccgggacaaacggtgtcggaacttcggaaacggatggcccgacccccgatcccgtcagcggcgagaacgttgnnnnnnnnnngagggtgtcggaacttcggaaaccgatggcccggcccccgatcccgtcagcggcgagaacgttgaaaccaagaaagatcaataaagccaatcaccatcattatttcttcatgttcggctgtgtaatgcaccagtgctcccatcggcatcgtcgaggggccacgaatatgctctttccgggtcacgctgcgaagaatgatgccccacccccagagtatcaaaagtctggtcatcatgcatatgaatggagcactgtgggctttgaagagttgtcgtgccggtctacgccatcaggaacgccattttcaggcactctcaaccccgactgggttttccgtcataggacccgcacagcaacggcagcgcaccgtcggacccctctgcgtcctctggtgccacgnnnnnnnnnngccccgactgggttttccgtcgtgggacccgcacagcaacggcagcgcaccatcggacccctctgcgtcctctggtgccacgctgaatgtggaaacaatcgagttgaattacccactcatcgctgcagttaggaaacctccgtgttcaacgatccgctggcagccggcttaaaccaccttctgggctgatacgccagctcatcccatggtcgacattcagatgaaaccaccgcctctcaaagtggctgtggcttcaaaggagaaacccgcagaggtgaattcatgagcgcgctcgaagtcgtgctggctggtgtcgatgggctgcgcatgtcccccacgtgcgagattctctgtgatccttgcccctccggtgcccctgcacgcgccctacgccgcctccatccacccacgccgcagacctnnnnnnnnnnaagaaacccgcagaggtgaattcatgggcgcgctcgagatcgtgctggctggtgtcgatgggttgcgtcccccacgtgcgagattctctgtgatctttgcccctccggtgcccctgcacgcgccccatgccgcctccatccacccacgccgcagacctgcattgattctccaccttctgggtccgacggaggccacctgccggggccccctcccacctcgggtggggcaggccagcaccccggggcagatgacattccagacattggggcgtctgcccacggcacctcacaccatgctcccaggcctgaggaggggccggacgagggcaggtctcctcaacgactgcacagtctgggatctggcagtccccctcccgggcagtacggtgtgccactggtggcataccagtttggcaggtnnnnnnnnnnagacggaggccacctgccggcccccccccccacctcgggtggggcaggccagcgccccggggcagatgacattccagacatgggggcgtctgcccacggcacctcacaccatnnnnnnnnnnaaggtaggggtggtagaagtggcgtggcgacagggtttcagacgagtgcagctccagaacagcatcggaggcttgtgagcaagcagcacggcaatgtcaactgggcagggccgatgttctcacacgtcacatcccggccctttcccatgcagctttcaatcgnnnnnnnnnngaggtaggggcggtagaagcggcgtcgcgacagggtttcagacgagtgcagctccagagcaggaccggaggcttgtgagcaggcagcacggcaatgtcaactaggcatggccgatgttctcgcacgtcacaccccggccctttcccatgcagctttcaatcggaggctgcagtccctgctccttgggtgcatggtgaggtttcatgagtgcagaagttatgggttctgtgcctggatcccatgtgcaccctgaagctgactcgtttagagtgatgacgtctgggattacgtcccaacccgatccctccggcgtgtcatcctcccccccgccctcccccgacatacacgcacagtgccccatccttactacatggagacgcccgggtcctctnnnnnnnnnntgtccctcctccctgggtgcatggtaaggtttcatgagtgcagaggttatgggttctgtgcctggagcccatgtgcaccctgtcattcagagtgatgacgtgctgggatcgcgtcccaacccgatccctccgccgtgtcatcctcccccctccccgacatacacgcacagtgccccacccttactacatggagacgcccgggtcctctccccactgctactccacccctatgtacggcggctcgcccccgcctggggcgccctgggtggacgcctatggctcctccccgccacagcatggccactacctgatggcagcccccggctatggcggctcgccgccctactccccgcacgggtactccccgccccagggcttctccccaccccacccaggctaccactatcaccctcagtaccccggtcatcaggggagcaaccagtctgtggatgcaggcgctgttgctctgtctgcactctccctcagcagggtaggtggacacacggttgagcacggtcggcacagcacccgtcggaccatgacccctccgacgcgtggccctacagcctgcgtcgtttttggtgctcaatcgagacgcagctcggctccctcaccccatgcctgcccccttgctgcaggccagctcacccacagaactgccccgcagcagctcgagctcctcgcttcgccgcgcgtcggcccgcatcgcacgcagcaatcgtgcgggaggggcttataatgccagcgaggtgcgattcgatgggtgatgggtcatgctcacgtcatttctctgcaggggcggcaacactgtgacagccgatggcaagtgcggtacnnnnnnnnnnagttgagcacgggcggcacaacacccgtcggaccatgacacctccgacgcgtggccctacagcctgcgtcnnnnnnnnnncgccagcgaggtgcgacgcgatggggtgatgagtcttgctcacgtcacttttctgcagggctggcagcactgtgacagccgatggcaagtgcggtacnnnnnnnnnncttatattgcagtatgtatttgatgccagcaaggccagcgttccccggggtgaccgactgtggnnnnnnnnnntccctgcagcgggtgaacccagaggcctttgatctctcccttactatggggaacgggccgctcaactcccccccccccccccaaccccctgccccaccccccatgcaacccttgtgttgcagtatgtatttgatgccagcaaagccagcgttccccggggtgaccgactgtggacaacggtcatgatccgtaacatccccaataagtacacccagtcattcttgctgcgccatgtcaaccaaggaggctgcaagtgagtttcccggtgtgatggcatctgtggaagagcagaagtgggtattcagggacccctccgtcttttcatcgttcctcgatggccaagagtcgctcaccaatgctcctcccaacgctgatacccaccacaggggcaagtttgacttcctgtaccttcccgtcgacttccgcaacnnnnnnnnnnactcaccaatgctcctcccaatgctggtacccaccacaggggcaagtttgatttcctgtaccttcccgtcgacttccgcaacgcctgcaacctgggatatgccttcatgaacttcctgtctgtcgaagccatggtacagttttaccagacatatcatggcgaacggtggagggccgaggaaagctcgaccaaggtatgagactgggcagctgatggaacaggatggatgcaatgggtcggcaccagacggcttgtgttggctgcctcactgctgggagtgttgaagtgcacagggctgtctttccttgaaagttgaccgtggggaggaaaggcnnnnnnnnnncgagactgggcagttgacgggacaggatggatgcaatgggtcggcaccggactgtttgtgttgggtgcctcactgctgggagtgttaaagtgcactgggctgtcttcccttgaaagttgaccgtggggaggaaaggcagttggctggcagtctgatgaaactcattctgcaatgacccactgctacaggtgtgtgagatcacgtatgccagggtgcaaggatttgaggccctggtttctcacttcaaagctgccaagttccctgtgggcgatgcgtcggcgctacccctcgtattcgccaaggtgattggagttgggggagcttgcgtggttgggcagtgtgagtgcgtcagcaatgggccgatgcttgtgatgatgtgaagtcttgtgagcaaactcggcgcccgataccaccacccctgcgacttccttactcccgccaggttgagaatggtgtggccagctgccnnnnnnnnnntcacccctgcaactttcttactcctgccaggttgagaatggtgtggccagctgccccctccccatcaaccagtacattgacacgagtggtggtgaggaggaggcaccctctgttgagggcaccagcgagtgtggcgagtctgatgtcctgggcacttctccataaatgtatgatgaggggaaacagttgtataaatattgagattgtggcaaatcaaacaagatgccatgctagctgtggcattctgcaagctaatctgagcaatacgcccacgaaacaatgaggggctgtgcgctagccatgattcccaagctgatggattatcaagatgaagtgcaggagaacggcaggacgggaggggctgtctccccactcatgcttcccgccattctcgcgcccagttggggggttttcgaacgtggatacgagaaaatggcagcgagttggtggctccctgagtcagcagccccttcagagttacttctgatcgatgcaaacgcttgcattgggaataatcacaagacacgaaggggagccttgcacaattctgaagtgagacaagcactccggcttttcgaccgcgaggatgagcacaaactaccnnnnnnnnnnacagccccttcaaagttacttctgatcgatgcaaatgcttgcatcgggaagaatcacaagacacgaagtggagccttgcacaattctgaagtgagacaaacactcccggcctttcgaccgcgaggatgagcacaaactaccttcgatccttcatagaaagtgggtccctgccctttctgcctggcttcttggctttcgggagtggagatgcgcatcgttgcgcagcatcatcttgtagtttcctcactagaccttccaccaaattttctctcccaggtgtgtctgatgtgcctgcagaactggagcgatggttccggggcatgcgggagctggacgagcgggcccatggcctccaggttcagctggaggcggactgccagcagcagctgaggctggccgccgagcaacagcagcatgggaacaagcgaaccaagggcgctggcgacatggacgctgggcccacacctccctctcagcccggcaacgagccagttgatctagaccagcgcatcgaggacacaacagcagagttactgaagctgtcggctgagaaggtcaggcnnnnnnnnnncgggaacaagcgagccaaagccactggcgacatggattctgggcccacacttcccactcagcccggcaacgagccagtcgatctagaccagcgcattgaggacacaacagcagagctactgaagctgtcggctgagaaggtcaggcgttcctgctgtcgttatctggaggtctatggcggcggtgccctgcctcgcagcgctgtactttgtcgagctctcccctgacctcctctctccacttcaccatggcagacaaatgcagcgcaacagatatatgactacgtggatcaacacatccgcaagcttgacaaggacctgaagacatttgatgcaggtgtttggcggggggggggggggggggggggggnnnnnnnnnnnnnnnnnnnnnnnnnnnnnnnnnnnnnnnnntaagtcttgggcatatggttgtgttggatgccactgtctggtgtggacttgacgtccaacatcctggaattgggaacacacacgctcaatcttgccctcccccactgatgaactcaccctggcagagattgctgtcgaaaggagtaaactggggcttccacccatagaggttgctggcacagacgcagaagccaagcgatcgaggaaagatggaggaagtgagtctacattgcctaagtggacatgttggtgggccaggctggggtgctgatgggcttgctgagatgttgaatggcacagagagagttgcttgcgccactgcgaggcatgctggctgccgcaccacttccattgattctccgcccccctccccgatagctccccatgtgatgacatcggaggagnnnnnnnnnnatgcttgcgccactgcgaggcacgctggctgccgcaccacttccactgattctccgccccccctcccaatagctccccatgtgatgacatcggaggagctgtaccaggcagcccttgcagcggcagatgcctccgagccaacatactgctactgcaagcgtatatcttttggggagatgatagcctgcgagcacccggagtgtctgatcgagtggttccattttgagtgtgtcggcctcacggccgagaaccggccaaaggggaagtggtactgcaaggaatgccgcaagttaatgggcaagaaatagcctgtatgtggtgtgctcccctcgtgctcgcctgttccgtgttgtacatgcgagcaagannnnnnnnnnactgtatgtggtgtgctccccccatgcttgcctgttccgtgttgtacatgcgagcaagatgaacagtaccatggttcagggcaatggtaaagcagtaaagagcttacagcacagatcatgtccactttccaggcaccagccagacgcactgtcccgctggcctgcgaggctcgagtgctacatcatcttgatccctgcttccttgaggccggtgaccaaggctgcgaccttgccgtggaatcgttggcggggcttgcgttgccagctcacggtatcgatgccggcagcctgggcccgctccgccagggtttgcgcgaccctgcggagaccaatgcatgcagattatgtcagctatgggcaaatttacatataagcgacagcacaatggcgtgcctagccattccgtgaaccgaccttgcgcaggctcctttgtcagaggtggactccagtccctcctgcagccccttctcgatggtggaggcagccgcagccacggtgtgcttgtctcctgataccttccagatttgcgcgtaggcatacttgttgctgaagaagagctgcagctgatacggcctgactttctgcagccccgccatatcaaagaggtgtggcccttgccacggccagcgctaactgcaataaaataataaacaacaataagtttcaaacgcggttttatggttgagtgtcaacagattatgcactcgcgcagcaggcttgttccccagacagggcctagcgattccgcagggaccctgctgtgcgtgccttcccttgcacagcacctcctgcggctgatctcctggtcccttcaccgcatgattttccacactcgaccattcgtcaaccagtttcaccctggggatgacactcctgggtgagcattatttcctcggcagcttgccaggattttgggggtgtctgattgacagggagatatgcacttacaaaggagatggggggcaggaaaggagctagtgctcagctcgtgactgtagcgcttagccccactggcagcgcctaccgccccccgtcctcccacgccatcgtcatctagtttgcgcgtgccttcttcgccgcccgtttctcctgctggccctgttccacgtaccgcttcttccgctcctccttgttgaactgcgcgcgccacgcctcctcggcctccctgcgcttggccagctgcttgagctgcttctgccgcgcctccctgcgcacccccgccttggcgttccggatggcattcagctggttcagcagcgtcgcagcccgcttctcctccggctccagcaccaccgcccgacgctgctctaggctcttgcgcttgcgcgccgcctccgtcttgggcttgctcttgaatggcagggcggcctgtgtgtgcaaaaaggatgaggttggtttttgaaggcgcgcagaggcggttgtcctgtcgagcctgtgcttgccttgagagacccgttccagctcgaggggccatgtcaccaaggttggattccaaacaaagacggaatgcaccctccaccagcagcacatggtgtgcatggcaatccgacgcactcccctcnnnnnnnnnnagttggattccaaacaaagacggagcgcacccccccacagcagcacatagtgtgcatggcaatccgacgcactcccctccaccacgaccttgacaccctccctgcctcgcagcccattattccacagcaaacaatccaacgccacccccctcctctcttcacaacctcgcacctggaggtttttgggtatcttgagggggttgaacacgcgcggcttgcgctcgatggcccggtacagggagtccgactcccgcggcgcacccaccccctgctccctgcgcaggtccgccaccgtcctcatccccacccacgagcctggttccgcggccccctggcccgcgcccgtgctcgccccctcggccccctcggccggagcctcggccccggctgcggccgcctcgacgtcgccgtcctggtagtaccccatgcctctggaccccagcttgaagaccatgcccgggcgggcgcccttgaaggccatgcaggcctcgaagcggccgtggtccctggccgcgacctcgccgccccgcgacccctgcggcagcatcgcggcggcctcccgctcgggctcctcctcccgcttgcggttcttgctgggcttgggcgcgcgcggcgccggcgctgcgcgcggctccagcaggttggtgatggggttgaagaagcgcgggatgtccaccgccacccaggccctgcgggatgttcagggggtgtgaggtggacgaagccgcggaacggctgagggcttcactttcttctgatgctgtttctcccttggtgaacaccccaccgcctggcacccagaaacgtcactgggccagcccatgcccgtcccaaacgcaacaacagtgcactcctgttccatgccaaatcatttcccccagcctgcccaacgcccaaaacagcgggccccttcacaaannnnnnnnnntagtgcactcctgttccatgccaaatgatttcccccagcctgcttaacgcccaaaacagcgggccccttcacaaatacaacgaaaccctctgcacctgaggaagatcatgtcgctcagcagtggcttgtcctcgaaggtggcgcggaaggtgccgtccttggcgccctgcacccccgcccgcagnnnnnnnnnnattggtgagtaccccaccacccgccatccagaaacgtcactgggccagcccatgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcggatgccagacaccgtgcggatgcccgcgccctcgaatttggccgcctccagctcgctgttgaacatgccagacacaaaggctgtgtggcgcaggatctgggcggaggtggcgagggtggggggggtgagatggtaggagactggctgggcgaaacaaatgcatggtcctgccatcgccgggagtactgagggcatgcagggctctgggtgctgctcgctcatccccattcttgctgcacccttcccgtccccaacaacctgttctctccccccaacaaaacccatcctcctcctcgccttgtgcggcgtgccgaccagcttcagcttcttcacgatgcgcagggaggcgtcgagggagagcaccacccccgtggcagcgatcctccagcctcgcccctcgccatgcagcttctgcacggccagcacgcccgtgcccggcggcgccagcggcccccaccacgccgccaggcagtgcgcatgctccggggtgtacttgagcatgcggtgccgcccgttgttgtcctgcatgccgtacacgggcagcgcctggtagcggcgccagcccaccgacacgaccagtgggtcgcggttcttcaggatgcgggggaaccagcggtggcgcttcagtcgcacctgctggcaccccacgccctcctccccgccccccagcccgcccaccagcacgggcgagcgcgggtcaaagtggcgcaccagctcgcagggcaggccccggaagcgcaggcgcacgtagtccccggggcggtggccctccatggcgaggcgctggtcggggcccagcgtgctcagcgcggcgtcggtgcgtgcctggcgctccgccaggtccttcttcagcgcgtcgtagtaggtctccccctcctcctcgacatcttccttggaggccttggaggaggccttgcctccgccggtgccatccttgacgccgcggctgccgcctgcgcgcaggtggatttgtgcagattcttaagaggtgggtctcaaggtcagtgccaggcactggaccgctggatgcatacagagcgtccgatggacaattgttctggcgaatctcgcttccgatccgacgcacagtgagatgacccgccttccactaagcccaagcccactgatcgaccgcaagacccaacaagagaacgacccagggcccgccggttgagttcacatcccccccactacacannnnnnnnnngggacaattgttctggcaaatctcacttccgatccgacgcacagtgaggtgacccgccttccactgagcccaagcccactgatcgaccgcaagaccccacaagagagcgacccagggcctgtcggttgagttcacatcccccccactacacacaaacaacaagcacctgtaccttggtcatactctgcgtcaaaggcagccttcttggaggctcgctttgcgtccaactccttcctctcctcctccgccgacagcttgatggcggctgctgccgcacgggtggcagggtctgcactgccctcgaaccggtcgcctgtgtgtggggaggaggagggagggggagagaggtgtcagcaatgtcatgggtgagtgggtgtggccagacacgtcggtgtctggccgcagtgcagacgctgcagggcctgcttcgaggcggctgcaacctgatgatcaagacagggctccaccaccctcagtgcagggcccccaggccccaaacatgcacgcaggcaggcgcgcggcacctgtctcgacgtcctcaaagtcgccgtacacctcctcctcctcgctcccggggtcctcgtccgcgccagctccgccgtcacggggccgggcggcggagcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgcggcctcccgcggtcggaacaaatcgccgtcatcgtcctcgtctccaccgctgctgggcgccccgggctcagcacgcgtaagctgctgggaagccggcgggcccaccgcccgctcgccgtacaccgcggcctgnnnnnnnnnnccctcgctcccggagtcctcatccgcgctagacccgccgtcacggggccgggcggcggagcgctcctccgcggcggcccaatcacccgtcacgaagcggtcgcgcaggccctccacagccgcgtcgtcgccccaggcggcgatcgtcgcgtcccaggcggcccaggcgcggctgcagtcctccaggcccgagggagggccctgcatgccccgcgcagcctcccgcggtcggaacaaatcgccatcatcgtcctcgtctccatcgctgctgggcgccttgggctcagcacgcggaagctgctgggaagccggcgggcacaccgcccgctcgccgtacaccgcggcctgcaggtcggcggcgcggtggctgaacagggcggccgcccgctccagcatggccgccttccagcgcgcagccgcgcccagcccctcctcgtcctcgacgccatcgtcgtcctcgccgccgccctcctcgtcggaggtcgcctcggagccagactccgagtcggagccctcttggtcgtcctccaaagcacctctgctcctcggcgccgtcccgggctcgtcgtcgctgtcactcccggaattctcatcgcttgagtcctcccctgacccagcccggggctccagggtcgtgctaaagacggcgcggcgcctgtggcgcccatctgcagccagcaccgcctcctggcctggcagggagtcccgctggcgaggctcgccctcctcgtcgctgtcactgccaccctcactctcgtcatcgctgctgccactgccccctgtggaggcatccttgtctccagactcgtccgcagactcgtcctcgctttcctcctcatcgctggaggctgcgccgtcggccggcagcggcttggcgcccttgaacacctgttgagggagatgttgtgagcgggatgtgttgagatggcgcgggtctggctggaatgggggtggcagaagtctgtgctggggtgagcccctacaccctactgccaacagaaatacggatggtagccaatgctgttgatgcgatgcaaggcaagtcgtgttgcccccattctttgagctgctgggcaactgccatacacacactcgaacccttacaaatttgggcagaggatctcacacagcatcctcttaacagcttcctcacacatgcccacaaccactcccctcggctgcacacacggacacacctggatttcagccccctgaagctgctcgtcgatgccgtggcgcgtggaagccagctccctgatcatggtctcgccatctgcccggccgttggcagccccagcggcactgtactggacctgtggaatgaccgggcatgagcggtctggtcagcatgaggagcgagtgccacccattctgtgcttcatgtgcctcatgagactgtgcagggacactgcgcaaggagcttgcaacagacaccccaatgaaatgccacgcccacctcccctcaannnnnnnnnntaccgggcatgagcggtctggtcggcatgaggagcgagtgccatccattctgtgcttcacgtgcctcatgagactgtgcagggacgctgcgcaaggagcttgcaacagacacctcaatgaaatgccacgcccacctcccctcaaaaattaccccgcaagacatgcctccccaccttccagtcaggaatatcgatgtacattgcatcggcatcatacagcagcccgccgacgtcgctcataggggcatacagcagacgatccttctcgctcaggctcctgcgcttgccggactgggaggtcgctgggagcgggcaggggtctggcagcggagtcaactcctcaatctgggggtgtgaaatagatggatgggtgggtggagggttggtggggtgtacaaacggcggggtgccgtgacctttcatggggaggcttcaggttgttaagagcgcatgcacgacagtgcaggagctgatagactggccggaggaggccatggacaaaccacactccaataaccctgaaattgcaaagcagttcatgccaggctgggaacacagccctgccatttccctccccttcccttctcatggcttgcctgatagtcgcccacgcctgccaggtgcacccggctcccggccctccaatttgtgccgcggacgtagccatacagggtgacgtccctgtctgctttgggatccgccttgatgctggcgggatctgtcacgtcctcaaacctgtagcaggaagattggaagaatgtgtccggcagcaggtgggagaggagaggcctgaagaaacggcctgcccagggcttgtgtactcgtgggggatgcccaacagtaccagtttctgccaccctttttggcccccgcctcctcagccgctgccaaaacacatgctgtgctcacctgtcggccacgaggaaggggtgctccattcgccaggacaggggccggaacttcatcaccgagatgaagcgcgccaggttgaggatctccctcttcaggtacttgccatgcctcatccccgacagatagaagagcttggcccctgcgccatttgaagagtgggagacggggaatgtgtgagggtaggggtccgacaggattcccccaccgcggagggaaattggaactgggcagcaggcatcaagtgcaaaggacaatcggttggacaccgagagtcctccaatcccctcaggtacatcgtgcagtacagccctttgcagctccgcagtgggccggcccagctgccacacatccgctctgcatgccttggtagatctccgaccagaagcggtgcttgagggacttctttgtcttcttcagggccttggtgtccttgtagccatccaggtgcgtcagcacccccatgaccttaggaaagccatgcacctggggatcacagaacaggcagtgtggtgatgatgcgcaggagctcaagaactggaacgtgacaatacgagccagctcctcgtgtcagaccagcggggttgcccagcgggcctgaggcctgggagctcggcgctccatataaactggttccctgcctgcaatgcaatatctgcccatgtactctctgctcagggcccacctggagcatgttgaggaactcaaaggtctccatctcaaagccaaaggcgccatcgaccagcaggaggaccaggtcagcgtacttggatgcatcaatggtggccgacaggtcctgtgggcactcgatgaaggtcagcctgtggggagcagccagggagaatgagggatgaggtggggctggtcggccgggtgtgcagcactctggtacccagcgcttcccaggacctagacggagagtgaaagggtcgaacaaggtgcacaatgcaggtaggagggcaaggcaggcaaccgaccaaacataacatcacccacctcctggctttcccagccaccaaagtgatgggtcccttgacgtccttgacatcctgccgcgtccagtgcttgatgagggccttgatgagggtggtcttgcccacctggtgtgattgcagaaaggtaataagtttgaggttggctcatgccactgagatcatacagaccctgttaaacgcaggcgctgagagcatgcccatttctcaaagttaagtcctcctctacccaaaaatgaaatagtgttgataacataccccagggggcccatgtacgagcacagtgaagggaggaggctcagatggggtcttctccacagcaggcactgcacgaggttttgggtcagattttgatatgctgctccctgttgcacgcctgagggtataaatatcatctgttccttctgcacatgattctctttgcacatatagcggctcctcaccatgcatgcgcttctggtctcggtcggctgtgcgggcctgctggatctttgcccggccccgagaggcaaaaacaaaggccttgggattcttcttgcgttcctgtgtacataatcaatacaagaacatagtcaaggcatacctacgaggccgtacaacagcacaggccagtgaactcttttgccatggtgcagggagtgctcctgacatcctctcagccagcaccgactctcatcgtgtgccacccagacgatgccaatgacttccgggtaggacgagacttaccttgtcatcgacccccttcttcttgttcacggccttcttcctcttctgcgccttggtgcctgactgtttcttgcggtgcgtcttctccgccatggcgacctctaccaggcccctcgcgcttagtaagcctcaagcaaatccgatgcttggtgaaggctggcgactgtcttcgactggatgaagggtttttgccctccctctcacaccaggagagcaacgcacgcggacatgttgtcgtccctgctcctgtgggcgatggtccagaacgaaaacaggcgtactccgtcacgctttactatactttatattcaattcatcctgtctaactacgcgcccacctccatatactgtgccatgcatgcagagacgatcgccagcctgggcgccctcagcaactcgagccacgccggcgcgcgcgcgcacggcggagctcgagcgaggacataggtaaaaggtggcactgcatggaatgtcagctggctaggcatgcgaacatataagaattctctgtcagtccatcatacgtgctgggcatcctcccgcacctcggcaaagggaattgccatctcgtgtatagggattcccgtacgccttacggccaagatgcacgaactctgagtctcccacggccccactggtgcgctgaaggatgcattttgacgtaaagtatgtatgaggttgcgcacagtgtaatgtatcgatattttgagcttccttgatgctgagcgacccagccctctcctgcactccttcccattgcagagttgtcatgggcttggcagacgttctgcagcaccgcctgcgtcgaagcagaccagaggtgtcccttccggtgttcccgacccagaacacacgcacagccgcccgaaagcggcggaaactgctgcgcgagcagaaggctgctggcctcgcagtcccccagaaagtgcggcaggagtctgatgacgatgaagaggagggggttgccctggacgccgacgacatcggcggggcgtacaagaccctggtatctcttttagcagacgacgatagcgagagcgatgtggggcccagctcgcaagaggacgacagcgaggagcctgcatccgacgaggagctggactctgacactgatgccacgagtgaagaggatcttgccgccgaagccagtcgtgagaagctcaccaatggttcggtcgcaagatccaagggtgttacgacggaagcccttgatgacgacacagctgagccagcagatgcgcagacctccgccagcgaggacgagcgcgaggatggggcggcggaggagtcaccagctcccgacccagactcgaggactgcgaatgagaagcgggatggaggttctacgttcgagactttggctaccgacacggtccagctccaccttgagaggtgtggatgtgtggtggcctgtcaggggatgcagggcctggaaatagaccgtccatcctgggcactccacgccaggtggaggtttgaggatggacccagagccagcgtgcaccttgcctccgagtcacgcatcatcacatgcacatgcctttgtgaaaccagggtcctgaccgaggatgaggtggcgtcgctggcaccggggtctcggcccctgcaccctgcccccaaggccgtgcagtccgaggtcggccgcatttggcccgaggcgcagctgctcgcgagcgacgacgtacggctcccggccttccctccctcgaccagcctggcgagctacggcatcaaggagcggctggtgacccgctggcgcacggtgcagggcgcgacagccggtgccgagctggccagcgggtgccaggcgggcctcttcgccctcctctcctcccaggcagacattctgcacacggcccgcccctacccgacctcagccgacccaggtaccggcagggggttagtcccttgccttgcggtgcctgggatgcatccaccaggtccagagggtttggtgacatacgtctccactgcaccccgctcgtcggctctgaattgcccaaggacatgcccggtcagtgcatgcagagactccagtccgctgcgagaccatcacccctcgagcccctcaatcccctcttccccctgcagctgtgccggacccggagctggacgcgatcctgctgcacatcctgcaacactgcgcctctaacgccgaccgcatccggaagaataatgagcgcctgaagaccaatcctgagctggaccctccccgggatcaaggcttcacacgtcccacggtgtgcaggggtggggtgggtgtcctggcaggtattccagcttacccgcccggtgtgttggttgtgtatactcttcggcgggttgtatcatgtggcaggccttctggagcatacggacataacgagtatgctgctcatgggtacatcacctggctgcactcacgggtcttgtccctgcaccccaccccgagtctcactccccttgttaaaccccaccccacaccaacccacccacaaaaacctccaggtgctgctgctgctgcccatgcgcaacatggcgctgcgggcggtgcagcgcttggccgagctggcgctggcgggggcgccgacagacagcgtgcagcaccgcgcgcgcctgctggaggagttcgaggtggaggagggtttcgccgcgccgcaggcggcggcgctggcgcgcaagccgccggagcaccgcgcgctcttctccggcaataccgacgaccacttccgcctgggcgtccggcttatgcgcgggacggtgaagctgtacgccgacttccacaccgccgacgtgatcgtggccagccccctggcgctggccaccaagctgaccgacccggcagacagggagggcgccgacttcctctcctccctggagctggtggtcatggaccgtgccgacgtggtgctcatgcagaactgggagcacgccgtcacaggtctgtgcttttgtttgggggtggttggccaggggtagggtagtgatgatgggtggtgaggaggattgccgagcactgattgaggtggagtgcatgcaccttggaggagttgtctccccgagacgtataccgcctggcacattgtgtcggtctcagcacctcaaccaccttcctgccacctgcacccgcctcccttggtgctccctcctcatcgccgtccctcatccactctttcctccacacacacgcagtcttcaaggcnnnnnnnnnngtcaccgtcccccatccactttttcctccacacacacgcagtcttcaaggcgctgaatgcggcgcccaggcaacagcacgacgtggacattatgcgggtgcgggagtggcagctggcggggcgcgcgcggcactaccgccagaccgtagtgctgagcagccttgccgcgccggagatgggggcgctgatgcggcgctgcgccgcctgccacgcaggcgcgctgcgcctggaggcgcggggggcgggcggggtgctggcccgtgttctgccacagctgcgccaggagtttgagcgcctgccgcgctgcgcgccggccgaggagccggacctgcgcttccagcacttcaaggagtcggtgtggccgcgcgtcaaggagaatgggcggggcggggggcagctcatctacgtgcccgcctactttgactttgtcaggtgtgggagctgtgtgtatactggggcagaggggaaggggtggggcggttttcaagtggtctgcaaggggggagtgacgaaaaactatgtgaaggacgtcatatgggcattgcccactgttcgcccgataccaagcaccctcctgnnnnnnnnnngttgacgaaaaattatgtgaaggacgttatatgggcattgcctactgttcgcccgataccaagcaccctcctgggctcgtgcctcctccaaacctcgacgcaccccactccccactccccactccccaaattcatccatcgctgctcagggtgcgcaactttttgcgttctgaggacgcctcccttttgctcctgtcagaatacaccgacagcggggatgcggcgcgcgcccgcgcctacttcaggcagggccggcgtaagatcctgctctacactgagcgagcccagttctacaaccgggggaggacacccggcatccaggtgagggtggtagtggaggggggcatggtacctcgtgagcagatggggccgccagggtacgcatagtttggagtgtgtcccaagtgcaactggcgccgaccagtacctggcatggaaatgcaacaaccccatcccctacaccctgccatgccttcacacacccagcctcccctgacacgcaggatgcggtgttctaccagctgcccacccacccccagttctacgaggagatcttgaaccaggtgcaggagagcgaggtgggcggcctgcccaccatcaccgtcctcttctctacgctggacgcactgcgtctcgagcgcgtcgtcggcaggcaacgggcggcacgcatgctgaagccctcttcaaactctaccttcctgttctgttaaaatgggtggggcaccgaaaccggacaccggcaaacatcaaggggccatacgggatttgtagagggtacacggtgaatctcgcatgggcaccgaccacggttgaaacgtattgtgcacgatacacgaggggcgcttcacaaaaactgctggctgcctgggatggagaatgggctggggcaggagccacaggtcaagcacgctcaagtctcatagtgtggtgtggtttgaccgtaccacaatactggggtcctccatcactccaggtccctcagtcgctgtacatcatctttcgagaggcttttgggggcatccagatcctctggtgcaacatcatcggggctgtctggctttgggacgtctgggcgagggtgctcctgcgcgaccagggaagaagagaggtgcacacagcaggctgacatggagatgaatggcatttacaagtgtgtgccctgcagcgtccctgagctactctgcctcaagccatccttttctacgcacgcacccctttgccagtggggaagttgctggaatgagtgttggcatcagcatctgggttatgtgttgaggcagtggatgtgtcatcgacgtcggtaaatcccggggatcacagaacaacttagaagatcgagaagctttcgttatccagattcctccccaagttgagactccacgaaccccttcgcccatcacctggtaggtcatcaccgctgcccgtctcctccctgctaggggacagatgtactgcacctttggctcgacatgaacgaagaacgtggggtccatgaccttactccacgcgatgctgcatcacccacttcatggagataccagttgtatcctccccagtatgtgcgcacccgctactcgaaacgtgtcggcggaactgggagacaatggagggaccggtctctagcgagcggacgacgaccctcgtcactgtggtggtagtcatcatcatcgaatataggtatcagagggagttgctatgcagtgcagccggcgcgggtaattccctcacccagtgcgcaggcgggggttggtggattggacgactgtgctcggcttccgctcagattcagtagtcgggggagggactggggtgggcagggtcaggaagccataaggacaaggtcttagcatggaatacaaggcggagagacaagctttgaaaatcttccataatagtgtctcaagtgaacaagacgtggaacgatcgatgatcggcatctcatagatcgggcaaggagcgcttactacagacaagcgcagaagatcacaccatcagcccttggcaactctcatgcaaggttatcagcccggcttctgcgcggttggaggtccaaaaagcatgcaaacgatctattgtgtgcgaaggagtgcagatcccatcctaagaaccctaggtagcagcagcccaacgctttgggcggtatgcacccttgagtaatcgacgactgagttgcacatattgcacattgacccctaggagtgctgaagtattccattaggggacatcatctcgcatttggacaggttgaagagtgtgcctgaggagtcgcctcccgcgccgcgaaatgcgtgagttgcgcatcgtcgtcctcaaccaccggaagctaagcaccgcaggatcagcgccaacaccttctgccattgtccgcagacaacccagacgcaaaagagaactcgatatattgggctaaattacaagtccttccgaaatagaacctcgtcgcccgccttaccctctgtgctcggaagctatgccctactccggatcagagcacgccgagccatctgggcattgaatccaccttggagacagtcattccttgacagtacacctagatcatactccaggtatctggctgtccccggcccggcgcctgggccatgtcccgcatcgcgacgggagtggttatagcaggatggtgagtgaggggtggtgccgctgcatcccgcatccaagcaccctgaatctccttttgacgatgcgtgcggcatctgcgtggcctctcgtcccactctctgtcattgcgcatgtgtttggacactcagcccttcctccacccctgcatgctcccaggtacttttccaacatcggcgtcatcctcctcaacaagtatctgctcagcatattcaatttcaggtctgtttgtgccattgctttcgtaggatgagctctgcatggtcatcggtgtcatcagctgggcagggtgctagtgtacccccatctgtgatgaaggctctgcacacccctgcacgaccctatgcatgcctgcagcccagcacatacaatcgcgaattgtggcacatgatatatacgacgcagaagtcagaaggcttctactgatgatggtctgcgtcacgcaatacaccatccttgtccccactgcgtctctgcgactccctccaaggccaacaccttttgaccccctcctccaatcacccacccccgccccgcccttccaccacacccctccaggtaccccattttcttgacactgtgccacatggtggcctgcagcctgctgggcggcgcactggccgccagccgcctcatccccgtgcagcccatcgcctcccggccccagatggcgaagatcacgctgctggccgccatcttctgcttcaccgtcgtgctgggcaacgtcagcctgaaaaccatccctgtgtccttcaaccaggccatcggcgcgaccacgcccgctttcaccgctgcgctgagcgtgctcatgctgagtcagcgtgagccgcgcgcggtctacctctccctcgtcccggtggtggtgggcatcgtgatcgcgtcgggcgcggagccaagctttgagatcgtgggcttcctggcctgcgtcgccgccaccgccggccgcgcgctcaagtcggtgctgcagagcatcatgctggacgaccccgccgaccgcatggactccatgagcctcctactgtacatggcccccatcgccgtcgtgctcctcgtccccgtcacggccacggcagaggcgggagccctgcaggcagcgcttgtcatgggcaggcagccaggtgggggggattggttgggggtgaaatggggaggaaatggggggtgggggtggaattcgtgtggcaatgcaggggttgaccgtttgtgaggagtgccaccctgccattcggcatcatgagaaaactacaaaatggctcgcttgctggctgtgcatgtcccatgccatcacattcttctctacggcctgcaggcatttgagcaccatgccaatgcacaacccttgagcacaaacccaaaccatcttccagtccccctcatttctccgtgcaggcttctggatgctgctcatcctgaacagcgggatggcgtactttgtcaacctcaccaacttcctggtcacaaagtacacctcggcgctcacgcttcaggtggggggtgaagggtgatccccagtggcccactcctgcgtggtactggggataacgtgcgctgggtggcggagcaaagtcctgccgatgcctcgtccctcttccgcaccccagaggcgtgatgtctccctgccccccacccaggtgctggggaacgccaagggcgtggtggccgtcgtcacctccgtcctctacttccagaaccccgtgaacgccatgagcgcgctgggctacaccatcaccgtggctggggtcgtggcctactctcaggtgtagggatggaggatgtgcgaggaaaaggcatgcggtgtgtgtgtgtgtgtagggggggggggtactgggatgggcgccagggtgtgggatggtgtgggcagagaggtgccgccatgggcggctttgaggggcggtgtcgttggatggcggcattacacaatccccctcacacactcccagagggcaatccctcaccctttgttcccctcacctggacaggccaagaagcgcacacggaaggtggcgtccgtgccaaagcatgccgcgcaggagcatgcggtgcagatcaagatcgacgtgcatgcggagtctgagagccctacgtccaggctgcagaggacgcaagggtgagctgggcaaggggggtgggggttgggaccggcccgagtgcgagcaggcgctatggggctttgccagcccttgccgggtatagtcacggtccagcctccacatcgttgccacctgaaaggccatgcccgcccaactgcaacctcccttcaaccatgcgcgcatgcagggtggggtcgagggacgcctccatcccggccctgctcatacaccagacgcccaaggacatgtgacttgcgctcactggcggagtgaggaccctgtgtgccatggcgagcctgcacgccggcccctggaaaccctggttgcgaaatcaaccagctgcataccgggcgtgccacgtcctgaggggcaccttgatcctgcacacgctgcaagccttcccgttgctagagtcgtcggtgaacagccctcgcggtggctgtcgctcgctgccgcacccttctaccccctttacctagcggcaactgcctcaccctttttgtccccatcgttacaagcttcacccccaccctagagatcatctcattgcatgaatatcttggactgcccgcgagttgtcatgttcagcgttctgccccagctgggcagccagccaggccacactctttagaggtgaagctgagatgattccctccgggcgcgagatcgtgcacacgagtatacacgggcatcacgtcgtcctccagcatccctgacgaaacattagtgcattctgcgatacatgcatgccatactacaccagtgaataccgacattggggatctcctgggcgttgagcttcggcaagggaggagtctgcgtcttctcctaagtaccaacgaagggagacttgtcgccggatctgagcgggaccatagaaccttttggggatggcgacgggggctgcaacgctcgcagagtcgttcctggcggacctggatgacctgtcggacgaggagccggaggacgtgggtgcgcctcaagagcagggcgatggcgaggaggcggtgagagggcgtcgtagtcctggatcattgggttgattgcgtaaaatccatgcatgccgggtcgcatgccctggtcgtgaccgacggcatggtcacccaaggccgtgcgacccacctccccctccacaccccccacccccccagcagatgccggatgtcgagaacctgcactacgacgacctctccgccgtggccaccctagtgaccaccgagcgataccagtgcatcttggaggccactcgccaggccctggctgatgatgaggccgggaccagcgagcagcaggcctggtccggccccaccgaggacgaccccacctacaagtgagcgagtgcgcgggtaattggtgttgcgtgctggggaccagatactgtgccggactcttcgtcccaagggtgtgacccgctcccttttcgccatgccattctctcagtggccctaagttccagacatgcaacctcctcttcccctgcgcccaccaccccccctccccaaaacacaggttgctggtccagtgcaaccagctgtcggtggacgtggacgcggagatcgcggcggtgtacaacttcctgcgggaccactaccgccccaagttcccggagctcgagtccctggtgcaaaacccgctggactacgcggcggtggtggcggccatcgggaacgagctggacgtcaccgccgtggacctcgacgcactgctgccccccgccaccgtcatggtggtcaccgtcaccgccaccaccacggcaggcaaagcgctgagcgaggaggagctcaggtggggaaaaggggaatgctgtgatgcttcgcgggaagattgtttgggtgtgagtgtgtggtagcgtggaggaaaggggggttgtacgggcccggggagtagcattcgggtggagatccagaacgtgccatgttgtagcagaggggagaacaggttctgcacacctgtgcggcaacctgggtgacnnnnnnnnnnccgggtggagatccagagcgtgccatgttgtagcagagagaagaacagggtctgcacacctgtgcggcaacctgggtgacggcgctgggcgccgctgtctgggtgctgggacgggggcccgcgcgtcagccggtcccctgggcttccctgtggcatcctcgacacggtcgatcaaaacctcacgtcatgctctcccccccaccccccacccaccccccaccaaaaaacaaatcccccctcaccaggcgggtggaggaggcgtgcgcgatgatcagccggctggcggcggacaaggcgctgatgctgcgcctggtgcagctgcgcatggaccgcatcgcgcccaacctgtcggcggcggtgggcaccgagatcgcggcgcagtgcatgggcctggccgggggcctgctggccctggccgccatgcccgcctgcaacctgctggtcctgggggccaagcgccgcacgctggccgggttctcctccaccgccgccgcgtcgcaccagggcttcgtccacggctccgcgctggtgcagggcacgccgcccgcgctgcgaccccgcgccgcgcgcctcgtggccgcaaagtgcgcgctgctggcgcgcatggacgcgtacgggcaggacccgtcgggggcgcggggacgcgcggcacgcgaggacatggccaagaagatcgagaagtggcaggagccgccgcccgccaagcagaccaaggtgctgcccgcgccggacgccaacgagcagcggcggcggcgcggcgggaagcggtaccgcaaggagaaggtggaggggggtggggggtggggtgggnnnnnnnnnnnnnnnnnnnnnnnnnnnnnnnnnnnnnnnnnnnnnnnnnnnnnnnnnnnnnnnnnnnnnnnnnggagtggcgcacctttcatcaggggtggggggaggggagggcaggcttatttaggtacgaatgtcggagggtctgaagggcgcggggagctggacagggcgatgtcgcgctctgtgcgcctcattggcatgcccttggggccggtggaggccccggcatgcagtttggcctgaacctacatcaggagcctgtgtctgtgcctgttcgccgggtggttttctctgccgcatccgttgctgggatcacccannnnnnnnnnagcgctctgtgcgcctcattggcatgcctttggggccggtgggggccccggcatgcagtttggcctgaacatacatcaggaggacgtgtctgtgcctgttcgccggttggtttcctctgccgcatccgttgctgggatcacccactatccccttgccatgcatcgaccatcgtaacaacatgctcccactccccccccctcatcattttcccaaccccgcacccgcacaggagcgttacgggctgacggagctgaagaagcaggccaaccgcatggccttcaaccaggcggaggacgagttctacgacggcgaggacaccatcggcctgggcgtgattggaaaggacggcagcgggcgtctgcgcaacgtggccatccagcagcggcagaagctgtccgccaagagcgccaagaagtttgcggcgcggagctacggctcctccggcgccgccagcggcctgtcctcctccctggccttcacccccatccagggcatcgagctggccaacccgctgcagggccaggcggccgcggaccgcatgcgggacggcaccgacagctacttctcggagtactcgggcttcaagtcggggaggaagtgacgcggcgatgcgcttcccgtctgaagccggaggggcatggggccggccgccgccggcgcatgttacgccgtgcgaggagcgcatcggctgcgccatgcatgcacgggcgtcgccatgccatgctattgagtatcctcttgtgtacatctctctcgcctgaggcacgctccatgcgggcatccatgtgtagaataaacgaaactggccctccacgtgatcgggggttccctctcggcaacaaatgcgcattgccagagctaccgggcagcccacaagccgcggcacgccgtcaggcgggcctggaagcgcatggccaccgatggtgcgacaggctctgcgtgaaggcgtccaccagcccctgctgcaccgcacgcacatggacaaggaggacgactccctgccgggggccgtggacctgtaccacaccctgttccgggacagtacccgcagcgataaccccgacaggaacaccagggtctggctgcacatcgatgagcatggcataccctccgacgtcgaggtgggggcacccggctggttggggggaaggcgcgtgccgggttaagccaggggagcaaaatgtcagagccggcaggggagtttcctgccgcccagccccggccagagacgctcttgatctggactggcaattcctttcattactcacaaacacaggtggacaagcacgttctggtgtatgagctgggggtgaggtaccgcgacctgctcaccctggaccccaccctccccctgcccttccccgccgccatcctcatccgcaaccgcgcgctcatcatcaacctggagaccgtgcgcatgatcatctgcgccaaccagtgctacgtcctgagtgtgccagacgtgagagcggcgcgatggtttttgcgtcggggtgcaagccaatgcccgtggggtgcggcatgagggccagcatggccgacgtgctccctgctgggtctgggaggcgcggacctgtacctcagtgcgtatgccgccgccaccgaggatctgtcagcctcaatgcgcaggacgccaacccctacaaacccagcctgccgacctgcgacagcctgttcatcaagaagctgtgcgagatgctgaagccgcacaaggcggcgcccagttcctccagcctgcagcgcatggccctgtgaggctggatgttggcaggctggggatctgtgctcggttggtgagagtctgtggccactcaagctatcagcgtttcgtgtctcagcatccccccccccgccccccctcgccccc

SEQ ID NO: 45695 - DNA, 61 bp, Chlorella protothecoides
acggatgagactggcaagctttgatcttagttccccctccccttccttgcatgcacagtac

SEQ ID NO: 45696 - DNA, 61 bp, Chlorella protothecoides
cgcctctaccatcgcatattgaaggggaggtatatacctcgaaaaggctgccagtcgaatt

SEQ ID NO: 45697 - DNA, 61 bp, Chlorella protothecoides
accctcctggcgctagccatgggggcgaacaccctgcttcgtagccattcacagctgcatg

SEQ ID NO: 45698 - DNA, 83 bp, Chlorella protothecoides
cttgattttatgctctgctcacacgagggcatccattgtatcaacaagaaggcataaaggttctcaggatcacagcaggagga

SEQ ID NO: 45699 - DNA, 61 bp, Chlorella protothecoides
tggttgcctagctgtgccacaaacctcttcaaccccccctcctcattgctcacttggacag

SEQ ID NO: 45700 - DNA, 61 bp, Chlorella protothecoides
aggagcggatcctgaccctggagcggcaggggggcaagggggcttagagggcacgatgtgc

SEQ ID NO: 45701 - DNA, 61 bp, Chlorella protothecoides
tttggttgcttggtggggaaatggggggggtgcctggacagctgcatgcaatacagggtga

SEQ ID NO: 45702 - DNA, 61 bp, Chlorella protothecoides
ccagcagcggcaagaggagcggcggtggggtggccgctgctcgggcgccggatcgcgatcc

SEQ ID NO: 45703 - DNA, 61 bp, Chlorella protothecoides
tatgaggcactctggagatcatctggagtcaagcttgtcaagcctgtctcaagcagttcag

SEQ ID NO: 45704 - DNA, 9165 bp, Chlorella protothecoides
  modified_base (258)..(267): a, c, t, g, unknown or other
  modified_base (347)..(356): a, c, t, g, unknown or other
  modified_base (497)..(506): a, c, t, g, unknown or other
  modified_base (1630)..(1639): a, c, t, g, unknown or other
  modified_base (1817)..(1952): a, c, t, g, unknown or other
  modified_base (2111)..(2325): a, c, t, g, unknown or other
  modified_base (2424)..(2433): a, c, t, g, unknown or other
  modified_base (4473)..(4482): a, c, t, g, unknown or other
  modified_base (5028)..(5037): a, c, t, g, unknown or other
  modified_base (5742)..(5751): a, c, t, g, unknown or other
  modified_base (5985)..(5994): a, c, t, g, unknown or other
  modified_base (6188)..(6197): a, c, t, g, unknown or other
  modified_base (6431)..(6440): a, c, t, g, unknown or other
  modified_base (6775)..(6784): a, c, t, g, unknown or other
  modified_base (6899)..(6908): a, c, t, g, unknown or other
  modified_base (7082)..(7091): a, c, t, g, unknown or other
  modified_base (8417)..(8426): a, c, t, g, unknown or other
ggcctgggggaggattattgtttctgttcagggatttgtaagcgtggacaagtggttggaatatcgtgacccaggagctgacagatcataccaactgctcctccctccacaggcttctacttcctgcactacctgcaaaccctggtcggggggccagaagtgtttgaggctttcttcaaggattacatcaaggccttcagcttcaagaccgtcaccagcgacggattcaaggtgctgaggcagctcatagggatgggnnnnnnnnnncgtccctggagctgaaagatcaataccaactgctcctccctccacaggtttctacttcctgcactacctgcaaaccctgnnnnnnnnnngggggaggccatgcgtgcaggggcgccgtgttagtattgtcaatggaaatgacatgccctcgttgcttgtcctgcatcctgtccacaattctagccagccctctaccttgaccctggccaggcctacttcctggactactnnnnnnnnnnagggaggccatgcgtgcaggggcgccatgttagtattgtcaatggaaatggcatgccctcgttgcttgtcctgcgtcctgtccacaattctagccagctctctaccttgaaccctggccaggcctacttcctggactacttcacggacagtacgcccggtgtggggggcattgactgggacctctggttctaccagcctggtgagtgtgtgcgcattgaccctgggagcctgagatgtgccatacgacaagtgacaggtcacgcaaggtttgaatctcatgtgaaccaatgcaattgctggacgggacgtctgcaggcatctgctgacaatagctgcaaccatctgcaagccccgacggcaataccgaccccttgcctccatccttttatcccaggaatgcccccaaacgtcaactcgtacgatgccagcctggctgaatctgcgtatgccctggcacagagctggcacacctctgacctgatgggccttggcaccgggagtactgcaggccctgccaaggcctccaccactgatctggatgggtggtcggcctcccaggtgcctttgctggagacctgatggtgttggtggtttgggtctccagcctgtgtgtcaatggattggtggccatacgacgcatggcagccccttaattcagttctcccctgcatcaggcatgcttaagtgggggtcacccctgtcatttccccctggtgtccacagaaagtggccttcttggacaaactgggggagctgaggagcatgaagcccttcacccccgccaccacaaggcgcatgcaggagctgtaccacttcgatgactccaagaacgccgagctgcgccgcgcctggtactcgctctgcatcaaagcaggtatggtgatggccgggggggtggggaggccggggccaggtggtcggcggcgggctcccaacataacgcaccagatgcggcccgtgagagggcgcaggtctctttgcgacaagtggaggctgacgacctaacctcaagtggcttctaagtgcccaggcaggacactccctcccttgcttcgtaaatcatacgaacaccaaccacatgtgcttgggccactccattccttgcaggtgacctggcaatccnnnnnnnnnntgataccaaccacatgtgcttgggcccctccattccttgcaggtgacctggcaatcctcccacagaccctggccttcctctcggagcagggccgcatgaaggtgagttcttgggtgaggatctttgggaccctgcactatacttagatccagggtgcccagcgcgcacaacaagccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccatcgcgagatgtaccaccccatcgccgccaagatggtcgccacagacctgcaggtgcccgctgctgtctgacggaacgcgtgggagctggcgaccgcagcgctgcatggctgcccggcgagctagactttctttctcgttaccctgccactgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagtgtgtattgaagacgatggcatgaggttctgacggtcctggcatcaggagatcatcaggccgaggcaactcaggaccctgcccccaccttatgnnnnnnnnnnaggctgaggatctttggaacctgcactatactaagctccagggtgcccagcgcgcacaacaagccgagccatggtatgcttgcagccccgttcagtcaccttgcgtctcacgtgtccccactccatcccatccaactgccgcagtaccttcgcccgctataccgtgcgctctacgccaaccctaagagccgccaggccgccctcgacacctttgccgcccatcgcgagatgtaccatcccattgccgccaagatggtcgccacagacctgcagatgcccgctgctgtctgatggaacgcctgagagctggcgaccgcatcgctgcatggctgcccggcaagctggactttctttctcgttcccctgccactgcgagcccgtgtgccccccgtcgcgagcctttgtgcgtcgactctgcactcacacgatgcaatgcggcgctgcctctcgccatgccccctcatgcagggtctgggtccaggcacagcctcacgctgcgatggaagcggtgctgacgcacatgcacccctgccatggccatgagcttcttagacgctgcatactgctggctccgactgcggaagtgtgtatggaagacgatggcatgagtttctgacggtcctgtcgtcaggagatcatcaggccgcggcaactcaggaccctgcccccaccttatgctccccggagctggctgggcgttgtcggcggctgggcccgacccgccggcggccgtgcccttgtcctcgtggaagaccacctcggcgatgcccgcctggatcatcagcttggcgcactcgttgcaggggaacatggtgacgtagatcctctggtgcaggggtgagggcgatggagggcagctggggccggttgctcaccacacctccagcggagtcggcggggaagtacctcggggacggcgccacacacttgcgcccatgatcacgacgacgccaggagctctaccccccctcaccgccccgctgacagacgccccattcttgttcagcagcgcgttcatctccgcgtggcagacataggggtacttggtgtccagcaagtccccgctctccgccgccttggaccaggggagctgtgcgtcggggcagccgcgggggaacccgttgtatccgatgccacagatgacattctggcggtcgacgatgcatgctcccacctgaggggaggggagggagagggggggggtggaagctgtgaaaggcacgcttctagggtacctgacgatgccactgtgttgttgggggccggcaagcccgagtgaaatgttggtatgcaagcagggcagccagtggcagtggagaggatagtcatccagcaccccccaacatcctgctggtgccttgggcttccagtcaccaggacgctggcctccaccacaccctgccattgcatttcaagcagctgccgccagcctcagagcagtggtcccatgcccacctgtttgtggggatccttggagcgctgggagctgaggaacgccaccgccataaagtaatcgtcccagctgaggtacctggagggagcttgcgggcctggtttatgatgggcaggcattgagccccctcgtcgccttgcccagagaccttctccacacccaccctgagcgtggcttcgtgtcgtagggattcaccgggcatggcccggctgagtccagcatcgaatcccgtttggcatcgggtccacacccgatgaaatgtacacagcgctgtctccactgccgcgtgcactggctccgcagaaaccagtacgtcagggacgacgacaccacagcagcccccactgcggcgcccacgagtgcgagatcgcttctgtggctgtatgtgtgcatgccaaatgctcaaggaggaggaacttcgcatcgataaaccaccaattttgcacgctcttgcccatgttcttgatcgtgcctccgattcaatccagcgcgctggggtttcgaatctcggctgcatcttaaacactaggcgaatgcatgaacgctccacactccgttgcattcccggatataacagctcgattgannnnnnnnnngaatgctcaaggaggaggaacttcgcatcgacacaacaccacttttgcacgctcttgcccatgttcttgatcgtgcctccgatccaatccagcgcgctggggtttcgaatcaccatctcggctgcacctcaatgaccaggcgaatgcatgaacgctccacaatccattgcattcccggatataacagctcgattgatagtatttacagcctgatcgagtgccacattgctgtaaagcagggttattgactccctagcgttgatgcgttgcttttcggaatgttatcgcgacacgagtataaatttgccttcgcaggctgctcagttgtatctaaagaaaacatatggtgcaagacggtcgaataatgtgttcgtcgacatgtgcgcattcatcgcgcgtcatcgtgcgcttcatgaacacgcacgttcccatgatctcgcgaggagaaatatgtggacatggtcatgcacgcctccaagaaatatcggcaacgatgtaaacatgcttaaatcagtagtataaagatatgagattatctctccggcnnnnnnnnnncgcgcttcatgaacacgcacgttcccataatctcgcgaggaggaatatgtggacatggtcatgcacgcctccacgaaagatcggcaccgatgtaaccattctcaaatcggcagtataaagatatgagattatctctccggcccctccagatgagcctcgtgaaagaaagtgtttgggactacccccggcccccccgcctggagaagactccacggcacctcaaggtcgagcttcatggcaaggtactcacctcatcacgaaccctagggctttctgggagcatattacattcattgggacgcgtctgaagtcgccgggtggaggggcgtgcatgcggaacctgctcttcttgtggagatctagcacccgttgaacacaagctccagattagagctcgatgacatcgaaaaacaccagagttcagtcttcctcgaactttctccacaaatcctttcaccttttccagattattgccgagactcggaatgcgtaccgggtgcttgagaccagccacccccccacatattacctcccaccctctgacgtgcaagctggctacctttccaaagcaaaaggtaggctctgcagggcagcgtctgtctctcactgttgacgctacattagtgccagaatagagtacaggtacgttttgtcaacaacctcagtgcaccgcacctgttgcacccagcacaggtgcctcctccnnnnnnnnnncctcactgatgatgctacattcgtgccagaatagagtacaggttcgttttatcaacaaactcagtgcaccgcgcctgttgcacccagcacaggtgcctcctccttctgtgaatggaaggggaatgcgacatactggaatgtaacagtcccgggtcattcccccgtcaaccagaggttttgtgccggtgtttgaggctttcaagaggaggatttgacctgccgtcaggctgcacnnnnnnnnnnctcccccgtcaaccagaggttttgtgctggtgtttgaggctttctacaggaggatttgacctgccgtcaggctgcacacccgatgcttgcacttcatcccgacagattattacaagggattgccgtcctgttgacaacaccatctccattccccactcaggacatggtcctatgagaatcctacacccagcttnnnnnnnnnnaatgcttgcacttcatttaacagattattccatgggattgccctcctgttaacaacaccatctccattcccccctcaggatatggtcctatgagaatcctacacccagcttcagcagcatcaaggggtatctgtccttctatgcctcgccatttgagtgcagcgtggacggcgaatgcgtgaagcctcaggtgggatgtttttgtgtagggtttgggcgctgcctgcaccccannnnnnnnnntgaacgcgtgaagcctcaggtggggtgtgttggtgtagggtttgggcgctgcctgcaccccattctcgggttgagtgaggatcacctcatgaactctaccagctaagaagaaagcccgcccatcacaccacaggagggcagcttctacgccggctggataacagatgatgtgatgggccccttcaagggagcccccaacaccctggggtggtgaatgtcggtctgccacacgctccccttgggtgcccactgcacctctgcttcctctgccaccctgatctgagacggatatatgcagtgccgctagccaccattacagcatgggtcggacaatnnnnnnnnnnttgtttgggtgggggttgtggccgggcagggctgccagtgctgaagcggctgccagctctggatcaaagaatcgacaggcgtggcgtggtgtcccccacaacctggtcctcatcnnnnnnnnnntttaccaaaaacatggacagttgagaaaataagcttgatggtagtatgcttcctggtaaggtcgtatcatggatgagggagggtgcctttggaggggcaaggtgtataggcattcagcgtcttgagcatcaatggtgttcatccaggcagcgtaagaagggtgtgctgcagggnnnnnnnnnncttactataaacacggacagttgagaaaatcagcttgatgggagtatgcttcctgataaggtcgtatcatgggtgagggagggtgccttcggaggggcaaggtatataggcattcagcgtcatgcgcatcaatggtgttcatgcaggcagcgtaagaagggtgtgctgcaggggcagaaggtgtttcgggtgggggttgtggccggcagggctgccagtgctgaaccggctgccagctctggatcaagaatcgacaggcgtgacgtggtgtcccccacaacctggtcctcatcagctcaggtggtggggcccctccgcgacaggtgctgggagggagcttggggatcagtgcgagaagggcagggcaaagcggaattttccggtatcatgggctccctgggaacgggcggggcatgttggaccgcggccttcaagcagggatgctctcagaaggcgcctgggaagggctcaatgcaagtgtacgggtggatgtggggtgacgtggcatgggtgtgctggaaagtgagggcgtgccagctggccgcgctttcctcctggttctcccacccccacatcaggcggtggtcacgaggatggcccggttgcggcgggggtcgggggtgcggtactgcagcttcaggcggcgggtgcccgtgagctcggggatcacctgttgcgaggagtggtgggcgcgcgagggggtaagcctcgtgagcaggtgtttctgtcggtttgagagtcacaactagctgcatttcatgttgctgccgcacaacccggggtcacagggatgggaacgaaggtttgttttggatgaaggtggtggaccacttccgtgcttgggtgtagcatacataagatcagcagcagcccctgtaacgccacctcgcacagggccccagccctctggccctttgagcattgcccaccttgccgcacaggttgtcgtaggctgcctgggaatcagacacctgcttgaagaccacaaagccccactggtcggtgcgaccgcgctcatgacgggcctgctgcaactccttgtcggcgaggggtccgaacctggggccgggcgcgagggggaggggctgagtgcagcagagaggctggagggggaactgggaatggatgcgccctgtgttagtcggctgcaacagcagagtgtgcggcaagcgagctgccgccggacacccacgctctcatgaccccactggtaactttgcaaggggtgagcaatgcttcataacacaggctggaagtccctctgaagagcatcgacgatctaaacaacgccaaacaaaccaccattgatcagagcaacccgttggnnnnnnnnnngactgggaatggatgcgccttgtgtttgtcggctgcaacagcagagtgtgtggcaaacgagcttccaccagacaccccacgctctcatgaccccattggtaactttgcaaggggtgagcaatgcttcgtaacgcaggctggaagtccctctgaagagcattgaggatctaaacaacgccaaataaaccaccattgatcagagcaacccgttggcgcaacgtagatctggttgcatatccgcactccagcacctcgacgcaacttccagcccctcgctggccatgctccctggactcacttgccaaagatgtcgtcgatgatctcaagcgtggcagagccatccaccccgcccagccacagcttgaccgtgggctccttgctggccccctccttgcccaggggccgcgccatcaggcccctctgccgcgcggccatccagttgagaccgcgctgctgctgcgccagcgccgcctgcatcagcgcgggccccatgtcctggtgacccaggggccccaccatgcccatgggccaggcgtccgcggggtggtggtgcccggggtggtggaacatggccgggccgccgtccagagcctgcgcgctggaggccaggtcggctgcacccaggcgctggcccagctgcagggctgccaggcccgcctcaagcccagcgtggtccgagtagtccagaatggatccgttgctgttgtgggagtccaggggggacagctcgccctgcggg

SEQ ID NO: 45705 - DNA, 61 bp, Chlorella protothecoides
ttctccattataaaaaagcattgggacggtacctgtcacagcatccaatcctccaccacct

SEQ ID NO: 45706 - DNA, 96 bp, Chlorella protothecoides
gctgagtgccacacttcgaggactcagtcagtgaagtctatcatcaagagtagccgaaacaaatacacgggcgatggtaagggtacctgttcgccc

SEQ ID NO: 45707 - DNA, 74 bp, Chlorella protothecoides
ctctcctcgtcctgcaggatctgggctccgttctgtaaccctggacctgcatccttcctctgcatgattcaggg

SEQ ID NO: 45708 - DNA, 111 bp, Chlorella protothecoides
gggacccccctcctccttgccaccttctggcacgaattcctggccccgtgaacttccatttcactcacattcctgaaccgcagcgcccgctcggaggtggtgagggtgcgg

SEQ ID NO: 45709 - DNA, 182 bp, Chlorella protothecoides
tgcttgttcaccatcatgtgccctggggggtgaggcatggggtgaagtgccaacaggaaagtgtcgagaacggccgacatcaactttcagtatatggggaaggggagggtgcgggcaacctagactccatgcagcatagcttcctgatgcgacgctcacacatcccatgcactctgctttga

SEQ ID NO: 45710 - DNA, 61 bp, Chlorella protothecoides
cccgaacgactccttcaggctcatcagcttgcccagccccttctccagggtggtggggaac

SEQ ID NO: 45711 - DNA, 61 bp, Chlorella protothecoides
tgtgacccccggggggaccattgccttcttcccctcccaccactatatggaggaggcggtg

SEQ ID NO: 45712 - DNA, 65 bp, Chlorella protothecoides
gtgggttgtcgtgtgcatgcgatctgacaccctgcctctcaatcattcccaagcctgagctcctc

SEQ ID NO: 45713 - DNA, 88 bp, Chlorella protothecoides
ggtgtcctcggccaccacgcaggcgaccccccgtcccgcatcgcagtccagggggggcctgcccccggcgaccccagcctccggtctg

SEQ ID NO: 45714 - DNA, 62 bp, Chlorella protothecoides
cccgcgcagactccggagaacgcgccaccagagcaggcgggcgaggaggcgatgcaacacga

SEQ ID NO: 45715 - DNA, 61 bp, Chlorella protothecoides
tttggtagaatgagaacgggattgcgtcctaggcacgatgtctagctcgcagtcgagatcg

SEQ ID NO: 45716 - DNA, 70 bp, Chlorella protothecoides
ccctcatggctaacgaagcagcacaggctgaggacagcctgcaactcaggcgggggagaatgttgtgggg

SEQ ID NO: 45717 - DNA, 61 bp, Chlorella protothecoides
gtggggagccaagagggctgtttgaagggcaccttccacatccaacactccctcccagaca

SEQ ID NO: 45718 - DNA, 66 bp, Chlorella protothecoides
accaaagaccgttgccctggcatctcgttaaggacagctgtagcatgcccgccgctgccactggct

SEQ ID NO: 45719 - DNA, 71 bp, Chlorella protothecoides
cggggaaatatcaagaccctcctttgacgaccatccaggtccaagtcgccttattgcgcagatacactgta

SEQ ID NO: 45720 - DNA, 61 bp, Chlorella protothecoides
cagcagctcgtagcccttgcccactttggcagtctcgagggtggctccttccagcacaaag

SEQ ID NO: 45721 - DNA, 87 bp, Chlorella protothecoides
cctggagctgggagggagcaaggtgcaggagtggcggacttggtaggggttgattgagggcttgtggatgtctgttgcagggccagg

SEQ ID NO: 45722 - DNA, 22025 bp, Chlorella protothecoides
  modified_base (480)..(489): a, c, t, g, unknown or other
  modified_base (1170)..(1179): a, c, t, g, unknown or other
  modified_base (3888)..(3897): a, c, t, g, unknown or other
  modified_base (6630)..(6639): a, c, t, g, unknown or other
  modified_base (7095)..(7104): a, c, t, g, unknown or other
  modified_base (8134)..(8143): a, c, t, g, unknown or other
  modified_base (8319)..(8443): a, c, t, g, unknown or other
  modified_base (8526)..(8701): a, c, t, g, unknown or other
  modified_base (9451)..(9460): a, c, t, g, unknown or other
  modified_base (9977)..(9986): a, c, t, g, unknown or other
  modified_base (10797)..(10806): a, c, t, g, unknown or other
  modified_base (11635)..(11644): a, c, t, g, unknown or other
  modified_base (12011)..(12020): a, c, t, g, unknown or other
  modified_base (13505)..(13514): a, c, t, g, unknown or other
  modified_base (13816)..(13825): a, c, t, g, unknown or other
  modified_base (15033)..(15042): a, c, t, g, unknown or other
  modified_base (18297)..(18306): a, c, t, g, unknown or other
  modified_base (18677)..(18686): a, c, t, g, unknown or other
  modified_base (18780)..(18789): a, c, t, g, unknown or other
  modified_base (18889)..(18898): a, c, t, g, unknown or other
  modified_base (18981)..(18990): a, c, t, g, unknown or other
  modified_base (19655)..(19664): a, c, t, g, unknown or other
  modified_base (20177)..(20186): a, c, t, g, unknown or other
  modified_base (20834)..(20940): a, c, t, g, unknown or other
  modified_base (21105)..(21114): a, c, t, g, unknown or other
  modified_base (21610)..(21619): a, c, t, g, unknown or other
  modified_base (21946)..(21955): a, c, t, g, unknown or other
gcgctccgcgcgcttcgactccagcgcgcgcgccgtggcgccccggggcgcgcggccgccgggggatcgcgcctcgcgcggcgtcgcgcggtatcccgccgccgtcaggatctgatgatggggttggtgggttggggttggtgacagaggagccagagggcaggaagctggcagagggggacactactttgtttgaacatggtgcatggcagcgagggcctgggcgtaggcccaggaaggagggcaggggaccggcttgctttgaggcaggatgccagtccacctggccagtcatagacgcaggacgaggcagaacctccttgcacccagcgcagaacccacagagcgccagggccatcccaacaagtgcccccaagctcactcctcctgcattcctcgcagcgcggggcccagacaacacgatgaaaccgctcacacagacaagcgagaccctacctgtgccaggctggcgcccagggnnnnnnnnnnagggcccaggcaacacgatgaacccgctcacacaggcaagcgaaaaccctacctgtgccaggctggcgcccagggcctccagcgcgccgccgccgccattcagagcttcgcccccgctcttctcaagctcgtcagccttgctgccagtggaactgtggctgggtgtagcgaggcgtacgcgcgcgagcgccgtctccgtcgccagcgagacggaggcgccgcggaccgccggctggtcctccagcagcttccggacccgggagacgcagccggcgcagtgcatgccgtccacgtcaagcaggaccacgtcctcccgcgtggtcccgggcggagcggcgggcgcgtcgccctggcccgtggaggagggactagggagaggctgcctggagccgcgccagcccttgccacccagggggggcctgggcgtcctgccgcccagaccaccccccagcgaccggttcacgacactgcagcgggggttgtgccgtcgagggcaggccccagatgcgggggaagggcgcacgaagggccgcgaaacatccggccctggcccggcctgggcgagggcacgcaccgtactccgagtccaatgagctgggcattccgccgatacattatatgtgtagcacataggcttggagaagatgcttgctgctccctgcatgtgccccagggcagagnnnnnnnnnncgtgtagcacatgggcttggataagatgatggctgctccctgcatgtgccccagggcagagccctgcaaactccggacaaccctgcccggacgtcggcagacctagcgacgagggaacttcatggccacggtgcccgcgcgatacatgcatgcaacagcattacacttgccgcattgtacatgggagatgcttgattgactggcaacacctgtaatgcagctgagctcggcgatatcttcaggggggtctctgctaacggggcaggatcgccccatttggcaccctgctgcgccaccgcagcacagctggggttgttgaggtgcgcccacttgtgtcacggacggagctgcaagcccagagaagtctgcccctgaacaacattcgagcaggagtcgtaggtgaccgctttcaggcatggcccatcgttgtcttggcaggcatcgtatacagtgaccacttcagaaagaacaaggacgacccgagacattgccggacaagtcatgcagctggccatgatactaagcacttatcatggatgatgaattctgtatcacgtacgacgagactactcagaaatcccgagaaggcccgaacacatcgaccccccgcctgtcgtctcgcccactccaggtgtgcgcaggtttaacgccgagcatcgtacagatgctgggggtgcattataggtggaattggaagtatcgaatggcattggagaatcccaagcacatgtgagtgtcccaggaacgcctgtacccgtcttcagttgcccgactcctcaccccccttcatcattggcaggcgcctgccgcctggaatgggagccaagaccctcacgaggcgggccactccccctcgactcacaaaaccaagcagctggaggcagaggtcgactccatcctccagcagctcacccagaaccccctcccagcacctgggagtgctgcagatggcggagccggtgaggagccgaggggcagtcgcttgtcatgaatgattcggttgagatgctagtttcatttcacctcagtcctgcagcacgtttgggtagcggccccacgtcttccatccccttccttgcagctccaagtggggagccagccgcacaggacctccctcggacgccaggcgtgctgagggcggcggcacccgggcagcccccacccccagcctggcaccagaccccctccagcgccaggagtcggctctcgctccaggctgccagcctgcccaccaccgctgggaagtcgcagaggaaagcgcggacctcagtcaaggcccaccccctgtacggcaatggggctgccaaaacctccccctccagcgtctcgccggccaccggcgggcgcagggccgcgcgctttgccatccgcggtggcgagggcgccgccacgcccgcggcgggcctctacagcctgctgggcgccgcagggccgggcccaaccccgggccgggcacagcaggggcctgccccccccgaagtcccctgcggcctggcgccgcaccagcccgtctccctggagcgctccttcatagcatccctgaccccggtggcggggcgaggccccagcctcagccagtccgcgccgaggacggtcgggaaggggcccgccacgctggcaggccgcctggcggcggcgcagcgccgcgcatcgctggccggggaccggctgctgcacggacatggcgatgccgccgcgctgtggaggctgcaggtggaagcgtgcgctgtggaggcgggcgtctggaagtgtcgctgcaggtgatgggggtcccatgtgcgtccagagtgtctgacctggcgtgccccttcggctgcgctgggctgggcgaccgcagcggttggatctggaatccggggatgggagcagaagttcctgcgaggcagggcagggggtgcatacatgcggtgtcgtgccattcaagctagcttccaggagcctgtgccttgtgatgctcgtcaacactatccctttccaatcacccctgtaccaaacagggtggaacagagcccctgcccggcagaggccccaacacactgtgtggcggtgttctcctgctccctcgcatccgctttttcgcccaacccaggctcgacatttgaaggcgtggcagcgtcgaggagcctgctggatgtgcaggggtgcggcctccctgtcctgctcctgacggcggtgcgtgccctgccttgaacccatggccgcaccaccagactgcgcgctgacccctgcatgccggcatttcaaccaacaggcatctgggtgccgtggggtttgcatgtgaccatcgcacgatgtactcgtgggacgaacaaaatatactgtgctccacacctcccgccattgtggccagagtacactcgactacaagacacataatgtaacgatgtacgctgtagcgattctacaatgcatcagcgccaccgttgtgtgtatgtcaagtaaccttgcctgtccagcaggatccctgcctgaaagggatgcataacaaccgtcggaagcgcaatggcgcgtcaggcttccacgcacctgggtcgtagcaccaggaggaagccagatactgcccattcgcctcgatgcatctgccggcccagcagcattggcataaagacccatcaaggattcaaagacccctttctgacagcccattctctccctccagagcagctcatggggtcattgagtcctgtgacgcagctgcgcgacaagtgnnnnnnnnnntagcccattctccctccagagcagctcatgggtcatcgagtcctgtgacgcagctgcgcgacaagtgacacctccagaagacatgcgccgaccatagtgcgcccatgccatcttcagcattacatacccggactctacccccaggcggcatgacctctgtcctgcatgctcacgctgcttcgagggcctcatgtccattggtgaacggacgcaccagcaccgcgcccggccagtgcaaggggcccaggcggcatgggcagacctcctggcgcctggatgccgtaaagtatccttttgcgcccctcatacaacagctgaagggcaccaaggagtcgcagtccgtgcaggacgagcactacccggaaaccacaggcaggccccagcctgactgccccatcatcagctgctgcggcggcggcatcttcttcttctgtgagccagcacgggggctgggcaaagggtgcatctgcatgcactgtggcggcactggatataggaaacaggctgctcccttgtgcattgttggaggccatcgctgctgttccggacatcggtgcttactagcgatccaatttcgcacgcctcggcccctcggtcctcattgcctacctccacacacacacacacacacacttgcacacgattcatccccctctgactgcaggggagctgggtgtcctcctctacctccagaagcaattcgacctgggcggtgtgcaggtgcgcggcgcctccgctggcgccctgctttccaccctggtggcctgcgacgtggacctggagaaggcgctggcctccgccacggtgcgcatccggcgcgtggaggccatggagcgcaagctgggcctggtgggcctggccgggcagctcgtgggcgactggctggccgacctgctgccggaggatgccgcacagcgcgcccaccgccgcggcctgcacatcgtcgtgaccgaggttccctctttccgcctcacgaccgtcaagcgctttgactccaagcaggacctggtgcaggccaatcgtacgtgggctggctggcttgctggatggacggtgggggggtttatgacgccagggccagggcttcgatgcagcaatggggctgctgctgcacccaaaggtgcccgcgccaagatatggggatgtgatcgcccaccgcacacatgcgcccaacctccttccacccctgcccacctgcctacagtggcatccacccacatccccttcttcacggacggcgccccatcctatgactacaagggccagccgtgcatcgacggctcactctgggactttgtgtttgccgacaactcggactacctgaaggcggagggtcgagcggtcctggttgactatgtgcgtcttgggttaaggtttggagacaggctggctcccaggctgcggtggctgctgtcgcaatcgagtctcttcatggtctaggcaggtgctggactccgctgtgcagtccccttttctgttttctggccaccaagaatcactgaaaccctccccaccctccacggcgctccagttcaaggatgaccagctatcaaccaaccgccttgactttatccggctggccagccctgacgagatcctgtccctggtcgggttcggttaccgctacgccagccgagcggacgaggcgggcgagttcgagctggcactgggcaggctgcggcgtagccccctgtcccgcctggtcagcggcggcttcctgccaggcttcctgtttgggagcgggtgaggcatgcagcccgaacataacagagcagcacagacaatgctgcagtcaccaccaggaagagtagggctccatgctgagccccagtacctgagccagactttttgcatgctcaggctttcatttcatcacgagaattgtgcattactgttttcccgctgtcatccaggaagcaaggcatatttttgtaccagacctgctcatgcagtcgcacgcttgatctccccccttggttgccttgcacatgcatccattctttcttgcagcctgagaaggcaataccagtattcttttgggcaagcagattctgccgccgatcacaccctctctttcattaagacctgtaacgcattaccccgccttggtagcaaggggcagttgcggatcgccaggggtgtgtgactgcgcagactgcaactgtagatctagttgtaatgctctgttatagcagaccctgtcatccctccagcggtctcagggtttgctgggtgcactccagacccttcagccaggcctcaatggcgccggccagctcaagcgggcgctcgagatgcacagcatgcccagcgctcaggatcgtggcagcctgcacgccgatgccgctcgttccggcgggctggcaccgctgcagcatggcctgctgtaggcccacgaacttctcgtcctcttctccagtgatcaggagaatgggcacgcgccgcgagagggcaggcagctcatcccaggcgtgggacgcccggccgggggaccaggcctccagcacatccgcgagggctgcatggtcgctctgcgcggacgcccgccttgcaacgataccggattgcctgtgcaggggaagggggatggcactgatgtgaaactactgtcgagggggggagtctgccgcctcatgcagacaagcatggccagacatacccagctcgcccgcgcttcgggtgtcgttaaaggtgcgattccctcctggctcgctaccctgccacaaacaaacnnnnnnnnnnaataccggattgcctgtgtaggggaagggggatggcactgatgtgaaaataatgttgagggggagagtctgccgccccatgcagacaagcatggccagacataccctgatcgcccgcttcgggtgtcattaaaggtgcgattccttcctggctcgctaccctgccacaaacaaaccaaggagcaagcacctggggtgccggcgcagcgttccccacatgggctgactgtaccagtgctccagaaacacttcaatgggcgcctgcctcatcgtcgccgccagggcagcatcctggcttgcacgctgtgcgcgagccagggcatctgcgcgggcattgcgggggtcggtcgcgtctttgagcgtgcagagggtttgccatcctgttgcgctgtttcaaccaggtcatccctttccatccgtcctgcgcatgctcctggcctggaccgaccagaaccannnnnnnnnngcctgttgcgctgttccaaccaggtcatccctttccatccgccatgcacatgctcctggcctggaccgaccagaaccacaggccccccaccccagctcgtcaccttggatgccgggggagccagacacaaggaccaggcgggagcaggcgcccgggtggcgcagcgccagggtcaaggccaggcgcgcccccagggagtaaccgaccagcgtcaccggctgctgcagcgtggcgcaccaccctgccacatctgctgctgcctgctccagggacggcggcaccgggcccgtgagcaggccagcactgccgtgccccggcaggtctggggcaagcacggcgcgcctggttcccagcgaggctgccacgggggtccagtcctcagccgcccccaggaagccgtgcagcaggaccagggtaccggctgccccgccctctgactcgcagccatgccgcaggacgcgcgggcagtggatggcgaggcctgcacacccctgcaggtctgaccctgtcgcacgcggtcgccgatcgccctctggagacctggcagacgaaggaagatccccacctggtcggcttccaggctctgcgagggcctcgcccacgtagtcgtcggtgcccagaccatgcagtcccaacatgtcagggaacacctgcacatccaccgcccgggccagctcgcggaggagggccagcccctccctcgtctccatgcacgaggaaagcgcgacctggaggccgaggcgcgcggcggtgcgggccagcttgaaggtcgcctccgggccacccatgaccccgggcttgagcacgagtgccaccgtcccctccggcggggggtcaaggatgcctgacgagtggggggggcggggcgtcagaagttgacagggggccagaccagttacaaacaggcttgcagacactctgcacctccttgtataccctgtgctgtggcctcgagtgagtccgtgtcaacactggactgatctccacacacagcaagtccaccgagatcacacctcttctcacaccttcnnnnnnnnnncggcagtggatggcgaggcctgcgcaaccctgcaggtctgaccctgtcgcacgtggtcgccgatcgccctctggagacctggcagatgaaggaagacctccgcctggtcggcttccaggctctgcgacggcctcgcccacgtagccgtcggtgcccagaccatgcagtcccaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcggcggtgcgggccagctcaaaggtcgcctccgggccacccatcacccccggcttgagcacgagtgccaccgtcccctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtcaacactggaatgatctccacacatagcaagtacaccgagatcacacctcttctcacaccttcctgggtcacagactcgtccagtgcggtggcgatccccgtcgctctccagaacgactccaggtcctgccagtcctgcacgggctcctcaatgtattggagctttgcccgcgcggcagccttcccaaactgcgggtcgtggaggcaggagggggacctgggatgagaaagtgcattcctccagccatgagggcagcgcccagaacccccacatcctccacacagccacccacctgcaccgcctgcggcagcgaccaggcgcaattggcgtcggcacgtagcacgacctcgctgccgaccgcagaccgcacgccacagaccaccgccgcatcgagctcggggttggccctgcgtcccactttgatcttgatggcgcgccagccctggagcacgagtttttcggcagcttctgccgcctcggccgccgtctgctcgccgcagtccagcagggcgttgttgggcaggggtcccgagagatgagggcctgccaactccgcgcacagcagctggctcagcgtctgctggccctcctgccaaatgatgggtgcgaggttggtgagggggttgataaggtggggaacagatcaaacaagtaatggtatggacctgcaggagtctacttcggacagcatgctctccgtccaacacaataaaccacccaggaaccctctccctggcctcacctnnnnnnnnnncactccgcgcacagcagctgactcagcgtctgctggccctcctgccgaatgatgggtacgaggttggtgagggggttgatgaggtggggagcagatccaacaagtgatggtatggacctgcaggagtctacttcggacggcatgctctccgtccagcacgatacatcacccaggaaccctctccctggcctcacctgcgccagggcacccaggagcgcaaattccagggcgcagcgcacggaggggtgcagcgtgcgcggcaggacgcccacctctcgctcgagccagtccgccaccctgccgcccagcctggccagagtctggggcatgcccacgccaggcaggagggcacagagccccgcgagctgggcctcgctttcctccaggctctcagcatgcacgcctgccagcggcgccgcctcgcccatcccgcacgcgccgccgctcagacgcaggtgcagacgcagtacccttcgacagtcgtgcggcgcccctccccgcacaggcagcggttgannnnnnnnnntgctcagacgcaagtgcagacgcagtacccttcgacagtcctgtggcgcccctccccgcacaggcagcggttgactgagcggggccgagcaccgctcgtaccaggcttgggcaatgacggcgcggcccaggctgggaacatgcctaccctctcccaccgccccgttggtggccggcgccatggactgaacatcccccaggcgccgccgccgcacctccgcaccccacacgccctccgccagcttggccgccgcggccgtcgtcgcgcggtgccagtccaggttgccggcggggtccacggccacctccaccacgctgtgggtgtgggaggcccaggcggctcgcagtgcggcgcacagggcctgggtgccgtcggccagatccaggcgcaggtgcggcacgccgtgcgctcggcagagcccacccagctcgacggcctgcggcgtggtccagccgtcgctcagcgtctgcgccggcacctgccccgcgatggggagggaagaaaagatgccgccgccgccgttgttgatcaccaccaccgtcagcggcgagcgggcggggcctgcaaaaatttgtcgatgagcgagtgtggcttgtggacgagggcagattttcactgccaaaaccctgtgctcaactcgtggctgggtctgtgtggccgattgatccagcaggcaccccgaggtagggcgccttgcagtcatggacaccgtcaggcccaaccccaagaagacaaagcaggtcagccagtcacctccataacatgtgcctcaagccctggcccaggtctccttgcctgatcgcagcagcannnnnnnnnncatttgtcggtgagcaagtgtggctcgtggacgagggtgggttttcactgccaaaaccttgtgctcaactcgtggctgggtctgtgtggcagatggatccagcatgcaccccaaagtagggcgacttgcagtcatggacaccgtcaggcccaatcccaagaagacaatgcaagcaggtcagccagtcacctccatgacatgtccatcaagccctgtcccaggtctccttgcctgatcgcagcagcatgaggccgttggtgtcgtgcagaaaagaaaggtcgcccacgaccagggtggtgggcatgcccagtccactggcaaaccccgccgccgaggacagcacgccgtcgatgccgctggcgccgcggttggcgcccaccgggcaccccaggctgggcactgatgggggaagggaaggcaggaggggggggtgtccggtggatgaggctacagcaccccatcaagagcaggctgcggaggtgacaccgacccacacggacggctcaaacccactctcccccgcccaccttgcccctgcgtgcacccgctcgatgccaggccgtcggcaaacatgtccatgtcacggatgggcatgctgttcccaatgtataacgcgtggcctgggtggggtgatcggggttggggaccgggtgcgtctgcgcttgcatcgaccctggcaatatgtcgggaatgggaactgttcctggtctgcaactccaagaccgttcctcctcccaacttccccccgggacttcccccaccagtgcccacctctgggcaggctggaggccaggcacgcggcgatgtgggcctcgccgtacggcgcgcnnnnnnnnnncgcccacctctgggcaggcaggaggccaagcacacggcgatgtgggcctcgccgtacggcgcgctgttcaagcgctgcctcaccaggaaccccacctcgcggtccatcgtccgccagagctccaagtacggactggtgaatggggctgccgcggctccctcgaccagcacccctgcttcacgcagcaggcgctccagggcgcccagcggcagccgcacccgccctgcaaggcagccatgctcatcaaaggagtgcgggctggcatccaccacccaccacgctgcaccgtcgttaccggcgctgctcccccgcccgctgctggcggccaggaaggccgagatccgcttggacgtcagccggccacccnnnnnnnnnntgtcattaccggcgctgctcccccgcgcgctgctggcggccaggaaggctgagatccgcttggacgtcagccggccacccagttgcaacaccacgtcggggcggagagcggtgcacatgcccggatcctgcgcagccagaatgttgtcgccgcaggcgatcagcccttccggcactccagtggcccccactctcaggcccgacagcacgtcggccagcaggggccagcgcagcgctcgcgagacggccagggcggccgcgcggtcctcgggcgcgcgcagctccccggctactagcaggccgcgggtcgcggtggaaagggcggcgaggagggagtgcgggaggcgcgaggcgcaggcggcggcctccagctgcacgctccacggccgggaggaggtcgcccagtcccccaggccctgtacattggacagggtgagttctttatatcagtactgttacttctgagccctgctcgtgctcgtatattcaacaatcctcggcattcctctcaaagcaaacagccagtaacctccagcggcccacgtccctgcagatattgcacgcttacagtcacccccagtcccatgccaaagtaccaacacaactcacctccagccacgccgtgctttcccagggttcgggcaccgggcccagtggctcgcgcaactggacattgaggtgcactgggcccgcccccgccgcagcaaccgcccgatccagcaaccccagcaggtgctgcggcggcatggccgagctggggggcgccaggtccgcctgccagcagacgtaggaggagaagatgccgggctggtggatggtctggttggccccggagccccgcacctccgccggcctgtctgccgtgaggatgatcagcggggtgccggactgccagccctcgaccgcggccgggagcaggtttgccaccgccgtcccagacgtcgttaggatgactgggaggtataaaggagagggaggttggggtggggtgagaggagatgaaggtgtcagacaggtgtccgggcgtcaggactatgggatgatttcatgatcagggaaaatgaagcagtatgaaaggaaatggatcgctgtgtatgttgcagtaatgtggttcactgggtgtaaagggaatcgcctgattaaaagatacccaggaaacgctacaatatcaagcagaagactcgaaggctggacagctctactatgcactctcaagagccagccttcacggctgcacatcctcaacccactccctccaaaatcctcaaaggcttgcccacctgctggcgctgcccctgaccgcccgtgacccagtgcccagaaggccaggctgcgctcatccatccccgacaccagctggacccggggatgctgggcggcagccagtgtgagtggggagctccgagaccctgttggaaggaaggggaggaacgcaagtttgggttttgggttttgatgcctcctcgttctcatgccgcgcatgcannnnnnnnnnagagaggaacgcaagttcgggttttgggtttttatgcctcctcgttctcatgccgcgcatgcaaccagttcatgagcagtgtagtccaccccatgcctacccggagcgatacagaatgtggagcatcccagcctgcagagctcctccaccaagatcctggcgtatgccgcattcaggttgggcgcctgaggtttgtcggaggaggagagaagaagttagggcgagcaggtatggacaggggggcgttggagcagattcagaagtccttactccccattggctcccccgtttccttgcctgcnnnnnnnnnnggccgcattcaggttgggcgcctgaggtatgccggaggaggagagaagaagttgaggcgagcaggtatggacagggaggcgttggagcagattctgaagtccttatcccccattggctcccccgtttccttgcctgctgaagtgccggaacgggggtcagcagccggtccagggccgccactttgagatcaagttcggcccactccagggacgccttggagccagggacgatgcccacgccggcatacagcgccacccgcatcgctgtcgggcccagggcctgcacgccaggaaattctggcgcttgaacctcggggacaaagagggcggagcggatggccaccgcaaactcggcgccctgtccccccagccagccaaacgggccagagtagaatcctcgatcaaagggctccagcgaggagagcatgtccctggacgcctccctgggtctgcgcatgggaggggggaggggggcatccatactggaacagctgtgtgggctgtgaacaaggcggcctatagtacagaaccgcaaagcaacctgctgcttcaatgataaaaaggtgagccatggcagtgctctctccctgcaagcttgcagcaagccacccaccttccacacacggctggggtggggtggagggcggcgagcaagtctgcatccgtggcagccggcagcagggtgcccgacagctggccgtacaggtgctgcagcgactcctgcttcagcaccgtcttcctcacgtccacacgcacagtggcgcagatgccgcgcaaggcctgcaatgccgtgtgtggggattcgattgatggcatttcgacccagggtgttgcggactcccctggcggttgaggcccaatccccccccctccctcccccaaaacacactggacccacttcgtacacccaatcccggacgatggtgaactcggcgtgctccttcttggactgcaggaggtccagggccagccagaaatcgttctccacactccctggaggaggtgatgacgggagggctgagaggagaggtgtgatgcagcgggggcttgccacacctggcaacagagtgcgacatgccaaggctgttacctggaatctgaaggggtgcggcctgcaaggctgccaccctccccagccccagaccactcagccaggcccagctcacccccgccacgggccctcgtgccggccacggcctccgaggccnnnnnnnnnnccctggcatctgaaggggtgcggcctgcaaaggctgtcaccctcccctgccccagaccacccagccaggtccagctcacccccgccacgcgccctcgtgccggccacggcctccgaggccacgctgcggccgctgcggctgtacagccgctcgggcgtgcaagacaggaaggcctccccgccttccagttctaggaacagggcgtaggcccgtgggttgcgggcctgcagggaggctagcagggccagcgggtcggcgccgccggacaggcgcagctcggagcgccgcgccagcacgaccttggaaagtgcagcggccccgcagtcggggtctcgggtgccgcagtcccctccctgtgtgagttgcacgattttatggtgtgggtgaggtcctggcatggcgtgaacagtgatggggggttcgagaaaacccttcccgtcgtcaacatctgccgcaccgtcgcgggagcgccgagtgcaggagtaccctccagcgcctctagaagatcgtccagcccctgctgcccccccgcgatgtagttctccagggccgtgccggggtcgagcagggagggcgtgcagggcgccgcctccccctctgcgctttcctcgtccagtagctcctgggccagggtgaccgccgcctcccactcggcgcggcggggggagtgcgacacggcgccgcgcccgccggcaaaggcggccagggagggcggcgccgccgcgctgcgcacgtcacgcagcgtggtcagcgcggtcgccagcgccgcgccggcgtccgtcgcgctggggcccgcgcccggcgctgccttggagtcccagcacgccgtgcaggccaggaggagcgcgccgccgacgtccgtcacctccacgctgcgcgaggaaggcgcggcggggtcgacggaaggtgctggcactgggtcacgcccggccccccacccacccagatgccagaaataccagagacaccccggtttcacaaagcagaacgacaggaggccgcccctccctcggacctggggatgaggaaggtgaaggtcccgaaggctgcccactccgggctggggccacgctgggcgtcaaagcgcgagccgcccagggccctgacccggggcgcggcggcggaggtgaagcgctgcatgccgtgcagcctggcggcgtccagggcctcccccggcgccccgcgccagagggccgccgcccccaccccagccaccgcgcccgcgccctcctcgcaggcggcggccgccgcgcccgcggaatcggggccgggggacaggcgcggcgagaagtagagcgtgggggccggccggctcggtgcagcggcccccgaagtcccggcgcgctgcgcctgcagccaggccagcgccgaatgggttcgagggacctgggcctcacagcgtatgagggcggcggggagcccggccctggccgccaccgccgcgtcgagcgccttctccacctgctccttgcctgcggcaaggtccttgcaggggggcagcgtctggcagtggacgtgcaccggcgggggcggggggctgggtgctggcatcggctggggtgcctcggcggggtccgagctcggcggccctcgggaggggtgtggggccacggcttcgtacaggctggaggaagcagggctcgcctggcttgtgatgggtctgcaaggagccctgtactgggctgagcgatggctacgccggcacctgcagaggtagggtgtccatgggagggatcggcaccgggtcaggaatttgtggcgcatgcggacctgtggtcccacggcactcctagcccctgctcacctccgagcattgtggtgcagcaggtgagcgtctggaccctcagccaggcgtgtgtggcctggctgcaggcctcgggccgggctgaaccccgctggtccggggctcgacctgcatggtggctcgacgacagagtaagtccggcgggtggataaatattaccaggaggtgattgattaattgcatcaaggacacatgataccagccagctccaccacgcaggctccgaagctcttgcatggcaatcctggtgccacaaccctgccgcacattattgggtcggtccggcaccaatctgcgagatcacttcatgccggccgaatcacgggtttccctaaatattcacaagttcattctagacattatgctagatttgcatgcaccgaatatctcggcatggcatggtcctcctccatggcaccgcggctcaggcaatcacgccatcaagaggattgagtgtgatgctggcgggaaatttcgagaggttcaacatgatgctcgacagctccccacatccgagggcgacgatgtggtccggtgccgccgagaatactgctggacacatggcgatgatgctttgagggagcactcggtctcgcgaacacctgggttgagttttggaagtgatccgatggaggccggctactccgagaacacgtcgctgaatgtcagcagcgcagcggtaagtgatgctgatgctgatggattggattaaataatagggatttatgtctcgacaggctctgtaatgacccgccgcgcagggaccctccaaggcgacggccaccagcaaggccagcaagaagaagaccatcgagcagacgtaccagaagctgacacagctagagcatgtgctgctgcgcccggacacctacatcggcagcactcagcgccagcagcagcagctgtgggtgcacgatggggagaggctggtaaaccgtgcaatccaggtgtcccccgggctgtacaagatctttgacgagatcctggtgaacgccgcggacaacaagatccgcgacccgaccatgagcaccctgcgagtggacgtggatgaggtatgagggattggaagccctcaaggcagggtcaagagttgccatgccgatccgggcagtgcagagaccctgctctgctggtgactgctctgcgccaccgcccagctggaagtcacctctggcacctgcctccaccctgtcagctgaacggcagcatcaaggtgtacaatgatggcgcgggcgtgcctgtggaggtgcacaaggagcacggcgtgcatgtccccgagctcatcttcgggcacctgctgacctcttccaactacgatgacaaggagaagaaggtgaggtcgaagtgcagtgggacgttgttgagcatctgtggatcttctggcatgcaaagaaagtaggatccaataggaatgcccctagttggcgtcaagggtgcctccattcgctgcnnnnnnnnnnattgttgagtatctgttgatttcctggcatgcacagaaagtaggatccaacaggaatgcccctcgttggcgtcaagggtgcctccattcgctgccagccaataccccaaaccatccaccctcgttgccatcattcaggtgacgggtggccgcaatggatatggcgccaagctggccaacattttctctaaagagttcatcgtggagacatgcgatggtgctcgcaagcggcgctacaagcaggtctgtagcatcacagggaaggttgggatgtgaagttatctgtggatggcatcctggtaaactcgagaaacgctggagactgagcagaggttggtccctcccaacagattgattcggttctactccttnnnnnnnnnnacagttcacccatcccacccccctccgccacttgctgtacatacctttccgtgctgcagccccaggatctgcttgatgttttggatctctgcannnnnnnnnngatgtgtgggaacctcttccctgctgagcagttgtgatgtcatcccgtcctccccagcagccaataaactgtggtctgatccagacgtttgaagacatcnnnnnnnnnnagtgaccggacactttcccattgattgtgagaagagggtagggccaaaaaacctgcagatcagctgtacattttgagcgtccnnnnnnnnnnttcccggtgatctgtgcagtccccgcatccctcacgtttagcagcttgcccctggttgtgtagagaggtgaccggagacttccccattgatagtgagaggagggtagggccaaaaagtctgcagatcagctgtacattttgagcgtcctgctcattcacaagcatctgccatccaagctggggcggaggatgcaccccccagagagacagtcctttggtcacagaccccaacgcctcagcagtctgctcccctcactccgatcccgagcatgccactacctgagggggaagacgccatacttgtctctgccgacaacactgagccccgagatggccagggttttggccgaatctccctcggtcaggatgagggtgcacgccgccgaattgcgcccaccagcgtcgttggcgtcgtccagcttgggaatgcctggtgccggaaatgtggatgtcaatctgtgggaacctcttccctgctgagcagtcgtgatgtcatgccatcctccccagcagccaataaattgtggtctgatccagacgtttgaagacatcggatcttcaagacctctgctccctaatcacgctcgagggtctactccagcaattcaactccaagtccatcctctgccacccgcacctgtgagacgggagcgcttggctccatnnnnnnnnnnctcctaatcacgcttgaaggtctattccagcaattcaactcccactccatcctctgccacccacacctgtgagacgggagcgcttggctccatcccccttcttcagctccttgtccgccttgaaggatgccagacgcaggatctggtcaacgacgccgctcgtggcgaccttcttcaggatcccatccgacaggtggcaggaggaaccaaagccgctggctaggagggtcatggtctccttggcctgcgcagaggaaagggggatgtgaatgtgctgctccaaggtgccatgcgtaagctgtcagcatgtgacctggcattttcctgggtgatagtcctgccacggctgttatcctttcctcacaaaccccaaacgaatacgggaacaacgagtccttcccaatcctacctgcgagtcaaaggccgggttttcgatgaggcagttgacgaacacccacaggtagctcttcaccatgtgcccttttactgtggcctgcgcgtgttgaaggcatnnnnnnnnnnccacaaatccccaaagaatacaggaacaatgagtccttcccaatcctacctgcgagtcaaaggccgggttttcaatgaggcaattgacgaagacccacaggtagctcttcaccatgtgcccctttactgtggcctgcgcgtgttgaaggcatttagatcagttgttgatggtcggcacatgaggcacactcatcattcccagtgcccagatctgccaactgcccactttcccgcatcatacgcacacgcaagcaggccatatctatgacactcaaccgacctgtttgtgcttcttggccataagctccagcaggtgcttggtgacctgtgcctccacggcgttcacatgggtgccgcccttggtggtgcagatggagttgacaaaggacacctgctggaactggccatccgactgcgcgattaccacctcccagcggttgttgatgcgctcgtagaaccgtggtggaccctcctcctgcaggcgaccggaccagggacagggtggggccaggaatatgtgggcaatcactggagtactgtttgcatatgcccgacaggcatatatgcccaaagagcaccctgcaaaagtccatctactggcacatgcccacgatcaggaacaccaaccggcatgagcccatggcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaggaaatgcaggattcgtgtcagctctacatcaactgggatggttaagcgtctggaatgggtctgcttgtcccttcgcatgcctgttcccactcatgcctgcctcaagcactgcggactgggcttcaaccaaacacaccttgacggtcttgcccagaacgccnnnnnnnnnnagcatgtacgcccaaagcgcaccctgcaaaagtccatttactggcacatgcccacgaccaagaacaccaaccggcatgagcccatggcctgcacaccttgtctccgaggtacatgtccacgtaggcggagaagtccctgacaggcagcatcttgccattgtaagacacctgcaggaaacgtaggattcgtgtcagccctacatcgactgggatggtcaagcgtctgggatgggtctgcttgtcccttcgcatgcctgttcccacccatgcctgcctcaagcactacggcctgggcttcaaccacacacaccttgacggtcttgcccagaacgcctgccatgtcgtatacacgcttgcggaagagagtgatggtgtcctcctccaaagcggccatttggaacctggtgtgggaaaagtatgggacgtggagcacacgggtcgttggtacagaaaattgaagaatgaaacagcagagcaagctgactgcgagaagggnnnnnnnnnncaaggccacacccgccagttatgtgcgctcacctccccacctttgcaacctcgtcccgcgtaggtgttcaagaataacatgtctgagaagggcgaaccccaaatcacaccatgctcatccagcgagaactggacttgcatcacctttaagcctgacctggagaggtagatggcgatgtgctgagtttgccggtggccgaatgttgggaagtctgcgagcaggcttggaccccccttctcgcagtcagcttgctctgctgttcattgttcaattttctgcaccaacgaccccctgcaccacgtcccatacttttcccacaccaggttnnnnnnnnnntggaccaacctctgctcagtctccagcacttctcgagtccaccaggatgccatccacagataacttcaca

SEQ ID NO: 45723 - DNA, 63 bp, Chlorella protothecoides
ttggtgggccaacgggcagtggcatccatgtgaatcacgctctgtggctccgggggctgcatg

SEQ ID NO: 45724 - DNA, 159 bp, Chlorella protothecoides
tgcaatggccagcacttaatcatctaagcgttgtgatgcaacacaggaccatcccttcgattcttaatcacacttgcccctccccggatctgccagactcacacagaataggatcaccagatgctgcaccacaggtacagcgcacggggtgagccgagc

SEQ ID NO: 45725 - DNA, 104 bp, Chlorella protothecoides
tgggcgacggccttctccggcatagtgacgaccgtgcgatcagacccgcggcaagttgtgaaggaagatgacctttgggaaaagaatcgtgcactccccacatc

SEQ ID NO: 45726 - DNA, 70 bp, Chlorella protothecoides
atctaccaggaggtgggcgttttctttttcatttttttttgggggggggttgattcttgtaggggatcgg

SEQ ID NO: 45727 - DNA, 104 bp, Chlorella protothecoides
cacatcttccaggcggatcgagaccagtaattcacacccttgcgccacacctgcaggagaagctggagaagaacggtccgtttgcagagtatgccaatgtcaag

SEQ ID NO: 45728 - DNA, 61 bp, Chlorella protothecoides
ccataaaacgccatgagacgacacctgcagggcttgtggggggaggaaggggctcgatgca

SEQ ID NO: 45729 - DNA, 79 bp, Chlorella protothecoides
gccatgggatgggggagacgtggctgacatgattcgggggtgttagaatcgcctggacggctgaaggtgtgggtgcagc

SEQ ID NO: 45730 - DNA, 72 bp, Chlorella protothecoides
acgccgcgggaagctgcttgatcgtgcattaaaccccatgctcgcagagaccggcagcgggggccgcctcct

SEQ ID NO: 45731 - DNA, 109 bp, Chlorella protothecoides
accctgcatggggcacggaatgtgggaaggcaggaaggcatgtgtgtgtgtggagaagggggggggaaagggagaacaagtggctgcatgagtgcacgaagtaagccat

SEQ ID NO: 45732 - DNA, 64 bp, Chlorella protothecoides
ggcgaccaactgattcgcataggggtgggacacacatagaggagtgattcaacgtcacactgat

SEQ ID NO: 45733 - DNA, 77 bp, Chlorella protothecoides
cgctgcggtgagaccagggacacaatctttcccgatctatgcatgcgtatttacagtactcataatgcattggtcca

SEQ ID NO: 45734 - DNA, 66 bp, Chlorella protothecoides
ctcattcctccctctgtgccattctccatcccacaggcgggcagtgagcaagggacccagtcctcc

SEQ ID NO: 45735 - DNA, 61 bp, Chlorella protothecoides
gcttgacccgggggaaaagccacctgggggtgcagactccggcaccaggtcactgcgcagt

SEQ ID NO: 45736 - DNA, 61 bp, Chlorella protothecoides
gagctcgcgaccctcatacgaaacggctggtgtgcatccatgctcttgatcagatctcaat

SEQ ID NO: 45737 - DNA, 61 bp, Chlorella protothecoides
caatacatcgcctagtgtcctatgccagcaacctttgcagcctctgtcacccgcaactccc

SEQ ID NO: 45738 - DNA, 70 bp, Chlorella protothecoides
actgccgcactccgggtgagtggtgtcggggttcccgacgccgcgtgagaattctccggaaggggagctg

SEQ ID NO: 45739 - DNA, 74 bp, Chlorella protothecoides
acctcatgctgagcgtgctgggagtgtttcagatagagctgatctctcgacacccgtcgcctgcgacgagtcag

SEQ ID NO: 45740 - DNA, 87 bp, Chlorella protothecoides
atgagcaggaagaagctgtgggagtgggttcgggtgtttgaggggggggcccatggcggagaagggctgagacactggccgcggcat

SEQ ID NO: 45741 - DNA, 61 bp, Chlorella protothecoides
ggcgcccaagaaacactggaggtggtggtcggcaaggtctatcagccccccattgtcatgc

SEQ ID NO: 45742 - DNA, 61 bp, Chlorella protothecoides
atcggcagcggatgcgtgtagaaccaggggtgctgtgcgaaggttggggagatggaggagg

SEQ ID NO: 45743 - DNA, 77 bp, Chlorella protothecoides
agtgcgtacgggtccatggcgcgcggctggaagagtacatcgcatgaaggattatatgcaacccttaatagtttatc

SEQ ID NO: 45744 - DNA, 76 bp, Chlorella protothecoides
ttggcaccagctggatgatgcctgcgggtgtgtgtgggggttgagggtggtgtgcatgtgtgatgtgttgccgggg

SEQ ID NO: 45745 - DNA, 79 bp, Chlorella protothecoides
tggtgtttgggggccagatgcgtgagcggacgacaagtatcgattgcctgcgcatggaatccctctccaaggagtgaga

SEQ ID NO: 45746 - DNA, 61 bp, Chlorella protothecoides
tcaataagacgcaaattacatggatggagcgcccgccagtgtcagcagccttggcgacgct

SEQ ID NO: 45747 - DNA, 61 bp, Chlorella protothecoides
tcaacgcgaggtgatggtttgtaggcggaaaatttgcgctccacgtagtcgtacaccaaga

SEQ ID NO: 45748 - DNA, 154 bp, Chlorella protothecoides
gcagccggacagccaggccagttcctgcgagtcgggaggcgcatcatgcctgcacggcgatgtcggggagggaggtgggatttgagggggtcggtgatgtggtgtgcagaacgcagtatgaccaggagtagtagtctctagaccatggcacgaa

SEQ ID NO: 45749 - DNA, 61 bp, Chlorella protothecoides
caggaataagcgattcaagaagcagcaaactgcagaggacaggatctatggcgtgtttgcc

SEQ ID NO: 45750 - DNA, 61 bp, Chlorella protothecoides
actcaggttggtgtcagggatgtggaagagctcggggcctcttcccatgaacccgtcgagg

SEQ ID NO: 45751 - DNA, 66 bp, Chlorella protothecoides
atagatctgtttctgctcgtgcacctgattgtaaaatgtaagggacatcgagccaaaacataaaaa

SEQ ID NO: 45752 - DNA, 106 bp, Chlorella protothecoides
ccaccagggatgggaggcgcccccagatctaccctgggaatgcagcgcaggcgcttcccagcggtgccggccactccttgagaacgcctgccgcaccatccagaaa

SEQ ID NO: 45753 - DNA, 132 bp, Chlorella protothecoides
gccccgcaccagccacgcgtcggccgggccgggctgggaggtgtgtgtggtgggcgcggcagcattgggacggccgggctgggctctcggaatgcccaacagtggggcggcacccccttggctggccaatgg

SEQ ID NO: 45754 - DNA, 61 bp, Chlorella protothecoides
gacctgacttcagtttcttgtttgtctccttcagcagggagatgtactccttgttgtcgtt

SEQ ID NO: 45755 - DNA, 64 bp, Chlorella protothecoides
tcctgtgatggtgggggatgaggatgagattgtggtgccggtgagcatcggcggcgccctgtac

SEQ ID NO: 45756 - DNA, 148 bp, Chlorella protothecoides
cgagtggcatggggagacttctttgcagaggttgtggtggtggttgtgggggaggaagaggtgctgcggtttggaggagggggatgggtgaactgcaccacgggggttggaggagagttaatcttgttgccgtactcgtcaaagtagt

SEQ ID NO: 45757 - DNA, 61 bp, Chlorella protothecoides
gacgatccctcggatcagtcactctcccgggaaaagtccctgttcgaggcgatgggcaccg

SEQ ID NO: 45758 - DNA, 61 bp, Chlorella protothecoides
cacccagccgcgccgcgtggcggccatgtcagtggccaagcgcgtgagcgaggagatgggg

SEQ ID NO: 45759 - DNA, 80 bp, Chlorella protothecoides
acatgatcctaaggccctcgttgaatccggtagtatttccaggcaatcctccctctcactcacgtcgagcccagcagcga

SEQ ID NO: 45760 - DNA, 129 bp, Chlorella protothecoides
ctggatgccagcaactgtgatgcatatgctatctgctgacctgaacagggctcatgtccaatgtgcacaatctcacatggcagggcacatgttgtgttgtcccctctttcatgcattcccaatgctcct

SEQ ID NO: 45761 - DNA, 79 bp, Chlorella protothecoides
agatgggggcggacttggtattggaattggcaacgtcgacggggttttggaataggtgtggggagggctatatagacag

SEQ ID NO: 45762 - DNA, 74 bp, Chlorella protothecoides
tcgttgagctcgacgagttcaatcagcccctcattgtcacgctcaacgacggcaaagtctgaacgccgagcctg

SEQ ID NO: 45763 - DNA, 61 bp, Chlorella protothecoides
gcctcattccgagagaaggaggccgatgatagcatgcaaattccgtcgagcaccccaatcg

SEQ ID NO: 45764 - DNA, 61 bp, Chlorella protothecoides
agggctgcccatgctcaggttcgttgtgaacgtccaactgcagacctacaaaggctccgct

SEQ ID NO: 45765 - DNA, 69 bp, Chlorella protothecoides
cccccccccctccctgcacatgcgcctcccaagagtaatggccgccctttccagcaaccgcccctctcc

SEQ ID NO: 45766 - DNA, 61 bp, Chlorella protothecoides
acggctccctgccaagaagcggcgccgaccctgctcaggaatgggtgctcacaagccatac

SEQ ID NO: 45767 - DNA, 61 bp, Chlorella protothecoides
gtgagattgccccgtccaacacaccagggaaggcctacttacagcaagttggaccctgcat

SEQ ID NO: 45768 - DNA, 61 bp, Chlorella protothecoides
ggacgtgaggggggcatggcctgtggcaggtgtggaggaagcttcccagccctcagcaccc

SEQ ID NO: 45769 - DNA, 62 bp, Chlorella protothecoides
gtgtccttttcctcgctcatgggcttcgcaccgttgccatgcaggccgaatgcaagtcttcg

SEQ ID NO: 45770 - DNA, 61 bp, Chlorella protothecoides
gacaacctcaaaatgctctgcggagaatcgccactccagaaggactgattgggtggttcgt

SEQ ID NO: 45771 - DNA, 104 bp, Chlorella protothecoides
cctgagacgatccagcctgtcacatacactgttgcgatgcccaggagaggtgaattcaggggcaggcggctagccactgcgaggagcaggggtgactcattaag

SEQ ID NO: 45772 - DNA, 61 bp, Chlorella protothecoides
tatcgcacgagtcctgagctaggaggcagccatggcagaaggtaccattactgtgcagcaa

SEQ ID NO: 45773 - DNA, 61 bp, Chlorella protothecoides
gggattctctgaagaaaaaaggggggggggagggggggaggagattttccaagagcagtga

SEQ ID NO: 45774 - DNA, 65 bp, Chlorella protothecoides
ttcaatccctcgaggattgcaaaagcaaaactcaccgcggaaattcgaagaccgcgctgagcgcg

SEQ ID NO: 45775 - DNA, 86 bp, Chlorella protothecoides
gccggcacggatgcactgcggaggggtacaaggtggtgtggtcttgccgctggtgggtctctgaacaaccaggcccttcagcaaac

SEQ ID NO: 45776 - DNA, 61 bp, Chlorella protothecoides
tgttcctgcgacgatgagggtgaggggggggggacagtgagtcggggtgcaaacacgcaca

SEQ ID NO: 45777 - DNA, 69 bp, Chlorella protothecoides
gaaaggctggggtagcacactcccataggatatacgtcgtgcaagccagacaggatacagcagacacac

SEQ ID NO: 45778 - DNA, 61 bp, Chlorella protothecoides
gtaggtggaaagcatggcagtatggagacataaaggtacaaggctcgagggtcgctccctt

SEQ ID NO: 45779 - DNA, 74 bp, Chlorella protothecoides
ccctttcttcggggagacctatattctatctactccccccccgaggacgagacccccgctcccctaccgccttt

SEQ ID NO: 45780 - DNA, 69 bp, Chlorella protothecoides
gattccagcatgtcgcatgacataatgtgctgcccccccccagggaatgctgaggaaatggtcaagcgc

SEQ ID NO: 45781 - DNA, 19652 bp, Chlorella protothecoides
  modified_base (410)..(419): a, c, t, g, unknown or other
  modified_base (654)..(663): a, c, t, g, unknown or other
  modified_base (1152)..(1161): a, c, t, g, unknown or other
  modified_base (1246)..(1351): a, c, t, g, unknown or other
  modified_base (1563)..(1572): a, c, t, g, unknown or other
  modified_base (1930)..(1939): a, c, t, g, unknown or other
  modified_base (2468)..(2477): a, c, t, g, unknown or other
  modified_base (2890)..(2899): a, c, t, g, unknown or other
  modified_base (4421)..(4430): a, c, t, g, unknown or other
  modified_base (4829)..(4838): a, c, t, g, unknown or other
  modified_base (4905)..(5166): a, c, t, g, unknown or other
  modified_base (5908)..(5976): a, c, t, g, unknown or other
  modified_base (6645)..(6654): a, c, t, g, unknown or other
  modified_base (6874)..(6883): a, c, t, g, unknown or other
  modified_base (6968)..(6977): a, c, t, g, unknown or other
  modified_base (7331)..(7416): a, c, t, g, unknown or other
  modified_base (7603)..(7681): a, c, t, g, unknown or other
  modified_base (7871)..(7880): a, c, t, g, unknown or other
  modified_base (8131)..(8140): a, c, t, g, unknown or other
  modified_base (8424)..(8433): a, c, t, g, unknown or other
  modified_base (9601)..(9610): a, c, t, g, unknown or other
  modified_base (9786)..(9835): a, c, t, g, unknown or other
  modified_base (9904)..(9913): a, c, t, g, unknown or other
  modified_base (10332)..(10341): a, c, t, g, unknown or other
  modified_base (10579)..(10588): a, c, t, g, unknown or other
  modified_base (10883)..(10892): a, c, t, g, unknown or other
  modified_base (11922)..(11931): a, c, t, g, unknown or other
  modified_base (13250)..(13259): a, c, t, g, unknown or other
  modified_base (13841)..(13850): a, c, t, g, unknown or other
  modified_base (15556)..(15565): a, c, t, g, unknown or other
  modified_base (15932)..(15941): a, c, t, g, unknown or other
  modified_base (16632)..(16641): a, c, t, g, unknown or other
  modified_base (17123)..(17144): a, c, t, g, unknown or other
  modified_base (17211)..(17220): a, c, t, g, unknown or other
  modified_base (19017)..(19026): a, c, t, g, unknown or other
ggcggcgccgcgcggcgcgcatctccccgggcatcgggcgcgcggcgcgggcggcggccgccgcgggccagccgtccagccccaccctcaccacctcggcctccatggagagcgaagcgcacagcctggggtttggatcgcgggaggccctgcgccacctcaggtgcggagggagggggaaggtgtgtggggggtgggagtgcacggggtgcaggaagaggttggtagaaaaaactccttgacaactcatgcggggccggtcgccacagagcgcgaggtgtcgtcggcatgggcgctcccgtgttcaccacgccgacggcggccctctccccctgtcaataggcacgacatcggtgtcgaggaggttcaggagtcggctcacgcccgactaacggggctgttcgaccccnnnnnnnnnntgtggccctctccccctatcaataggcacgacattggtgtcgaggaggttcaggagtcggcccacgcccgactaacggggctgttcgaccccgaacccgcctgcggcctgtcctcccacgctgtggattcgagagatttgggcagttgcgcccttgatggcacgatggagagggcactgtcgtagccaacgcggtagactctttccaacaaagctcctgcgccctcgtcgcacgnnnnnnnnnnttggattcgagagatttgggcaattgcgccatcgatggcacggtggagagggcactgtcgtagccaacgcggcagactcttcccaacaaagctcctgcgccctcgtcacacgatgggttgtgccacgtagcgtgcgtgcctgccgccctcgggcacactcccccaccctccggcacaagtggccggtgttgaccccgccctcccccatcccatgccctgcagcaatcccttgctcttgcatcacgtgatacgccttgcccctttcggcccttttgaccagcaagccgcccgccagacgagagcgaggcgggaagagttttctctgaggtaacgtggtaaagcatgcgtccattccactgctccctcaccttctcctgcctcggcagagcccaccagcccaaccgcttcctgcataggacccacgtcaacagaccgccattggtcatttcaaaaccagcactttgttgatgccaggtgcaccttgccaannnnnnnnnntgcccgccagacgagagcgaggcgggaagaattttctctgagataacgtggtacagcatgcgtccattccactgctccctcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgccattggtcattccaaaaccagtactttgttgatgccaggtgcaccttgccaactcatcaacattggtacttggacggccagacgaggctggcatcgtgaatacgatggtgtcggatgcaaagtacgggaaaatcgctagctttttgcagctgtagttgtcctgcgcgcgcgaccagtgctcggacttccgacgaggcgtgtagctgcnnnnnnnnnnagatgcaaagtacgggaagatcgttagctttccgaagctgtagttgtcttgcgcgcgcgaccagggctcggacttccgacgaggcgtgtagctgctgaaaacaagtccctcgcgcatggtgggtaaattgtaacgcgagtctggtactctacaagcacaagcaaggaataattctcatccagtggacgccctgtgcgggttctcctagtcaaggccgacgaccagatacctatcacgcgaggtggcgacctagctctcgctagaccgtcgaagctcctcacaacggactcgaatattttataactgcaatctgaggacttgagtacccggtgatcggctcgctgcgatcctgtctgannnnnnnnnncttttctaactgcaatctgaggacttgagtactcggtgatcggctcgctgcgatcctgtctgaagtggggatcggtgcctgcctcaccccacactcgggacgcaatctgtctgagagtctgatcgcacggggcagctttgatccatcagaggactggtgccatcagcgtggtgtggacctggctccatgcgcccgaggttcgggccaggcgaggctgagtcctcacgggccaccaccaccagtggctcagcccccgtaggcaccatccgcaaccgcagcgacgtgttcttcaggtaccgtcgaaacgcccgtgcgggcagcaggcccctcctctcacctggagcgtcatcagcagcactcgatgggtgaggcggccatggaagatggtcctgcggcgtcgcagcggggtctggaggacaagggatgctggcctgtgccaaacaggcagagatggcgtcaattcacccctcaaacccggcccacgccatggcttcctcacaggaacgagacggcgcggctcatggcatcnnnnnnnnnnacctggcccacgccatggctccctcgcaggaacgagacggcgcggctcatggcatcggcgctggggggtatgtcagatgccgaggtgggccccgagccgcctcagtacgtcactttccgagaagctgcccgagccgagatgctcaccatacgcaccgagatgacggagctgaggggcttgcatgggcgggccaccctcagcaggtttgacgagagcaacgacgacgagatccaggtgcagcatacgtggcagggaggggtgtgtggtttaccttggttcgtcatgagggaagctgcatggggggcagttgtcattgcggcgaggttgctggacccatccacgttggtatctaatgcggtgcaggagtacttgccgttccaggttaacatggtgcacccctccaaatgccattnnnnnnnnnngatgcggtgcaggagtacttgccgttccagcttaacatggtgcacccctccaaatgccattgcacaaacaggtggaggtgacaactcagcagatcaccaagctcttccgacgctgcgaggcgcgtctccagaagtttgggtctgtgccgtcggagaacgaggccgacgagaaggtgcgatgcggaatgttgcctgacctgcaatcgtgcactgggtctgcagcgtccgctgcttttgtgtatccaggtagagtctaccttactacagaatccccttctgtcgacctttagcatcaatgccccagaggccggctgtttgcatgcttaaagtctcttgcttcatacacaacatctggtgctcagatccctgcccgacacattaagaattccccatccacctacccatccgcccccctactcccacacccgccacgatgcacaggtgaagcgcaacctgcagcggaccctggctgcggagctgcaggagctgtccatccagttccgcaagcagcagaaggcctacctggcccagctgcggcggcgcgaggcgggcagcgccgcccccggcggcgccctgggcggcctggctctggcggcgcgggacggggactacgacaccggcttctcgagccagcaggcactgcaggccgacacgctgagcgccctgatcgatgaccgcgaccgcgaggtggcgggcatcgtggccagcatccacgagctggcccagatcatgaaggacctgtcagtactggtgatcgaccagggcacggtgctggaccgcatcgactacaacatggaggccactgccgcgcaggtgacggagggggtgaagcagctggccaaggccgagaagaagcagaagcagggcctgatggcggtgtgcatcatgttcctccttgtcgccatcggcatcctggtgctctttgtggtcatcaaggccattgtattctgaggcgtgccccggatcccgagccggggcgggcaccccgtcgatggctgtcggcgcgggggccgcgggggggaagtggttcccatgcacatcaccgagggcacgctgttggtctgcccgatgtcacatcatgccccccctgccactgccactgatgtgaacatgctcactccggggggcagcgggggcatccatgtccgagatcaaatcttggggacgccgggtcacgccctccatcgggtgccccgcgcgccgtagtcgcaacagttccggcaataactctggaggcccagactcccgacgagcacagcagcgttccccaacctggctaacgaccatgtgctgaacaagaaattgtgcgatggagacggactacgtcaaggcacagatttcggggcagaagggagaggtgcgccgggggaagtggtgggaagggtttcagggttcgtctcccgtcggcgaggatcaggcgacagcttaccttcgggcattctgcaggaccgaatcatagccgtgcatcgagcctggcctctggatgacggtgagggcgtgtcggtggtgggcaccgcttccnnnnnnnnnncgaggtgcgcctggggaattggtgggaagggtttcagagttcgtctcccgtcggcgaggatcaggcgacaccttaccttcgggcactctgcaggaccgaatcatagccgtgcatcgggcctggcctctggatgacggcgagggcgtgtcggtggtgggcaccgcttccgagtccccgaccagcaatttcctgcaagtctggggcggtctcgagcgggatgcggacgccagcaggtgcgctgcgtgcgggttcacgggacgcagggatgattttcagtgtgtttccagaggaccgcggggccgtcggatgcccgtgccctcggccctgaccccccacccgctcccccaccggcttgtccctgcagcccgacgacgggccccgagtaccacctcttcgccnnnnnnnnnncccccaaccgggctaaccaccatgtgctgaacaagtaattgtgcgatggagacggactacgtcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccagaggaccgcggggccgtcgggtgcccgtgccctcggccctgaccgcccacccgcacccccaccggctcatccctgcagccccacgacgggccccgagtaccacctcttcgccgtgttcgacggccacaacggcgacgccgcctccaccttcgcccagtccagcctggtcccggtgctggaggcctacctccccgtccccgagatggtggagggtgtggacggcgccgcggcctgggccggcgcggtgcaggaggccatggtgaagacgctgctggagatcgaccgtcgcttcgcggcccgcggggcgacggggggcaccaccgccaccctggtcctccagattggccagctggtgacctgcgcgtcggtgggcaactcgcgcgcggtgctggacacgggcgcggggcgcgtggcgctgacgcgcgagcacgtggtggccagcaaccccgatgagcgcgagcgcctgctggccgcggggtgcaccctggcgcggctggacgtcgccggcggcggccccgccgtcatctcctcgcgcggcacaggcccgctccgcgtctggccgggcggcgtcacgctatcgcgctccctgggcgacttcagcgtgggccccgccctcctggctgtgccacatgtggtggcggtcatgctgccccccgccggcggccgcatcgtgctcgcctccgacgccgtgtggaaagccggcgtcgatgcagtgctggccgctgcggccgccgcgcnnnnnnnnnnnnnnnnnnnnnnnnnnnnnnnnnnnnnnnnnnnnnnnnnnnnnnnnnnnnnnnnnnnnnccgcgcatgccgtgctcaaggcgctcgggccgcgcctgcgcggcgatgcctcggtggtcgtggccgacacgctgccgcgcggagagaccttcccccagctggctgcgcgcctggcgcagggggggggagggcgcgcggggcgccccgcgcccatgcgcgcgccctccgcatcccgcctctggtccctgctcaagccgcggcgggcggaggaggcggcgccgccggcccccgccctctccgcgggggaaggcgggggcgcgcgcgtgctcaccgactgcgacgtcgccacgcttatgggcctgaccacgttgaccctgggcgaggacgacccccagcccatctggtacgaggactgcgttgcggaggacctgcaccaggccagggtgagcaggaatgtgtgtgtgtgtgttttggaggggaggggaggggagggcggaggtggggcgattgtgacgctggatggcctgtgacgacgggggacatgcgatcacctgggctgcggctgcgaggggcacgggtgtgtgcggcgccggctgtgtcccggtgggcagcgacttcgttgggtgagagacctgctgtcgaagagcgggatgcggtgctctctcacatcgttgaacaagccaccccgaggccagccgactggtctggcgagcgtgctggcacaggcannnnnnnnnngcgtgaggtgagagacctcttgtcgaagggcgggatgcggtgctctctcacatcattgaacaagccaccccgaggccagcccactggtctggcgagcgtgctggcacaggcaccagccgtgcttcggtcgggatggcttgacccctctttcccaacacgaactaccaccctccaccggctgctccctcacccacccacccacccttcctcctctccaccnnnnnnnnnntcccctctttccaaacacgaaccaccaccctccaccgtctgctccctcacccacccaccccaccttccccctctccacccccctnnnnnnnnnngcgtggcggatctggcccgctgcgcgcgccatggcgctgagcaacccggcgctggcctccctgcgcccctcccgctccatcggcacgctgtcggagctggtggggtggagcgcgccgtccagcggcgccgcctcgccgcgcggtggcgtgggccgcccgcccggccgcccctccttctcgcgccgctcctgcctgaagcagccgggggagtcgacggacggcggggccagcgacgcgctgggtgccggtcccggcggcgcctccagcgacgagaccctggcctcgcccctggcctccaagcgcgtcagcttcgcggcgggggagcgcaaccctctgcgccgcacctcctccgannnnnnnnnnnnnnnnnnnnnnnnnnnnnnnnnnnnnnnnnnnnnnnnnnnnnnnnnnnnnnnnnnnnnnnnnnnnnnnnnnnnnnggctccacgccgcccagcagctggctgggcggcctgtccgacgccgacgcgggcaacgggcgcggcggcgacgcgcccgcgcccctcggcggcggcggccaaggttcgggcagtgccggcatggcctccatgcgcagcctgagcctgcccctggccgcggggcggccgccgcggccccccggcgccnnnnnnnnnnnnnnnnnnnnnnnnnnnnnnnnnnnnnnnnnnnnnnnnnnnnnnnnnnnnnnnnnnnnnnnnnnnnnnnaccacgcgctggcgggacagctacagctccaccgcctcggtcttcaccaagcgcggcgcggcgcgcgagcgcgaccgccttcggtgacgcctgcaacggcgttgggcggcgccagccgcatggcgaggccccggccccagccggggtccagcgactcgtggccccaggaccccagaatgcaggccccgcnnnnnnnnnnggcctgcaacggcgttggatggcgccagccgcgtggcgaggccccggccccagccggggtctagcgactcgcggccccaggaccccagaatgcaggccccgctcgcctcattgcgttgacatttccgcttgcacacacacacacacatacacacacactatgttgcccggccacagccccggaaacccttgcaccccacccaccgtcctcatcattgcaccccccaccccccttgactgtgcggtccaaannnnnnnnnngttgcccggccacagccccggaaacctttgcacaccacccaccgtcctcatcattgcacccccaccccccttgactgtgcggtccaaagcgcagcggagggccgtgccctcccctcgccgtcagttttcccttgagcggtcagttgctgcggtaatgcatcccttctccctgccacttccctgaccctggcagcctttgtctagcccagccatcgtcctggttcacagcctgcagtggccccaaatcccgctccccttggcccccagcgccacccggactgtgnnnnnnnnnnttgaccctggcagcctttgtctagcccagtcatcgtcctggttcactgcctggagtggccccaaatcccgctgcccttggcccccagcgccacccggactgtgatgatctacgctgctctgagaatcaaagggccaggacactgaactgaatggaaaagggctggacggtcgacacaggggcatggcaagggggcatcgaaccccagaactcaggctcagcaccagctttgatgtaaagaatgcaaacacacccctggtgtgtactccagggggtgtgaagtgatatgcgtggcccaggccctgttgaatgggaaagaatcatcaatcctacgtcccttcccccgtctcccggccagatcttccgcccaggagggggtacagcagcgacaccctattcttgatctccttcaccgtgtttcgcgtgtccttccgaaggttgaccagctgcttggcagccttcctctgctggacgcgtgcggccttctggagccgcgcctcccgctgctgccaccaggcgatggtgctcgagatgtcctgtgtgggtgggttgcgtgaggcagtgttgcgcgagagccgatggaaagcaggcctccatcctctcagcccaggagggggtcgaggctcccatcacagggcatgccaaccttccgccccgcacgcacacacctttgggggcgcctgccacacctccccgtcctcttccagctcctcactcagctgggcctccgtgaagccgccgctggcggcagtgcccgacctcgccatcacctccccaagccactgcccgcccaggccggtcgtggcctggctgacccgctgcgtcaggtccccaaaggcagaccccaaccgggccaggggcgaggtgtcgaaccaggggtggcgcagcgcgccctgcgccgacagcctgtgtgtggggtggggggaggggatggggctggagggtgagagggtgtctggtgctgggcgtgattcttggaggaccactctgtcttgaagcatcaacactgtccgagccgctgcacttgatcgccagcgtcgcatgccactccctcgacatggctcgggggggccacatgagccctcagaagacatgctgggacacacccacggcatccatccacgggcccctgatcccgcgctttcctcacctgtcctcaggtcggtacnnnnnnnnnncgaagcatcaacactgtgcgagccgctgcgcttgctcgccagcgtcgcatgccacaccctcgacatggctcgagggggctacatgagccctcagaagacatgctgggacagacccacggcatccatccacggccccctgatcccacgctttcctcacctgtcctcaggtcggtacnnnnnnnnnnnnnnnnnnnnnnnnnnnnnnnnnnnnnnnnnnnnnnnnnnacacacatgcaggcccccgagcttgccatccacgctgctcttggcccacccccgcgccgtcctcacttnnnnnnnnnncgaaaacacgggacatggtgggagggtgcgtggacattgggccaggtacgcaacatgacgtgaacagacccgcttctgcaaccccaaccacgcatgcaggcccccgagcttgccgtccacgctgttcttggcccacccccgcgccgtcctcacttgttgaatgcaaccagggcattgtccgtcctcagcggcggcagggccagctgcagcatcatgattcccacagagtacatgtcgaatctgtctggcgagtttagcgcccagaccacgggcgacagcagggcagccaccggggccgcaggtgccctgcacagccgagcaagggggggtggggggagggggagtggttgaggggagcggtgtttaggatgcccgtctgggccggtaaggcgactctgttctgttggggcgccgccatnnnnnnnnnngtgcgtccctggccctctgtccaggcacccctccgaccatgtcccgtgctttcacctgctcaggcaactggcggacacatacaagcacgacctgcgggcatggcgtcgggcgcgggagcggcgaggaaagaaggacctggccgcggggctggccatcctggatgcggacgggggggcgggctgggacctggcgtgcaacctcgtgcagtaccgacctgaggacaggtgaggaaagcgnnnnnnnnnntggtggggggaggggggagtgggtgaggggagcggtgtttaggatgcccatctgggccggtagggcgactctgttctgttggggcgccgccatagaaacatgcgccgagccccagagcgcagtgctggctgccagctgggctgcagcaagggctggggtggctagcaccatgcaatggcgcatcgcaaacaccagcaggcaacctgatgacccctgggacgcacacacagcccggccctgtcacccccaggcaacaccctccaaagccacaaacccacatgccaccaccgccagnnnnnnnnnnttgatgacccctgggacgcacattcatccgggccctgtcctccccaggcaacatactccatagccacaaacccacatgccaccaccgccagctgcccggtacctgggtgtgtgcttggacatgatgtactgctggggcggggcgtatctcgggtccagcaggtactggttcggcacgtagtttattccgatgcgcaggtcggccgccgcgccaaagtcgatgagcttgatgcggcggtccacggtggagacgatgcaattgtgcggcttcacgtcgcggtgcacgatccctgcggccgcaggggaaggcgacagcagagaggtgctgagtggaggagggcatccccaggacatggcacttctcacgggactccccacccctttttttgtgcctccagtctcaggcaggccagccgggcacctgtggagtggcaggccgccaggccctccagtaactgctgcatcacggtcttcagcaggaacacctggccggccacgccgggtggcacgacgctggggtcctcaaacagcagcggcgccaggcactgggggaaatccttgcgcaccatcagctccgccagggtgtgctccccctcgaactgccacaccagccagagcgggtcggttgcggtgcgcgcgctggggaactccgtgaaggcggccacgaagtccgccacggccaggggattggtgcgggccatgcgctcattcatccacgcctcggcctcgccaaattcggtggccttcttcaggatcacgggcctttttattggaggagggggggggccaagggtgagtcaacagagctcagagaagcatggtggccaagcatgaccagcccatgtcttggggaacgatgccagttcttcacatggagacacacagaagcctgggggagctgtttccagaagtccattcctccctcacggcagcaacacccgcatggtattgccggactggcaacccagcacgggcagcctcgcgccgccacctgcaccagccccacaccagcatcccactcaccgggtctnnnnnnnnnnacccatgtcttggggaacgatgccagttgttcacatagagacacacagaagcctgggggagctgttcccagaagtccattcctgcctcacggcagcaacacccgcatggtattgccggacgggcaacccagcacgggcagcctcacgctgccacctgcaccaaccccacaccagcatcccactcaccgggtctctccggggcggcgagggtccttcatctcagccctgtacactgtcccaaaccctccgctggccaccttcttgccgacagtgaagtcctcgctgcagtagggctgggcacggagtcgctggagcggggccttgatgtatgtgtcgatcgcgccggggaggacaccaggggtggcgaagaggtacaccaggaggcccaggcacagcacgacgccctgggggttgatccccttctgctccaaccgcagcacaggatccagggtgctgcaagggggatgaggggaggccaaaatgcgtgcggggcaggctaccagggtggcgatctccagtctgcagcctcatccaggtctgatcgccctggcggaggcatggcatacccttggcccgtacctaccttctgtggacctggtcgccgcagttctgggtgtggcatggcagaactacgggctcgtaggccaggggcagcagggccagcccggtgttgaagatgtggagtagatcgaggctcgaaagggcatgcgcaatgtgccttgatcgacgcacccgagctggccggacattcagggcgccaaggcgaagagtctgagcgggcaggacgcctggccgttgcggcatgagtccgaggggcctcatcgtgagcccggctcgctgcatcccatgcgtccacgcttgagcgccgctcacaggtgagaaataaacggagtgaccctatgagcttatgcgtgctggacagttctgcatgagttctgcgcgggtggatttctacgacgacatgaccgcctggatccgcaatctgaatgccaggtcggcattccggggcggggccatttccccgcgccgatggaataatcgtgccggaacgagtcagcctggcccccatgtccgcactccagtgtgcttaaatccctaatcaaatcacggatcctgggccgtgatccctgcaaatctatttgtattgtcgatctttcgcacgcgacatggcggacctcctcaccctcgcctggaagcgctacctgtatggcttgcactaccaccccatcaagaccaaggtgagaggacaggacatcgcgggtccaaggggtattcctttgctgtctgcagatcaaccaggaaaccctaaccctcgcccnnnnnnnnnnagacaggacatcgagggtccaaggggtattccttcgctatctggagatcaaccaggaaaccctaaccctcgcccacactccgccaggctgtcactgccgggaccctggcagctctggcagacctggtgtcccagcgcattgcaggtgcaggctccatcaagtggcgccgcaccgccctgctggcactttatggcctcctctactccgggccctgctcccacttctggcagtactacctggagaagctgttcccagacaagcaggaccccctgcgcatcgtcaagaaggtggtggtggaccagctggtgtacgcccccttccagaacgtcgtggtgctggcctacctggcgaaggtggtggagggcctgcccctggtcgctaccatcgccaagctgaaagtgcagtggccgacagtgcaggccatgggatggagggtgagtgtgagggtgtgtacaggagggggaattgatgtgtttgtgatttaggagtgcgcctgccatgcctggcttcgcttgcatgggtcccaatcgcactctgttgcggaagctctggctgctcccagcagcgtccgagttgttcccnnnnnnnnnngggagtgcgcctgccatgcctggctttgcttgcatgggtcccaaccgcactctgttgcgaaagctcttgctgctcccagcagcgtccgagttgttcccaccacccaactaacgcatgccgggcaagccaaggcctccaataatcaggacacacaaggtcacgcctcatctcatccctgcctcccctgcagttctggcccttggctcagtacatcaaccagaagtacttccccctccagctccgtgtcatgtggctcaacattgtcgccttcctgtggggcatcttcatcatggtcagctcccgcagctccccactgccagctgtcatcaagaaggtctgaaaggcgggcagggcaaagccacccagaggcctggggcatgcgtcgaggcatcctggcgtgctgcccatccctcactgcctccagggtcacatttttgtttaatgaaccccacccaagtttttggtgctgtacacaaggcagtctgccccagcttgagctccgaacacagtcatgggaaataaatgaggggccaaaaattacagggcggctgatgttcatcacagacgctgggcgtgggtcccttgtatggctggcaagtactccttcacggtcgccttggccctccttcatggtcggtctgccccatgggcaacccaaacacggcagcttcgacgttttccaaccgggcagtcgagctcgttgtcatcgaatggaggagttcaatcgcccagcaatgtacccattgttccacgtgctctgcttgggggccgctgcacgcctggtgtcccatccttcgccctcactctggctggctgctgccgctgtcttctcagccctcaggatgctgcaaggtggagtacacatggtgattgagcaggtgcagagagtcaccagaccctgtgtaattgtacaactggggtatgtaatcggctgaaccacggggtgctgatcaccgccaaactctgcaaaaccccgccaggctcacctcaccacccacgtcatgagacgcgagctcttcagctctgctatgttttcaacctgctcaaacaccttggcctggccctggctgaggaagaggatgtgcgtcggccagttgtccagcccgtcaaagatgtgggtggcctggacgggaggacagggaggggctgagggacatgtggcgatgcagcgatacacacggagcggctggtggaccaggcttgcaaggtcgacacacccagtgcgagccatttcgatctcacaatcgcccaggcaggccaatcacatgcagcgctgcctgcgccaggagcgacaggtgaaccccgacacaggcgcggccctcccccaccaccctcacaccgctcacatacaccacggtcgcctgcctctccctgcactccctcctcaggaaagccatcaggctggagcgagccagaacatccaggtccaccgtcacttcatcgagcaagaggacctgcatgggagccatgccagaggttcaaggaccaggggagtctgtctctctcctgtgctttgggatcgggtgcaccaggttgcaaaagggagaagcaagctgggaccgtacgtgtcccgcatcgaggtagctcacctcagccctttccaacccgtgccccctacgcaacaccctgctcagatgcaagttcttgctctcggacaccgccatcaagcggtgcacctcgtccaggtcctcccacctcaaaggggnnnnnnnnnnccagatgcaagttcttgctctcggactccgccatcaagcggtgcacctcctcgtccaggtcctcccacctcaaaggggtgaaggaggcccatggctatctgcacacgccgacgctgcccgtcggacaccaggtgcatgcgccaggcggggttgatgtccatgacctccaacagcatcgcgcggcgagccgcgcccacgcccctcacgttctccagcatggcgccggcgctgatgtcggcctgcgcgggggcatgcatcgtttgtgagggccggtgtggctttggctttgcgcaaggtgcatgcagcatgaccccacgtgtgccatggattctgtgcacatgtgcttgtgtgcagctgcagctccagnnnnnnnnnnacggggcatgaatcgtttgtgagggccggtgtggcttgtgctttgcgtaaggtgcatgcagcatgatcccgcgtatgccatggattctgtgaacatgtgcttgtgtgcagctgcagctccagggcaaggcaccttgcttgacatggctttcaggtttggccagctgagcaggtttgctccttcaaagtcatgccatcaccatcacaccctgtggccggccccctcccaaacacttcgaccacaatgatcgatgccctcaccctgaggggttggctgtacccggcaaacgccacgtcctggtcccagttgcccccgatgtaggacaggcggttggaggtggtgaggtgcgtggcgtggaagggcggctcccccatgacctgcagcgcagcgcggtccaccatgtgctttccggccaggacgcggagcagcgtggtcttgcccgcaccgttggcccccaggaggagagtgcatgacccgcgggggagctgcagcgagagctggcggacgatgggctggtcgcctgggcggggctggccatctgtcgcgggtgggaatggggcttgtgatctgatgtgagggcggcggcgggagcgaggaggatatcttctcagaatacgaactgaatttgaggagataggtgggggtccaaattatcccctacgtgtcgttgcgccgggtgaggtgaggcccnnnnnnnnnnggggcggcggcgggagcgaggaggataccttctcaggctacgaactgaatttgagaagataggtgggggtccaaactatcccctgcgtgtcgttgcgccgggtgaggtgaggccccagacggaagcacacacgcacccaccaatagtggggtacgtgaaggtcaggtccctcagctcgactgctggctgatccatggcgacgcacgagtgcttgtgcactgatgttattgaagtctgagttgatcaggatttcggcaattacaactgcaaaaaacctcttggaagtgaagtacgccgtgcactggaacgcgctcggggctgtaatggagcgacacacaggccggaggctttgctcggtgatcacaggagtgagagaggtgactcgggcataccagtgagctcaggacgcctgagttgagcttgcaagttttccttggctagagtgcctcgcatttgagtggctgggaacactcacaagggannnnnnnnnnnnnnnnnnnnnncaagatctaaccagatggcccaaaccacattgtgggaggctttgtcgattcttttatgatgatactnnnnnnnnnntcgacttccggcgacaagcaagagcgctatgaaataatggcctggtaaagggacgaccagcacgcagcagtgggtgaagagtcggtgcctcggaatattcatcatgccatctcgctggcggggcccgaatcagaatggctggaactaagatctaaccagatggccaaaaccacattctggtaggctttgtcgattcttttatgatgatacttctgccaacacagggagcacgatgacctgtagtagctttggagttcgactgttacacacctagaacatggacttgtactgcttttgttggacacgcgatcctgtgacatctccggcactcggctgttgcccagaattttgctcagcttggagcaagatttctcgtattttctttgccaagcctgatccaccgaacgatgagcttgtctcggcctgttctaggaccagctgctgacgagctgtgagatgcctcacttgctcttccaacctaccacagattgtgtttcaaggaagtgagaggcatgggaaactatggagcgggagagacagttctacattctcccgcaccctgaccggcactcaccggtctgctttggctcgaagcttttgcctctcctcttctacctccttcatgaaagcctggaagacagcatgctggagtcagattcagtgctgcactcaccagcatgacatggctgacccatgcggagctgatcaagcagctaatatggtgagcagatagaggacacaacgcccaaacccaaaccacatcaaatccagccagccaccgcacaagccattccccctccacacccattcctacctcttgctcatacttctcttgcagcctgttccaggccatgccgaagagtaaacctgtcgtagcgatccagaagatgccattcccatgcttctggaagtaccgtactaagcggacctgggaggtcgccccagcctttgccctctgcagctcctctatcctcttgatcgctttcgtatgcgattctatatcattggtaatagccaggtcaaggctggggtctgcgttgatgctcttgagcttcttgagtgcctcattcgagccggcgaagagtttgtcgacctcggcagcggaggggcctgccattcccgcggcaccaccctgacaatgctgccggcgctaagcttgtggggattgacgcatacgcacagggtaccgtcgtctgcctcaagggcgctcagctgcacgagagtggcctacgccatcattgcgctcccgtttgggcgccattgccgaaaccccgaaacatatagctgggctattgcatccatgctcctgcccctgtgtccatgcaggcatattttatagaatcaaactggatctgaaatcttcgtctagtacctattgcagtcaccacaaagctggattcgagcctggcagcgtcggagggctgaggcccgaccgtgaaggaggatggacgagtccgtcggtggactgcagattatgaacaaggacaagcacgtcttcaaagctccagctcctcgcaaatctgtcctcggtaagtggcgagcgtgagtgtgtcggtgacgaagagaggtacactgcagggagtgctgtgaaacacgtcactccctcccttacacgctcaggcctggaccgactcgccgaggaaaagcgctctgagcaagcatccgtgctcggtgtgttggcggtagagcgaggcagatccagacttcgtgcatgcctaggctgcacggggcagggcggggggcccctgctagcgttcctttcatgatgctctacctcccttgccctaccccttttcnnnnnnnnnnatgggctgcacggggcagggcgggggggccctgctagcgttcctttcatggtgctctacctcccttgccctaccccttttccgcaggcaaacgacccgtcgtctctcttgcccgggaggaggacaatgcagacgctcagcaggagacgggctcggccgaccaggcccacacgtcctcggcaggcccagcggcacgcagctaccgctcgtcccggatcgagaccccctcccaccccggcggcgtcagcgttgaggcgcgccagcagcaggcagagagggatgcacgctggcgcgagcaccgtcgggccccggtgcactcccatgatcgcggggatgcgcgtggcgaggaccgcttgcacagatctcggtgaggggtgacagcgctgtgctccggggcatggacggcggaggatggctgggccggtgctggaaacagtgtcagaggtacacatgattggccgtgcaggtcagccccctgcctcatcaggattcttcctcccctccccagggatgaccgggggtctagacacgggcgggaggacgatcggcgccggggcggggagcagcggggcgacgaccggcggcgcggcgaggcgtcgggccgcgcgtcccctccccggcgccggg

SEQ ID NO: 45782 - DNA, 61 bp, Chlorella protothecoides
gtactcgcgctgtccctcctcctccttcccgcctcggtcatcggcacatgcgagggagggg

SEQ ID NO: 45783 - DNA, 89 bp, Chlorella protothecoides
tttgcagaccgcttgatgaagtcgcagtccggggtttaggctcatcacgcccgtcttcatacatgtcattaaatctatacctaaggctg

SEQ ID NO: 45784 - DNA, 63 bp, Chlorella protothecoides
gcttggtggttctgttgtggatctgatctttcgtacttcccgcaagtttgcatctccatatca

SEQ ID NO: 45785 - DNA, 334 bp, Chlorella protothecoides
  modified_base (92)..(267): a, c, t, g, unknown or other
ctcggggtcgtcggccaggcccagggggtcgaagggaccgccagggtacagggggtccagcccctgcaggtccgacgactcaaacttacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatctggtatgttgctgattgtgagagcgttggcatacaccgactgtactttgattatttgaaaca

SEQ ID NO: 45786 - DNA, 67 bp, Chlorella protothecoides
accgcagctcccaggcatgcagactaaccgattcttctcaggtattgctggagcactgcaggttgtg

SEQ ID NO: 45787 - DNA, 72 bp, Chlorella protothecoides
cacctgtacacgactgtgcacaccccctatccaacctgtgcgcaacaccgaccctttttcatctcctgcctc

SEQ ID NO: 45788 - DNA, 80 bp, Chlorella protothecoides
gcctcttgcgacgggcttgcacaggattggaagaccagatggggaactgcaagcagagggcatgcggtgaggcgggtcag

SEQ ID NO: 45789 - DNA, 88 bp, Chlorella protothecoides
ttccataggcggcatggacccgtttgagcgccagaggcatgctcatccgtcaacccccccctccaaaaaaaacatatagaggtgctgg

SEQ ID NO: 45790 - DNA, 69 bp, Chlorella protothecoides
tgtccgtcacgacgcgcgaggagggccttgccattctgcgcgaagcggcgggggcgtgcgaggattcta

SEQ ID NO: 45791 - DNA, 61 bp, Chlorella protothecoides
ctgcctcgcgcacgacggttgagacgcgggtgaaggagcccaggcgccggccctccagccc

SEQ ID NO: 45792 - DNA, 5365 bp, Chlorella protothecoides
  modified_base (413)..(422): a, c, t, g, unknown or other
  modified_base (983)..(992): a, c, t, g, unknown or other
  modified_base (1279)..(1288): a, c, t, g, unknown or other
  modified_base (3093)..(3102): a, c, t, g, unknown or other
  modified_base (3164)..(3173): a, c, t, g, unknown or other
  modified_base (3890)..(3899): a, c, t, g, unknown or other
  modified_base (4976)..(4985): a, c, t, g, unknown or other
gcggccgccagcggccggcagggcgaccgcctgggcgcggcgctgaccgcggccgcgctgactcagcacgcgtcgcgcctgctgacggaggacacgcagctggcggcggagctctgcgccgccatcgcgtcccgcttcggccgcgacccgtacccgctcatcaagcaggccgccggggcggcggccgggaggctggctgctgcgcagctccaaggtggggtaccggggggaggggtagttggaggggtgggaggggtgggagagcagcgacttaaggcgggcagagggcgtgatctgtgtgtgtgtttgcgtgtgttccttgtcctccgaactcgccgaagctcaccagcaccccaaaacctccccccttcaccctctactccatccccacgcagcggctggaagcgcccccnnnnnnnnnngctcgccgaagctcaccagcacccaaaacctccccccttcaccctttacttcatccccacgcagcggctggaagcgcccccagcctgcccaagctggtcccgctcttcgtcagcctgctgggctccgaccaggacagtgacgtgcagcgcaccatgctgggcgtgctgcggcggctggcctcctcgaccccggcagcccccgcagccctggccccttacttcccggacctggtgccctccctgctggctgtggtgcaggtcaggaaaggggggaatgaggactggaggaggcagcccctttgcagcgcttgcggcaaaacccctggtgctgcagcctgccctccctccgggccccgcccatcgaccgcgatctcctcgtaatcccctccctccccgccccttcattccctcaactaccccaggaaaccagcggcacaaccaagctgagcgcagagaggacgctggcgcgggtgctgggcctggcgagcggcgacgagttgctgacacaggccttcctggaggacggcgcaggcaccgccgcgcggcgccagctcaccgagnnnnnnnnnngaccaagctgagtgcggagaggacgctggcgcgggtgctgggcttggcgagcggcgacgagttgctgacgcaggccttcctggaggacggcgcgggcaccgccgcgcggcgccagctcaccgaggcctatgtccggcgcctgacccgcctgcccccgggcgacgaggacgacgacgtcgagttttaaaggcacaccgaatgcacgcatggaggggagctggcagaggccgggcctccttctcctcaacagcatgctcctccctggcagggatgcaccgctgccgtgnnnnnnnnnnaaatgcacgcatggaggggagctggcagaagccgggcatccttctcctcaacagcgtgcacctccctggcagggatgcaccgctgccgtgcatctgggtgcctggcgcctgactctgcaggtcgagcctcagcaccccttgctgaacccccttgggagcctgccagcatttgagcatgtcccatcacgctccggggcttgagacaggcgtgcatcgcagccctcacacgatccccaccaccctcagcttgtcacgattcagaccacaaaagagcaccgttccggggaagtcgagcatgacagtcactgccagagacaggctcacgccggcacggcgtccagggcggcagcctgcgcctgcagcgccgccgccagcttggcgtagacggcggcggggccgagccccgtgatgcggagcgttggcttcctcgtggcttcacccctttccaaggacagttgggacagccgggtgcctgcgagccggggcaggagggtgctgcatgacaatcctgcccgcgcactcacacggcgcgctcacaagcaggctgccggcgaggggggtgcgcagggcggggcctgcgcacccaggcacctgtgctcaggcagcgggcgggcgccgggcgccgagcgccaggccctccgtgggcccggccccggtggggctgcgacgtatcacccccctccaccctccccaccatgcacccaccgaggatgctcctgaggtactccaggagctcctccgccgccccctccgcgatgatagaggtcttcagctgcagccgcaccgcatccgccgacaccttcaggatgcccgtggccctggcgcggtcgtcaacctccagggtcacggccgtggcgccccccgccgcgtccagcgcgcggatgcaggggggcaccggcacgatgaccccggacccggaggggtcgtccgccgtgctgtaggtcgtgaccgccgagtccatgatgtacaggagcttgccctccggctccgtccagtacgcaaagggcagcttgcccacgcgcatgcggagctgacgctccacggcaccactcctgcggggggttggggggaactgggagatgaggatcgcaaacacggacacaccttgttcgggcagggccacccaaacagtgggcaagtcctcgggatgccaccccacaccccttcccactggcgcacctccgtcgtaggagcttctccccggcgtctgttgtattgtacaggcggactgtgtgccgtgtggtgtcgatcaccagggcatggtctgtctggcgacggggcgccttggacaggtcgcagtctgtcgtcagcacgtgcttgccgctgtacttgcagtaataaacgaacacctgggcgtcgcccaggggtgccgcatcctctgagctataggtaagggtggtgcgacggggccccatcccagcctgaccaggaggagacttggctcacaggggtcccacgccgcgctattggcaggataagccttcccggtaatgaatcagtaaacaggacggcgcttggcagccgataactgcccaaaatggaagcaaaccaggcccgtatcgtaagagtcctccttcccttgaatgcgggttgcaggtctggagagaatgacctcaatctgtgaaacatatgtttctatcaactgcctaggaatcgctactgtccaggatgcattgttcgacaaacgctagagtgcagagcaatccctgcccgacatggcaaccctggcaggcacagcacgcaccaccagaccgtgatcgcacctgtttgaaaggagacgcctgcccaccgcagccacaattgcnnnnnnnnnntatatgtttctatcaaccgcctaagaatcgatactgtccaggatgcattgttcgacaaacgnnnnnnnnnngattggaatacctgctttatacgctctcgagaataacacattctgcatcatgtctggacgcggcaagggaaagacctccggcagcaaggccgtgagcaagtcctccaaggctggtctgcagttccccgtcgggcgcattgctcgctacctgaagaacggtcgttatgcaggtagctgtgattctggagggctcccgatatggccggatgtccgcattttcagcgcgacctgagatcggtctgtcgcccttaacaacggctttctcaccgatccgcctgaccacacgcacgcagagcgcatcggtgccggtgcccccgtgtacctggcagctgtcctggagtacctggcggccgaggtgctcgagctggccggcaacgccgctcgcgacaacaagaagacccgcatcgtgccccgccacatccagctggcggtccgcaatgacgaggagctgtccaagctgctcgccggcgtgaccatcgccgagggtggcgtgctccccaacatccagtcggtgctgctgccacagaagaccgccaagaagggcaccaatgcgtccatctcacaggcaagtaccctttgtgacttggttggtatgccgactgtggaattatgcagaaacgatcaaagcttgtgggtttggaggttccatggcacttccactttgaccagtttggtgacgatacactgaagaacaaagtgtgcgctccactcccaaannnnnnnnnngaatgatcaaagcttgtgagtttggaggttccatggcacttccactctgaccagtttggtgacgatacaccgaagaacaaagtgtgcgctccactcccaaacatgtgcaggagttctgacatccctgactgatagacaatggtgtgacaggattcatgctgagatactgcatggatagaccagatttgattagcttctatcgattctgctcctctgccgttgttgtaagaattcagctttgggcagcggtatttccatagggcgcacgcgcgacaatcggcctggcgataaggccgcttgccagctcgacccatcgagggccacgcaatgccgcaggaaaaggctgccttactctgtcgatcctgctccccacgttctatattgtcattaccggtagcctatgctacaccatgtcgctgtcagcgttgcagatccgctatgcacccagggtgtcggggcttggggcatgtgagaagccatcaggccccagtgcacgcatgttgcagcacttctgggagctgcatgcaagacggccgatgcaccgggatgtgagatcgtatgcctccaacacagtgcagcttcgtctgccggatgacagcacggtgatgttggacgttccggagggctcctcgattctggaggtggccctggatgagggactggacatccctcacgactgtaaaatgggcgtctgcatgaattgcgccgcaaagctggtgcgtgaatgtctgatgtgggttcaagaagatctgactatggaagcaagacgattgtggaccattcacaggtgtgctccaggcaggatggtatctagacagtgttcgccccacatcctatcccaggaggagggagacgtcgatcaagaggcaggaatgctcagtgaagacgtccgttccaagggatatgcccttctatgtgtctcacaaccgcatggcaatgtcaaagttcgcatcatccccgaggtgcagtggctggcgagtctttggggcttgtttataggacacgtgttgaccttggcctttcagcgcaagccacccatctgtctcaaatgctttcatccacaggaagagctcctgnnnnnnnnnnttggcgagtctttgggcttgtttataggacacatgttgaccttggcctttgagcgcaagccacccatctgtcttaaatgctttcatccacaggaagagctcctggatgaagtcatgaactgagaggctctgctgagtacatcttcgatatttcatgtcctatcaggcatccactgtgtgctgtcttcccttgcgattgtaacctttctctgtcaccatctgtgtgtaagaggcaacctggcgctgtatactgaatgcaccgagaggtttgtacatacaacagatcagggcagtggcacatgtttctcagcgtgagcactgagggtttgtcacatacaggaggtatgcctacatgccgccgcgcaggcgcagcaccaggtg

SEQ ID NO: 45793 - DNA, 61 bp, Chlorella protothecoides
cctgacatgatcgaggtacgacaagggactggacgtttttgttattgtcgattcattgttt

SEQ ID NO: 45794 - DNA, 69 bp, Chlorella protothecoides
ccccccccccccacacacacacacgcacacacacatcctcccaaaggtgggcctggtcgacatcttcct

SEQ ID NO: 45795 - DNA, 243 bp, Chlorella protothecoides
aggaggccgccctgctcccccctctggccagttctgcggagaaggcacgcagctccctcctctcctactacgcccagaccggggtacgatgccagtgccttctctgcttgtggcttggatctgttggtgttggggatcgctgaggcctatccaacttgaatatcattgaaacgttatacctctagtgggtcgacccatttaagacatccccaaagcatgcgcactccatgcaggaaacccgca

SEQ ID NO: 45796 - DNA, 10140 bp, Chlorella protothecoides
  modified_base (117)..(184): a, c, t, g, unknown or other
  modified_base (467)..(476): a, c, t, g, unknown or other
  modified_base (735)..(744): a, c, t, g, unknown or other
  modified_base (978)..(987): a, c, t, g, unknown or other
  modified_base (1260)..(1321): a, c, t, g, unknown or other
  modified_base (1888)..(1897): a, c, t, g, unknown or other
  modified_base (2469)..(2478): a, c, t, g, unknown or other
  modified_base (3121)..(3130): a, c, t, g, unknown or other
  modified_base (3753)..(3762): a, c, t, g, unknown or other
  modified_base (4303)..(4312): a, c, t, g, unknown or other
  modified_base (4655)..(4664): a, c, t, g, unknown or other
  modified_base (4769)..(4778): a, c, t, g, unknown or other
  modified_base (5896)..(5905): a, c, t, g, unknown or other
  modified_base (5997)..(6006): a, c, t, g, unknown or other
  modified_base (6186)..(6195): a, c, t, g, unknown or other
  modified_base (6848)..(6857): a, c, t, g, unknown or other
  modified_base (6920)..(6929): a, c, t, g, unknown or other
  modified_base (7266)..(7296): a, c, t, g, unknown or other
  modified_base (7545)..(7554): a, c, t, g, unknown or other
  modified_base (7618)..(7627): a, c, t, g, unknown or other
  modified_base (7933)..(7942): a, c, t, g, unknown or other
  modified_base (7996)..(8192): a, c, t, g, unknown or other
  modified_base (8374)..(8383): a, c, t, g, unknown or other
  modified_base (9018)..(9027): a, c, t, g, unknown or other
  modified_base (9291)..(9386): a, c, t, g, unknown or other
  modified_base (9548)..(9557): a, c, t, g, unknown or other
  modified_base (9777)..(9786): a, c, t, g, unknown or other
  modified_base (9879)..(10032): a, c, t, g, unknown or other
gccgccgccgcgccaccgctggcccgccaggcctcggccatgcaggcgtcccagcagcacccggcgcccggcgccgcgcaggcgccggcgctgacgccgcagcagcagcagcaggcnnnnnnnnnnnnnnnnnnnnnnnnnnnnnnnnnnnnnnnnnnnnnnnnnnnnnnnnnnnnnnnnnnnnagctggcagccatgcagcagcagcagcagcagaacggcgccacgcctgcggccgcgtggcacgccgcgctgctgcaataccagcagtacctcgcgtaccagcaccacgcgcaggcggcggcggcggcgggggggcagaagccggggcaaccggggctgcccatggcgtggatgccggggcagtttggcgtgcccggggccgcgccgacccagcagcagcagcagcagctgggcctcgcagcgggggtggcgagcccggcgccgggcgtccctccccccgcacnnnnnnnnnntgcgccgacccagcagcagcagcagcagcagcagctgggcctcgcggcgggggtggcgggcccggcgccgggcgtccctccccccgcaccctcctgaaagacctggggcggccggagggggcgtcgggcattcagtgaccgtctgccagaccccaagtgtcgctccctgcacccgcctcctacctgccgtggcggtgcgctgcaatgattctccctgacccatgacaattttctatgtctccctttttaaatggacaannnnnnnnnntggcatagagggggcagcggcaatccaccacattgtgacagtgctacacgcatatcaacactcgaccagacttcaagacgcatccatcgtgcgaggggctactggaagggatgctttgcctctctcagtggagtccggcctgtcgatgctcgcaccctactttgtccccggtatcgcgcatgaaaaatccgagcctaaccctgattgcagggccatgctggtcaagggcgggannnnnnnnnnacgctgcgttgactctccctgacccatgacaatttttctatgtctccctttttaaatggacaacatgatttaactgctcgccaggggaagggtggtggaggaatagctgcgtcatgatcccaaagggtcacaccggtcgtcatgcgttgatccatctgccccacgttgacggccaggcatagagggggcagcggcaacctaccacattgtgacagtgctacacgcaaaccaacactcgacctgacttcaagacgcatccatcgtgcgaggggnnnnnnnnnnnnnnnnnnnnnnnnnnnnnnnnnnnnnnnnnnnnnnnnnnnnnnnnnnnnnnacctttctccaacgtgtccagactcgtgaacggcgtcgactcttcccggtaccaaggacaccggaaccatgcagcatgttagcctgagcagcaggacgggtgagcccatgcggggccgtgtgggcgcgcatggatcgtgccgctcctttccctgggtcatgatagagctcagagtgtgtccaggtgaccgatcccaccctccctcgcatcaggctttgtggggacccgcctggccgcccgcccttcgaccatcagggcccgggcggtgggcatgccacaggtccgtgcggccgcgagcggctaccagtggctgaagaaggagcccatcgtcatcctggccggcttcctggggtgcgtggaaggtgcctcggcatgatgtcgcggtcgtcatcggagcttgcatgggtgcggttcgtggtgtgatgtgatcctgttgccctgcttgggacccctaccacactcctctagaccccacacccgctgcccgctttgcgccagacctagaccctcagcatccaccctcctcccacgcctcgcccccaaccttgcagctggtttgccccctcnnnnnnnnnnaacaccactctggaccccacacccgctgcccgctttgcaccagacctggaccctcagcatccaccctcctcccacccctctcccccaaccttgcagctggtttgccccctccaacatcggggtgcctgccctgggagggaagagcctcttcggcctgttctccgagtccatcggccaggagctgtcccacttccccgtcggccccgccctcactgacaacttctggctctacctggtcacctggcacgtgggcctcttcctgaccctcttcctgggccagatcggcgtgcgtggccgtgcccagggctactttgactgacaggggcctctgcacctggagaagaatcaagcgatcggggagctgtgcccgccgtagaaccgaggccagactgtaacaataatgagcagcatggagctgtcagtgcaccagtggggggaggggcagtgtcctgcattgctctccaggggacgagggaggacaggaagccagcagcaggggcggagggctgggccgcatgcaggcgcggctgcgggcgcgcctcgggtgtcgaagcagcgaccctgccgcctcnnnnnnnnnncggaccgcatgcaggcgcggctgcaggcgcgccacgggtgtcgaagcagcgaccctgccgcctcctaggtggcggtgccgtacctggccgtccattcctcgaactgggccatggactctggggtcaaggagggcctgatcacctgcaggcccgcccggaagtcggccacggtcaggccgcggatgcgattggccggcacggtggccacgcggcggcccagctcccgaatgggggccatggccgcctccttgcacagggccgccaggtcggagcccgagtacctgtgcatggtgaaaggaggggcgaggggatggctgggcaatgctgaactgcgtccgcaaggacccgaccctgtgatctggggcacagtgtgcacggggcacgggccccatttgcacatgtggtgccggcaacggctcgccctcgtgcacttcgcagcatgctcatgcctggccatgctccgcagcagcctggaacacttcatcgaggatggaccccacttgacgcgctcaaagagcaggcattctcgctggagcacggcctgagacagcccctgctcccccctcaggcacccccgcagagtcccgcctccccccccccaatacacacacacacccctcggtcaggcctgcgacgacggccnnnnnnnnnnagcacccccgcagactcccgcctccccctctcccacacccacccacccctcggtcaggcctgcgacgacggccgggatgccggggtcggccctctggcctcgcagcatgccctccagcagcgcgcgccgcccctccgcgcccggcagggggacgtagatgcgcttgggcaggcgccgcaccaccgcctcgtccaggtcccagggtcggttggtggcgcccaggaccagcaggtgggcgccccccgaggccacgccgtcaaaggcgctcaggaactcggtcttgagccggcgcgaggcgtcgtgctcgtcgccgcgccgcgcggacagcacggagtcgatctcgtcgatgaagatgatggagggcgccgcggcggcggccacgcggaagagcgcgcgcaccagcttctccgcctcgccgtgccacttggaggtcagggaggccgccgaaatgttgaagaaggtggcctgcgcctcgtgcgccagggcctgggccgcccaaagaggggttgagagagggagcatggtgggcggcctgagggggggctggcgctggcttcacggtttcagggttccacgcgatggaggggcgggtctgactcgagtgagagatgccgaacctggcnnnnnnnnnnaactggcgcaggcttcacgtttcagggttccacgcaatggaggggcgggcctgactcgagtgagagatgccgaacctggcgcagcgcggggcctgatgtgccggctgcactgcagacttcgccatgcaatcgaatgcaacttcccccctccggtgacccctcctcaccttggccagcagggtcttgccgttgccgggcgggccatagaggagcaggcccctcgccggcgcacgcaggccctggaacaggtctctgcgcagcgtcgggagcaccaccatctcctgcagcgcctgcagtcggcatgcaagggaggaggggtgggggggaaggcggctcgacgacgcaggccgaccccccatgaacatgcagtgccgccagtgtgggggtgtaccagcacgtgaggcaggcacgggtcctcctccccccgccgcctgcacaccggccgccgggctgcgggcatgatcggcccgcgcatgcacccggccgccgacagctcggccatgcacccatcccacaaccccatgcccgcggcacctgcttnnnnnnnnnnaggctgcggccatgatgggcccgcgcatgcatccggccgccgacagctcggccgggcatcccaacccacaaccccatgcccgcggcacctgcttcgccttggccaggccggccacatcgtcccagcccaccgccggggagtcgtccagcacctctgtcaggattcggtcctcgtacgccctttcctccttgtccgccgcaccggagggctgggagacggcggagcgcaggggcgggggcgcggcggccctggaccccggagtggggtgtgacagcgagcgcggcacggcgccgcagggagggccccgcgaggccgccgcgggcggcagcggcgccccccgccnnnnnnnnnngttgggcggccagcaagatggtgtgctggcatctccaagcatcatgccgacgagcggactgcgcaacccacgcgcaggtcttcccacgcacagcacagcacaaannnnnnnnnnggacagcgagcgcggcacggtgccgcagggagggccccgcgcgcccgccgcgggcggcagcggcgccccccgcctcaggcgctcctccgcggcgctcagccaggcctgcatgtcgccgcgccagcgctgggtgttgctgtgcgcggcctccagccccaggctcgggggcaggggctgggccaggccctcgcacaggatgctctgcgccgccgtccacagccgcgtggccgcctgggtggcgcccgctgcgtcctgccgctgcgccctgtccaccgcatcctggtcgatgtgcaatggggcaggttgcatggggtctgagggtgttgggcggccagcaagatggtttgctggcatctccaaacaacatgccaatgagcggtctgcgcaacccacgcacaggtcttcccacgcacagcacagcacaaagctcggtgagaaattactccttcaggatcagcagcacccccacctgagccagatcatggtagccgcgcagtttctcaacccgtcgtctgctttctgcaagggccgacagcggctgggccggtggggggaagtcgctgctcgtgccctttttgggcgctgtgaaccactgcatcacacatgcaatgggatgcaggagggtgggtcaggcccacccccgctctggtagaggtgacgggggaaggacagacccgcaagtgatcgagagaaacggagggcgaggcgtgcgggtgcgcaggctgagcggttgtgtatgagcatttagattcaagaatagtgacactttttcatatggttcaggctcgctggatgtagtcgagcattgtcgagtgcgaaagccacgcatcagttcctccgcgggggtaaaaggtctgggttgggatcaagacttcatggcaacataccggacaacacaccggattttgaagcacctctgggccacatgcatgagctcccttgaccatgactaagaattacacactggatcggcctggtaagctttcaagagagcgaggactaacttcaactttgcaggatgctgccacaagcgctcaacaagggaggttatgggcaaggaggatgtgggaggagtaaggtctcaaattcttgtgcttgctgtagcagcagggagaatnnnnnnnnnngcaaaatgcctgggttgggatgaaggcttcatggcgacatactggacaaaacaccggattctgaagcacctctgggccacatgcatgagctnnnnnnnnnncatgggcaaggaggatgtgggaggattaacgtctcaaactcttgtgcttgctgtagcagcagggagaatgggtgtggcagctgcagcagaggaggggatcttggaaagggaagggggagggagggggacagggaagctgcggatggtctgggcatcaaggcttcaagcctgcagcatgcnnnnnnnnnnaaaagggaagggggaggggggggggacagggaagctgcggatggtccgggcatcaaggcttcaagcctgcagcatgcgccgcccgtggttgtggtgggcatgctcccccatgggggccgccattgctgcctccatagagtcctgggcctccaccggggtcatggggcccccacccctcacccactccacgatggtcgccgcggaggggtcgtcgctgggctcctcggcggggccctccagctcctccacctcgcccgtggtctcggtgttctcctcaccgctggtcagcacgaagacgatgctgccgtcggccaggccgttctgaacgttggtcaggttccaggcgctgtaggcggcggtgaggctgctggggtggaagatgccgtagatgtcggcgtcgccggagatgggggtggtcaccggctccaacgcggtaggcaacagatccacgactaacaagggacgaagaaagggagaagatgggggtgagactgatggacgtgggcctttgaaaagcgagcatggcgtgggaggagagagcgggctacccaggctcgggctatgcagtcttgcatttcgagttcctatctcaaggtgcagagtactcctgatccaaggcccggccccctcccacccttcccctccctcaccgnnnnnnnnnnagtttgggagatgtagtgcacttctaaaagtagtgcgaaagcggccgagcaagcgcgcgagcnnnnnnnnnnactacccaggctcgggctatccagtcgttgcagctcgagttcccatctcaaggtgcaaggtactcctgatccaaggcccagccccctcccacccttcccctccctcaccggtggtgatcatgccggccgtgatctgagccaggctgatgcctgtaacctcctctgccccggtcacattcagctcccagaagccgttgctgctatggtagaaagaataccattccgcggtggtgaccccgtcatccacggtcgccttgaaccacctgcacgggagggtttgggagatgtagtgtacttctaaaagtggtgcgaaagcggccgagcaagcgcgcgagcnnnnnnnnnnnnnnnnnnnnnnnnnnnnnnngtgtatgtggatcggggaatgcacaattatgcacccatcggccgctcttatcccccctgtcgggtcgattcccgcgcactggcgctggtacaattcaatcacgtttccctgcgtgcgggcatggacaagattcgtcgggccggtgagtgtacgccagagcgctttccaagcagtcccagtgcatgtacatgctacggtaccgtataggacggctttgagcaaggctgtggccgctggcccattgatgannnnnnnnnngtgaaaatgtccgcgaggtctagggtttgtcgcgagataatcgagtcgccgctggtacaggtannnnnnnnnnatgaaaatgtccgcgaggtctagggtttatggtgagataatcgagtcgccgctggtacaggtaccatcggcggaccatcctcaagcctcataaggctcacctgtggccgtaggcgccggagcccaggctcagagcgcataccaatgcaagaatgagaccggcgcgggacattgtcaacggttgtaaagtttgaggcaggtgacttaagccgtcgcgaggggctcggaagggacagaggagggagaggcggagtcactggaatgccaggagaaaacagagtctgaatgagtgggagtgggggagtannnnnnnnnnccactcgaatgcctggagaaaatagagtctgaatgagtgggagtgggggagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggataccctcactcttttggggttcctaggaaaatccgcagccctgccttggcacgaggtcgacagtcctgccgtctcagacccgatgaacatgcattccaatctagagaatcatgattttcagcagaaataaacttacacatcatgcttggctggggcatgtagctgacggcaggcctcnnnnnnnnnntggataccctcacccttttggggttcctaggaaagtccgcagccctgccttggcacgaagtcgacattcctgccgtctcagacccgatgaacatgcattccaacctagagaatcatgattttcagcagaaagaaacttacaaaccatgcacggctggggcatgtagctgacggcaggcctccaaggctccttgcgaggggcagcctacatgttttcacttcctccccgacttgaggtccttgtacagctgcttcagctccgcctcgtacttgctcttcagctggggcctcttcaccttcagggagggcgtgagcaggttgttttccggcgtccagggctcatcgtccaggtgcaccgccctcacaaactcaaagcccttgagcttgttggccttggccgtcttggacagctcctccaccatggccttcttggcctgcgcggggcaggggttcaagtcaggaatggagctttgtgttgaggttacagctctgatcttggtagaaataagacggaggcccaacctccgcgcatcagatgggtcgtccatgcaatgcgtttcccctcgtcaccccagcaccagccatcagtgcacaccccacaatttacctctggcttgttcagggcctccttcccgnnnnnnnnnngggcccagcctccgcgcctcagatggggcgtccatgcaatgcgtttcccctcggcaccccagcaccagccatcagcgcacaccccacaacccacctctggcttgttcagggcctccttcccgccattttccttcagccagtccttggcggggatcaccacggcgatgagctgggattcggtggactctccatgcacccagatctataaggggtgtttaaggagattgatttgggctgagggtaggtggaaggaccacctcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggcgacgcacgcttcgtggcggcccttttttaaagtttcctcgaatgaccccccccacacacacacacactcagcttgctcccttcgaccgcacaccccgacccagcccagcactcctcaccctgagcgagcttgaagatgttcttcttgcggtcgatgnnnnnnnnnngcatctggaaaacgtttacaaccgctccgatgcgctcgagcaggtcaacggggcggagggctggaacttgtgcagccttgctcaggatgtgtgagcttccagatgacccccgtgtttgaggtggtccttccacctaccctcagctcacatcaatccccctgaacacccctatagatctgggtgcatggcgagtccaccgaatcccagctcatcgccgtgnnnnnnnnnngcggcgacgcacgcttcgtggcggccctttctgaaagtttccttgcatgaaaccctcccccccactcagcttgctcccttcgaccgcacaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattggggggtgcgcttacctcttgaaaagggtggcaggagggagggttccatgcatgatatacgagagcgcgctggcaccagggcctgacacgccatcggaccccccc

SEQ ID NO: 45797 - DNA, 76 bp, Chlorella protothecoides
gtactcgaggaggagagggatggtcagcttagagtcctcgagggcacgccgggtgctcagagccgtcttggggtgg

SEQ ID NO: 45798 - DNA, 61 bp, Chlorella protothecoides
gtaccagtcagcgcgtatacgtctgctgggaaagatatcgggaggacctggaacttgcact

SEQ ID NO: 45799 - DNA, 61 bp, Chlorella protothecoides
ggacagtcatgggaactcaaggtgtatgggttccagcagcaacgggaaggtcaccgccttg

SEQ ID NO: 45800 - DNA, 84 bp, Chlorella protothecoides
ccctgtgagcaggcatgcgggcttcagcaaggtggggtcactccgcacctcaacgctccacatcatggggctctccatgtcagc

SEQ ID NO: 45801 - DNA, 67 bp, Chlorella protothecoides
tgcaaggggggtgagtccacccagcaggcgcatactttggctggcttgtgcaatcggaaggacaggg

SEQ ID NO: 45802 - DNA, 85 bp, Chlorella protothecoides
tcgtcgatcatcgcacccactcagagccagcatgcgatatctaggttttaccgagcacagtttaaatccatttgcgctgtttctc

SEQ ID NO: 45803 - DNA, 73 bp, Chlorella protothecoides
aggctacgatatgtatgaagccagcgtggacgcaggagctattgagagtcagtacaagacgtaccaatcagaa

SEQ ID NO: 45804 - DNA, 6106 bp, Chlorella protothecoides
  modified_base (110)..(119): a, c, t, g, unknown or other
  modified_base (2864)..(2884): a, c, t, g, unknown or other
  modified_base (3039)..(3048): a, c, t, g, unknown or other
cctgcctcaagacccctgccctgcgtctaccaggtcgggttagcccggcgctggggatcacgatgttacatggccgcgggcgcatgcagccgggcccctcctccggcaannnnnnnnnnaaggtcgggtcagcccggcgctgggagtcacgatgttacatggccacgagcgcatgcagccgggcccctcctccggcaagcctgccaggccgtcggcaaaggtttcgagtcacgggggggtgggggggagcggccgagtgtagggcaactccggcggccccgtcactgagcattggtgcggcttttcgggcagtccatcccaatgcacttgttccgcatccacttggtggccgcccacttctggccggagaccacgtcgcagccgccgtgcagggcatgctggtccaggctgccatcggggttgatgttccagaacagcagggcatcgcccttgcgcggcttgacctggggcgggagccaaaggaggggggggtcggcagggatcggcaggctgtatagccgaggggaggggcgccaaattcgagcgactctggccgcagccctcggctgtgcagggtgtgtgcacgatgattagggcactgcacaacgcttcaacgaggccatgcgggcggaggctgcgtcgactccgtcgctctcaaatgaccatgttcccccctccgtcccccaacgctcacctgaatgccggtgtcacacttggtgtagtcgatgttgcgcaggcggtccaggccgtcctttccttccaggaggaaggtggtctcacccccttcctccacgtccgtcaggtagagcagcatggtggcaatctgtgcagggtggtgcaggggcagagccgagtggatatcagaggcactcgttcccaaccagaccatttgaggggcaggcatggtactccatcgtaaggtactgtactggatgaggaacccttgacgcatgtgcacgccattccacccagcacccgccgatgcctgcagcaacacacatgccctttccccccctccttgccaaccacaggcctacgacacagcagctcccctggccccgcgatgccccagaagctgcaacagggccaggtcaggacccactcaccctctgggagctctgcggtccatagtccttctcagggaaggcgtccaggtgcgagtggtagtgctgcccattctcgtaccgcaggacgttgaagggctcaccatatgctgaggggttgggaggtggagagcaccgaggtggagtgagtgtctgggtgctgtccctgcctaaacatgtggcaccagttcattcaacatggtgcggctggcaaggaaacagaagcaggtggggcctgactcggcccgcaggcatatccagctaggcccccctcccaactcacctgagggtacgccggtcaccgctgcaatcttctcctcgaccgccctcagggtgcctgtcttgtccatgcctgaggacaggaaggtgcccgagctggtccttacatccctgtgaggatcaggagacgaaatgtctgcgtcgataacctaccctgaggcacgagttgtcaaacacgccgctctgcggaaacatctgagcttgcctaaagcacacaggggcgcacccaacctccctacttctgttggttggggtcatcgcccctcttgagggccagccctgaaggtgccagtctgctggccgccagctccaccattttgtcggcctctgcctcgcttaagaattttgggaagatgtaggcccgggggtagatgctgagcaactggaaaggctgtgtgtggagggtgggatccagggaggggtttggatggaaggacagaagcgatgccccaggattgcggcttccttgacgctacaggagttggggccattagttatatcgacagaggggcaggtgttggtgagtgcagggtgctgggttggcaagggacacggctggtcttgtcaatcacaccctttacctagaaaagtcactgccacctgctcacaggtgccctccccataccgctcccgatctcacggcacctggacgacgtaatggtcgagtccagtctctcctgactgcaacactggcctgtcggcgagcatgcccgaccattccaacaattcctcgaacgaggtccagttgcgtgtgggcccggttgtggaaactgctggcacgctctcctcttgttgcagggagcgtgcgctgcctccctctcgctctaccgtcaactgcatgcagcggagaggggatccagacgcatggaacaaggcacctctgagcagcaacgactccttcgacacccccgacccccccgactgctactcacccctcgtccggcgctgggcaagcctgggtactgctgcaccattatccctgtgaagaaagctatggcacagagcaccaggacggctgttgtagagtacccattccgagcatggaaccgcattgcggccagcacagtgggtttacactcactgcagaatgccaggggcgaggaataacgggaaacagtgttaagaaaccgctttacacatccaaatttcggtggtcatatcgtacccgcaaaacgttgcggctgttccctgttgccccgaggtgcacggtgcacgtctccgtcttcccgagctgcaccggacagcaacacgacacgccacaggagctcccggagagttgatgtatcataaccggaggtgctccacacccattgatgttctctttttccgatggttctaaacatccacattcatgtcgaggagctcaattctgccatccacggtaaagatgatatggatacagcctcgacctccacctgcctggttccttggataccaaagtataagtttgatggtggtgatcgcaaacatccctcagcaatnnnnnnnnnnnnnnnnnnnnnatgctccctttgaacatgcattcgccgggagggtgggccatgtgacatggctcgaactgggtagactgcacaggcgcagccaattccgcagtagtaactaccaaatgctattctgtaccgaccatagcctcactttggggttgcaaagtagaatnnnnnnnnnngattccgcagtagtaactcccacatgctattctgtaccgaccctagcctcactttggggttgcaaagtagaatcatattagtcgtctgttctgcctctccaccatgtgtctcgtatgccgcagctgggtatcggagttacgaaagcgggaatcagggtagaaatattcaacttctcgctccggtggggacagcgctgtctcgctggtcatgctcagaccgcgcgatgttgcatctgatgcctcttcgtaaataccagattgctatgtcgtgccactagcatgtcgtgggacgatgatgaagccttgtttgcagcattcgaagcgtgagttccatgcggggtttggcagggcgccgggatccgccaggcgccatgcggacgtggcctccagcatgtgtactctaattgtgtctgaatcgatccatcacagggactttgagtccgggaggagccggacccctggcgcacatgctgcccctgctgcggctcggctgccacgacccgaacacggccctgccagtggccatcctgcagcgaccccctccagccccccggctcctgcccagcatgctgcatgccactctgcaccacccgctccaagcattgcttcttcagctgcagaaaacaggcccgcatacggtctgggcaccctgcggtccctcttcatgcaacctcaagctgcggaaccctcacccgccccgcaaccgagtgcggtgggcccgttccaaacggcgacgccgcagctggcagcggccccacctatgctggcccaggcccagctgtccatggccccacccatgtggaacaatcacagcggcccctctgtatctggttccgggccccatcccccaggcgttccagttcatcccagcggccctcgagcgctccccgcctcctttggggctgcggtatcaggcccgagcgcggcgccacccccttcccccaccctgcgggtcagcagcagcaccgccgcacccctgccagcccaggagcctggtctggggtcgggaggagccgggcccctcatgcatgccagcatggagttgggggcggagcggaccctcgagctccgggtcggcttccacgatgccatcgccgctgtgctcaagaggtgcgtgggagccctggggctgcaaatagcacctttctgctccagacaatggatgaagagccggttcccccaatgtctggagcctgctgccatgcccttgctgcccctaggcgtgcggagaacgaacagccatgcatgcaggcttggcatcgatgccactccttccaaccgtgcgccagtcaaatgtccgccagtcgcgccgccctgcaggctccctggcagctcctattcctcctcccgccgcacatggacgttcccggtttccagccacgacgaggtgacggccgcgctggaggccgtgccgggcgtgagggtgaggctggagcccctgccgaagcccgccctggcggtgctgcaggtggggcggcaaggctgatcagccctggacggggttcagcgggaggagccctatgtgtgacagctccgcatggaatggttgaggacacagtcccttcttcagaggtgggcacaccatgctcagagtgtcgggcatcgagcacagtccatggcatcctcccccagttcccacaccccaccgcaggacgtatctggctgggccgacgacagcccgcgctacgcatccatcccctccaacctggaggcgcagctcatgcccttccagcgcgagggcgtccggtttgcgctagcacggggcggccgggccctgatcggggacgagatggggctgggcaagacggtgcaggcgctggcggtggcggccgcctaccgcgacgcgtggccggcgctcatcatcgcgcccagctccctccgaggtgcggcatgcagcttcgaactgggtggggggtttgtgctgtgaggaggggcccacagactgggaggccgggtgtgtacttggtcacctgtggtccggactccgtgcggcgcagacatcactgcagtgcccagggatgtcccatctgagacccgggtgggggtccggcagcactccagaatccctgggggccatggcctggggccatgcactccactcttgacgacgggttcccttctttcttcttgggacaccccatgcagagcaatgggctgacgcggtgcatcgctggctgggcgtgacggaggaccgggtgcacgtcgtgcacacgcacaaggacgccgccgccatccctgcccgcctccagttcctcattgcctcctacaactttgttcccaagatggtgaggccctggggatggggactggcccgccgacgaagcacagtggaccatcttgcatgccactctgcgccacggacggcactgccaccatgaacctgctggctcggggcccagtcgcaggtctcaaaacctcgggacagaggtttgagcccctgccgccctccccaaacccccgcaggacttgggccagcgcttcaacctgatcatcgccgacgaggcgcactacctcaaggaccccaaggcgcgaggttcccatgtctgggccccatacccgccgcgcctgcctgcttgcgcctccatccccccacccggggtgcatgccccctctccgtgaccccctccccctccacaccgcgccgccaccacgccaccaccgcaggcgcagcgctcgctggcggtgctgcccctgctgcgcgagacgccgcgcgtgctgctgctcaccggcacccctgccctgaacaagcccaaggagctcttctccctgctctccgccctcgtccccggcgcgcgcctgaagatgaaggactttggcgagcgctactgcgcgggcacgcgctgggaccgctacggcggcgccagcaacctgccggagctccacgcgctcctgcgcgcggtcatggtgcgccgccagaaggcctgcgtgctgccgcagctgccgcgcaagcgccgccagcagtgcttcctgtcgctggacgccgccgcgcgccgcgcgctggccgcgcagcaggccaagctggaggcgctgcgcgaggtggcggctgccgccaccgcgc

SEQ ID NO: 45805 - DNA, 74 bp, Chlorella protothecoides
gaccggcagaggaggtgaacatgtctccagaggttttcatgtttgggttgatctggaaatctcaggatggaatg

SEQ ID NO: 45806 - DNA, 64 bp, Chlorella protothecoides
cacactggcgccaccatggccccaccccccgcaccctggccactgtgtgtgcgcgcgtgtgctg

SEQ ID NO: 45807 - DNA, 75 bp, Chlorella protothecoides
atgcataggcaagagacagacgcacgtgccccggcttataatatcgatggctcttcacctcagggacctgtcaaa

SEQ ID NO: 45808 - DNA, 69 bp, Chlorella protothecoides
ttttctggcatgcatcctccgctgtaaaagcaggaagcttttacgaccaaaagaaacccattcacaaag

SEQ ID NO: 45809 - DNA, 77 bp, Chlorella protothecoides
gtccatgcacctttgaggccatgcagacaggcggaggtgtggtgcccacgcactcgttgcaatatatctcatgccat

SEQ ID NO: 45810 - DNA, 93 bp, Chlorella protothecoides
ataagtaaagacattgcaaatacacacagtttaacatcattccaccatgcctgttcatgggcgtgccagctccccctcctggtgccctcgcag

SEQ ID NO: 45811 - DNA, 68 bp, Chlorella protothecoides
cccgcgtccatgctgctctgagcacagcagtgggtttatggctgggcttgccgacctgcaccccgtac

SEQ ID NO: 45812 - DNA, 61 bp, Chlorella protothecoides
tctgaaattccaggcctgtccaaatctgcctgtgtgggacatggcaggcgccttttaccgc

SEQ ID NO: 45813 - DNA, 70 bp, Chlorella protothecoides
ccacggacataccccctcaaatattgtcaaataagccttttctagatcttaacatgcttgttcgcgatgc

SEQ ID NO: 45814 - DNA, 61 bp, Chlorella protothecoides
ccactagtgataagtaagcgaaggcatgacactccggtagccatggaagtcaaggacttgg

SEQ ID NO: 45815 - DNA, 132 bp, Chlorella protothecoides
gcaaacggcgccctccccgcccccgctgaggacatcatggcctcctacgactttgttgcgtccgcctggaaggggcgcatcgcttccctcatctcctccgaggtggtgtgagcctgtgacagaagaatttcc

SEQ ID NO: 45816 - DNA, 12276 bp, Chlorella protothecoides
  modified_base (493)..(502): a, c, t, g, unknown or other
  modified_base (580)..(589): a, c, t, g, unknown or other
  modified_base (766)..(775): a, c, t, g, unknown or other
  modified_base (941)..(950): a, c, t, g, unknown or other
  modified_base (1642)..(1859): a, c, t, g, unknown or other
  modified_base (1913)..(1922): a, c, t, g, unknown or other
  modified_base (2952)..(2961): a, c, t, g, unknown or other
  modified_base (3873)..(3882): a, c, t, g, unknown or other
  modified_base (4270)..(4279): a, c, t, g, unknown or other
  modified_base (6835)..(6844): a, c, t, g, unknown or other
  modified_base (8565)..(8574): a, c, t, g, unknown or other
  modified_base (9866)..(9875): a, c, t, g, unknown or other
  modified_base (10322)..(10331): a, c, t, g, unknown or other
  modified_base (10738)..(10747): a, c, t, g, unknown or other
  modified_base (11743)..(11846): a, c, t, g, unknown or other
  modified_base (11913)..(12088): a, c, t, g, unknown or other
gaggctttgactttccacttggcatctcccatgtctccacggggggtcccggaatccagccacccaatcaccccctcaccctccccgcgtcacaggttccagcgaaaacattggcggcggcatgctcctccccgcccccgccggctccgagtcgaagaccccgatgccctgcccctcctactcccatgcgaccgcctccagcgggcaacactaggtcgaccgaggcgcaaggcatgacgcggtgacgcaggagggaggcagggggattggtgcgctgccttgcagccgcgcccgcacatctgtgcgaccccactcgccgccgaggcagggtatcccacccttttgtttgcgggacctctgcacctcccttgcacccgcattccgcccccattctgggcagttgctgacgacggccgcaggcgctgcctcctcatgacagtaccacccctgatgtgtgtgcgtgcgtgcgtctctattcccttcccctgtgcgnnnnnnnnnnctgaacagtcttagtgtgctcctctgcctgcaggttatttacaatgggccggacccaaatacactcaggggtagtgtnnnnnnnnnnatgaacagttttagtgcgctcctctgcctgcagattatttacaatgagccggacccaaatacactcaggggtagtgtctgggggacctgtaaatgccgcagcacacattcctcgccaggtgccttgttctcacaaccacgcccaggccccccggcaagaggcagtacctccgatctnnnnnnnnnnggcacacattccgcgccgggtgccttgttctcacgaccacgcccagcccccccggcaagaggcagtacctccgatctccagcacacatcaaattcgacaacccctgcccacctgactctgcgcctcctcggccaacctccgcgcctcctccgcctgacgtctcgcnnnnnnnnnntgacaaccctgcccacctgacgctgcgcctcctcggccagcctccgcgcctcctccgcctgacgtctcgcctctgcctctcccgcgctcgaagcctcgagcctcgtttcgagctgcgcgactacgctggcatggcgctcattcacctccgcttccagcgcccttcgctggtcgctgcaaggaagtcaagggatggtgcaggcgtgggaggcgcggtggcggcgcctctttgcagtgcaagctgcacacgcctcaaataccaagcagttccagcccgcaaagccattgcctgcagcagccataattcccccactcccggcaaccacctgagctcagcataccgccgctgcagatctgccagctccgaccttgcacttagaagctgtgcggcttgctcgtcctgataccttagcttggtttccaaagcctcacactcttgcctgcacaaaatgcattgatatggtgttgcattcgtcctgtgtaccagcatgaagcatgtacgagtgccggcccaatctttggaagagagacaccgaggccagtggacccggccgggcttctggtctgccacatgagattctgcagctgatctcagcaccctccaaatctgaaaatttgcttgagaagaactccagttttcggtctttcagtttcacgtaccgatccttcttccaaattcacgccaacaagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttccaacgcctcaaccgccgcagcgcgctcctcggcggctgcagcgcgcnnnnnnnnnngttccagttttcggtcatttcagttccacgtaccaatccttcttccaaattcacgccaacaagcccttctgccacccacctcgccgcggccaaggccctgcccaggccctcctgctcggcccgtagcgcctccgccaccgcaccggcagttcccagcacagaagccagctcagccctgctttcttccacctcgcgccgcaaggcgaggctctccgcctcggcagcgctgccgcgcgcctcggcctctttttccaacgcctcggcggctgcagcgcgctcctcggcggctgcagcgcgctcctcggcggctgcagcgcgctccccggctgtggcagcgctctcgtcagcggcggcagcgctctcgtcagcggcggcagcgcgctcctcggcggcggcagcgctctccccggcggcggcagcgctctcctcggcggtgcgccgcgccgcggtcgcggcttccagcgaagtctcggccgcggcggatcgcgccattgcggcctggagcgcctcagcgtggcagctgctggcctgggccaaacgctcctcggcctgttggacctcatcacgagcggcccggacggaagcctccagctccgcaatgcgcgcgtccgcttcccgctctgcacacctcacggcttccctgagcgccgtctctgtgtcccgctccgcctctgcagccctctgcgccgcagcgtcagccgcggcctgagcctcggcggcggctgcggcggctgcggcggcggcctggtccgcgacagacttgccggcctctgcagccgcacaccgggccccgaaccggtctcgctcttgcaccgccaagtcccgctcctgtagagcagctgccctggtggacactgcggcgtcccgatcttccattgcctgcgtgtgccaagcgtggtgtgcacatgagcgcagcggcacctcgccctctactgcctgcacagtgactccgaaccccacggcccattcaatgccctacagccccacactcgccgaccctgcgctcatccaggaccatccatagcaccannnnnnnnnncactgcctgcacagcgactccgaaccccacggccctttcaatgccccacagccccacactcgccgaccttgcgctcatccaggaccatccatagcaccacccaacccctcactcggacacccacctggcgacgtgcgcgctcggcgtccgctgcggcggcggcggacgctgtcttgattgccagggcatccgccctgtctgtgcctgccagcgctgccaggcgctgggcctcgcgggcatcccgccggtgctgggcctcggcgcgctgcgcacgctgcaggtctagcgccgcctgctgggccgagcgctgggcgctcaccagggcagtgctggccgtctccagctcccggacgaggcgcgccacctccgccttgtcggcccggctggcggcgagcagggtctccaggcgagactccagctcctgcgcccccgtgcccaggccgtttagggtgtgggaccgcgactcgacctcatgggtcagcttggccaggtgctcctcggcctgccgggcctgggccctcagccgacggttctccgccattctgggggaagatccgacgaaagcgggcgttgatgttacatattgtctcccttgatacgacacacatctatgcccaaccccccatcgcagcgcactctcggacgagcttgatcaccaggagcaacagccccgccagggccagccaccacgtcatggcctctcagtatatgaagatcggagatttaatcaagttaatattataacacaaggcgcagaagctggatccatcagtctgctgcttcgtgcagcggggaccctcgctgctgctgttgtgtccgagcgcgcggtgagcctgacccagtgcttaccaagagatcaagaggttacaccaggggaaaaaacacctcagctctaccgcatggtctgctggnnnnnnnnnnctactgcagtggaagaggacaccctcaccatgtcggcggtgagccttgagctgtgagcctgatgtgacccagtgctgaccaagatcaagaggttacaccaggggaaaagacacctcagctctaccgcatggtctgctggaatcaataatggtgcatgtcagagaatgggccgcagcatgcccgcacaatggcagccccaagcacgctcagtcacggggaagccactgggagccatgctggcgctggccccagccacatgcggccgggtgtgagtgcatctacgccaatagcttgccagggaatttgcgatggcatcagaccaaccccacacagcggacgcagtggggtccacattcaaagtcgcccgtcctcatcaggtgggcttgtnnnnnnnnnncgccgggccccagccacatgcggccggatgtgagtgcttctacgccaatagcttgccagggaattttcgatggcatcgaccaaccccacacagaggacgcagtggggtccacattccaagtcgcccgtcctcatcaggtgggcttgtccgcggacgccgccaccagcgtgaccgaggccgcgggggtcgtggcggcagggacagctgcctccgcctccggctccaccgccggcgcaatcatgaagtggtccagctccgcggcagcggggctggcggcgaactcgcggaagccgtcgacaacatccgggttggcccccgtggcgacgcccgggtaggtgaaggcggcgcaggccgcgtccacgtccatgtccaggcggtagtaggtgagccagaagccgcaggggatggaatactcgatgacctcgcccgcgcgcgactcggtgctgttgcacatgatctccttggggtcatagcagaagttgtagatggggcactgggagcgcttgaggaagcaggtctcctgcaccgcattgtaggtgatggactcgcaggtaggcgccatctggcacgcgatctggcactccagcaggctcacgttggcgcgggagccgtaatcattggcgtaggcgcccagcgcgtcgtaccggtaccccggcgcgtcggacggccaggccacgtccgcgcccgggtcgcaggcgccggcctcgggctcggaccagtaggcggaggccagggtcttgagcgcagcggcgtcaggggcgcaggtctcgccgtccccggcgtagccccagaagcaggcgcaggcgaagccctcggggtcgtccaggcaggcggcctcgggcgcgcaggtgtcggtaccgcgcacgcattcgttgatggggagggcgcaggtggggccctccatccccgtctcgggcgcgccgtccacccaggtgtcggagcagttggcgggcgggggcacgtcggcaccggcgggcctgcaccccgccaccggcgcggacagctcggccgccacggccgcgttctccaccacggggcggaaggcggcgtcggactcgtagatgccgtacaggcctcggccgccgccctcggtcagcggcgcgatctggccgtcggcgtaccactgccagaagagggagcccttgagcgccgacccggcccgctgcagctggctggtctggtcgtaggcggcctgcatgaacaccaggcggtcggccagggtgctgtccgggtcggtctcgttcacccacttgccaaactcctcctgcagcaccggcttcttcagcgtcttctccgccgcgtcggcgtgcgcagcgatccaggcggactgccactcgggcgtgacctcctgccagttgtccacccaggtgtggaaggtggcgaagtcgatgtcggggctggagtggtcggcgatgaagtcctgcccctcctccgcggcccactccgtgtactgcacgcccgggttggcggtgccgcccgcggcgaagaagccgtcctcgcccacggtcagcaggtggttggggtcggcctgcttcacgaaggcggccatctccttgacccaggcggcgatggtcccggcggggcaccccgtgcaccgcggctcgttgatcaggttccaggcgaagatggtggggtcctccgagtagcgccgcccgttgatggtgttgacgcgggaggtgacggcggtgacgtgggccttgaacaggctggcgatgctggggttggtgtagaactgcaccggcgcagtctcccccgcccactccaggtactggggcaggccgcccacgggcgtccagttggaggtgaaggccaggatgagcttgatgccgcgctggcgcgcctcgtccagcaggtagtccaggccgcggaagacggcctcgttgtactcgcccggcgcggtctgcagcgcaaagcgctcgtccaccgtgaaggcccaggtgcgcatggtgttcaggccgttggcctgcgcgcggtccagcagctcgcggaccaggccggggccggtgaggttggcgggcagggacgcgccggagaggtagggcgcaccgccggcggcctcgaccacctcccacctggtgcaaggtggttgggggtggggaggggtgaggcgagggggtgcggggtggtcgacgaggaagggggctgcagcggcgaataggtgtgtggacaagtgcagcgtttggtgagggttctatggcagagagagtgtgcagccctcagctttcagcccaggtctcctgccacagaggcagtacagacatcgggccccaccagaaaagaaaaccatcgtccttcctccccaaacccccactcactggttccagccggcgggaaagaacagctcgcagccgttcacgaagtcgccgtccttgatggtgatgaagtactccggctccgtaggctgtgtggcacccagggccggggtggagctcgcggccagcaactgtgcagggggaggggacggggggtcatgatagggtgcgataagagtgacaacggcattacatgaccatgtgcaggggttgcaggtccgaggcgctccgcggcgctggacgnnnnnnnnnngtaaggtgcgataagagtgacaacgacattacatgaccatgtgcaggggttacaggtccgaggcgctccgcggcgctggacgcgggggggcccgcccccgtcccagaccgacgccgacccccaccccttgcaccgactcctcaccctgcggtcagccagcgctggtgctgccaccatggcagcgaggaggagggcaatcatgccccgacacgccatcctgcaggacagtggtgggagtctgcaaaagcccacacccggtctacagggatcttttggtgcagggtgttgacacccacgaatgcgatgcggaaggggtggctaaggtgatcaaataagcaacaacattagccaatcatgtgtacattgcatgagatggggggccttcctatagtctttctacgcgtcgcaggccaacgctggctgaggcaagtctctgcccgaccactgggacgggccgacggcctgtggttgaacctgacggcgtgcccatgtgacccacgcccctgcatgacgcctggatgtctcggactcacgacaatcggtctgaccatgtgtacctgggacgaggacaccgcagtcgagggcattgccgcccatgcatgcaagtcgacagcgatcaccgcctcggacctggcctccgggccacggggaggtgggtggagctggtcaggagccggcccacctctccttccccttgcgccggtgcagccccacgggcatgcgtgcctttatgtcatcggccgcggacaggtcgatgtcagccagggcaatgcccgtggccgtgccgtcctgcagtcgtccgcacacggtgccccaggggtcgaccaccaggctgtgcccgtagctcacgcgcttctcattgtgctgccccgcctgcgccgcggcaatcacgtacgactgggtctcgatggcacgggcccgcagcaggatctcccaatgcgccttccctgcgatcagggtcggcggtacggtgctggcggtgagatctcgcccccagggaggggccggatcgtacggacaccggctcgaaagcatgcacgccctcgtttaccccctccaagcgggcctggccacagttaacactgaacgtcctttcaggctcttgggcctgatggcttgaacagtgcggcgcacgtgtttgatgggttgctagcatgctttcaaacccaatgttgatgttagcaactaattatcccaccccacttcaacacccccttcctccaccacgtcacctgtgggcactgtaaaggcactgggcacgagcaggacgtctgcccccttgtcaaacgccaggtgctggtacagctccggaaagcgcaggtcgtagcaggtggtcaggcccaggacgccggcggggctggcgcaggtcaccgcctgcgaccctggcgcagtgaatcggctctccagcagcaccggcccgctgggcacgtccacgtcaaacagatggatcttgcggtacaccgccgcagtttgaccccggtcgtccagcacgacgtgcgtgttgtggatgtggctgtcgtcggggccctcctcctgaaacccgcctagggacagccagaggcccgtggaggctgccagctggcggtagcgagccatcagggggccctccaggggctgcgcctgggccagggactgcgggcgggcagtgtgtgggtcgggcgttgaggaacgaggacaggtcacacgctggggcggtgcatggccgcgcctgacagatgggnnnnnnnnnnaggcgggcagtgtgtgggtcggggtttgaggaacgaggacaggtcacacgctggcggtgcatggccgcgcctgacagatggggggcaggaccctcgaaacattgatccccagatgcaggcgctatccccatgccggagtctttgcaccatgcaaccctcaggcaccagcctgcatcacctcggccggggatcggcccaggaagccaaagttttcagggaggaagagcatggccgcaccactgtccttggcctcctgtgggtgcagcgaagctcagtgaagtggaccagcccagaatgtgccgaataagcgccagtggcgtcggagctgagccccatgcacgtcctgctgcttctgccatggcccgaaggaggcacacctgcgccagcctctgacacgtcttgaaattggcgtccgggtctcccacagacgtcatctgggccaccgcgatcttgcaacttcctctcatgctcgatccatccgccacgctcgacatcccaccctgagaagagggcctgtgccaggaagcctgtacctggccccgccacctcctccccacggtctcgacgggaaaagcaccccgtccggggctgatcaccctcagcgcccggctcagactgacgatgccccgcatacaaatcgtatcgtgttatctgtcacgccagcgggtcctggatcatgtgtactcggtgagaagggggggtgaagacggtttcggcacaactcggctgagatggacgacatggtgttcccattctcaacaggcccagtcacgctcagaaatcgtcacccatcaacgccaccaagtgaattgtgcggtgcatgagtttctcatggatgcttacagagtacatggccttcaggtgccgtggacatgggaaggtgtgattgtacagggagcacatggcccccagctcaggcagtggccaggacatgctgctgtactgcacaggtacagagggtttccaggcagggtggtgccctcacaggaccacgagacctgccagcatgcgcactgcggtgagcagcgccgtcagcaccgccttggccagccaggggttggtgtaggctgagaaggcgccgtacgacaccgccaccgccctgtagatcgtacgaccccagtccagcagccgccggacgcgccccttgcgcagctcctacgatgcagcgcagggggggtgcgtgaagaaggggtcaggaagggcgaggcgagctcaagcatggctggcgggcgacgtggtgatgaggaaggggcatgccatgccctgcccctccttgcctggatggtctcagnnnnnnnnnntgaagggcgaggcgaggtcaagcatggctggcgggcgatgtggggatgaggaaggggcatgccattccctgcccctccttgcctggatggtctcagccagggccttctgcagctgccgtgagtcacaggaggctgcctccggaagggtcacgatgtaggcggcgatgaagtgactcatggcggcgacggcgtcggcatgctccaccacgacataatcccccgtgtcctcgctcactgaggaagggaggggagcagggtgggaggcagtgcgcaggctggagcgatgctggcctgggcttcaccgcgcaggacaccaaagtaagtgctcgggccggccccggccctgtgctggtccacccttcggagggccacaccaaacagcaacagaagaagactccatatctcgttcaggctgggataaattggaggtgacaaccaccgtcccannnnnnnnnntaccaaacagcaacagaagactccatatctcgttcaacctgagataaattggaggtgacaaccaccgtcccactctttgccctgagagacacacttgtgtgttccccccttgccgcatcaaccaacccaccggaggcaaaatcgccatcaggcttgagctcccaccagtctgcctgcaaggcatggctgtggggtggtgcctggtcaacccctccagcgggcggggtggggtccggctggcctgcggcctcgctctccgcccgcgccgactcgagggagtgcaggaaggagggctccgagacatgctcctccagaagacgcagtaactgtcagtccgagtaagaaagaagcgtgtcaggtggaagactgcacatggaacggcaactccctcctctcaaagcagagannnnnnnnnngagaggcgtgtcaggtggacgactgcacatgcaacggcaactccctcctctcaaagcagagaagttcttttacagtatcactgccagtgcctgtcccaacaaatcaccaggcaccttccccccaaccgaacccgccagccctggtgcgaaccttgtccgtgccaggctcggtggaggcgcatgatttcacccatgcctgcgtgttgggctcagctccaacctgctccaacgagtgcctgcaagaggggttgcccgcaagatccagggtcgagatactccgttttcagatcaacggtgactcttcagcacacactatcaattacctgctcctggagagcacgtgcagaaggcgagggtcatttagctcctcgccggccatgtcagggagtttccgaaaggtaaccaagccgtgcgtctcatgcccgctccgggagtagtgcaggctgtcacagaataaaaacgcaagaagcaagtaggggatggtcagtggcttgttaccgagcgcttggtgtcgccgagtgaggaagtgatccagatcgttacgaggcgcaccgagattcccccagacgcgggttgaaagccccaagtcgccggcagccccttcacacacttcgagtgccatggatgagtttacaagggaaaggttggcacagcacctgctgcaatggaggatcccacgtgtcatgggggttagggtctatatcgaaggagagacgaggcgtgcggagaagtggaggagcatggacagtgtcaggtgggaggggtcctgcgagccccctcctcaggacgttgataaaaggacggggggaaggggggcagcagacctgtggattcagcccatcagcctgggcatgcatgcatgggatggataagtcacgcacaggggaagggaatagagacgcacgcgcacacatcaggggtggtactttcatgaggaggcagggcctgcggccgtcgtcagcaagtgcccagaatgggggcggaatgcgggtgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatgtgcgggcgcggctgcgaggcagcgcacccacccccctgcctccctcctgcgtcaccgcgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgctggaacctgtgatgcggggagggtgagcgggtgattgggtggctggattccggggaccccccgtggagacacgggagatgccaagtggaaagtcaaagcctccaagttgccctttcgtcccctggcgctgaacatcaccgggcaggcccagcccaggagccattctgacacaggagccattct

SEQ ID NO: 45817 - DNA, 69 bp, Chlorella protothecoides
ttggttcctcgtctcccacttcatgacatggcacaaatcccaggtccgagaatgatgagaagccgactt

SEQ ID NO: 45818 - DNA, 89 bp, Chlorella protothecoides
cctcatttgcttgctgaagcagtctgccgccccttaccacacccctctcaaggtgggagcggatgcgacatgctttgcaattgacgtgc

SEQ ID NO: 45819 - DNA, 69 bp, Chlorella protothecoides
agcgacgatgcagattttcgtcaagaccctcacgggcaagactatcaccctcgaggtcgagtcgaatga

SEQ ID NO: 45820 - DNA, 69 bp, Chlorella protothecoides
cctcatccatcttagtctcttgttcatcgcccagcatatctcggcgcagggtttaggcgctgctgggtg

SEQ ID NO: 45821 - DNA, 61 bp, Chlorella protothecoides
ggtaggctcggatgcatggcatcagtggctcacagaattacctccagccaagagacgggaa

SEQ ID NO: 45822 - DNA, 61 bp, Chlorella protothecoides
gccgtcatcatcatcatcggcagcaccaggtgggaccttggaagaaaggaagactacttag

SEQ ID NO: 45823 - DNA, 66 bp, Chlorella protothecoides
aaggtgagatgctatggaggggggctggatcatgacgattggaggtctgtgcacgaggccacctca

SEQ ID NO: 45824 - DNA, 64 bp, Chlorella protothecoides
ggcattagccctctgagctgtagtgcacactgcgcaggagtctcattctcgtgtacagggcttg

SEQ ID NO: 45825 - DNA, 120 bp, Chlorella protothecoides
atgaggactcaacagcacatacttggatgacatagcacacgcctcttcaaactttgatgtttggttctccgtggacatcctgagtctctaggcacctccagactttgtttgggagatcct

SEQ ID NO: 45826 - DNA, 74 bp, Chlorella protothecoides
cgtccccctgcctgcctcagcgctcaggccagcgacgccggctgccccttgattctccaggtcccgcaccgcct

SEQ ID NO: 45827 - DNA, 61 bp, Chlorella protothecoides
agaagtagatgtgcattcccttcaacacgcacctcccagtgtgatgagtgtaatcgtccac

SEQ ID NO: 45828 - DNA, 61 bp, Chlorella protothecoides
tggaggatgacgacgtgatgccatgcatctggagtccgtgaccacccgtgttgcacagtcg

SEQ ID NO: 45829 - DNA, 72 bp, Chlorella protothecoides
tgcctcccaaggaataggacgcccttgccatcgcaccccgggcagactcctgctgggcagtcgtgacattga

SEQ ID NO: 45830 - DNA, 95 bp, Chlorella protothecoides
cttcggggagggtccccagcgggtcccatcttctgcctcccaaagctcgagtttcgccccccagccccaaaaccagagatagaacagcccattcc

SEQ ID NO: 45831 - DNA, 61 bp, Chlorella protothecoides
atggagtcctgcatacttgataatcaggcctgcatgacacaccgcccatctcccttggcca

SEQ ID NO: 45832 - DNA, 64 bp, Chlorella protothecoides
tgtggatggtcagctgttcttgatctcggagaagagcggcccagcattctgccggtgagacatt

SEQ ID NO: 45833 - DNA, 61 bp, Chlorella protothecoides
gtatctgtacttctccaactggctgcggggggacatcgtgcagtacgacatcaccgaccca

SEQ ID NO: 45834 - DNA, 142 bp, Chlorella protothecoides
ccggaggatgcttgatgctcctgacacatgccgcacaaccctgatgcaaggccaaaccattgaggccagctcgtgcaagacacgggcagcttattgagcttctaggatcttgcaaatgacaccgtcgcctcccgtatcctcg

SEQ ID NO: 45835 - DNA, 90 bp, Chlorella protothecoides
ggttatcgaaattgcgggtttcgaggaaaaaagcgcgaaattttcgggaaaataacattctcgaaattcgactccgaaatttcgtgctga

SEQ ID NO: 45836 - DNA, 3237 bp, Chlorella protothecoides
  modified_base (101)..(213): a, c, t, g, unknown or other
  modified_base (645)..(654): a, c, t, g, unknown or other
  modified_base (811)..(820): a, c, t, g, unknown or other
  modified_base (1805)..(1814): a, c, t, g, unknown or other
catggccgcctcgccgctgcgtgcgtctgagttctcttgttgttcctggaagggcgggaggggttgtgtttccaatgggcgtgagtctgcagggctggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccactcccactgctgcaggtgcaagcaacggcgccgctccccccgccccgcaccattcgccggcacggagtctggacggcgagaatcggggcgccgaggccggtggccagcccaggcccccccacggcgccaagcgcgcaagcgagggtgccagggcgggcgacgacgcgccacgcgaggggtcgccggccaaggcgccgggatccgccccggggacggcgcgtgtcttcctcccgaccaccagccccgtgcggaggagggcctggatctgagcccggagattgagcccagcttgcgtgtgggtctgtgcgctctgacgcccacaagcaccggggcggagtcttgctgtggaggctcagcgcggtcctcgattgactcttgcgtcgtggcgacacacccggcgccggcgacggacagaacgggcctgccnnnnnnnnnnctcctcgattgactcttgcgtcgtggcgatacacttggcgccggcgacggacagaacgggcctgcccatccatgatcccgtcgcatgaccatccagacaatgcctgaagaggctccaggctccccccccttcaccacatcaagcaaaccttgacatnnnnnnnnnnatcgcatgaccatccagacaatacctgaagaggcgccaggcctcccacccttcaccacatcaagcaaaccttgacatggcggggcgtcgatcgccccagcctgcttgacattgcagccgccctgccctgcacccacgtggcaacagatagaccatgtacaaagccgcgtcaggggagcaggggatcaacaggtccaggcagtcgctttcttggggacaggcagcgaggagggcagggggatgggcgcctcgcggcctgtcagtcgtggcgcttgcctgaaaggggcacggcctccagtgccccctgactggcgcaccccaccgggttgccgaagtccctgccctgcgggcgtgccagaggcaggctcgctgggcggtgggatgaggcgggagaccgcgaccgcatccaggttgaagcccgactgcctgggtggagccttggtgaactgggctaggctggcggcgtcgcgcggctgcccagacccggtcaggctgcgctcccgcagcagagtatcgacccgggcgatctcctccctggtccaagctcgctctctgcgacggaaggagagtgcgcggaggagggcagttgagcggcctgggctgggtgttagacacccgagctctctaccaaactgttgtcaggaatcccttcccccactttccaccatgcagttgtcccagcaagacacacaccttgagggtttccaccaacacgcacctccgcgccgagagcagggtgagctccaggcgatccatgctggccgcttggcccgccagcccctcctgcaggctgcgctgctgctcctggatgcccgacagcagcgccgccagagagggggacaccgagtccagaccctcgcccagcggctcgcggtctcgggcgagggtgggggggggggaatttggatgcaccccactcatgtccgccccacccgcagtgcgccctggcctcggcgggcccgccatcaccgcaccacgcctcacgnnnnnnnnnntgggggggggactttggatgcaccccactcatgtccgcgccacccgcagagcgccctggtctcggggggcccgccatcaccgcaccacgcctcacgctcgaccccgctgccatgggcttcgtgccgcgccctgctgcggcttcgcgacccggagccccagccgccactggaaaccccgggtcgtcgtcgcgcgcggccagccgctggtggtaggcttggatctcggcctcctcgcgttcctcctgcgcgcgctgctctgcgcggcgtgccgcatccgcggcccgcttctcctggacctggcgcgccaggtcggccttcagcgcggcctgcttcgccgcagcttcctcggcctgcgctcgtgtggggccggggcgcagggactgcagcgaggccaggaaaccccggccccggccctggagggggggggaggccgaccccggcatgggcacgcccgattgccagccggcggcagttgatggcggcggtgaggtggcgctggtctgggaacggcgcgacagggtttccagtgcatctgcagccccgtcctgggattgtgcgtgggtaagacgcgccgtgtggcttccgttgtcggtagcttcgggtcctggggctccagcttgttccactcccatgggtccgtgaggcacgacggcgtcccccttctccgcagcatgtggtactccctgctgcaggctggcacgctgctgctgcagaatttgcagcagggagtcgatctcgacctgactgagggccgggtgcggggctgggatggcgctggggggatgggcccgagcctcctgttgatgcaccgccccgcgaccgggagggccggaggttcggcgtggtggtctgggatccctcgcaccttgcagaccaatgcacggggaatcttgaataagatggtgggtcctgggccaaaatctctgaccttgaagcacatgcgcctaccttgcagtccattctttgggggagcaaagtacgtcattctggctagaccggccccaggaggcagattgtggacctacatcacccaatatgcaattcagtatgttctatcatcagtttttcgcatcgccaagagggtttccgacagagtttcggggatgcgaggttacatcgctcagtcaattcttgctttgactccgacactcccgcaccacccctatccgcgaacatatgcggcgcacgagtcgaagatatgccgctaccgggcttgcgccggttgcacagctgcttcccgcaagcgggatctgacttgcgcagttggttgcctctaatggcgaaccggagaggtgggggggcgggagaagggggagcaggggggccaccaaatgcagtgggacgaagtgcattatcaaaaaagcacttgagcaacatcagcatgttgaccaccccgttgacatcgcggttgacgacgttgacc

SEQ ID NO: 45837 - DNA, 61 bp, Chlorella protothecoides
aagctgtgggacgggcctcccgggcaaaaaggcacttggtcagcatcagcatgttggccgc

SEQ ID NO: 45838 - DNA, 61 bp, Chlorella protothecoides
ccgggcccggtcccagtatatttatggctacagccaagccgcgacgcagctttcttcaggt

SEQ ID NO: 45839 - DNA, 3275 bp, Chlorella protothecoides
  modified_base (455)..(545): a, c, t, g, unknown or other
  modified_base (925)..(934): a, c, t, g, unknown or other
  modified_base (1631)..(1640): a, c, t, g, unknown or other
  modified_base (1974)..(1983): a, c, t, g, unknown or other
  modified_base (2302)..(2311): a, c, t, g, unknown or other
  modified_base (2511)..(2520): a, c, t, g, unknown or other
  modified_base (2620)..(2643): a, c, t, g, unknown or other
  modified_base (2704)..(2713): a, c, t, g, unknown or other
  modified_base (2855)..(2864): a, c, t, g, unknown or other
aggggggctgggaggtggtggtgatggaggtgggctgggaggaaatggcggtggcggagatggatggggcctgggggaaggtggtgatggaggtgggcttggtggaggagggaggttccttgaaggaaaggggctaggcagtggagagggggggggtggaggagaactcaggttcgaatgtgggggtggagactgcttggcaggtggaggtgggaaagtcttggcaggtgggggtggagacttctttatgggagggggtggagacctcttggcagatggaggtggagacttcttagcaggtggcggaggagatttcctggcgggtgggggtggggatttcttggcgggcggcggtggaaacgcgagagtccttgcattcttgcgaagctgaagcaagttgcaatcgttgacgactttgcgatccccgacgctgttgaagcagcggttgcccttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttggagttccctgcagaggtagcaccatatcactgtttcctctgtttcacccagggttgcagcagcagtgcacattctgtataccgttaacaacccctgctttgctcaccaatgttgtcatccccgacgttcctagtgccaaagttgttcttgcccttactgccggagccgatgttgccactgctgtctgccgtgcacgccttctggcccgccttgaggcactccacggctaccaggatctccgtagagcgtggtgtcacgatctccaacgtgctcatgcggatggcactcactgagagacccatgatgtcgagagtggatttacggacagatcccgccttgctgaagcccttatgcctgcaacatgtgagaggtgggnnnnnnnnnnggaaaccccttggcgggtggcgggggggaccatttggggggaggcggaggatagataagcttccatgcatactttctgaactcctgcaggctgcagtcgttgacaatcttgcgattaccagtcttgtcaaagcagcgattgcttgtgcctttattattgtttccccagttagccgtgcccacattggagttacctggaaaaggcagcaccattgaatttgttagtcagtttcacccaaatctgcaacggctgtgcaaatatcccatgccatatggagcccccgcccaacccctgctcaccaatattgtcatccccaacgttcttggtgccaaaattgttcttgcccctgttgccggagccgatgttgccatcgctgtctgccgagcacgccttctgtcctggcttcaggcactccacggcggtaaggaccaccgtggatcgagctgacaggatctccaagttgctcacgcgaatagctgacatggagagccccatgatgtggagcgttgaggtgcggagtgaccccaccttgctgaagcccgcatgcctgctcacagggtggaaggagggggcggaggggtgcatttactgggttttgtacagtttggtgcacttgagaggctatgcctgcctcgggatggctttccgtggccaggccactgatttgcaagcaaaccctgggatttcataacccctnnnnnnnnnncgtgaccaggccactgatttgcaagcaaagcctgggatttcataacccctctcatgctgcccacctgcagatggcgtcggcgtcgtcaactgtcatgaggtacacatgggctcccagactgcaaggaggcgagcatgtgcggcatgaggtcagagaataggcgtacagtgccttactaaaaggcacagtcgaaggctctgtgtttgtgcatgtccgaggaaagcagggtgggctgccctcaggaagctgggtatcgacgcgcacaaaaccgcattccggcggcagccatgtgcgcaaggggtccgtgcggacagaaacgtcgcccgtgcagcannnnnnnnnnatccggcggcagctatgtgcgcgaggggtccgagcggacagaaacatcgcccgtgcacacgattcccgttgtgaaaccagctctcagctcacattgcactcggaagcgcgatgaatgtggagctgcacggagcctgcgctcagatgggagatagggggaagtaagcgacgccgcggtgtagcagcgtggatgatacgtgatcgtcatcggcctgagtgcactgggacccaccgcaaaggcacaactggagagcagcagcatcagtgcaatcaggatggcagggttcccggccgccgctggcatcctgcacccctcagcnnnnnnnnnntcagtccaatcaagacggcagggttcctggccgccgctggcatcctgcacccctcagcaacttctttcttccgcctgtacgagttacgtgtgcggtgggaaggaggtgcaaccccttcgatgaagtgcaggctcattataaccacacataccacgggttgacgtgtaatacgatgaatcctagcccgtgcacaggcttcnnnnnnnnnnagggggtgcaaccccttccatgaagtgcaggctcattataactacacataccacgggttgacgtgtaacacgatgaatcctagcccgtgcacaggcttcnnnnnnnnnnnnnnnnnnnnnnnncggtgacagcgtttccggctgcacttgatgtggacctgctgacaacctcaaaatgctctgnnnnnnnnnntactcacgtttttctcaaccccatccctcacaatcaatgaaggttgccctcattcgacgtggtgacagcgtttccggctgcacttgatctagacctgctgacaacctaaatatgctctgcggagaatcgtcactccagaagnnnnnnnnnncattcacgtcttccttaaccccatacctcacaatcaatgaaggttgcgcctcattcgacgcggtgacagcgcttccggctgcacttgatctggacctgctgacaccctcaaaatgatctgcggagaatcgtcactccagaaggactgattgaggggttagtgctctatacggatgctgtcccccattttaggtaccagccggagatttttacccatccttcatacagccgagcatcgcccaggttcctgcctccaggaggttgtcaacccgtacatgagcgtgaaaggatgtcgcgattgccccaactgacgctcaaagccatcttgggggattccactcagtaaatgatctcacctcgggcgatggccgggtaaggttcaacgtcacgccagactatcacccacatcgca

SEQ ID NO: 45840 - DNA, 78 bp, Chlorella protothecoides
tcgcaggacgtcaagtcaacagggctggggttcatgtgtgtgtgtatgtgcaatggacaggtcacgcaggaacttgcc

SEQ ID NO: 45841 - DNA, 61 bp, Chlorella protothecoides
gctttggaaaggcatctgcacagagtgaggaccctctctcgcttccggtcccgacggtccc

SEQ ID NO: 45842 - DNA, 72 bp, Chlorella protothecoides
tctgtgcacctgtcgatcttctcgccgcgtacaatgctggcaaagaaaaggaaaaccccaggcagccagtct

SEQ ID NO: 45843 - DNA, 61 bp, Chlorella protothecoides
cctgtgtaatggcatgttaaagggctggggtgcccaaacacgccgcggaggagcagtaatg

SEQ ID NO: 45844 - DNA, 63 bp, Chlorella protothecoides
ccgccgccacgacatccacgtccattgggcagagggtctgttgcgtgccttggcctggatgcg

SEQ ID NO: 45845 - DNA, 61 bp, Chlorella protothecoides
cagcgggcgggccggagggcgacggcggggtggctgaatcgtccggaccgtgcgaaacccg

SEQ ID NO: 45846 - DNA, 411 bp, Chlorella protothecoides
  modified_base (156)..(358): a, c, t, g, unknown or other
gtgaactacttgaaggtgcctgccctgctgtgctcaagacgttgacaaccctctcttgttcacactttgaagcgactgggcccattccccactcgatgcctttcaactcataagtcttgatactagcatggatgcagtgcctgataacaatactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtatggcttgcaccgcacgagcctgagcaggtagcaggatgcagagccggga

SEQ ID NO: 45847 - DNA, 91 bp, Chlorella protothecoides
agcaatccgtctgcacaaaaggggtgtgcataggatccatctttggttggcttgatagagcgggtccaactctgcggtccctctggaattg

SEQ ID NO: 45848 - DNA, 61 bp, Chlorella protothecoides
ctgctaccagggtcctgccacaggggaacaactcaagccgttcgagagccctgaatgccaa

SEQ ID NO: 45849 - DNA, 102 bp, Chlorella protothecoides
acaccacaggacggcgccaaatccgctcagattggcaagccgatctcagtgaatgaatggatctcgatgtcacagtcattgcaccattgcgcgcagctttgc

SEQ ID NO: 45850 - DNA, 78 bp, Chlorella protothecoides
tcctccgcatgcctccaccttgtgtgtcaatgttaccatccagatatgcgcagggggtgaaatgtcatactccatacg

SEQ ID NO: 45851 - DNA, 66 bp, Chlorella protothecoides
agctgcggagtgcctggatccgtgcctacttgggttgggtccaccaacaggatttggaagtcatac

SEQ ID NO: 45852 - DNA, 61 bp, Chlorella protothecoides
accatcgagcttccccggggcggtccccccgctgtgcgctcccatgatttacacctctctg

SEQ ID NO: 45853 - DNA, 88 bp, Chlorella protothecoides
tttatcctccgcctctgacggcccgagaaacacatacgatggcaaaatggccacccttgacgtcgctccatttcgagatgaaggggtg

SEQ ID NO: 45854 - DNA, 61 bp, Chlorella protothecoides
cgatgggttcgtcacccgcagtagcggcttccgtcatatcgccgagtttctgtatctatgc

SEQ ID NO: 45855 - DNA, 80 bp, Chlorella protothecoides
cagatctgattgagctcccacgattgattgctggccaacataccctaagctttaacagagataggacagacgatgggtct

SEQ ID NO: 45856 - DNA, 76 bp, Chlorella protothecoides
ataatgcactcaattgcccagcgcaaacattttgacagcacagaccacacttggattgtataagtacaacttgcaa

SEQ ID NO: 45857 - DNA, 61 bp, Chlorella protothecoides
gcacattccatcttgggtaacacttgtaagtagggtgatgtcggctgggtcaccttgccta

SEQ ID NO: 45858 - DNA, 75 bp, Chlorella protothecoides
cagaactgcactgtgagacgctgacaccacgaaccaacacaatgtcacagccagcagacattggcactgcccgaa

SEQ ID NO: 45859 - DNA, 144 bp, Chlorella protothecoides
gcccacgctcaggtgcgatggcagctggagtgtggcgggtagcttgcacctgacggcctgcgagggagtagatggtcggtctgcagggggaaatgcaatgccatccttggatggccagggccccgcgctgatgtctggcttgtt

SEQ ID NO: 45860 - DNA, 66 bp, Chlorella protothecoides
gcgcatgtctcttcccaaccctacgccaacaattcgcgcatacattcaattccttgcagcctggga

SEQ ID NO: 45861 - DNA, 23908 bp, Chlorella protothecoides
  modified_base (1108)..(1117): a, c, t, g, unknown or other
  modified_base (1371)..(1380): a, c, t, g, unknown or other
  modified_base (2189)..(2198): a, c, t, g, unknown or other
  modified_base (3098)..(3107): a, c, t, g, unknown or other
  modified_base (4660)..(4669): a, c, t, g, unknown or other
  modified_base (4950)..(4959): a, c, t, g, unknown or other
  modified_base (5040)..(5049): a, c, t, g, unknown or other
  modified_base (5150)..(5159): a, c, t, g, unknown or other
  modified_base (6221)..(6230): a, c, t, g, unknown or other
  modified_base (6354)..(6363): a, c, t, g, unknown or other
  modified_base (6617)..(6626): a, c, t, g, unknown or other
  modified_base (7431)..(7440): a, c, t, g, unknown or other
  modified_base (8333)..(8342): a, c, t, g, unknown or other
  modified_base (8678)..(8687): a, c, t, g, unknown or other
  modified_base (9295)..(9304): a, c, t, g, unknown or other
  modified_base (10588)..(10597): a, c, t, g, unknown or other
  modified_base (11397)..(11406): a, c, t, g, unknown or other
  modified_base (11713)..(11722): a, c, t, g, unknown or other
  modified_base (12529)..(12538): a, c, t, g, unknown or other
  modified_base (13122)..(13131): a, c, t, g, unknown or other
  modified_base (13298)..(13307): a, c, t, g, unknown or other
  modified_base (13386)..(13395): a, c, t, g, unknown or other
  modified_base (14505)..(14514): a, c, t, g, unknown or other
  modified_base (16902)..(16911): a, c, t, g, unknown or other
  modified_base (18354)..(18363): a, c, t, g, unknown or other
  modified_base (18430)..(18439): a, c, t, g, unknown or other
  modified_base (18964)..(18973): a, c, t, g, unknown or other
  modified_base (19304)..(19313): a, c, t, g, unknown or other
  modified_base (19428)..(19437): a, c, t, g, unknown or other
  modified_base (19650)..(19659): a, c, t, g, unknown or other
  modified_base (19986)..(19995): a, c, t, g, unknown or other
  modified_base (20529)..(20538): a, c, t, g, unknown or other
  modified_base (22229)..(22238): a, c, t, g, unknown or other
  modified_base (22679)..(22688): a, c, t, g, unknown or other
  modified_base (22990)..(22999): a, c, t, g, unknown or other
  modified_base (23363)..(23372): a, c, t, g, unknown or other
ccctcgtgcccctcaccacacacaggttctacgcttcggacaacgagctgcaccgcctgttcaagtcggtgaatggcatcatcttccccggcggcctgaccgacatctggctggacaacccctacgtcatcgcggcgcgcaagctgtggacctgggcccgcgaggccaatgacgcgggcgacatcttccccatctggggcacctgcctcggcttccagctgctccacgtcctggaggccaacgtctccttcactgagctgctgatccgcaccgactcggtggggcacgcatccaccctggacctgacggaggctgcgccctcctccgcgctgttcggcggcatcagcccccacctggcgcgcaaggtggccgaccccgcgctgaacatcaccatggagaaccactacttcggcctccctcccgagcactaccagcgctggggcgtgctgggtgaggccttcaccgtggtgtccaccacccgcgatcgggtgggcgtggagtacatctccaccgcggagcacaggcgctaccccttcttcgccacgcagtggcacccggagaagccgccctacgagttcggcatgaaggccatcccacacagtctggacgcggtgctggtctcccagcacctggccaacgtgtttgtggacaccgcgcggcggtcggggcacgagcccgagtcgcacgaggaggagctggtcatgctcatctacaacaccaagccctacttcacgctcaaggactcggtcatggaccgctcctacgacgggccagacatgacctacttcttcgactcaaaggatgatgcgccagacaacgggctgcgtggcgccgagccgcggggctcaaccagctttgcggggcgggtgtaccgtggccaggaggcgcctcacctcaccgcctgggcatgagggggcggggttactgctgcgaaagacgtacaccctgtgtcaaagcattgatgcgcccagcacacacctctcaaagacagccaggaggggcaaagaccggcgagtagccgttcaggtacgcccaaccgggaaagcgagggtccgatcacctgcgcgcccctccccccccgtccttcggggacgcgcgccctggtccnnnnnnnnnntggcgagtagccgttcaggtacgcccaaacgggaaagcgagggtccgatcacctgcgcccttccacccgtccttcggggacgcgcgccctggtcccaagggtttcccaagcatgtcgtgacccaagggtaggcccgttattcagcagtgcttcttgcgtgaaaacttcggcttcaccatcaattcaaatcaagaaagtaatcaaggaagagccgagcgactttgaggtacgtcccgtgaggacggggtggcttnnnnnnnnnntggcttcaccatcaattcgaatcaacaaagtaatcaagggggagacgagcgacttcgaggtacgtcccgtgaggacggggtggctttgacacattgtccccatgcgtggtggccgcctgtgatggacacttcaggcccaggtatcttccggacgagccatcgagcccacatcgcgacgcgcagggctggagcaggggcatccgccaggctcgccatgaccagtgcagcccggctgcaggccctgtggaaccaccccgccgggcccaagaccatccacttctgggcacccaccttcaagtgggccatcacatttgccaacatcgctgacttctcccgcccggcagagctggtgtcctatcctcagcagtgcgctgtgacggccacgggcctcatctggtcgcgctttgccacccagatcaagccggtgcgttgaggggggggttgattgtggccacgagttcagcccgcgatgagcgtcataagggttcgatgaggagcttggtggttctgttgtggatctgatctttcgtacttcccgcaagtttgcatctccatatcattgccttgccttcctcaccacgtaggtgaactacaatcttctggcagttaactgcttcatggcagccacaggcatctaccagttgtcacgaaagatcaaatccgacatggaccgggagaaggcttgatggcagagaccataaaatgtacagaacacactggtctcgcgcagctggattgacagcgatcctgttgctgctgctgctccctccacttgttacacggaggccagaacatgccagagcatcctnnnnnnnnnnttcccgttgctgctgctgctgcctccaattgttgcacggaggccagaacatgccagagcatcctctgcaaatctaagcagtccatttgttgcaaagtgcaccgttcacctcagaggaagggacaaaatggggattggcctcgggaacttggttgcgcaacccgcactatcgcgaaattcaaagatgcgtacaccagctcaaatgctgtgccggtctcgtgcacacagcttcgacacgacaactctgtgacgtgttacctggacactccacatggtcaccgattttattgccttcgagtattccctgccaacggccacaggcaggtcgcccgtgggtaagcccgcccacatggcctcctcccaaggagacggggagaacatgcacccctccgcccctcgcgtcgtcgagccgcgtcagtaccctctccagtccctaccctcgaaccagattttcagtcctgaagcctttcgcacgccccagcacaagtactccagtagcacgccggctcctgatccgattgctcggctcgtggacctccagacgcggcatgcagcgctgctggacggcatagagcaggcccagcgctccgctgagcaggtgggatggatttgctgtgcaattgtgtggtgctgcgaggagttgcctggcggggcagcctgagtcggtcacctccctgatgcagccttaaacatactatgccccacccacccccaaaccccacagctcggcaagatatgcatggatcgcgaggctgcagcggatgctgccgaggccaggctgcaggaagccacggagcagctgcaggggacctccaaggagctgtccgggtcagtgacgtctgtgatatgtggttggtgacggagctcacaatgccatgccacacaaaacttggtgggaaannnnnnnnnntagtgacgtctgtgagatgtggttggtgaaggagctcacgatgccatgccacacaaaacttggtgggaaatgggtgcatgccttcgagcacattgctgcttgctgcatgaaaggattcacaaccctagccggcactcgtgcccatgctcccttcccctggacgcccaccgtccatgcagcctccaggaggagtatgaggccacctctgcgctgctggcgcggtgtgcggaggggttggcggctcagcacaccgccctggaaaccgccgaggtgtcggccgccgaggcggagacccaggcgcaggccgcccagacccggcgggccgaggccgaggccggggcgcagagtgcacagcgtgagctagacgccctggccgagcgggtcgccgccctgcgtggcgagagcgccgagctggaggccgccggcgccgacaaggcggaggccctgcggcgccagctggcggaggagtctgccgccgcccagcagcaggttgggcttgggatggttgcttttggggggagggggcctgacccggcaagtctcagttgcgggcacggtgtgcgatcaccaggacggttgcttccactgctacctccaaccgcgacctgggtgcctcgcccccccaaccccaacattcttactttctctcttgcgccttaccctcacagatcgcaagctgcgtggcggagggcgaggcgcgcctgcgaggggtccaggcccaggcatcagatgctgcacagcaggcggccgcgtctgtccgcgaggccgagcaggcacaggcccagttggaagagacaaactctcagctggcagagacaacctgccagctgtcggaggcacgacacttgctggcggccgcgcaggaagaaaccacgctgtgccgcagggaggcccagcagagccttggcacgctggaagccgacgtcgcccggctgcgtggcgaggccgtggcgctggaggccagggtggtgacgctggggagccggttggcagagctgagcgcggcgtgcagggcgcgggagggggaactccgggacctgcgggatgcggagggcaagtgcggggagctagaggcctcacgccgccgcggcgagctgctgggcgagggcctggacctgctcagggaccagctggcctgccagcgagagaccctggcagcggcgcgggagggcgtggccgccgccgacgcgcaggcccgggcggcggaggacagggcggcccgtgccgaggagagggtggcgcgggccgaggagagggcggaggtgctgctgtggcagcaggatggtgccccaggctcatccggcaggtggggcgggaaggaggggcagtggtggggctggggcgacgagcagggaagctcgtctcacagcagtaccccgcagcagtaccccgcagcagtaccctgcagcagtaccccgcagatgggggcgcgagcacagagtagtgcttggcaggcagggcacttctcctttgaggagccctatgggcagcatgccggccaccgccggctgcaatgcaagctcagcatggcacccgatgctcccttcgccacnnnnnnnnnncgaggagccctatggtcagcatgctggccaccgccggctgcaatgcaagcacagcatggcacccgatgctcccttcgccacaccacacaggtccttccggcccctgctgcaacatcgcgaccggtcggcgggccctggccacctcgacgccgaccagtgggccccgcccatgctgtcaggcgcctcgctctccagcaccttgggaatgcccgagcagggggccctggtgccaggtcccggccacccccaagcattggaccccggtcaagcggaggccctgnnnnnnnnnncgggaatgcctgagcagggggccctggtgccagggctcggccgcccccaggcattggaccccggtcaagcggaggccctgnnnnnnnnnncatcagaggagcactaccattcttgctgcgacgagacatatcatctgacaaccatcgaccgtacagcgtgatttgccattgttgcacccgtccacatactnnnnnnnnnncaccagctgggcgccatgcgctcggcggcgcaccgtctgactcgcgcactgctcctgctcatcagcacgcccgcggcgcgccagctggggatgaaggaggcggaggagctgcgggtgctgctgtccggcatccccctgctgcgcagcagcggcgaggcagaggccccccgctggactgactgacgacgcttgtttcctgagtgggtgaaaatatcagaggagcactaccattcttgctgcaacgagacatatcatctgacaaccattgactgtacagcgtaatttgccattgttgcacccgtccacatactagcagcgcgacagacaggagtaaggggctggtgacagaggagcctgcttgaattttgacacactcacaatcccccctgtctcattatgctgtgacgtcgcagtacaggccgtcccacaggatcatcttcttgtaggcctggtactgcaggaccaggagccccgtccgcttggtcgaccaggaagtgtcttcgggctgtgtgtcgcgggcgccgacgccggggtctgccgtgggcttgcctccccagcgggcgcccgcccgggcctccagggcgcggtagtgccgcagcgcggcagcccacgggtgctctccgccttcagcggcctgcatggccgccaggcgctccaggtcctggcacagcccggagtcaaacgccccggccagctcgcggcagcggcgggccagggccacctgcagggcagcctccagggaagccacgccctgatcgggcgggcacgggcgccacccgcgggcatgcagcgtctccaccacggccaggaagcgggcatccacgctggcctgcgcctgcagccggaggcggcccgcctctcgcgccgcggcgccggcctccacggcgggcatgcgcagtaagatgcctgggtcgacgggccccgccacctcggcggccgctgcggctgcctcctcccacaccaggaccgccgctgcctggcgagtgggcaaccgaagagggagtgggatgaggatctgcagaagccatctgtcaggcttttgctggactggctctgtgctcnnnnnnnnnntacggcgggcatgcgcagtaagatgccggggtcgacggaccccgccacctcggtggccgctgcggctgcctcctcccacaccagaaccgccgttgcctggcgagtgggcaaccgaagagggagnnnnnnnnnngttccaggcgtcgctaccgcaacaccacaagcgaccgtggggcggggtgtgtgagcaaatccgccttgaacgccctgaagacggtggcatgggccggcatgtttccccaccgcctcgacacagagcacgagggcagccaccagcggcgctggacgccatggccctgcgcagcccagggacagtctgtccgaggagacaggaacccacctcgtcaagggctgggtcgggggcctggaactctgcagcacaccatnnnnnnnnnnaacaggaacccacctcgtcaaggcttgcatcgggggcctggaactctgcagcacaccattgcagggcttcggtgacgtcctcaaacagcacgacatcgtcgtgagggttcatgggcgggacaaagccgtagtgcagcaggaagtcatcattgttgcgttcgcctggtattggagtgaggcgtaggaagtgacactcccgacgagtgcacatgcacggtcacaggcgccacagcgcctcaacgcaccgtatgagagcaggagctcggagcccgcggcgatgtcctgggtggcagacactgcgacggtccaccttccacccagctgcggcaccatgtcccatctgtggatggtggagagggaggaggcagggggtggaggttccattggtccgatgcgcaccgcaagattggaaacccacctgccccccacgcgcccccctgcacctcgcgttgtccctggagacgggctcggctcctgggctccagctctcgggcgtttcgtccccggcgtggttgatcatgtccacaaggggaaccagcatgcgtacgcccacccctccccgctttccagcagagccaaacgtccgggaatgcaccagctgcgcctcgcaggcaaggggtgaagggtggtggtggatgatggagcgggggagagttccggggtcgggcgttctgggcatgatgcgccacatcaatccatgcacagaataacactcctgctcccatgatagtttccacgcagcaggccaggccaccccagaccggcctcacccccagcgcccagtggaagtcggccgtgctccagnnnnnnnnnnagggggagagttccggggtcgggcattctgggcatgatgcgccacaccgatccatgcacagcatgacactcctgctcccatgggagattccacgcagcaggccaggccatcccagaccggcctcaccccgagcgcccagtggaagtcggccgtgctccagcttgcgccctgggcccgggcggcggcaatgccctcgtgcacgatccaccccagccgatccagttcagcccgggcgggggggtactgcacgatttgcagcgcctcccaggtcacgtccagccagggggagggggcattgcgcgggagcacctccaggtaaggttcccaggcgctccctgccgctccttccctgagggacaggaggcgcgaggccagggtcaggctccaaggcgcccccgggtagggcggcggcggcccgtccttgtcagcgtctgtgatggcgaggcgggccggcacgcgcagcaggatctctccggccttcacatcctgtgcgcgggtgtggtgttgtggacagggtggaatggggagctgcagacatggggcagaccaggcaaggccctggcaaaggccatgaggatgtgccattcaatttctcactaagagacatccctgcccaagcagggctcatcgacgcactttgacggcgaccaggcctcgactgtcaacatcttggccctcaaagagggcgaccttgctctccttgcttcctactccagaaacacctgtgcaagtgtcatgaagaggcacaaatagtgagtgactgtcacagcacctccatcacagcattctttcaatgcacggccactctatactagccctgtttgctgtacatgcaagcagacactctttgacccgcagtcatacgtaggttcctcctgcagccaacaccctannnnnnnnnncgtaggcaatgactgtcacagcacctccgtcccagcatcctttcgatgcacggccactctatactagccctgtttgctgcacatgcaagcaggcactctttgacctgcagtcacacgtaggttcctcctgcagccaacaccctatatccgtgaaacatcttaccattctgcagtgcccatgacaaaaaagttcccaaggcgtccttggtaggctgagctggtttagacgcctcgcttttcagtccagcctggatttttccttgcaacgaagtgcgaggcttgcctggagctcgccccatggaacactgccatttttggtggcccagagcagcactnnnnnnnnnnacccaaggcgtccttggtaagctgagttggtttagaagcctcgcttttcagtccagcctggatttttccttgcaacgacgtgcgaggcttgcccggaactcgccccatggaaccctgccatttttggtggcccagagcagcactgggtgatgcaccactggggacctgatggcgaagatgaggatcatgaaattgatgacctcgtcctgccagccgtatggatgcaccagatgatgctcgactccctgcgacttccagggtccgacccagaaatgcctgcatggagggtgagcgattcaggcgagcacgttgcgtccggccggttccatgacgggctcacagacagatgtgagctcgtctcgaaaaggaatgccaacttcatgcattacacggcgatgtaagcctctccttcccgtccatgcaggctacaatgcctccatgtgccggcgccggtcacccatccatgggagagcgcaatgccacgtcacccggcctttgttttccggggtgtgcagggaaaccatcaaagagccctcgaccgtattctggcatgcctgaagcacaagctctggtaggcttacaaaccttttggtggaagagtgcgatcnnnnnnnnnntggtcacccatccatgggatgccacgtcaccccgcccttgttttccggggtgtgcagggaacctttcaaagagccctcgaccgtactctgtactctggcatcaagctctcgcaggattacaaaccttttggtggaagagtgcgatccggcgcgactggctgactcactcccgacaccctgtggaagtgatcccccatgctccccgatccccggcgatgagcctgagctcctccgaggcggatgattttccggatgaagagaccagcccgacaacgttcggccagcgtctggtgggcttcgcctcgggattcggggaggccctggcacggaccgctgcctccgccacggtcctcctctctgacgcccagctgcgacgccagggcgcctcggtgctgagcgcgggggccagcaaggggcttcgcggggtgcagtccggcgtggtggcgggggtgcagcgcctgcaggccgggcccaagcagctgcgtgcagccctcgcccgcgtccagcagcgcatcgaggaggagcgcctggccgtgctcctacgggtgaggtggggctttcttctgggagggggatgattggtgggaaaccgactgccattacagcacttgtcctctatctcagggacagtcacatggtatcgtggtcggcagcctcgctgggtgtcttcatcgaatcttgaccatccagcatgtctaccttgctcttccagggagctgagtgtgaagggcaccctctctccagcagaccgcttccatccacttccctttccccccgaaaaccgttcgcgcttgtcaggagcagcgtgactcgccagtggatgtgcaggtcggatttcaggtgtacgaggatgcgccccaggagctccgttcgcggctgtggatggcgctgctggagcacccgggcttcgtgcgggagcaccgccggctcatggggtcgcgcaggagatccagcgtgccgctcgagctgcctggcgaatgtgtggagacaccgagggagagccaggccacgccgccggcaggcgccggctccgtcgcgtcagcagcgggacgtagggaggcccatgatgctgccgaggacgcagttgcgaccgacgggtttccgcggcaggatgacgtgggggctcacgatccaacaacggccgccgctgagtctccccctgctgacggggcgggcggccaggtggaggatggtagggaggaaatcatcgggcccctggagcagttgagcctggaggaaacagcggcggcccgttccgccgatgagacggggccatcgtcgcannnnnnnnnnatcaccagcgggacgtagggaggctcatgatgctgccgaggacgcacttgcgaccgacgggtctccacggcaggctgacgtgggggctcacgatccaacaacggccgctgctgagtctccccctgctaacagggcgggcggccaggtggaggatggtaaggaggaaatcatcgggcccctggagcagtcgagcctggaggaaacagcggcggcccattccgccgatgagacggggccatcgtcgcacactgtgcactccagccccaggaaggagtctggggagaccctgcccacgccctttcgcaccgccaggcccaatgccacgggcgtgccagggcgaggcgtgcagcctatcccagcgggctccgacgacagcgctgtggacctggactcccctcggcccttggaacccgcctcgctttcctccagcgcggaggagctgctggccagcgagccctccagctcggtggcctcgcccgcgccgccagcgcgggatgaggcgggatgggaggtggtgcgggacgggcggccagaggggagattgcagggggccgccctcctgcagagcgcctcagggtcgctgccctggagcctggagcgggaggcactgcgcaacggtgagtgggttgtgtattgtgtgtggggagtggaggctatgcgagcggtccctcgtcaccgacgtggtgtgtggggagcaggcctttaggggtgcagtcgtttgcactgcttcaagtatgctgacttcctcacaccgaccccaccctccaaccccctccagccctgatggcggccatggtcgnnnnnnnnnntctcatatcgaccccaccctccaaacccctccagccctgatggcggccatggtcgcgctgccctggccgctgcccactgactacccgccggactgtcgctactccaccctgctgcaaatcaggtgggcaagtgatggttgactttgcccagcatagcagggggccaatgcagcctggagactttgacagtaggtcacacataacggcagccactcgagcagcacacttgggcactgcaccccaacccccccccatcctacccaccctccgccacctccagcgtcggccaggaggaggtggacgaggnnnnnnnnnncgatggttgactttgccccgcatagccggggtccaaagcagcctggagactttgacagtaggtcgcacataacggcatccactcgagcagcacacttgggcactgcactccaatcctacccaatcctacccaccctccgccacccccagcgtcggccaggaggaggtggacgaggtgatcagccgcgacatccaccgcaccttcccggagtacccgctgtttggcgcggagtcggggcagcaggccctcttccgcgtgctcaaggcctacagcctgcacgacctggaggcgagtggattacgaaggctggggtgatggcgaggggtcgtgtgcctgctggggtgcttgctggccccacatttgactggccccgtggttccccgatgttgatccctcgctcgtgcaccccaggtgggctactgccagggcatggcgtttgtggcggggctggtcctcttctatgtcccggaggagccggccttccagcttttcggccgcctcctctcctcctccggccccaacctgcgtcgcttctacctgcccggcctggcggggctcaagtcggagctgctgcgcttcgacaggctcatgcagcggcacatgccggccctgcgctcccacctcgaggtctgcatgtcgtcaggctgtgtgggcatgcggtgtgccggcgggggtgcggcctgagaggtcttggcacaggggtcgagccgcttcggtccccccccgggcagggtgtgatgtcattcctgaccccttggcacaggccctttgctgccacaccggtcccctccacccactcgcatcctnnnnnnnnnntgtgaggctgtgtgggcatgcggtgtgccggctggggtgcggcctgagagatcttggcacaggtgtcgagccacttcgatccccccccggggcagggtgtgatgtcattcctgaccctggcacaggccctttgctgcgacaccggtcccctccacccactcgcatcctccaccaccctccaccccccaggcgcacggcgtgatccccgtcctcttcgccagccagtggttcctgacggccttcgcctgccccttcccggtttcctttgcctgccgcgtcatcgacggcctgctggccgagaacggcagcgaggtgctgctgcgtgtgggcctggccatcatggccgagtgcgaggctgacctgctgctgcgggacgactttgaggacctgctgacctttctgaaggtgcagggattctgtccctgccaagaggggtgggccttgaagtggctccaggatgtatccggcgggcaacccctcgtggcccactggcggcccttgccacccactcaagtgaggggtacttgtgaccgcacgtctcctggtccctgttgttccgacctcccaacctcccctcccaaacnnnnnnnnnncgtccctgccggaaggggtggggcttgaagtggctccaggatgtgtccagcgggcaacccctcgtggcccactggcggccctcgccacccactcaagtgaggggtacttgtgtccgcacgtctcctggtccctatcgttccgacctcccaacctcccctcccaaacnnnnnnnnnncttgcaagggaaccaaggtggatggacgggagattctgcttcttgcagggcgcctggcgtgcaatttttgtgctgttcnnnnnnnnnnaatggcagcctggatttgggctgcgaggaggtgcagggcgccagcgaggatggcgctgggccagtgcccccacccctgcccaggtgaggatggaccgggcaggagttttgggtgggcgggggagactaggtggttcccgggtgtggaaggtgcttgcaagggaagcaaggtggatggacgggagactctgcttcttggacggcgcctggcgtgcaatttttgtgctgttcgtggcttgcattacggtaggttgagtgtcatgtgtgcgacccaggacccaccacccctgcctgcaccattcccacaggacgccgctcaagggagctgaccccgcacgggaggagagcccctcccctgcacccctcatggccgccgccgacgcggtggatgccgacgtcgccaagcagcgggcagaaatggacgaggactttttggagatggtcctggagctggaccatctgtggacggggggggcggtgtccaacgccgccagcgcggcgtatgacgagcacctgggcggagtccgcagtgctgagggggcctgagtcatcgcgtgcaaccgcgcggctccagggttccggaaccggtctgtgctacgatgggtttgcaggattgggacgatgtgcagggaggggagggagctgcgcgatacccccgactcggaatgcactgttgcataccctcctggtctgcaagcactgcacacttcgatctcaacatgccgcagcagggtgcctgcccagtgtcatatagctccatgtatgactgatgcagcacaccaagggcattgcaggggtgggagtagggattcatttgtacggaagaaaggctggcagcacccaatactccgctcctgcagcccaacaatggcaagcccagatctctcctcctggaggctcccacccccctagaggctggcaggcttgctgaactcgatcttgtccaccttgacctcttcgccgtgcagctcgtacacgtacacagtcacctgcatgaaaaggatgcgggcatcacctgtgccggaacggaccaggaacaaggttccttgagcttctcagccccaccgcaacacataccacccccagccagagctcaccctcgggccgtcgnnnnnnnnnnctgccggaacggaccaggaacagggttccttgagctcctcagccccaccgcaatgcagaccaccccagccagagctcaccctcgggccgtcgatatccatgagcacgaagctggggatgggatcgggcgtgatggtgctgaaggcccccgtccccgacccggggttgatcacgaatcgaccttcgtgcttgtaggcctggaaggcatgggtatggcccagcaccaggatgtcggtgttcagcttccgctgcaggatggcggcggccgccctgtcgcccacggggacgatctggtggccgtggcacatgccaattctgaactggccgtaggtctggacctgttgggggggggaggggaggcagcactgaggtcgcccgcagggcaaggtgccagcggcggccatgacctcatcacaccgtcgccacccaccagggtgtctgaccacttgctgctgtcgtcaaagtcgccttgcgtgacttgcacgtcggagcagatggatttgaggtagtcataggttgcctgggaagagttgggggattaccagggtcatggatctgctgcaggcaagtcaatggatcagaggtaccacccctgatcatggagaggagagaaagggcccattggaatctgcaaggtgcacgtcccaggaagcattgagcagaaaaagacgttggcctggccctacctccgtgcagaggttgcccgggcagaggatgtggtgaatcttcccaggcacaagcagggccttgaacttctcgtgcaggtctggcacacggtgtgggatgtgcagatcgccgatcaccagcaccagcatgatgctgagtgaggaaggcagagcccctcgccagtagatgagtgcgaggggagcctgggctgtatccgcgcactgcgcccacctccggtgtgaggagcgactgccggcctgataccctgactaattatggaagggtcctagttaaaaggtgagggcgaatgcaggattggatcttgtgtgactgaccgactgtccacccgagttcgagagtgcagtgagcagcagcgcccggatccacctccgacattggtcagccgggcttcccagcagtggtataagagatgaagagacccgctcgtacaccgttttttcagcccgaaactctacaaacccaataaaatcactgtctatctctccacctggatgggtacactcgatcggtgacagggacggcagtcatgtccttctgcaaccttgaccaggccctgcagggtgcgtgtgtgcgggatggaagtgccaagcctctgtgcctgctgcggcacgcgcctgctaaccttcctctgctcctttgcaggggtggagagggccgtgcgggatgcccgcctgtcccacgagcgggcgaatgccgcgagctcctccgacaagggccggatggaccgcctagaggccaggtatgggaacgggatgtggatgcagccagcctcggtcgacggggctccagcagcacccacgtctccttccttcactgtcttagcctccccttgtacccctcccccgccagcctgcgggaggagcgtgccaagacggcgcggctggagcgggagctggcggctgccacaaggccgcgcagcccgcccttcagggcgccacgcccggcctcggagcgttccgcggcctccgcgtcgtccgcctcgcgccggcacaccgcctccctggccccacgcacacagagcctgcaggggcagctgatgcgccagtgcgcggagctggccaagctgcgtgccgcgcttgcggcggtggagtctggggaggacggcgtgctgcccctgtcccgcctgcgcgagatgctggaccgcgcgctgcgcctgcaggagagcacgctgagcgaggtggcggcaggggagggcgatggcccgggcgaggggcggcgcgcctcggtggacgaggaggtgagtctggccgacgacgggtcggcgggggtgggggccaccgccgccgcggcggtctccgtggcgctggcgcagagctgggcggccacggcacgccacgccacgccctccagcacccacgcctccttcacccgcgccaacggcggcgcggcgccgggcaacggccgcgcccgcttcaagctggtggccgccgtgccgcgctcccgccggaaaaaggtgcccggagtgagggtgtttgcttgtgtgtgttttcctggaagatctatggggttccatgaaaggcgttgcagtcacgaatctcgtgggcgacttggttggcaggagggggcatggagatggtccccggcgtcggccggaaacatggactcgatcgctaccgcaatccagccgatgacaaaacgccgcctttcaaagcgtcccccccgcgtcgcctcgcaggacggcggcgcgacgcagaccacgctnnnnnnnnnngtccatgaaaggcgttgcagtcgcgaatctcgtgggcgacttggttggaaggagggggcgtggagatggtccctggcgtcggccggaaacatggatccgatcgctaccgcaatccagccgacgacaaaacgccgcctttcacagcgtccccccccgcgtcgccttgcaggacggcggcgcgacgcagaccacgctgaccaccaagctgagcatgctgcccacggaaagcagcgtggccctggactcgctggcggatgcctcgcgcaggtttgtgagagggtctgctctggtggtctttctgtgcgctcggctgctggattcgtgccgcatgatgcggacgccaagctggcacgtgacacctgagtcgctgcagggttccagcgccccctcctctggcgattcccacccaagctccatcttctgaaccaccaaaccccttcccccacccgcacacaacaccacagcgccatggacgacgagcaggaggcgacgtggcgggcgtgcgggagccaccttaagctgcactggctgtccagcccacgaagcgtgctgctgtccagcaagcccacgcccagcctggcgccacgcactgtggatgccgtgctgtggctggtgcgccgtgggctgacggtgtgggtggagcccggggtctatcgccgcgtgcgcgcggcggtgggcgccgcgctggcggaccccggcgcggggccccccggttcgggggacgagggactgagcagcgtggggagtggggatgtggcggggtcgccggggcccggctgcggcctggacgccgggcggccgccgcgcgggcccggcagcgctggcgccgggggcgcctccacgcccaacctgtgccgcctggcggacgaccaggtggacctggacgcggcgctgcgcacgtggaaagcacgccgcggctgttgggggcggggccggtccggccaggcaggagaggtcggcgaggaggcggggtcgggcggcgaggaggcggaggagtatgatgacagtgagccgctctggggggatgaccatgaaatggagcagagcgacggccacacggcagctcagcggcgctcctcgacagcgtcccgatcggcaccgcccaccgccaacccctacgcggacgtggagggccccgaacccttgcccgcccgtgtggcttcagccatcgatctggtggtgaccctgggtggcgacggcaccctgctctgggcctgctccctgttcggggacgcgcccgtgccgcccatcgtggccttcgccatgggctcgctggggttcatgacgcccttccccgccgcgcgcctctgcaccgtgctctcccgcgtcgccagcaccgcccacggcttccccatcatgctccgccaccgcctccaggttggtttggggtgttggtttttaaatgtgtcttttgttaattcgaggggaggggggatggggggnnnnnnnnnnagtttggggtgttggtcttataatgtgtcttttgtttaatccttggggggaggggggggggggggannnnnnnnnnagaacccgagccaggaaagcatgggccggactcagtcccagtaggcacaaggcagatgcgccgccgatgctccatcctcacacattcacatcaagctctgtgacccgtccccgccccccaaagaccaacaacacaccgcatcgcagggcacggtgttgcgcgaggcggcgggcgaggcggcgtgcccctcccccccgctcatggtgctgaacgagctggtcatcgaccgcggcaccgcgcccagcctgaccaacctccacgtttacgcggacggcgcctttgtgaccgtggtccagggcgacggcttgatcgtggccacgcccaccggctccaccgcctacaatctggcggcgggggggtccatggtgcacccgggggtgccctgcctgctgttcacccccatctgcccccacaccctctcctcccgccccctagtcttccccgagcacgtggccctgaccatcgtggtcccgcgcgaggcccgcgccggggtatacgcctccttcgacggcaagcaccgcgtgnnnnnnnnnntgttccgcgcgaggcccgtgccggggtgtacgcctccttcgacggcaagcaccgcgtgctcctggcccccggggacggcgtggcggtgcgcgcctcgcacttccctgtgcccacggtgtgcaacctggacgccagcaacgactggttcaggagcgtgcgggacgggctcaactggaacgcgcgcgtcgtgcagggcgcgggggagaaggcggcaaaggcgtgaggttaagcatgggtggagagggagcgcggggtgggagggggggtggggacggcaccctgcctcccgctccaatccacagcccctgcggagaccttcggccccctatgnnnnnnnnnntgcgtgagggtaagcatgggtggagagggagcgcggggtgtgagggggggtgggtacggcaccctgcctcccgctccaatccaaagcccctgcggagaccttcggccccctatgnnnnnnnnnnaggcagtcatcacagtttgttctatccgtttacagggcccctggggtctgcgaaacatgcatgattgggaatgcaggggggagtgtgcatgggtgggcatgcgagagtgaagggggaggctgtggtccctcacatgggagcagcagcgtaagatggatgggcacgaggtcatcactgggtcgcatagggggccgaaggtctccgcaggggctnnnnnnnnnnttgcattcccagccatgcatgtttcgcagaccccagggaccctgtaaacggatagaacacactgtgatgactgccgtgatcaggtcctgatgagtccatctatcccacgcagctctagcctgctcatccgatgctgggcagtgcaagtgtacacagtcgagggcaatctgacactgtggtgagatacagagcacagcttcactgcaattccgagagtgacagcaggcatggcatgcagtcatgtctgaataaacatccagcaccaacagtaggctgacgatagataaagaatgtggaattgcaaggtaacgccagggctgcacaggnnnnnnnnnnggtcatgtctgaatgaacatccagcaccaacagtgggctgacgatagataaagaatgtgaaattgcaaggtaacgccagggctgcacaggagggacaggcacccaaagggaatgcgtggaggacagaacacagggccctctctcaccacgctgcatcctcgttgcttgcctcgcgcccatcaccgcccgtgccagccttcgcccccccctcctcctcttcccaggggacgccttgctgggcaaagacatcacgcagcgccgcctcggcatccgcgctctcctctggacctcgcccaccatcggcgccctggaatctgatggccaggtcaacgccaaaggcttcgggagggcggtacaccccgagggaggcaagctcggcctccagcgaggcgtcacgcagctccccggtcatggcacgcaggaaggtggaaagcaggtccgcgctggcggcggcctcggcggcagaacgcgcatcgccgacggctcgggatagcagcaggtcatgggctgccttaagccgctggaactcctggnnnnnnnnnntgcgctggcggcggcctccgcggcagaacgcgcctcgccgacggctcgggatagcagcaggtcgtgggctgccttaagccgctggaactcctggacggcccccggatccctgcacttgtcggggtgcacccgcacagcccgtcggaggtagtggcgccggatgaggttgggcgtgtaggggccgctgcctggcatcggcaggcccagggcatcggccgcctgggctggggtcagacccgcctccatggcgccgtcattggtagcagtctgggggtgaagaggagaggaatgcttggtatctacgtgcacagaagggtctgtgtcatcatgtttaggatggagcttgcagaacttcaggatgcaggccgcgtactctgcatgatggtgctggtctgaccgtgcaaattctctgcaagcacgaacatcgcagctatccgcccacgcaggctcggactcgtgtcacttcatgtgaaactcaacatcggagatgtcgacctgccacatcaatggttgtgcgcgcgaaagtaatcccagtcaggatatcatcattcgcctgctggtcaaactcagcagcgcctgcctgcatttgtccctgggctccggcccccgcctccctccctggtatgttcgagagagcctacttagtggcggcaagcagcagccgtttcacacttctgttcgtacgtgctccaacattgcaatcccactcggcagtactacctgcctgtgtgtgcaggtagtctgctcacttgttaccatgtaggcctcattcactggctgcggagtgcagcaccaggtgtgtgggcgggcccagctggacggcactgtttcatctttggggtgtgatgagcttgaatgtcgccccagtcctagtacccgcagccagggtaacagcgatgacgatcgactcagccagttggcttctgaccccgacgccactcctttgtctgtttcccatatgcatgcctgcccggtcgtgatgatgaatgccttcccagctcattccgatcccatatgaagagaatataggttctcaacacgtttatattctgagcgacccttttcttttcttttggcatgccggccgatggctgcccggcctcccgcctctgagcatttggccccgagtggatgtgacgacacaattttatacacatggtccgtgtttctgattgagcttgtctcatgcagagatctgactccctgatccactcttcacgctccctcccttgttctgccgcgctttctcttgagttccaaatgcccttctcacatccgctgaccccccgtccactcctcctgcgcagatgacattctagacgtttgtgtggagcagcagatgctgtcgctcgggcaaaccaagcgccattgatgcctccatctcagggtacgtgttggtctgtcctccgtcccttttggtgtcccaaccccttcttgcctgctgccctcgtggcaccctgtgtgttgcatggatgaattgagaattggactagagtttctgatccggctagataccggcattgacgataaagttctcgatttctgagcacacactttgagctccacggcgtgatgccctttttcactgaaatctcagttgttgcccttcaaagacacctgctgttccctcacacctcttgatctgctttgcctctgttgtcattttccactgccctgggctgcttctactnnnnnnnnnngtttcactgagatctcagttgttgccctccaaagacacctgcttttccctcacacctcttgatctgttttgcctctgttgccattttccactgccctgggctgcttctactaagttgagccactcgccttccatgcgagtgggtccgttcccagaagccagactgatgaggctgtgaggtgttatgatcaaggcatcaacagctgtcgacccggagacacgctatcccgccggcaggctccttgtgccctcgcgggacgtcgttttcggatattccccttccgcagcattcccacacatgcattctacttccaggccacgacatgcccgcacattgacagtcgcactcactccttctcctgctgctttcctcacagcctgcacagcaatctctcaagagaggcctgcagtcatttccgtgaggacgggctgttggaggatnnnnnnnnnnattcccttccgcagcattcccacacatgcattttacttccaggccacgacctgccagcacattgacggttgcactcacaccttttcctgctgctttcctcacagcctgcacagcaatttctcgagagaggcctgcggccatttccgtgaggacgggctgttggaggatgggcttggtggtactgccagccctggagcttgggcctgcaccccagcctgcgtctgttggtgagtagcttgttgtgctggtggatccacgccctcatgcgatcccatcccatgcccgctatgatgacggtcgannnnnnnnnnagatccgcgccctcgtgcgttccatcccatgcccgctatgatgacggtcgagccttgggctgcccatgcccctggctcaacataaatcacatagcaagagcaagtgggcaagaggctgtgccccatcttgctccttcagtgcagggggggttgcttctatgctcgtacatccgcaccctcagtgcttgcaccccttgtgtgaattgatgggaaggtcacttctcatcaatcccatgtatccataaccctcaggaacactttggaggtcgtggacaccctttcgatgctcagtaatggcgtcatccccttttccctttgaagtcaagacagaatggtgtcggccatcatcaggtgaatgggtctnnnnnnnnnnagctcagcaatggcgtcatcgcctcttccctttgaagtcgagacacagagcggtgtcggccatcatcaggtgaatgggtctgcgaggtccatccctgggtgtatcttggtctgggatgaagtacaagcattcctttcctccaatacgactcttgttctctcctttcttcgtggaaccatctcaatacacagcttgcattgcgaggacgacatccttgaggctgtttctgaacgggctgataacccactccttgattacacactcaaatgaaaaacgacttcttcttccactgagcaatgctggatggttccacatccctcctttgtcctatctcctgcgtcttgccttttcaaaagtatcagctgtctgtgaagatcctcgcctgggggctttcctgccacccatcgcctgcgtacttgatgcagcacgtttgcggcaacctctgagacatcactcttggctttcctagtggcttcgcacacttggcaatgatgaaatgtgcccaggggctttcctgccctctacctcttctgcac

SEQ ID NO: 45862 - DNA, 80 bp, Chlorella protothecoides
ccaaggtccatggccagcgctggcgtccagggctcacagttctggatcactgcccctcccaccaaatctagctcttgcac

SEQ ID NO: 45863 - DNA, 22050 bp, Chlorella protothecoides
  modified_base (111)..(120): a, c, t, g, unknown or other
  modified_base (1304)..(1313): a, c, t, g, unknown or other
  modified_base (2018)..(2027): a, c, t, g, unknown or other
  modified_base (2106)..(2236): a, c, t, g, unknown or other
  modified_base (2959)..(2968): a, c, t, g, unknown or other
  modified_base (3408)..(3417): a, c, t, g, unknown or other
  modified_base (3476)..(3485): a, c, t, g, unknown or other
  modified_base (3551)..(3560): a, c, t, g, unknown or other
  modified_base (3707)..(3762): a, c, t, g, unknown or other
  modified_base (4470)..(4479): a, c, t, g, unknown or other
  modified_base (4953)..(4962): a, c, t, g, unknown or other
  modified_base (5893)..(5902): a, c, t, g, unknown or other
  modified_base (6512)..(6521): a, c, t, g, unknown or other
  modified_base (7764)..(7773): a, c, t, g, unknown or other
  modified_base (8295)..(8304): a, c, t, g, unknown or other
  modified_base (9780)..(9789): a, c, t, g, unknown or other
  modified_base (9942)..(9951): a, c, t, g, unknown or other
  modified_base (10378)..(10387): a, c, t, g, unknown or other
  modified_base (11244)..(11253): a, c, t, g, unknown or other
  modified_base (11353)..(11362): a, c, t, g, unknown or other
  modified_base (11468)..(11490): a, c, t, g, unknown or other
  modified_base (11571)..(11695): a, c, t, g, unknown or other
  modified_base (11796)..(11805): a, c, t, g, unknown or other
  modified_base (12052)..(12061): a, c, t, g, unknown or other
  modified_base (12205)..(12214): a, c, t, g, unknown or other
  modified_base (12572)..(12581): a, c, t, g, unknown or other
  modified_base (12984)..(12993): a, c, t, g, unknown or other
  modified_base (13729)..(13738): a, c, t, g, unknown or other
  modified_base (13986)..(13995): a, c, t, g, unknown or other
  modified_base (14072)..(14081): a, c, t, g, unknown or other
  modified_base (14200)..(14209): a, c, t, g, unknown or other
  modified_base (14902)..(14911): a, c, t, g, unknown or other
  modified_base (15951)..(15960): a, c, t, g, unknown or other
  modified_base (16229)..(16330): a, c, t, g, unknown or other
  modified_base (16877)..(16886): a, c, t, g, unknown or other
  modified_base (17707)..(17716): a, c, t, g, unknown or other
  modified_base (18018)..(18027): a, c, t, g, unknown or other
  modified_base (18188)..(18197): a, c, t, g, unknown or other
  modified_base (18976)..(18985): a, c, t, g, unknown or other
  modified_base (20696)..(20705): a, c, t, g, unknown or other
  modified_base (21025)..(21034): a, c, t, g, unknown or other
  modified_base (21502)..(21511): a, c, t, g, unknown or other
gcggcgagcccgggcgaggggggcgagccgacggcgcggcgcgcggggcgcctgccgacgggccgcgctccctgccctctgcgctgtgagccgcgctggcctccagcgccnnnnnnnnnncggcgcggcgcgcggggcgcctgccgacgagccgcgctccctgccctccgcgctgtgagccgcgctggcctccagcgccacgctcgacctgtttgatgcagtcgatggggcagcggtgaggcaaagggtatgccgggggtggctgcgatcaaggcttgtggttccctgaaactcgatccctcttgccccctggcccctgcctgtccacgccgcactccgcacaagcctgaagggaatggcacatgcacgggcagggctgggaccacccctcacacactcgagaaagaaaaagtttcccacatgaggcgctgctcaaaatcccagttgccgcgggagtgggccgacagtgccgccttgaggacgggggtctggccgtcgcggggcggggcggacgccgtcttcttcccgggctgcgtggcggacagcaggacgtagagaccctgaaggggggggagaggggggaaaaagggggaaatgaggaggtggtagggcaggacaagatccgtgcacgcattctcaggagagggcgagtggggcgagggcagccagccggaaacaatcggtcatcgggcggcgcctgacgatgagccgatgccatgatgcgagaggggttgatatcaggacatcactccacacaaacccagtccagcaaaaagccggggtgcctccacgggcggtggcacgcaccttgttcacgtggctgccggtggggcggcggtggaggggttgatgggggaggaagtgaggaagggttccaccattgattgggggctctgccccatgacaccaagcagcctggccccaaccactcagccactggaccctgacgcatacagagaatggcacattcggacccctcccacaacagctgcactcactaggggtggcagaacatcatgagcgggcgcaggaccaccgccgccagcagttcggaggtcacggtgaagctgggacagcgggtggggatgtccttggggtccaggagcaggcgcgcaatcccacgggagacggcgcgcagcatctgcggtggtcatttttgggggggtgacgggcggcttagcctttgtggggtccctgcagcccaagccccctgtagcccagtacccatgcctctcagtctgcagggaccgcatccgggtcttggtctcccgaagcagggccccccccccccccccccccccccnnnnnnnnnncggtcatttattggggggtggcgggcgtcttagcctttgtggggtccctgcagcccagtacccccctgcagcccagtacccccctgcagcccagtaccccatgccgctgagtctgcagggaccgcattcgggccttggtctcccgaagcagaccccccccccccaaaggcatgcctgtcgacccacgcaaacgcccatggcccctgcagagagcctcgaacgagtcgatccagcgctcgcggcgcacccaccaggtagtgcccctgcgggctgtgcatggctgggtgcaggttgttctccgccttcatctccctctggaaggcgcgctcgcgggcggcgggctgcatgtccttcagggccaggccgcaccgggcggccagctggatggactcccgagtgtcgcgatacaggtcaatctgcagagggggaggggtgggagcccaaacggtggggggtgatgggggggggaagggaagaggggaaacggcacacaaacaccttaccccacccctccacatccgtgggccttgagggatcctcagtcgtgaagacaggggacaggggtcccaaccaaacagcgacaggatgcaatgcagaacgagggttccgccgaggtgcggccctggcagcccctgtcaaccacagaagtgtgcggagctccctcccgccgccctccctccctccaagggtacctgctccatgagnnnnnnnnnnaggtggggggtgatggggggagaagggaaggggggaaacggcacacagacaccttaccccacccctccacatccgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaacagaagtgtgcggagctccctctcgccgccgccctccctccaagggtacctgctccatgagcagctcagacaggtcgttcagcacggcacgcaggtcggcccgccgcgagcgcgcggccagctttccaaaggcgtcgttcagcagggcccggatcttggcggggaactcgcagtctggcgtgacggccgagtaccacacgtcgtagatgaactgcgccgcggggggtggcgggcaggggtgggtgctggcgggaacaggagacccaggtcctggccatgccctcaggatgccaggaccggcccacaccgaaaacccgggcctggtgcagacagcgggttcgccccacaccacccacctcctggacgatggagccgcagaggaggtgccaggcgtgcgccaccacatcgctccccacggcctcccgccagtcggtcgggggcgggggtgtgcggagggtgggcagcgggtcttcgccgggagggaccgcggcaggagaggacgcgggccgcaccctgcgtcgctgccccggggcagaggcttgctccggtgaggggcgggctggcgtgaagagcttggcgctcgccacaaggagcatggccagcggtatgttgcccagcagggaggcagtggtccctgcacgagacggggcagcggatgcaccaggtgggaagggtccaggcatggcaacctgtcaatgggcaaagctcgggatgccannnnnnnnnntagtgggtgcagcaggtgggaagggtccaggcatggcgacctgtcaatgggcaaagctcgggatgccattcaactacataagatcaatcgcaagtgagggcccccgcgccctgccccccgcacccccctccgcctcgcatttacccacttgacaggagccatgccagggcgagtgggagcgcgacccagatcagtgcaagccgcacgcgctcctcatgatacatgctggacggacgggatctcagctggtaatgctactcaatagacatgcagaggcagcacgtcccgggccatgcatgccgttcctcggcgaggcccggagaagatggtcaagccctgtgaagacaaacactgtgcgtcccggggttcaccgcagctctcaaccccctgtgttactgatcaggatttatgtgtcacattcccgcactccctctgcatgnnnnnnnnnngggcgcgaaatctggacgcgcctcggtgtgctgggccgcccatctccaaggcggggcannnnnnnnnnaggcgcgaactctgtacgcgcctcggtgtgccggctgctgggccgcccatctccaaggcggggcannnnnnnnnnacactgtgcgtgccggggttcaccgcagctctccaccccctctgttactgatcaggatttgtgtgtcacattcccgcactccctctgcatgtgttctcgccaagttccctccgactcgggactcgcgacagagggtggggtccccannnnnnnnnnnnnnnnnnnnnnnnnnnnnnnnnnnnnnnnnnnnnnnnnnnnnnnncacactccagggcactgtggctgcaccgctcctggccagccccccgccgcgatgcacagcctgcacgatcgctgccccatcaagctcagggcccccccgcgcgcgccgcctcccgcagcgcctccttcctggggcggatgacctccaggcccatcatgaagggccgcagggcgggcgggatgacaacgctgccgtcctcctgctggaagttctccaggatggccaccagcatgcgcggcacagcacaccccgtcgcattcagcgtgtggacgaagcgggtgccctgggcccttctggtacccaggtcccccacctcctcgagccgcggcctgcgtgtgtgtggatgcaagcggggactgggcctgctcagcgcattgcctgaccggcaaaagtgctcggatgccgcgcaggtgccaggccagcttcctgggcagcccctctcgcgggggctgcccaggaagctggcctggcccaaggggcacagccagtgtccccctcgtgcatcacttttccccccgcacttccccctcctaccactatatgcctatttcccctctcccaccactatatgcccattctcctctcctaccactatatgcccatcccccctcctgaaatgtcatactgcccattcccccccaaacccactacaccaccttcccaccccccacccacgcgcccacctgtatcgtatgttcaggcggcgcnnnnnnnnnntccccccaaacccactataccaccttcccaccccccaccccatgcccacctgtatcgtatgttcaggcggcgcgcctggtagtcggtgcagttggaggcggaggagatctccccataccgccccagccccggcatccaggcctccacgtcgtacttgcggtaggccggcgcgcccaggtcgccgctgggcatgtccaggaccttgaagtgcaggcccagccccgcaaacaggcccacctccagctccagcagctcctcgtgcagggcctcgctctgctccggcgtgcacagcacaaaggcctccaccttggtgaactggtgcacgcggtacaagccccgccccgcagcgcctggcagggttgggtgggtcgggtgggtgggtggcgtgggcaggcggggggagcgggtggcgcacgggcggagagctggggtgctgggggccaatgaggagaggagagggcattcaccggatcnnnnnnnnnngggtgggtgggtggtgtgggcaggtggggggagcgggtggcgcacgggcggagggccggggtgctggggtgacatgaggagaggagagggcattcaccggatcgcagcgacacccccgccgcccgatccccgccgcccgatccccgccgcaccccccctgcacacctgccgcgccggcctcggtgcggaagcagtgcccgacgcctgccagcctgagaggcagctggtcctcctccagcaccgcgtccatgtgcaggccggccagcgggatctccgcggtgcccgccaggcacagccccgcgccctccaccgagtacacctgggtgttggccgcgcgcggctggaagccgcagcgctcaaacacgtgttcacgcaccagatccggcgtcgcgtgcggcacgaagccggcggccaccagcgcgcgcagcgcgtgcgccaccagcgcctgctccagcagcgccgcctcgtgcttgaggtagtagaatttgggccccgccacggtgctcccggccgcaaagtccaccaggtccaggtgggccgcgagctccacgtggtcgcgcagtgggaaggcaaacgcgggcggcgtgccgacgctgcgcagcagccgctcggcgccctccccgcccaccggcgaggcggggtgcgtcgcgttgggcaggcgttggccctccacctgcagcgcggcctccaggctgaccagtcgtccctgcaagccctccagctcccccttcagccggcggccgacggccaccagtgccgcgcgctcctccgcgcccagcttggcctggggaggaggggacgcaggggtggcaggagggtgagtgttgtggggatgaggtgtgcggtgtgtgggcgtgtgaatgcggggaatctatcgatagaatgcggttggatgggcactgcaggtccctgaccagccgaggcaaaaccnnnnnnnnnnaagtggacacaggggtggcaggagggtgagcgctgtggggatgaggtgtacggtgtgtgggcgtgtgaatgtggggaatctatcgatagaatgcggttgaatggtcaatgcaggtccctgaccagccgaggcaaaaccgcacagcacgacacgttccctgggcctggccttgcaggctgtccaccgggccgcccactggcccactccaaagccttagcctcctgagaccacccctcaaacacactttccccccccatttcaccttcatttgggcgctgttctggttgcgctctgccctgacccggtcggccgcctgctgcagctcgagaaactggccatacagcgccgccacccgctccgggtcggcgctcgctccccgccgccggcagttttccaccagggaggtagggtcccgctgaatggccttgaagtctaggtaggcgtgaaaggcaggggcgggggcctgggccagctctgtggaggcagcactagacatgctggacctcacacctgtgggtggggcctcccagggcttgatttcgagggttgcggcgcggtaagaggcataaaaggttggaacatatccatccagcctcaacgcaccggagcnnnnnnnnnnagcgcgggaagagacataacaggttggagcatatccatccagcctcaactcaccggagcagcgcggatagtggggcactgggcgcgcacagctgcgggaggcgtgctgggtggcgagcccggtgaacgcaccacacctgccggcccagctcgtcatcctcgacaccgatcggtacatgagcctgggattgggagtctcagtgcatgctccgccgcaccgcgtggcgagttgggagcctcggggcacggtgtcgcaccaccgagccactgtgactccccgtcccgatgccgagcaatgccagtccaggaatgggtctcgtgtcaaccttttgccaagcttgcatcaggggaattagtgtctggcgctttaacacaacatgctcatgcatgcaatgtcgcgggatcagatccagggccccgtcactttcttctgcagttgctgggcacgtgctggcatgaggccactgggccacccagccaccgggcctgtccgaggcaaggatccgtcgccatgctccgtcaagcattctgcacgctgtccacgatggcctctgccaggtaccctgccttcgcccggttcagccccgccaggctgatgcgcccatccttggtcatgaaaacatgccactgcatcagggggcaagggaggggtgggttgtggggcacctctcaggccgaggctgccaggtcgtcggcaggcatcccacgaccagaggccgctggtctgcggtgcttgatcccccggcacacaccgccatccgccccccccccttcagccacaccttgttggtcatgttttccacttgctgcggggacagcccggtgaaggagaacatgccgatctgcggggtgcagagagtggccgggtggtcgagctggccccgcgcccgggctgcatcggctgcaacccagacgcccggaaacaggtgcgagctgtgctcacgcccctgccggcagcagcggcccacgctctcaacactcgtcatcccccagtcgagcactgccctgtgtccctgcccccccacccccacccttcctagcctgcctggttggtgacgaagctccagtccttgctcggcagcaggcgggtgaggtggtcgaacaggtcctgtcgcaccgtctgaggttggggggtggggtagaggggtctgagacgcactcggatgcgttttcttcgcaccgacggcgagccggcaatgtccccgccctggtgtggcgcccgacccccgaccgtgatcctgcgnnnnnnnnnntacaggtcctgtcgcaccgtctgaggttggagggtggggtcgaggggtctgagacgcacttggatgtgttttcttcgcaccaacggcgagccggcaatgtccccgccctggtctggcgcccgacccccgaccgtgatcctgcgccctgcccatgccctgccgcgtcaggccacccgcctgcccgcaccttgatgcggccggccatctcctccatctccacgttccactcgccaaacatggcggcgtcgcccaccacctccgccactatcctcgcgccgtgcacgggcgggttggagtagatcgccctgttgaggaaggggtcccaggtgcagggtgccggtggtgggatggccgagacccgcgtgtttcctcaggggcaccctgacctcggacatgcttactctccccacccacgccacccggaggggagactcccctgcacccttccccccctcgcaacccttcccctcgcagtgcggcgccctgcatgcaccccacctggcgatgcgtttgagctgggannnnnnnnnngggaaggggtcccaggtgcaggggtgccggtggtgggatggccgagacccgagtgtttcctcagagggcaccctgacctcggacatgctcactctccccacccacgccaccaggaggggagactaccctgcacctttcccccctcgcaaccctttcccccgcagcgcggcgccctgcatgaaccccacctggcgatgcgtttgagctgggagagcaccctgtcggccgcctgcgagctggccagcacgatgttcagggcgccgatgcgctcagcatagaggcccaggttcttgctgtacgactgcgcggacagggcgggggaagggctggcttgggggaaggctggcaggggccagcggtgggggcggggcggcgcgtcggccaggggtgcgatcaggaggaggggaggggcggccttgcattccgcagctcccagccacgggcaggaaacagatgggggagtgtgtgtgtgtgtgtgtgtgtgtgtgtgcgtgtcgatgccgccggcgggcgccgcggcgcggtccaggcacccgcgccgccgttcagggagccccccatgcccccccgcctggcccctcgtggcgccctccacggtccccgcgccgcgcctttcccgacctgcgccaccaggacctccaggccccgctccacgaagaggcgcggggcgaatgcgtcatcgtccaggctcccgctcgcgaagccctgcgtgtttcatgggaaggggggggtggtccaggcgcgcggcacatgtgcgtggggtgttggggtgggggcgcgcggcgcgccggggtggcgtcgaggccttggggcccggcgccgggccccgcccgcggggccgggcgggccgagggggtgaacccaccatgcctcagggcccgccttcctcgccgctccacagatcccccacgagggccctaaatactgcatactcctcccctaccccgcccttccaggccagccccccgccatcaccccacctggtaggcgacatcgaaaaaggccaggtggtgtcgctcctcgatcacgtcggcgatcttggaccactgctcgcgggtggggtcgatgcccgtggggttgtgcgcacagcctgcgtgcggcggggagcggcagggcggggtgagtggcgaggcggcggcgggggtcggggctgggcagggtgccggggaggggtcggcgccgcccagccgccagaccccctgccctgggagcatgcacggcgtgacccgtccctgcaggcccccccctccacccagtcagtgcacgtcgcgcgaggcagcgccacccccgcccgagcttcccgcacgctccagcggctcaggacatgctatgcagcattgcaccgctgctctcctgcgcacccgcacaccaacaatctctctcatcctctcctcaccctcaccctgtcgcgccttccccccacactcttgcatgattgccgacggcgacagtcatcactacccccccccccccccnnnnnnnnnngctcaggtcacgcgatgtagcattgcaccgctgctctcctgcgaacccgcacaccaacaatctctctcaccctctcctcccccacaccctgtcgcgcctttcccccacactcttgcatggttgccgaccgcgacagccatcactacaaccccnnnnnnnnnntaggcatactccctccactccacccccgcatccccaaagatgttcttgtggttgccccacgtgggacgggacaggtacaccgccaccccaggcaggaacttggccaggaaggcggcggcgacgcgcaggctgccggtgccggagagggattgcagcgtcgcgaccctgccctgcgcgaccgggtgggggaggaggatgggagtgtccagagggcggggggtgggggtggggagggatgctgtgggtaatgggttgcttgaaaatgtgttgctgcctccctgcccacactgcggagagcctgtggacgggggtccttccgccccgccggccgcccaggccccccccaattcccccctttcctacacccatggcagcgcctgccacgtcggcccccctgcgccccacctccttcaccgcggcggagtcnnnnnnnnnngttgaaaatgtgttgctgtctccctgcccacgctgcggagagcctggggacgggggtccttccgccccgccgcccgcccagggccccccatttcccccctttccgacacccgaggcagcgcctgccacgtcggccccccggcgccccacctccttcaccgcggcggagtcggcccccagcagcagctccaccgtcgcggcccgaaactcgggcaggccctcgatgctcaggtactccttgttgtcgccccgctccagcatcctcttctcggcctgcgcggcgggcgggggttccggcgagcgtgtgcatctggggccatcccgcagcaagtgtggggtgtggagccccgcggcggccggtcggttgggggcggggctgtccgggggtgctcaccttgccgacgaccctcaggacatagggctgcagctcctcggtccggtatgcgcccacctgcagggcgagggggcgcggtggtggttggcagccggcgcccgcacgtggagtggccaggatgtgcacgtgcgggggcgcggcggcgccgcgcagtaggccccatgggagcccagacgcacccccaggttcagcttgtctgttgaggtttcgcgcttgaatgcctccgacacgcccaggactgcgcgcggggggggagggggcacggggatggtggacggggcaccgacacccgaccacagccttgcaggacgggccgaggtgctgtgtccacgggcatgcagccacgtcgggtgcagttcccctgtcatgccccaacacgagcttcacttggatcgggaggggccatctccacggcgtccagtcgactgcccccatgcccacgagcagtcaggtggcgaggtgcnnnnnnnnnnagagggggcacggagatggtgggcggggcaccagcacccctccacagccacgcaggacgggccgaggtgccgtgtccacgggcatgcagccacgtcgggnnnnnnnnnnctgccgcccggctgactacatgggggcggcaagagacgctggaagggaggggatgggcatgcagtgctgatgctcgacgcaaaccggattatgagtgccccacacnnnnnnnnnnnnnnnnnnnnnnnggtcgtccgtgtctgcatcgtgtgccctcggacacccacgcacacccacttgttgattgcaaggcgccgggattggcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccccgggatgccattcctcacatcaagttccaggtcgacttcttccgagccggatgacctgctcggtcttctgtgcaatacaccatgcgctggtcgactnnnnnnnnnnatgccgcccggctgactacacgggggcggcaagagacgctggaaggcaggggctgggcatgcagggctgatgcttgacgcaaaccggattatgagtgccccacacccaagggtctgacctgctgcttatgctgcccgtgcctggaggtgcacatcctcgtcgcgggcgtcgtccgtgcctgcatcctgtgccctcggacacccacacacacccacatgttgattgcaaggcgccgggattggcatgnnnnnnnnnntaaaatctccaccccggttggaaagaaaatctctcaccgggtagggaccgggaacttgaaagctcgcactacgcgacgccagacacataagattttctctcgaatggccgcgcaaggacgaggagtgtgaacagtgtcgcatcnnnnnnnnnncaccgactggatgagtcgatcggtgcttcgtaccatcgaccatccaccgtcccgccaaacggaccccgggatgccattcctcgcatcaacttccaggtcgacttcttccaagccggatgacctgctcggtcatctgtgcaatacaccatgcgctggtcgactgccctgatctccggggtccacctcccgacggacggctgtccgaaatttcttcacacgatgttcctgaggccatcttaagagtaccctctgagaggcggatcgtcgttattgatcgtatgcataaattgctatcgagtcatgtgaagggacgataaataatctatgttactgctaacttggggccacattgagttgnnnnnnnnnnttccggggtccatcctccgacggacggctgtccgacattccttcacacgctgttcctgaggccatcttaaaggtaccctctgagaggcggatcgtcgttaccgatcgtatgcataaattgctatcgagttatgtgaagggacgataaaaagtctatattactgctaacttggggccacattgagttgaggtcctcggattccctgatttgaatgtgcagcgttctcaaggtaaaacatacaggacaccttctcagatcggcagcatacatctcattgaatgatgtgtatggctgtggatggacacctgcgcttcgtcgccagtggagttagaccagtgaaaagctacaagaaaagtcatgggctgaaataagggcgcccatgaaggcactttcaaccattctnnnnnnnnnntcaggacaccttttcagatcggctgcatacatctcattgaatgatgagtgtggatgtggatgacacctgcgcttcgtcgccagtgaagttagaccagtaaaacgctacaagaaaagtcatgggctgcaataaaggcgcccatgaaggcactttcaaccattctatcgcagagcttgccagcctcgagaggatcggcaagcttcgaatctcgaggatggcagtgacgtcaccatcagtgatcatgggagcacgatctgcatccacttaccactcaagtccccgtgcagccaaggtgtccacatctcatggcagccaggcttgatcaaacccagaatccccttccctaatcagacgcaacaaaccacacattccatgccactccctgcaattctcatccaccacgtccgagccctcatctgtgaaggcacccttggcggtggatgggaagccgctctgaggcaatgaaatcatgaggcccagacatagagcggtgccaccactcctgttaatagcagtgcggctcaaaagagccatgctcaaagtgaagccatcggctcgcatcatatgctaaatcagctggtgttttcagccgacagacatcgaacgaccgcgtgggaaatgtccagcagcggcgtacgtagcacatcttgtcttgcgactaaatttccaccaaatacacatcaggcaggctgggatggctggatgtcccaatccattacagtcactctagttctannnnnnnnnnatttcagctgacagacatcgaacggccgcatggggaaagtccagtggcggcgtatgaagcacatcttgtcttgcgaccaaatctccaccaaatacacatcaggcagattgggatggctggatttcccaatccattacagtcactctagttctagaacactcttaagtcattagtgacccgtattgtacacagtgcatggaatgcatgaaacaatatacttgatccaggtatcctggacactgtgcagnnnnnnnnnnggtgacccgtattgtacgcagtgcatggaacgaatgaaacaatatgcttgatccaggtatcctggacactgtgcagnnnnnnnnnntactatgcgctagaagcagcctaggaaggtttgttgatctagcgcagcatggccgagtagcatgtagctctattcaaggcgatgatgtaaagcagacgcgcacaaaaagtgacagaagnnnnnnnnnnactgcacggaggggcgatgtgggggtgcttgtcaatagactccgaaaacatcactcgatagactggagtatgcgctagaagcaggctaggaaggtatggtgatctagcgcagcatggccgagtggcatgtagctctgttcaaggcgatgatgcaaagcagacgcgcacaaaaagtgacagaagcgcagaaccagtcccggcaacaggaagagaggccaaataagtataactcagatgcgacactgttcacactcctcgtccttacaaggccgttcgagagaaatccttatgtgtctggcgtcgcatggtgcgagcttttaagttcccggtccctacccggtgagagatttcctttccgaccggggcgaagatttttgaaagagaggagctccggattttattcccatgcctgcgatgctggggcaactctaaaagatgcacctatttcaggtcccataaaagtagatctgccaaaaaccttgctaagcatattgtgtcttgccggttgggataaccggggttggcgcagcaatgggcactttacccccgcttctcctgacggtgggtatcatagtaggcatagccctttctgctctcgttcaggtgcgcagtgcggctctgggttggttgagtcttgtaagcctttgtaaatgctttcgaaacttttcacttgggctgcgagccgatactcannnnnnnnnngccccgcttctcctgacggtgggtataatagtagccatagcccattctcctctcgttcaggtgcgcagtgcggctttgggttgtttaagtcttctaagcctttgtaaatgctttcgaaaccttttcacttgggctgcgagccgatactcaacactcgtagggagcaattgcggtgaggcataaagagcaggcgtaccctacgctggcatcgtatggtgagttcaacgaacagcacacctctccaggcgggaggagactcctaacgcaggagaactctgtcacctcatcctcaccaccatccgccgaaaccatgcattcagaaatatcgaaccccagccctcctccacccctccccccaacccccaccccaccctgacccgcctccgccgaatccccaaagacaacctccttccccaacaccacctcccccgtccctcccttgcccacaacctcgctccctcctccaacacccccgatgaccccgccgtcgccaacaggcgacgggtctccgttccccgcatccccccctccgcctccagacccgcctccaagcgccataggatcaccacctcccccagccctctctcccccgctctctccctctgaaaccacatccaccagccccctcccacccccctcgcattcctcggcaacgtcctcgcccacagccgtcctggccccatcggctgtctccccatcccctagcgccgattcgcatctgaataagggcgggtcgccacccccttcctccacatcctcccccgccaacgtctcccctgtccctcaggtctccaccttcccatccccatccttgccaaggaacaacccaacacctacaatggtcaagtctccatcagccgccccgccctcacccacagccgtgatgcctccaagcaacagtcccccactttcttcctctctctccaatggcgccacaccctcatcagcagcatccaaatcctctacatcttcctcttcctcacccggcgcgacgccgtcacgcgctggcgtccgatcccccaccacggcctccccatccnnnnnnnnnngtcctctctctctaatggggccacaccctcatcggcagcatccaaatcctccacatcttcctcttcctcacccacaccggtgccgtcacctgctggcgtccagtcctccaccacagcctccccatcccctgcctctgctccacctcccagcgcaggcggatcaccacccgctcccaccgtgggccccaccacctctccctcctccaccgtcccagcctcttctgtgcctccccatccacccccaccgcggcgccgtcacctgctggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacccgctggcgtctggtcccctactacagcagtcccaggccccatgcccgttccagcgccagtcatcaacgtatccccctcttcttcctccatttccccggctggtactcccttccccaccaccgccccctctcctggctcccttacatcctcacctgccatcacaccgtcacccattgtcgccttgtcaccaactcccgtttccctgtccccccaaggtcgtccctccacctcttggcatacagtctccatcccctgccagccaaccccctccatctccaccgtcacccaccatagtgcagtctccatcgccggtcacccagtctcctacagacatcccaccaccgactggcgtacgatctccaccccctgcccctctcatccccacgcctcccccgccccccaccgatgtgcggtctccatctccgattccatcttctcttgggacaatcccaccacctcctggcataccttctccatccccagtcttcccatcccccacagcaaatccatcccctcctggcataccttctccatccccagtcnnnnnnnnnncccccaccacctctccctccaacatcgtcccagcctcttctgtgcctcccccatccacccccaccacggcgccgtcacccgctggcgtccggtccccaactgcatcctccccatcccccaccgcggcgccgtcacccgctggcgtccggtccccaactgcatcctctccaccccccaccacgccgccgtcacccgcaggcgtccggtcccccacagcaaatccaccccctcctggcataccttctccatccccaatatccccgtcccccacagcaaatccaccccctcctggcataccttctccatccccaatatccccgctacccacagcaaatccaccccctcctggcataccttctccatccccaatatccccgtcccccacagcaaaaccaccccctcccagcatatcttctccatccccactctccccaccacccacagcaaatccactccctcccagcataccctctccatcatcagtctccccgtcccccacagcactcccaacccctcctggcataccttctctatccccagtctccccgccccccacagcactcccaacccctcctggcataccttctccatcatcagccttcctgcctctaatggctggcccttcaccaagcgccggtggatcactaccctcccaatccttctctcccggcaccatcgcctcccccatcactgcgccgcctggttcggctgcgccctctccaagcaccatcgatccaccaccatcgcccaccttctctcccaccttcattcctcccccatccactcccatggtcgtcccgtcacccactggcgtgcggccnnnnnnnnnntcttcccgcctccaacggctggcccttcaccaagcgccggtggaccactaccctcccaatccttttctccaggcaccgtcgcctcccccatcactgcgccgtctggttcggctgccccctctccaagcaccatcgatccaccaccatttcccacctcctctcccacatttatttctcccccatccattcccaaggtcgtcccgtcacccactggcgtgcggcctccgaaccctgcctccccatcccccttggcaggagctccacccccgcctgataccctgcaagcgccccctccccagaannnnnnnnnntcgccaccgccctcccccaaaaagttgtcgccgccgtcccctatgaagtcgccgccgtctcctctagggaagtcgccacccccaacttctaagaattcgccaccaccctcccccaagaaaataccacagccccctccaaagaagtcaccgcccccccctcnnnnnnnnnnaggaagtcgccaccgcaccctcctaacaagaagtcaccgcctcctcccaggaaaaagtcaccgccccctcccaagaagaagtcgccgcctcctcccaggaaaaagtcgccgccccctcccaagaagaagtcgccgccccctcccaagaagaagtcgccgcccccccctttgaagaagaaaccgccgcctcctcctaggagaaaatctccaccccctgctaggagactgccgccgccccctcccaaacagtcatctcatgcatccaaggcggaggcatatcctccaccaaagcagaggtctcctcctccccccaagaaaaggtctcctcctccccccaagaaaaggtctcctccccccgggacgaagtgatctgcctccaccacagagcggagttacgtcaaacaccatggttaacaccatcttcttataactcaagccgtctggcaccagataggttcgcagtatgggtcggggtgatggctcaaagccttcctcttcaaaccaccaagagcgctcccacgccctgaaccaccgctgcgggacaaccctgacggcggtcaaccacaattgttctgggtccccatcctgtcaaatcctatctttacgtcaaccaatataatgttggtcacaccgacttcccgcaggatgaatctgctccaatccgcattgtgtttcgtcccacaccgctgcgccgctattacagtgctggtttctcttgtccatggcccttgaaccaaacttaaattcccagggcacaagtatgtatgcatgctcccatnnnnnnnnnnattgaagaagaaaccgccgcctcctcctaagaaaacatctccaccccctgctaggaaactgccgccgccctctcccaaacagtcatctcatgcatccaaagcggaggcatatcctccaccaaagcagaggtctcctcctccccccaagaaaaggtctcctcctccccccaagaaaaggtctccccccccccgcacaaagtgatctgcctccaccacagggcggagatacgtcaaacaccatggttaacaccatcttcttataactcaagccgtctggcaccagataggttcgcagtatggggcggggtgatggctcgaagccttcctcttcaaaccaccaagagcgcccccacacccgggaccaccgctacgggacaaccctaacagcggtccaccaccgttgttctgggtccccatcctgtcaaaacctatctttacgtcaaccagtataatgttggtcacaccgacttcccgcatgatgaatctgcttcaatccgcattgtgtttcgtcccacatcgctgcgccgctattacagtgctggttcctcttgtccatggcccttgaaccaaactcaaattctcagggcacaagtatgtatgcatgctcccattcacatcgaatgacctcgccatgtaatacgtcagttactccaacccccggcgatggtcacctcgtttgaggtacccagttcccagatcgggatgatgagggcacattcatactttggttggagtcttccagactgtgaggaggttggaggatcgggccacaacccgccctctcattcaaggctgtccaccacaatgtgacaagggcagcattggtgtgtgatctgggtgttgtacagtccttgcctcaaggagccctgtcagatcaatgaagccctaccttacactttgttgctgatgcaaggaagatattgcaccctgcagcagcgatctgactggccttgtcaacaacttgagtgccatcggtgacctttcacagggacatgcgcaagtcagcagccggaggcggagcaccacactcgcactgctgcagctgaccgctcaatgggttggtgccaccaaatgaaggggggccatgatgccacaggcagaccccccacccgtaacaggaacgacgcggtggtcaccagatacttcgccgccaacccatggacgtccaccaatcccgagggacagcacgatcatagaataagcaggttggtacgaggctcttccattccggaggcacgcgagtccttgcccctcctgaccggacactgtgctgatgtgatccgtaaggcaccctccgagagtcagctctgctcatgtgaccaaggtgcatgcatcttctctttacacacaggaagtggggggttgacaccgtgagcgcagcagaccgtcttcgagccacgaccccaccagcccatcactgtcgtcggacggggtcaaagttggacaccagggtgatggcacccacaatggctccgaggagcagcccaccggccaccaccgagttgagcaggttcttgagggagggcgtgaccgcagcctctgccaccagggggtgggccatcattgccccaagtccgactgtgacacctgccgctatggcttgctgctgcgacccatcactggcagctctgcatgggatggggcaggaaggaaaggcggggggagggttagtacagggcagagcacacagggtgtaaccaggcctgctggnnnnnnnnnnctcactggcagctctgcatggggtggggaaggaaggaatggcggggggagggttagtacagggctgagcacacagggtgtaaccaggcctgctggccggagcaagatatcatggggtcggggtgaaggagcctaggaccagacacaataccgcacaccccaaccctaggtgcacgactcgcctgcatcgcagggacggcgccctggggcggacggtgagcggagcccgcgctccgagtcctattaagaccattggtggaggggttagaggttcaattccactcaaaatggtgtataactctcccgcccttcccatgctgnnnnnnnnnnggaccattgggggagggtttagaggttcaattccactcaaaatagtgtataactctcccgcccttcccatgctgcccactcgtcctgcctggcccacctgaggaggggcgcctcagacagcgggaggctgccggtaggctagcagtgatgcacgcggtcaccatgaatgccagaagacttgagcgatgggagattactggtctgcttccgagggcatgtggtacaggtctcgcccggcatggtgttatatcgggtgccctggagccgaaagcgatcgggctctgatcctttgctcggattccaaatttgaccccggttgctacagtctgtgcctcgagtgtgtgggccggccacccccgcccccttccccccctcatagcggtctcagtacctgtgtactcctataatgcttggcggagactaagtattgcccggacggtgtttttaattccctccctgaccaggggnnnnnnnnnntttggcagagactaagcattgcccggaaggtgtttttaattccctccctgaccaggggttcgcattgttgttacacacctcggggtggcgggacgcggccctgcagaatgagtggccgtgacttcaggggcgtccacgcccacgactgccctcccacaccggtgccaaccctgctcctcgccatggcgtggcccacgacccgcccctagtccttcttcgctgcctcggagtccgccggtaggagcaggtacttcagcagcgcatggcacgccgcgtgcgctgcggcatccctctgcgccactaggcgagcccctcgctgctcggcgccaagccgctcaccccgggcccgcaaccccccctctgtggcccctgccctgcgccccccggtcaggcggacctgcagggcggccaggctagcgcccagccgggcgggccaggctgccagctcgtccccccccagtgcaccgcgcacgtccgcgaccagccgcagcaggggctccgcctgggcagcctggtcgggagacgggcccgggatggtg

SEQ ID NO: 45864 - DNA, 61 bp, Chlorella protothecoides
gggcgtttgtcgctgattgccggcagcgccacacctcaacgtccaccgaagcacccctccc

SEQ ID NO: 45865 - DNA, 97 bp, Chlorella protothecoides
gggggggccaggcaggtgcagggcatgggagggcatgctccctcagcgccccgcatgctcgccacccgaatgcgaggcacacgccaccgtggccggc

SEQ ID NO: 45866 - DNA, 62 bp, Chlorella protothecoides
ttctgtgctcataggccagtgacatcacccaggagggtgagctcagggggcaggaaaacccc

SEQ ID NO: 45867 - DNA, 61 bp, Chlorella protothecoides
ccaaactgtggggcaagtggtactgcccagcaagccatactcacgcacggcttgcatgtgg

SEQ ID NO: 45868 - DNA, 80 bp, Chlorella protothecoides
gaggtactgggagtgtggtcgaggactggggaatggggtgtgcgacggcatgccgcaattcatcctgatcgccgcgcctt

SEQ ID NO: 45869 - DNA, 61 bp, Chlorella protothecoides
cgccagaagccccagtttttggtagggtactctaggttcctcttcctgtgtgtggaggagg

SEQ ID NO: 45870 - DNA, 77 bp, Chlorella protothecoides
tgagtcgtaccccccacacccaaccccacacactaccatgcacccctccccagttttgacgagcacgatgcgattcg

SEQ ID NO: 45871 - DNA, 61 bp, Chlorella protothecoides
tctgtgatccctgcactgcacagtaccgctgaaaggcgtcccaggtttttgcagccgtcag

SEQ ID NO: 45872 - DNA, 61 bp, Chlorella protothecoides
acctggcgtgagcagtacttgcacgagaggttttgttcccagccgtgcaagcttccccttt

SEQ ID NO: 45873 - DNA, 75 bp, Chlorella protothecoides
agggtcggtgacaattcttccccacctccaattccttcctgcagtgtgccaggaagcatgcaacccgtatcagca

SEQ ID NO: 45874 - DNA, 71 bp, Chlorella protothecoides
gtggggggttccccttgtgttgcggggggtccccttgtgctgtggggggttccccttgtgttgcggggggt

SEQ ID NO: 45875 - DNA, 123 bp, Chlorella protothecoides
attcttttctgaattcgatgctggtacccggtgctgatggaccttgcattcgtactggggcggggatctaacctaaaccaaagtaaagtttccccccaattgtccacagtgatggcagtaggg

SEQ ID NO: 45876 - DNA, 77 bp, Chlorella protothecoides
atcagctgggtctcgcgccctccctttcgacggcttccctcaccgcgaacccgagaaggggttgctcagaaaataaa

SEQ ID NO: 45877 - DNA, 66 bp, Chlorella protothecoides
aacccgagaaggggttgctcagaaaataaatcaatctaatactcaacatgcaagtaacatgagcag

SEQ ID NO: 45878 - DNA, 61 bp, Chlorella protothecoides
gattcatgcaacttgtgacagatttgctggtgcagcctcgatcggcactcacagcggtggg

SEQ ID NO: 45879 - DNA, 66 bp, Chlorella protothecoides
caccattcaaagcatggtcactgctgggtggcagccttttggtccagacatgtctcatgcccccct

SEQ ID NO: 45880 - DNA, 135 bp, Chlorella protothecoides
ccttcacacccatcctcaccttcacacacatcctcactctcctacaccgtgtcacatctatatgtacacagaggcgcatgatgaaacacatgcacagcctcactttcgcacacatgcacagcctcactctcacaa

SEQ ID NO: 45881 - DNA, 61 bp, Chlorella protothecoides
ctggtccccgccgcgcagggccccgccactttgctgcgcctgcggcacgaccacctgctgc

SEQ ID NO: 45882 - DNA, 68 bp, Chlorella protothecoides
accattccctacgagcggcacgtcaggtgcaaagcacgccgcatccgctcccaccttgagaggggagg

SEQ ID NO: 45883 - DNA, 61 bp, Chlorella protothecoides
aagaacatgcatgcgactcgtgcccaggggtgtcgccatgctccagcgtccgtcaatccag

SEQ ID NO: 45884 - DNA, 72 bp, Chlorella protothecoides
tgcccaatgcccttgcgactgcggctgccagcccctgaagaaaatgtcaagttgagttgcagtcagggtgtg

SEQ ID NO: 45885 - DNA, 16449 bp, Chlorella protothecoides
  modified_base (9296)..(9447): a, c, t, g, unknown or other
  modified_base (9654)..(9820): a, c, t, g, unknown or other
  modified_base (10266)..(10275): a, c, t, g, unknown or other
  modified_base (12265)..(12274): a, c, t, g, unknown or other
  modified_base (12507)..(12516): a, c, t, g, unknown or other
  modified_base (12901)..(12910): a, c, t, g, unknown or other
  modified_base (13324)..(13333): a, c, t, g, unknown or other
  modified_base (13521)..(13530): a, c, t, g, unknown or other
  modified_base (13804)..(13813): a, c, t, g, unknown or other
  modified_base (14022)..(14031): a, c, t, g, unknown or other
  modified_base (14350)..(14359): a, c, t, g, unknown or other
  modified_base (14777)..(14786): a, c, t, g, unknown or other
  modified_base (15304)..(15313): a, c, t, g, unknown or other
  modified_base (15559)..(15619): a, c, t, g, unknown or other
ggggggggggggggggggcattggggagtcggcacatagtgctttaacatgacctccctatgatgcagcgcatcagaacctggcagagcgtttagggacggcacactctcgcccaccagtgttgcagagggaccgcctgcccgcctctcccaacacccctcacacccaggggatcggaggccgccgaaagggcgatggtggccaggaaggacttgtcgccccactctgcggcaaataccagcgcgaagcaggacgccaccaggcccagcgagccccctgtgagttgggaacagggaccaggggcgggggaggcgatgaggggttggtgggccctcagtgtagcgcggcgagactctctgagcgggccgcctctgtatcagaaccccatccacgatacacacggggtgtcttctgcctgtgagcaccaacatccactcactctcccccccccctcccttcaaacaggggcaaccaacagggtcccacccacctatcccctccttccccttcaaccaggcaccccataaccccccccaaaaaaccccacctatgccgttgccgctcttggccagcagccctcccaccaggccctccgcccccgcccgctcgtcctccaccgcctcgtcggcatccggcacgctgagcagcgcctgcacgccaaaggcggccagcagcaccaccgccagcccgtcgtccagcgggatgccgccgggcaggctgggcaccaccacctgcgcgacgtgcagggcccggcccaggcccacggagagcagggtcatgatggccagggcgccccaggtgccggcaaacaccaggccccgggggagctgcagggccaggagcagggccaggaagaaggtcttgtcgcccagctcggagaggaagatgaggaagaaggcggagacggccccctcgcgcagcgtgctgtcccccaggaagcctgggtcaggtggagggggggagacggggttcgagggtttgagtttggggaatgaggggcaaccagttcgggggagggaggagactccttggggtcgcggaccagcatgcacagcaaacacgggcacatcttgcaggtgctccacagaagtaccatggccagcagccaaggcgggcatgcagtggctggacagacattcagttccttcccgcagtatcacagaaatggtggcctcctggagggccaccatggcagcagcctggcaagcacatgcagtacctggtatgaggggccccgggccggcgggcgaggaagcgatcaagtccagaggagaagccagtgctgtcacggggtgccaggagctgagagcaagcatgccaaggagcatcacgatggaggcggcatgacggcggggcctggccccgtccgcctccgtgccctgcaatggagccataaggttgagcctgcatgagccttgcacggtcagcaccgaatggcacacgattcatcaagattcacagtacctgggctgagatttgcagtgtttttaaggccttggatccggtacgatcgcgcgagctggacgactgaaggctggaccgaggtgggtgcctgtcatgtgctccatgaggccgtacacaccgagccgatggggcgcccctcacgagcccagcccgcgccaggtcggccccatgcctcagtggtcttgtcgtgaatgcatgggagctgagagccccgcatgcaatcattttggctgtgtgatacctgccaggcgcatggtccttttacctcggctttctttggatcgttctcccgctcgctttcctccccgccaagtggatgaggcttttggaggtaagcgcgctgttttcctccatatgcagtgtccaatacccactggagtcgggggcgggattatacagtgtttggattagctgcaggcggacgtcaatatgcagctccaagtgctttcatctcgctcagcggcattcaccacccaggcaaggatggcggggtccgtaggagcagtgcagcggcaaagtgtgacggtgcggctcaacttctgcatgctccttccaccacagtgtcctcgagtccacagcaagccggtttcccgagcagtatgccggcctgcatgcagcctgcgtcctcagtctcgacggagcacctttgtcgcccgcgcagcggctgaggtgtgctagccgtggagagggtcacgcgacaggctgtgatctgagaagagaatggcgtaacctccataaaacctgttgacataccagcactgcttccctgtaggtccaggacgcaccggcagatgctgggagtggggtggaggctgcagaccttgcggtggaggagcagcagcaggtgatggggccggagggacctggcggtgtggcactggggtgcacctctccgtgacacagcaatcgatgcctgccctccctgcaccacaggatgtcgcggaagagagggagaccctcagcgctcctccatccgtgccgtcggacggcctcacgtcagctccggtccgcaagaggtccaacagattcgccttgaatgtgctgtggatggacaagcagattggcgtcgcagtggatcagttgttcagcgtacgctgcctgggggggggcttggcagggagggtgaagaggccaatgggtagcatgtacatcggctgcatgactttgcaaagggcccgaacctgcttcatgttaacctctttggtgcatcttgggctcctgaatgacatcttgacatgaagcatcacgcagcatggatttcacccctctctctgcagggccagcgtagccctgtgacgccctacttcttctggcccaaggaggaggcctgggacctgatgaaggagacgctggagggcgagagtagctggattccagaggagtgagtggcgtgatgaattcgtcgtcgagaacaagggtgctgcatgaagaagtgctgctcttaaaagattgacgttctccgggaagggtgtcgagatggcgcaggacaagaccgggcatgcccgtcctcggcctggggagcatgccagccaccccggttcctcgagtcttaactccccctatcttattgatttcatttggttctcagtgtctcaactctctcacccttctctatgtgctacaggcaagtgatcgaggtgctgaacagcttcacatccctcatcaactactggcagtcggacaaccccacgctgaagcaggccaaggacaacttccccaacgccagatttcatggttgatgcccctgcatcatggatgcagtcaattgccttcttctgttgatgtggaccagtgtgtacacccaaagccttgctgagagctggttgatgggaacccgagcaggccctcaggatgtcagccagtaccctgggtggctgtcatgcagtgatctgcgcagggggtggaggtatgagcgtttgggggccacctgccatagctcttagtgttgtcatgcacggtttggagcccagcttctcccaccctttggccacctgatctcctgctccatggcttggcaagctgccagaaactcctccctgttgttggcattggggcgctctctttctggttggaccttggtgaagaggagatcggggcatcggcagagcaacactcacctggcgtggtatgaagcactctcgacgccatccatcgcctgcttcaagcctcggcccttgatcaccaggtctgccatggatgcctgtggggaccccctatgccctcttgttatttgtgcgcatggtgactaaagagcatgctgtgggggaaggaggtcagtgaacacgtgcacggcatccacaaacttgccttgacagtcgcaagttcttgctcggcatgggcaacgtcggcgtcgactgccaccgcctcctcccgtgccttacgaatggcgctgtcaagtgcctccttacgagatttttgctgttgattctcctgggaatagtaaacaacaggggaatagcagcttgcaggaacagggctcctgatcgaaccctgatcgtgcaaacattctttgtgatcctcacagcatactctgcgcacctccatggcagcacgctgagcagcctggatcttgcctatctcctgctctggtatgcgtcgtcgacagacggaaaggatgcactgaagtgcaacgttcggaaggtcatgacggtcagttcagccacctggtagactcaccaatgcatgtgtagcgagttttgtactgtcgaagcatagcatgcagctcatcggcacgagaagtgcgcagctgcggcatggggtccctcgagggtgcgtgctggcacgcactccccgcagcactggtggtatggtacatcgaggccatggtgagatcaatacacgatcacagccgaataatacagagcgcctctgggtatcattgccatgctcattcgcatgaccgatggatgcaagaatgcatggtgtcgcaaggtcagaccgcctgggggcaattgtcacactgaccccggcatcatggagaaagttaacaatttcggtgtgctctaaaggatgtcgatagagacattctttctcctctcaaatcctcacaatcataccaaaattttcttgtaagctgaggttctccctaatgctgcctcgcgcatcctctgcaggcaccagcaccaaatgtggcgatcgccggaaatgtgctcgcagagttgcgtcggcaggggtggttcccagcagtaagtggcccccgcgtgcccctcggtcggttttcattggttcttgcagcgatatcagataatccactacgggtgcaatccaggtctggcaatggccgagagcatagggtgcgcgaagaagagggctaggccgtgtacgccagaccaagactctcaggtgcgagacggcaatcgcggcccaatgacatcgacgtgggccctaatccttggaaggacaaaccagcaggtgttgaagggtagatcaatgtcatgtacacaaggacgtcacaccagttggattcacctctgccgcagttgacgaaatgtgtcaccggtactggagtcatgaggcatgccacacctacatcgggctgcacgacgccacacagcgagcatggccccatggctcatgccgacggtcttgtcagtcccatcgtatttctcaccccaccctgcccggtaaagtactggcatggggggttgtggcagccgttatgcttgcatgcccgtgctggtcatccgtgcatcaaaatcgttcctatttccatccctatgcgcagtcactcgaatgtcatgaggtcgcaaaggtgtcgagaggtcccttgccccaggtgggcagccatgaacctgtgtgcagcggacccgcaccaaacctcggtccaacgcatccagcaatcagtgtcccctcgaccccacgcttctgatcacaggtccagggcagacaattccgtctggagatctcctctgcgacctcagcaggacacacgtggaccatccaggactatgtcctggaggtgaaaacctcgctgggcgaaggaggtctcgggacagtctacagggccgagcattccagcgggcacattgtggcaatgaagataggcaacgcaatggaggttggggacttcacatggtgagtgatgtggaggcctggatcttggtgggagagcctggctgcgatcgtgtcgacttcatgcaggggtgaagttcatttggtgctgtgggattccccctattacacagccaaatgaagagaacgtcccctctggcacacggcaggcagacattcctgacggagtggaacgtgtacgtcgccctcacacacaagcagcactgcaagtggatcccacgtgctttccagtttggtcttcactctgccccgactgggactgctccctggtaagtccctgacagcgtctgtagctgtgtgaatgcgggtatccagctcagtgtactggaagcacgtgctctgcctgctcccactacccaagcctgcctcctagtaaaaccttattaggatgaccatggagctgctggggccgtcgctccacgacctgcgccgccgccgggtgatcgctgcaccacaagtcaaagccctgggaagtcatgccctggatgctctgcagtggctgcatggccgtggatacctccacagagatgtgaaaccagaggtcagtagtctggtgtgtgagaaagggtggtacggatccggtgcggtcaggattgatgtctgggtgacctaggctacgattttccttgtgtgttgtttccccctttggactatactaatatgcagcctgctcatcctccttgacgacccttcccctgatcttccgatccacagaacctggtgatgcctcatggctgggtcccggacctggagcctgctgttcgcctgatagacctcggcatggcacagcagtggcaggcaggacaggacccacctcgcccaacctttgcaggttcaccagagtactccttgccagggaatactatcaaggaacgggttggtgtttgctcagaagcgaccctttgcatcctttggcaatgagcatgcagaggagatgcaggcattcgcatggtcagcttcatcaccctcccgcatggtgtacttggtttcaccttgcccgcaccccccctatctccctgcccaggcacgcccgactacgccagcacagccagtctttacgagaacgaactcgggccacgggatgacatggaaagcctggcctacaccctcctctacctctggatggggaagctgccgtggtgagggggccggaaacagaccagcacactggggagctcctgtacgagcgcatgcgcccagacttcctgcgcccttccctgaccctgtccccaccagcgcgtagggctgggctgcccgacatgctctccgaacggaccagcggccccaacggctggacccgggaggagcttgccgccatggctgagaacagggagtccctgctggagaacgccatgcaagagggtgcgtgtctgggccaatactgcctaatgcgggatttagctcgaggacggcaaccagaagcggaacgctgcttgcttgggaatgcccatgccctacacccgtcccaacgccacaggtggagtgcctgctttcttggaggactggttggagcactgcctgcacctgcagcccaaggacctgcccgactacgggtacctgcgatcgctgctggatgaggaaggtgctcccctggcccagatgggcccagtcaaagggaggatcgccaagcctctgtgtgctgaggagtgatggttgtgtggtcttaggagatgatccagagcttatacaccgcgcacatccatgacaaatgcaagggacgtgggtgctgtaacatagctggagtcgaagcgtttgtctaatgagcctccatcctctctgcgtagcttccatctagatccgttccggatggcacctttccagcgcgtgccgtatatcccccacaacaaaatctactcattcttagagtactttccacattatcctccactaaaaatcattaaagcagctattatgacagacacactactacggttcagctctggggagcttcgcgagttggcacgggacatctcctgcgctagccccgagagtgccagtgacgactccgaggtgtccgcctcaccactttccgaggatcaagttgatggagcttcacacgacaatcccggcgaagagaaagaagggggggaggaggacgagactgcggcctgaacaagctttcggcccggcaggatgcaagccacatgatattttgacacgcctctacgcttcctcatcagcaccatcaccccagcattcctcccatgcactgcaataagaccatcctgacctgggtgcccttcgctggtggaactccggcctcaggctgctctttctggtcagaacttgatgctccatttgggggcaatggtgtcatagtgcttgagctcgaggctccctgaagtgccctcttcccttttttgtggacagagtggcacaggcaatgcccttgagatcctggcaggacacccgccaaccacgtccaagccacgtccaagccctgcatctaaacttgcggcgaattcccttccccctttcacaatgcttccctgcctaatgacttgtaacaccgtccgcatttgcgacgagtaccagagttgtctcctcggggggccatgtgggcacggggcacccgggaaagcacggaatacccttaccccccctaccgggcttgcaccggttgctagcagcttattcccgaggacgggatgtcgctggcgcaggtggttgcctcaatcggcgaaccaggggggtagggggcgaggggaatggaaggggaagcaggggtccacctaaagctgtgggacgaggtgcattctcaataaagcacttggtcagcatcaggatgttcaccgctctattcacgtcgcggttgacaacgttgaccttgcaggccttgttgacgcaccgcttcgtgtcccacagttccgtccacgtttccacgccgttgcagacccgcatgtactggtgggcgagcagggtggtgtgacaggcgcagcacagttttgaggtcctgtgctcgtcgatcaccaccaccctgcacacccaccgcaagaagcgtatccaggcccccggcggagccccccacatgatgcccccccggtcctgggccgaccagttgcccatgcccacgaccgtagtcatgcccgggggggggcggaactgctctgtcagccggttgatggcccgctccctggcgacgtatgcctgatggcgcagctttcaaaatggcttcctgaccctgtgccaggccaggccctgtcgcaaggtggggacgatccacgcgacccgcgacaggagcacctctgtgctcgctgtcttgtgggtcgggcacctgcaggaagaggggcttgcgcgaggaggttggtacatttggagcgacaggggtgtcgtgacacaggccccagagaatgacactgtatgcacaggcaacgatgctggggttgcaaaagaccgggttgatgtccagcagcgactccacgaggtcaacagcccactgggacagacgcaaacactgggtagtgttctagctgtggcccaaatgcccgatgtcagggtagaagacaatgctcttcttggagtcttgcctcagctgcttcatcgtaaatttttgctggcagccggtcttcttggtgcggaggctcgtttggcccatctacccctcccgctggctggctctgtcattctctacccactcaggtgtgcccggaccacggttgcacctgtggtactcgactgacaaccagtcatgtgtgtgatatgaagcgccaggagtgagtgcagcgggaaagggacgggctgcatgctcatcacacgggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaacagtttgggggaggggggtcggcgatctgtcgtcgggttcttactaattcatatcccgcgcgatctgggacttctagagcgtaactctctatcggatggcctcgtgtgatgagtatgcagcctgtccctttccgctgcacccagtcccagctcttcgtaatatacacagcactggttgtcagtcaagtaatacaggtgcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccagtcgcgccgccgctgtgagaagaccagctgccagcatacattcacgatcaagcagctgaggcaagactccaagaagagcattgtcttctaccctgacattgggcattcgggccacagtgacgccactttccactgtctgcgcctgtcccagtgggctgttgacctcgtggaggctctgctggccatcaacccggcctttcgcaatcccagcatcgttgcctcggtgcgagaagctgcacaagtcagggatgagtttggccgtctacaacagtgtggccgaccacttggccttccagctaaaccacccaaatctgcaccaaagggattactcgatcaccaacaaggagatcgcgtgagctgcaaggcagggtcgctcggtgccaattacctgcaccatggtgccaatcaccagcaccttggtgccccactgtagtcccacatnnnnnnnnnnttgttgcacctttcatgacgacgcaggagggcccccagcgtcgtcatggtccccgtgatgtgcactgcctccaggccctgcttgcagggcaggaggctgaacagccgcccgatgtgccgcggcggcggcggcttctgggggctctgggcggggctgccggcggcgttcgccgcggcctccttgcgcttggccagcgccgcgcgccgttgcttgcccaggccccgccgcttgctgggaatgccggcgccctcgttggccgcgtgctgcttcgcacggccctcaaccaggcgcttgagctgggcgagggcggcgtcggatgctgcgccagcgccagcctgtgcatgtgggccaggatgggagagggtggtgagtacacgaggaggagccacagttgtagattggaatctgtgtccaccctctccctcgagggagtgcaaggacgttgccgtgtcaaaccactgccaacccccgaacatccatacccgttcccagccatcactcgacactcacatctcggcggatcgcgtcgtgctgcatcgcctcctcgcccatctgccccggggacgcgttctctggagcctgcgccagagccggcgcggccggctgaagcctctcacgcgccgcgaggagtcgtcgcgccagcggcaggcacaagtggggatgatcctcccacaggcccctttcaggccttttcggcatgcatcggcgaagctccacgatccagtcgacctgctgctgcgtgaaggggatgcgccaccaccctgacgcgacattcggggctgggggttctgctgcgtcgttgctgacgagtggtgctggtgctggcgggtcgggcgcaatgttcagggcgtttgctgcagctgcatgggcgccagtcgccggggctgggggggttgggtcgggtgttacggccagggcagacgccgcagctgcatggacgccagtcactggctggcgggatcgggtccggcgcggcgtccgctgctgggacaggcggagacactggaaagtggcgtcactgtggctcgaatgcccaatgtcagggtagaaaacaatgctcttcttggagtcttgcctcagctgcttcatcgtaaatgtatgctggcagccggtcctctcagagcggcggcgcgacaggctcgtccgcccctcatgctggctggcgacgcccctctcgtcagccacttgggctttatgggaccaggggcgcacctgaagcactcgactgacaaccagtcctgcgtgtgtggtgaagagcctcggtgagtgcagggaggagacccgaccgggggaggtctcacagcgggcatccgttgggtgacatttcgacttcggaccttggtgacaggacggatggtgtgtgcttgaatgatgtcctgaagctgcgcccctggcctcgcaaggagtcatccatgcgctccgtggggggggggtcgcgacttgagttgtcggggctgcatggtaggtatccaactttgtagaccccgcggccaccagctcggccatagtgaacacgcccttttggggttcggatgtctcgggcacgtttcgcatcgtacgcgagcttgggaggtaaaaacatgatgtaaataggctgtcgccagtagtcggaaggatgtcttcggggggtttcgtagcgttagtcgcaattaaagagcggcgagggaagggctcccacctgatctgagtgggtagaggaaggcacgccaaccagcgtgagggtacaaaaggcatgcaagcacagcatcacggtgtggcgcatgctgtatccagaccttgccgaccaccacattatatacatcatggggtccaagatgagctcaactgagggcggcctccaccgcatgtttgcagctatgcgggacgacaagggcatgcttggctaatgccgtagacattccaatagacaacatgcaagccaaagaaggcttagatgttcatgctgggagggtgccaggacccccctttcccccgccctcacaaacaagannnnnnnnnnaaaagaaggcctagatgttcctgctgggagggtgccaggcccccccctttcccccgccctcacaaacaagagactctccaatcacgaaatatgcccgtctccgaccattctatgatgctgtccagatcatccatatgttgcatacccctctattatgctctggcgtctgcagacgtcaatcattgttgtcaagaaaaacttctctgtggtttgtatatgacgagagcttgttnnnnnnnnnntgtcaatgtttgttgtcaagaaaaacttatctgtggtttgtatatgacgagagcttgttcatgcaatcgcacgagatgcggcgcgagtttgcctctctcccttttccttccatttgtttcaccggcatgcttgtgtttgcatgtagggagcagatcatgaatgacccatgggatgtgtccatacacgcccgcttcctctgacctctccttgtacctgctctgtatgtatgtatgaaatcttcttttgcgacggaagcaaatggagtgacatgcaattacaaacgcaacacccatatattcatgggattgccaaggcattatactacaccaaacgccggcatgcgccgcgcgcgattcgaggttgcgttaacatcgttggcaggannnnnnnnnnggttcttttgcgacggaaacaaaaggagtgacatgccattacaaacgcaacacccatataatcatgggattgccaaggcattacactccaccaaacgccggcatgcgccgcgcgcgtttcgaggttgcgttaacatcgttggcaggaagaccttaatttaaaaatgaccatcaaccgggttgggtgcggcctagactgattgacacctctgaaactagacagactggtctgcattacatcccaaccctgagtgtgcctgcatccattgtcgacctctggctggcacgttagtccctccatttctaagagtcgccaagagcggcgatacctcaattgagccttgtgttgtggaagactccctggacggggccctttcctcattaccccctgatctgtgccctgcaccgagtccannnnnnnnnngagactccctcgacggggccctttccccatgtccccctgatctgtgccctgcaccgagtccatgccgccttgcgacgcttatgaaacccaagccccccacactgcatccaggactatggcctccaacattcctactttttaaggtcatatatagcagtccacggtgtgggatctagccagcccccacnnnnnnnnnnctatgaaactcaagcccctcacactgcatccaggactatggcctgcaacattcctacctttttaggtcatatatagcattccacggtgtgggatctagccagcccccacaacaagtaaacgaacacgatgacgaatcctgcacaagacccctgcagtgagaagagctcgtgtagttttcatcatcttcatcgactgttggacgtggtgaaagatcccaaggccccgttgctctcatgcataattagggcgtttggtaattgacgggggtatagnnnnnnnnnnacccattgctctcatgttttactagggcgtttggtaattgacgggggtatagtgattcctgtcatgcaccatattccgtccgtcgtcacagagcaatgccgcaaggcaggcataccgctttattcgcaagctggagacgaactcataacattgatgagtgtagcaaaacaaaaatgtagaatgtcagaagtgggattcgaacccacgcnnnnnnnnnngactcataacattgatgagtgtagcaaaaaaaaaagtaggactgtcagaagtgggattcgaacccacgcccttccggatacggacctgaaccgcacgccttagaccgctcggccatcctgacggtggtgttggctcctaacctggtgtgacccagggggatgacttgttgtaaatggaccattatttttctactatatttgaggagaaaatgcagtatctaaaagacacctcgcagaataaacattggagcttgaggagcggataatttggcggggcgtccgacaccaattactcgccagcatgctgcagtgcgtcccnnnnnnnnnnaactattttttgtccaccatatttgaggggaaaatgcagtatttaaaaagacaactcgcagaataaacagtggagcttgaggagcggatattttggcggggcgtccgacacccattactcgccagcatgctgcagtgcgtccctccccacgctcaatgtttcctgaaagatctgagcgaacatcagcacaccccaagggacatcttgccacgcccatatgcatattcaccacagaagacgttccttggcgtagtgactgagcatggagtgacgtgatcttgttcacctgagaatacccaagcatcacgtcgacaatgcactcgcacatcatgaagggaccggaagcacagttgtggttgcccccgattggtggtgggggtggttgccccccccaattgttggtgggttgcccccaatnnnnnnnnnngtgagcgaacatcagcacaccccaaaggacatcttgccacgcccatatgtatgttcaccctagaagacgttcattggcgtggtgactgagcatggagtgacgtgatcttgatcacctgggaatacccaagcatcacgttgacaatgtactcgcacatcatgaaaggaccacaagcacagttgtggttccccccgattggtgggggggtggttgggccccccaattgttggtgggttgcccccaatcatacatctagtcgcaggattgctgggaacccaaaaaattgaggggcggctagtttccccccccagatccttcgttggatggtagggctagatccctcgtcccttctgtttcaacggcatgattgtgtttgcattcagggaggagatggtgaataacaaatggggtgtggctctggacacccggtttctttgacctctccttgcacctgctgtatctgtatggacccctcgttggacactcaagaacactggtcgccgacatcgccatggaannnnnnnnnnatgtggctctagacaaccggtttctctgacctctccttgcacctgctatatctgtatggacccctcgttggacactcgagaacactggtcgccgacatcgccatggaaacgaaatgcggcgaccggcacaccgagtcatgctttttctttttacagtccaagtccaccaacatggacgctgaatgtggggcggtatacgcactcgagctgcaggctgcatagccctcttgtacctgctcttctggnnnnnnnnnnnnnnnnnnnnnnnnnnnnnnnnnnnnnnnnnnnnnnnnnnnnnnnnnnnnnacattcgatagccggatatattacatcagatcatgctcgtgtggactcgctgatctccgcgcagggctgccccgcaacaccagtgcacggacgaggtgtggcaccagggcagctggctcgacactccgccgggtccctgccctcctcagcccccactggcaacctgcaacgcctcttccagccagcaatgggccttctccagcccagcaagagcatgtggagcgcggtacctggaccccacacaccttcgtcgggccctgaagggccagaccatgatgttcatcggcgactccatcactcgccacctggcggccgcgctcctgcgagccgtgggcagcacaggtgcaagggggggggtcctgatttctccatgtgctccaggcctgggaggtgccctgctcctcgtgaccctccaaccccctggcaagtcctccacggcagatgaggtggtggtgggccatgccgacttcgacctcacccttcccggccgcgacgcacgcctctccttcctctggcgcccctacccctggaacgtgaccgaggccctgctggaggaggtgcccgccctgcccagaccccccagcgtggtgatcgcctccttctgcctctggcacgccctccacgtccgggacgcagacgccttcgcggaggacgccgcggagctcagcgccgctgccgccaaggtcggtgagggctggggctgggtggtgtggtctggcaaggggagcaggaaatcgcaaagggccagcctgcatctctccccttgatgggtgatgctggcccctcgatgggtgatgctggccaccaatctcctcttcccccccccctcc

SEQ ID NO: 45886 - DNA, 61 bp, Chlorella protothecoides
tacatattcttacgccccagccactcattgggtcgatgccctagactatcggcatggtggt

SEQ ID NO: 45887 - DNA, 85 bp, Chlorella protothecoides
aaagttgcgcttgcccctgttgccggatccgatgttgccattgctatctgctgtgcaagccgtctgcccaggcttgaggcactcc

SEQ ID NO: 45888 - DNA, 61 bp, Chlorella protothecoides
gttggatgtcacttgcagagaccttcatgctgtcctgcctgagctctgctgttgctcgtac

SEQ ID NO: 45889 - DNA, 39125 bp, Chlorella protothecoides
  modified_base (387)..(396): a, c, t, g, unknown or other
  modified_base (498)..(507): a, c, t, g, unknown or other
  modified_base (1133)..(1142): a, c, t, g, unknown or other
  modified_base (1614)..(1623): a, c, t, g, unknown or other
  modified_base (2318)..(2551): a, c, t, g, unknown or other
  modified_base (2631)..(2640): a, c, t, g, unknown or other
  modified_base (2889)..(2898): a, c, t, g, unknown or other
  modified_base (4503)..(4512): a, c, t, g, unknown or other
  modified_base (5250)..(5259): a, c, t, g, unknown or other
  modified_base (5519)..(5528): a, c, t, g, unknown or other
  modified_base (6288)..(6297): a, c, t, g, unknown or other
  modified_base (7576)..(7688): a, c, t, g, unknown or other
  modified_base (7743)..(7752): a, c, t, g, unknown or other
  modified_base (7807)..(7816): a, c, t, g, unknown or other
  modified_base (7937)..(7992): a, c, t, g, unknown or other
  modified_base (9257)..(9266): a, c, t, g, unknown or other
  modified_base (11495)..(11504): a, c, t, g, unknown or other
  modified_base (12043)..(12052): a, c, t, g, unknown or other
  modified_base (12583)..(12592): a, c, t, g, unknown or other
  modified_base (13482)..(13491): a, c, t, g, unknown or other
  modified_base (13625)..(13634): a, c, t, g, unknown or other
  modified_base (13953)..(13962): a, c, t, g, unknown or other
  modified_base (14784)..(14793): a, c, t, g, unknown or other
  modified_base (15370)..(15379): a, c, t, g, unknown or other
  modified_base (17247)..(17256): a, c, t, g, unknown or other
  modified_base (17475)..(17724): a, c, t, g, unknown or other
  modified_base (18260)..(18269): a, c, t, g, unknown or other
  modified_base (18480)..(18489): a, c, t, g, unknown or other
  modified_base (21129)..(21138): a, c, t, g, unknown or other
  modified_base (21603)..(21726): a, c, t, g, unknown or other
  modified_base (22620)..(22629): a, c, t, g, unknown or other
  modified_base (22714)..(22723): a, c, t, g, unknown or other
  modified_base (24653)..(24662): a, c, t, g, unknown or other
  modified_base (24824)..(24833): a, c, t, g, unknown or other
  modified_base (25003)..(25012): a, c, t, g, unknown or other
  modified_base (26117)..(26126): a, c, t, g, unknown or other
  modified_base (26907)..(26916): a, c, t, g, unknown or other
  modified_base (27205)..(27214): a, c, t, g, unknown or other
  modified_base (28350)..(28437): a, c, t, g, unknown or other
  modified_base (28651)..(28660): a, c, t, g, unknown or other
  modified_base (29092)..(29101): a, c, t, g, unknown or other
  modified_base (30176)..(30185): a, c, t, g, unknown or other
  modified_base (30808)..(30817): a, c, t, g, unknown or other
  modified_base (35068)..(35077): a, c, t, g, unknown or other
  modified_base (36026)..(36035): a, c, t, g, unknown or other
  modified_base (37572)..(37581): a, c, t, g, unknown or other
  modified_base (38552)..(38561): a, c, t, g, unknown or other
  modified_base (38806)..(39044): a, c, t, g, unknown or other
aacctcctggtctggggcgtggacctggtggaggagcagctgctgctggccgcgggcatcccttcccggccccccgtcgcgcccgcgcccctcacccacctcgccgagttctcggtgaatgcacagcgctcgggcgtgctcgccgacgtcagcttcctggacaagtacgacgtaatgaaggacgtgctgtacgtgcggccgctggtggaggcgggggccaaggtcacgtgcgtggaggacggcatgcccacgtgggtgtgcgagatcatggtgcagcacccgaactccacccaggccgccatcgactacgtcaaccagatcgaggccgccatccagaaggagatgcccattgaggcacgcaaggccaagtgaacgaaaacggcatgnnnnnnnnnnagctttccataccagtcgtgctttgcgccctcgtccctgcacacacccgtatcctcggcattcgagggccacccagccagtctcctgcgccgggcgggcgcnnnnnnnnnngcgccgaggcgccctggcctggacgaatgtcccccgtcgaccagcctgtcggtgggcaccccccacatcccatggtgtcatgcgtctcacccccggcccggctttccataccagttgtgctttgcgccctcgtccctgcacaccccccgtaccctcggcattcgagggccgcccagccagtctcctgcgccgggcgggcgccgatccaaacaatcggtctgggggttcttccgctcgattcagatcaccccccctgtaacattcccgcactcgcaacaaggaattcaccggggaggggcaagcacgggcaggtgcagggcgcttgtgaggatcgggaagtaggaggcatggacttcttttccttcaccgcccacaatacgctaggcaaaggccgccaggttgcggtaggccgtcaccaggcggtgaaaggcgtcggcggccccaggcgcagagctcttgtccgggtggagcgacaccgccatctggcggtacctcttgcgcaggaccgcagcattggcaccaggtggcagctgggagtggagggcgagcggtgtggagtttgggagaccattgtcaagcggggggattgtaaccggcaggctggtgttgggacgagtcgtgtgctnnnnnnnnnnaattgggaaaccattgtcaagcggggggatcgtaaccagcaggctggtgttgggacgagtcgtgtgctggaagatgcagggtcgagcctcgtgcaaccctctggtccccaagcacatgcgcccccaccaagctgcccccaagcagtacctggagcacagcatgatctgatgctgcctgcagaacacggcggacctcggcctcatcggcaaaggtgaggctaggcgctgatgccctttgtgcggcgaggtcggcatcggcctgttttcgagcctcctcgtacacctgcatgggtaggggcaagcgggggagtgtgacgccccagatggcacctacattgggaatccaagggggcgccaggaccgtcacacagggccagacaaggtgctgcactccctgaatgctgatcaggggcactcccgagatggcgtccgggtacacaaaggcagacctcaccttggcaaagccagactnnnnnnnnnncggccagacaaggtgctgcactacccgaatgctgatcaggggcactcccgggatggcgtccgggtacccacaggcagacctcaccttggcaaagccagactccaggcgttgccggcgctgggcgagcagggctgcatccctgtcctgacacgctcttgttgtgtcctgcgcctggcggcggctctgctccgctgccgcgaccgccgctttgagcttctccatttcccgcagcacgtccgcggcagacttttggggagcctggggcgcggccggctgcggtggcctgggccgtgcccgagacctgttgggtccatggatgggtgcgggctggggggctgcgctggaaggcctgggcggctgctgaggcccggctgccggatggcctgcttccgtcttcttctcgacatacaacccgtctggctcagcggcgtcggaggtattcccggcgtcccggctccaggtgagcttggcgcgttttgggggtggaggggctggggatttagctgtgcctgccacgtacgtcttccctccagtcgacttggaggtgtccctcacccagacatgggctcccatcatgaaaaagactccaaacagccaaagtgtgtcaaagctagcggcctcgtgggagtctacttggagctcctcgggtgtcggggagccccgggggctgtcaggctcggttccgatatcatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaccgatcttgcgtcatcgatcccgagctgtggctgacaaggtatgaatgacccctcgctccctgtttggaccgggcgnnnnnnnnnngacagccaaagtgcgtcaaagctagcggccttgtgggagtctatttggagctcctcgggtgtcggggagccccgagggctgtcaggctcggttccgatatcatcaatggtgggcagacgcagtcctgatactttgcgctaagatacaatatgagtatagtgtttgcccagtaccaagactccggagagagggagcacctcgccagaactccgatcacagtactcagatcacaatgagggcgcgggcgcnnnnnnnnnntccagtaccaagactccgcggagagggagcacctcgccagagctccgatcacggtactcagatcacaatgagggcgcgggcgcgccctggtcacacttttgccaagacgaaatctatcgcggtggggtgtgcaccgggacctttggacctagcatcacaataagttggatcttaactggagcatacaaggtgaccgatcttgcgtcatcgatcccgagctctggctgacaaggtatgactgacccctcgctccctgtttggaccgggcgtgggcccacgaaccaatcgtgacgcaagcacttgcatgagaggacgacggaataaaatcgtgactcggacttgagtaagtaaggatcacatccactagcagggcagaccttacttccctcctaggacgcttgtgggcattgtcttcacctccagatcttgcagctcctcgaatatcaaacatgggcaacatctttggaggcgacaagaagaggtagtggggacagtttgtgttgaaaggcgtcattgtgggtatgtagttgcccatctctaaaccccggccctctaacctccctgtgacagggagatcactgatgtcgacagggcaatcttgtccctcaagactcagcggcgcaagcttgatgaccagcggaagagggtgagtggcatgaggcgaaggcacatcgcgctttaccacctcaggattatgggtgatgcacccttgggccagatgactggttgagttcgccatggaatgagggatgtagccaactttactggactccttccgacttgcagacagacacactaatagagagggaggcagtggtggcaaggacacttgtggctcaaggaaagcgggaccgagccctcttggcgctccgcaagaaacgattgcatggtcagcagctggaatttttggacaagctcgtgctcaatgtggaggaaacggtgagggactggcggggctgatgggtgattggaatcttattgacaggtttaagagcaggtctatgccatgtaatctggagtgtgatccgtcgtttggtgcccagtctcgcgtcccaagttgtatcctattcttcacactcattcttccagttggcgaatgtcgagggggcagctaggcagaaacgacttttcgacacactgaagcaaggcgccgctgccctcaaacagctccaaaaggtgggagagtcggataggctttgatgttgcctggttatgggcataccaatttgcaaagaccccatcccatgttcacccagattgctgtgtcacacaaggacccctgaatcaactggtgctgccttctctgctgcaggatgtttccctggaggatgtggagcagctcatgtccgacaccgcagaagccaaggagtatgagacgagggtccaatctatgtttggtacgtcacagggctctttgctcccgggttttgggggggaggggggggggagggtcccgcaaaaataaagtctacatttgcatgaccgatgggaaggtgggtggtcttgctggtcctttgcattatcctcatgacccccaccatccctgtggtctcatctcaggggagagctggactggggtggatgaggaggcagcgcacgcagagnnnnnnnnnncatcctcatgccccctaccatccctgtggtctcatttcaggggagagctggaccggggtggatgaggaggcagcgcacgcagagctggcagagatggaggcgcagctgctggacgaggaggtgctggacctgcccagcgtcccccagacaaaagttgctgacgcggctgcagtgccagggccgcctgcccaggtggaggccctcgccgcgacgcccagggaggatcggcccgaggaccccctccctgcctgaactacctgacatcaggtgtcagtgtgcatgccagggcctcaggatcctgatgccttttcatgtcctggattgtcaggacaaggcagaggctgccctgtgtaggttgtacccactgtaacaagcagcatgtgttgtacaacggtcgttatgcagcccccaagtcaaatatacagggaggcagcaaacatgatgtctcgtcggatggtgtcccgcgactcggcgatcttggcggccagtcctgcgtcgcccaccgccagcgcggcccgctccagctcgctcatcagctcatccagccgcctcgttgccctgtccgggatggttgattgtgagcaataattatactcgggagtggctcaggatggatatgtaggagatgcctggtggccaccattgcagtgccagcacgcttgaagtagtaggtatacctccttatggtaaggaaattccattcccccacagcgcaatcatctcgaagggctcattccnnnnnnnnnnagacatctccttatggtaaggaaattccattcccctacagcgcaatcatctcgaagggctcattccacaccggcaacggtcagtcatcaaatggcatgcacagctactcccagtgtccaaggagggtccccactcagatccccacaacacgagacgcccacagacatccccgcccccacagagaaaaccaccagacacccacctcacgatgctgccctcaaacaggtccgtcatctcgcagatctcagcaaaggatgcgnnnnnnnnnnacccaaagacatccccgcccccacagacacaccaccacacacccacctgacgatgctgccctcaaacaggtctgtcatctcgcagatctcagcaaaggatgcgcccttggaccaggcgtagataacgtccatgaggaagggccaaaatgactccacgtactcgtccaccttcacctccagcctgcactccaccgacacctcggcaatgcgccgcgcggcgtcttgcagcgcctgcagcggccgcgccaggctctccttcagccggatctgctcgttgctcttctccacctgcaccaggcaggacaccatggccaccagctggtgccgatccagggcattgaaggtgccgttcagcatcagttccgttgccagcagctcatcggcggggttgatctcacaggccacgcgccccttgagcgtcaccactccctccccgtccacatagcccagcttgcgcaggaccgcgccgcggtgacgcgcttcgtcccggaagctggtcagctgtgaggctcgcatgcgtgccgccagcgactcggcctcagccatcagccgcgccttctcgcgcaggggagccatcagcgaggcctcgccctccccgcgctccgcctgtgtggcgggtgaagggggtttggatgcgtcattgcgctgaattttaggagtccagagatgtgaactggtctggctttcatcggcggtagacatcgggatcggggtagcacgcaggagaatgtcacgtgccacatatgcgacaagcacgcannnnnnnnnncttgcgctgaattctaggagggcagaggtgtgaactgggctggctttcatcgacggtagacatcgggatcggggtggcacgcaggagaacgtcacgtgccacatatgcgacaagcacgcaacaaaccattccagaccccacccaatcgatcaacttcccacatgcgacgccaccgcccacccagctcaccttagagatggggttggccgccagcgcggcggcaacctcctcgcgctcggcggcagcggccgccacgccagtgtcctcgatgcccatgtcggcgacggggtgaaggagaggcagggcgccgccggggtaccttccgcgcagcgccttcagcgtctgcagcacggcgcggcgcgcctccggcgggcgcaggtcctgcgggatgctgatgcgcagcgtgctcagcgcgtgcagcaggcctaggggcaccgggatcacctccatgctgccccgttcgtcgtcgagtggggccggggtgggctcgccgcccacgaccccggcgcagcacagcagcgtgtccatgtggtaggcaggcgcggcggcgggcggggcgttgccacgctcctcccgcatcgcgctgaccaccacgccccagccccagtccacaccctctgtcgtgttgtgggaggagtgagtgcgacagggggggatggagggccggcgccatgctgcgcatgcatcgtcgtgcatccagccaattcccatccatccagggcaaggcgtcgttggatgggcaaggcccctcaggcgcagtcaggtcccaggaaagcatgaaagggcctccaccactgtatcaatccccattcacactctctcgtctgcaccatcccggcgcaccctggaccacgcggacgaggcggcccggcctcaggtagtgcaggcaccgctccggcttcctgacctccgcagcgagcgtgctttccagctccgccagccgcgtcttgagcctggtgtactccgccgccgtctcctcccccgcgtccccgatggccgccactgccgcctgaacctcctccagccgggcctccagcgctggcagctccttctcgtgctgaaactgggagaaggagtgctggatgacatactccatgctggccccgctgccctccacccgccgcatcaggttgagcagggtgtaataggacaggcggaaggaggagagcagtgggttggccttgcccttgatgatggccctggaggggacgagaggaggggtggattcgtaggaacctgaggatgagctggcactccatggccgtccaatgcacccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataccacccaccctaccacaaccccccctactcgccccactcacttgcacgtggnnnnnnnnnngtaccacccaccctaccacaaagacccctactcgccccactcacttgcacgtggnnnnnnnnnntggattcgtaggggcctgagggtgaaatggcactccatggccgtccaatgcaccccccagcgccctcatcaatgcacgctgtcctggatacatacacacaagcatcgctttcccacctgcnnnnnnnnnnnnnnnnnnnnnnnnnnnnnnnnnnnnnnnnnnnnnnnnnnnnnnnncctcgtccatgctgttgttcatcatcatgatggtcatcccgcggtcgtcctttcctcgccgccccgcgcggccgctcatctgaatgtactccccgctccccatccaccgctcctcctgcccgtcccacttccgcatcgccgtgaagaccaccgtgcgggcaggcatgttgaggcccatggcaaaggtctcggtggcaaacaggcactgcgccaatgtttcgttgaggatggggaaagattagggggtgttagtgctggggaaagtgtggggcgctgtgcactcaggcagaggcgaggagtccacttgacgctcatggtaacccaagcaatgtatcatgcttcttgtcttccctcctgcctcccctacaaaccttgatcagctgctcctggaacaggatctccaccacctccttgatgatgggcagcaggccggagtggtggatgccgatgccgcagcgcagcagggggtagatgtgcgccaccgccctcaggtcccggtccttctcggacaggcactggggggcggcggtgggtgaagagagagctcatgatgcagagattgtaccatcgagccatcagctcacgtccttgtcgcttgcagaaggaggaggcttaggaaacagccagatgcagatgtggagcgctcacaaaggctgccttcccccaacgcctgacatgcatccccttccttgtcaccgcatctgcctcacctggagggcggattggaacaccgcatccaccgtctccttttcttcctgggtattgaagtccagggctcccaggtcggccttggccatcagcatggcattggattcgcactccctgtcggtgtgtgggaagtaattgtgaggacagctttggtccaaggcagcagatgcttggccactgtacgatggtggcaggcgctcattgccgcgcatttcccaccaggagtgccgcacctgcggctgaagctgaagacgatgacggggtccagctttcgctccttgatcagcatcacaatcttgcggaggtcttgtgccgccgaggcgccggtgggcttcccgccgccgccgccgccgcccctcttgcccttgccctcctgcccgccgtcgccgcccttgcccagcaccttttgaagcttctggaagttgtcgtctcggaactcgccaaattcgttcatcacctagagggaggtgggggttgacgtgggggggttcagtcagcatcatgtgaatcgcctcgggtgtctcccgccggcggtctcactggttgcaaagcaccannnnnnnnnntgcatcatgtgaattgcctcgagtgtctccagccggcggtctcactggttgcaaagcaccacagttgccatgctgcccggcacgattccactgcccggcagcgttgcatcatctcgcgtgctgccctcgacaagctgcatagtgcatgcgccctggtgccctgcttccgaaaggcatcctccaatccatcgcttggctgcagcccatgtccatctcccccactccccacacagcgccctcccctcgccccaacccccgactccacgcccctcccggacccccctccccagccactcaccagatacagcccgtccccgcccgagggaaatgcaaagtggcgcaggggggtgggtcggaactcggtgtacaccacgtggcagggggactggtgcaccgaggccacccagtcggcaaactcagtggcgttggaaagcgtggcggagaggaagaccatgcgcgcatccttgggcgcaaagatgattgtctcctcccagatcacgccgcgctcccggtcctgcatgtagtgaacctcatcaaacacgatccacgccgtctcgcgcagcagctcggagcccctgcgtgcggatggggtggaggattgctgggcggaggtcagctcagtggggtggccacgttaacattgcgcaatggcagcgctgggcctgagctcttacgagggcaggccctgcagcatccattgggggtgactgaaagcgccttctttcatcccaaccctttcccacagcaattgcccagcggcccagggcagatcacatccctcccacacaaacctgtagatcatggagcgcaggatctccgtggtcatgacgatgcaggcggcgttgggattgatggaaacgtcccctgtcatcaggcccacgtcgccaaactcctctgacagttcgcggaacttctggttgctcagcgcctgtaggtatgtaattggagggttgagacagatgagagcggggcttggttgttcctggattccagcatggcttttgggcagccctgggcagtggccccaaggcgctgcacagatgaccagcgcccagtggccagaccttgatgggggaggtgtaaaaaacgcgctggcccatggcgaaggccttggcgatggcgtactctgcgatcgccgtcttcccggcagaggtgtgggcggccaccagcacattctccttgcgctcctgcgtggtgtttggtgcatgacctgtgaggatatcacctgcccaggcaagcctcccacacccaaaggcgcctggttccttcccattggcacggtatgggatgcacttggaatgccacgcattccttcctaacccccaaaatcaaagagagcaaggatagtaatctcaccacgcaggccaccgccttggcttggaaagagtccaggacaaaggggtactccttggcgggcttccccttccactgcgggtcctccagcgttcctgagggacaaacggagggtttgcaagttggcgcaaggcgtcatgctccagcaaaacactctctagcaacacatagtctacgctgccagccacgtccagcgtcaaaccaccaaggggcgttagtttccagcacgtccctctgcgcccttcacaccatagcgctcagggtcgagggtgatgctgctggggtcaaagccctttgggcaagctacctcatgcgtgcacacggcagatggtgctgcacccgtttgcttcttggatggggggccatcttcgatctgggacgggaggggtgcatcgcagggtggcgtgctgagatgtccatcctgggtgagagtcactaaatctaccactgcccacgccatccaagaggccgtcttcctcaccagttccaactccctctttttcttcttcagagcttcccgagtcgcagcggctttggcgagcccctccgctgtagcctccatgtgagcaccgccccgagtggtccccgcctgctctaggtgcacggcgcaagcatacaaaccaaagtacctcgatccgatgctctgcaacggtgcagaatgtaatttcccgatgacacgagtatggagggcggttctgcggttccaagactgggttaaaaacatgtctgcatgcatggagtttttgaagcgctacacagcgcgcgctgagtagttttcgctgcgtcccgaagaatagcatgatgagcatcgtatgtgatcaaaaagtgttctacgaatgctaaaatattcgtttacaaactgatgcattggtgcannnnnnnnnncagcatgctgagcatcgtatgtgatcaaaagtgttctacgaatgctaaagtattcgtttacaaactgatgcattggtgcaaaaggcctgagtgaggaggcaggtgagggtgcactaccaaagagtaccaaagcggtgtggtgttacaacggcctgctgaaggccccccatagatattttggggtcttaaggcgcctgagcgggcgaatatgtccgccattcgggtccagcggctggatgtggcggcaccgaggaccatcttggaggcagggctggcagaggctcccagcaacctggactcgacccgcatagtatccatcggcgatgagctcgacatgggaacggaccaggaatccatcctcaggtgagtggacttcatgtgtctgtgtggtggtcttgctgggctgccctcagtgcaagggcagcagagccgatggcgtcgcccagacaagcttttcactggaccgtctgcatatttgatgttgcgatgcttgtgtcacactgatttccatcacccgcacacatcaccaaacgacaggnnnnnnnnnngcctcagtgcaagggcagcagagctgatggcgtcgtccagacaagctgttcactggaccgtctgcatattcgatgttgcgatgcatgtgtcgcactgaattacatcacccgcacacatcaccaaacgacaggggccatggcactcagacacgtgccgagacgggcgcgctggtggcgtcggtggccggcgttgtagagcgggtggaccaactagtcacagtcaagaccctccgaacccgatatgtggcggaggttggggacgtcgtcgtcgggcgtgtggccgaggtacgacctgggatgttttggttatggatgtctgtgcagacggcagtacgggggcctctgtttgtgccctgcagatggcgctgcgttgcacagggttctgtcaccaggtcatggttatggcatcacgcatgatgcggttgcaaagagaatctccaggcggcctcccagtgccggttttgctcttatgccctgatcctagctcccacgcacacccacccgcccacaaacaagcacagatcgtgggcnnnnnnnnnncggttctgtcaccaggtcatggtcatggcctcacgcatgatgcggttgcaaagagaacctccaggcggcctcccagtgccgtttttgctcttgtgccctgatcctagctcccacacacccgcccgcccacaaacaagcacagatcgtgggcaagcgctggcggctggacctgggctcccggcacgaggccacgctgctgctctcggccgtggacgtgcccggcggcatccagcggcggcgcactgccgaggacgagctgaccatgcgcgccgtcttccccgagggcacggtgctggcggtggaggtgcagagcgtgcacgccgacggcggcctggccctgcacgcgcggtcggcgcgctacggcgcgctggccgggggcacgctggtggccgtccccggcgcgctggtccggcgccaggcgcgccacttccagcggctagatggacgcggcgtggacctcatcctcggctgcaacggcggcgtctgggtggcgcccgcgcggctggatgcgcgcggcgtgcgtggccactttggcggcgccggggacgaagaggaagagggggtcgcattgcgggccgtgccggcaagtgttcaggagaggaaggaggtggcgcgcgtggcgcaggcgctgcgcgcgctggccacgctgtacctgcccatcgacgcggggagcgtggcgggggcgctgcaggtggccgatgccgtgggcgtggccacgccggacatgggcagcagggcctacctcaccgccctggtcgaggacgtggcggctgggagggtcgctaccgtggccgaccgggggcaatgacaatgctgttgcgcgggaggtgtgggcaggcgatgattggacgctgttgagcatcacctgtgcggagaaaagtggaggatgnnnnnnnnnncggacgcgcgcggcgtgcgcggccactttggcggcgccggggacggagaggaagaggggtccgcattgcgggccgtgccggcaagtgtccaggagcggcagggggtggcgcgcgtggcgcaggcgctgcgcgcnnnnnnnnnngactgcggccgaccgggggcaatgacactgctgttgcgcgggaggtgtggacaggcgatgattggacgctgttgatcatcacctgtgcggagaaaagtggaggatgtgagggtattaagcgaagagcgggctgacagatgaaggcgaattaggggccatggcgctcagaggtggggtgcccaaagcgatcacagatcgcgcgcaaccaaacgggcgacctagtattctacatgaggtcgcgcaggtacgcatcgagcatctgtttaatacgaatcgggagtccatcttgaactcataaaagctgggcgaggcccaacgnnnnnnnnnncgtcgcgcaggtacgcaccgagcatctatttgataagatcgggagtccatctcgaactcataaaagctgggcgaggcccaacgcccggatggccagcccttgaggggggccaaggggcgatgccgaacctgaggaacttgctgcgcaagcggccctcatccagcacctcgggggcctacctcagtccccaagtactggaggccgcctcgaatgcatattacaacaatgccaacaagtgtgtgggcgactgggggcccggggtggagtgctcaaggcagggtgtcgggactcctggcgaataccccagccgcttggcgcagctggggatagaaccagagagtgtgggcgctcacgccctccccactcccctccaggtcaaacttcatggaggagatccccgagatcttccagctgcctgcgctggaccgaggcaagtggacggcgcagcaggagatggaaagggcccagcaggcaacgctcgtggaagggggcaggtatgtcagggatattccggttgggggacagcatgagtctctttatgttgaagtttggacgcacccaagcacgggctcatcgatcgctgcaagcgcaggaaggctgggaaatcgcgagtccactacttcagcccacgcctgagactcgtgctcttcagcaagggtgaatgggtgtgggcagatgacgatgttttgtctgcggtggccagaaactcaggccattctgtgacgatggagaagatgacattgagtctggcaatgttcactgccggttgctcgtctgggcaatcaaagcgcctgtgtgtggctggggccctcagccgtcacnnnnnnnnnnatgtgacgatggagaagatgacaatgagtctggcaacattcactgccggttgcccgtctgggcaatcaaagcgtctgtgtgtggctggggccctcagccgtcaccctcctctgacaaacccctgcaaccccatgaatccacagacttcttcatcagtgccatcaaccagaagacccacgtcatcttcggggtcgtgttcctcctgtacgtcttcctctccttcttctggtccataccctactacctcatcatgcgcttcgagccagggtgcatctacggcgccacccactacgtagagatctggatctacgccttcatcaccatggccaccattggtgagggggagttggctgtgcctgctgtcttttcaatgtctgcaagggagcagaagggtgggcttccttagacctcactgtggcgctctggctgcccgggttagggtgtcgcaggcggggacctggccttggccccagcacccgccttcctcactcacctgtacccctctcccacttcccctctcatcaaaattcaactactgcagggtatggcaacaccggcccccaggcctgctggtccnnnnnnnnnncattcgaccactgcagggtacggcaacaccggcccccaggcctgctggtccacctcggtcgtcatctcggtccagagcatcttcagcctgctgctggaggcggtggtcatcggcatcatcttcgcgcgcatctcccaccccaagcagcgtggccgctccatcttcatctccgactccgcggtcatctcgcgccgggacggcatcctcaagttcatgttccgcgtggccgacgtgcgcaagacgcaggtggtggaccccaagatcaaggcctacctgtacacctggggcgacggacgcatcaccgccgagggggaacgggtgccaggtgggaggctgggtgatatggggcctctggttcaggggctcctgtggcgtcggctcttgggtgggaatacagtgtagatcatgacccaagaatgtcgtcatcagataaccattcccactttcaaagcctccacctcatccccctggcgcctgcagtgcggtgcgaggcgctggagatcggctacatcgacggcatgctcatcctccccctcatcatcgagcacaccatcgatgagctgtcgcccctgtgcggccacactcacgacagcctgcaggccatgaacgccgagctggtcatcacctttgaggggaccactgaggtgggggtgttgggatggtgggtcccatgactcctggtggggctgggtgagtggctctggttgcggttgccggacggtttgcctgtggaagtgcactgactttaatcctctggcggtgtgacctcacaccttgaccctggcatcatcctagtggtgtgctcttctcacccctactccctttcaccctccttccctccccctttcaccctccacccctcccgttacaatcatttccaaccctctacaatcgcagtttggcaaccccttcatggcccgccgctcctttgtgcccaccgacatcttctggggctaccagtttgtggacatcatcgtgcgcccctcaccgggggagacccgctacagcatcgacctcaaccgcttccatgacattgtgccccaggccggcctgcccccgctccccgcctccgccctctcccgcctggtcaccaaccgcgccaagcgcaccgtgccctacccgctgctgggcgacaacacgctggtggtatcagacacgatgtgcctgtaccgcgacgaggccgggcggctgtgcctggcggcacgcgtggccgacacctacccaaaccagatgattgagatcaccgccaagatgtcagtgaattggtgttttgttctttattgggggggggagtggtggtgaggaggtttgggggggggggggattgaggggaactttggggtctattggatggtggcaggtttgggaatcatcgctgtcacaatgctccttttccgcgaatgtttgactatatctgtttcatgccgcaaaacctgtaacactccacaggtatctgtatcgctgggccgcccccggttcggacccgtcctttgagtgcatcccgctggagtgcgggtacaagacgggggaggacaggctctacctgcgcctgcccatggagcttacccacgtgattgacgaggcctccccgctggccgcctggctgcaaggggaggagggacgagcggcggacgccgactcggaggtcgtggtcatggtgagtgagggattgcatgtctgcatgtcgtggcttttggggggtggtgtagattggaacccagctgcatgagtggggcgttgctgccggcgagtggaagtgatgcctgacgtgtgcgacgccctccctgcgctttgcaacactccacctgctgttgcaggcgtagcttgatcattgctgtgttccgccacccaagctttcccaaggcttnnnnnnnnnnatggtgttttgttctttatgggggggggagtgggggtaatgaggtttgggggggggattggattgaggggaacttggggtctatcggatggtggcaggttcgggaatcatcgctgtcacaacgctcctttaccgcgaatgcttgactatgtctgtttcatgccgcaaaacctgtgacactccacaggcatctgtatcgctgggccgcccccggttcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggaagtactgcctgacgtgcgcgacgcccctccctgcgctttgcaacactcctcttgctgtcgcaggcgtagcttgatcattgctttgttccgccacccaagctttcccaaggcttgtcgagtactgcatcacccaaacaccccctgcactccccccccctccccaaattgccagttgactgggtacatgttctccacggggtccaacatcctgcgtcagcggacctactccgtgctgaaccacatcaagatggaccaccgcttcgtgcccatcgtgcggcaccccgagctgcaggccgacaagaagccggtggtgcgctgggcacgcttccacgacgtggcctccaccgaccccaaggcccgcgcgctgaggaccgccatgacgcagcgccagtcctgtgagtgccagtggtgtatgtggatggaggggcggtgggaggtctctggtcgagggggggggaggatcatgtgtgacgtcagaactcttcctctgagagagcatttgacgggcatcgatgtccctaattctctgcnnnnnnnnnngtggaggggcgatgggaggtctctggttgaagggggtgggggaggatcatgtgtgacgtcacaactcttcctctgagagagcatgtgacgggcatcgatgtccctaattctctgcatggtcacactccatcacttgccgttgtgtgcctgcccctagggctcggctggtccaccattccaatgcctctccggtccgacccgccccaagccnnnnnnnnnntacttgccgttgtgtgcctgcctttagagctcggctggtccaccattctgatgcctctccggtccgacccgccccaagcccattttccatgtccacaacccaatcccccaccaccacccctcctcccgcgccacagtccgccagcagagcccggacaacccctccccccccgcgcccggcgctgcgagtgcggcggcagccagcctggcccgcgcctcccctggccttggcttcagccccctggacgccgccaacgacttcaccgtctcgcccatcggcctggcgcgctacgcggccatggtgacggcggcgggggacaacacgctcacgcgcggcgcggggggacgccgcgagtttccccccattcccgacttccagtccatcgtggacgaggcgggggccgaccccgccacgcgccacgcgctgcgcatgctgccctccatcgccaagtacacgctgaccacctttgacgccgccgactccctgccccaccgcgtggcgctgcacccggccatgcccggggccagccgtttccggggcatgatggacgacgaggaggaggacatggaggaggtgggggacgacctgggcgaggacctggcgcggtacgagctggacatgcagggcagcgagggaggaaaggacggcgcgggggcgggggtggcgaccgcagacgcctgggctgagccggaggctgggccctcagacctggggccggtggcggccgccgtggaggctagcgcgtccagccagccggaggcctcgggcagcgaggcgacagaagagcgggggggcgggagccccagcgcggtccgggaggacgagctggggctggaggcgccggcatctggccgggctcccatcctgcaggcttcgtccccgagcgcaggcggggaggacgcctcctcccccgtcgccctcatcgaggaggaggtggagccgggcatgctggagacgcccggcagcggcggcagcttgcgcctcctgggctcccgcaccttcgcacccagcttccggtcccagccggagcaagacgaggcgacggctgaggaggacgccgacgaggatgctgaggaggccaacgccgggcccatccacttcaagtgagcagcaggggtgtatgagagggaggaactagaggtttacccgtgatgaaacagtctagcaggctgtgcctcctttggcagactacttgatgccatgtgcaagcatggcacatgttgacttgaggcctgcttgcccaaccactcagcttgatcatctccacctttaccccctgcagcacccccagctcttggtcccagacacgtgccctcacaaacctgtttggggcccccccgagcccagcaccgcagcggcaacagcctgagggtgaagattctgagtccccttgatgcgctgcagtgtggcacctgggttgtgatgcaggccactgcgtcttgccatcacgcttgcaaaccaccccgtacatctccattgtttactgaagctgcaagcaacactttggccaagcgaccaccagttgagggttacttttgcctctgtcaagtcgtggttaacatcatggggtgagtcgaggcgtcgcaggaggcatcatccggggaaggtggaaaagggaaaggtcggcagcacaatcggcggcgatggacagcgatgcactgctagagggtcctggggtggactgctcaacatgggcgggcatcgcttctggagtgaggcaggcggggtggggacccgggaactgcatggtcatcgcagccgcgaacagcagccgtcaccctcagccccctcctctgctccttgcgaagtacccttattccacaggaccgctcgcccctctcaaccacctcccctcctacagccctccatccgtcggtcagttgaagttcttgggggctcgtcgccgcaggaagtctggcacctggatggacgtcccccgcccctggctggtggccggaggctggacaaagggcggcggagcgtcgccgccgtccctggccggcgcgcccggcgccggcgcggcctgccgctgcccggcgggcgtgcccgcgccgggcgcgccgccgaaccccgtggcgatgagggtgatggacacctcctgcgtcatcttggggtccaccaccgcgccgaagatgaggttggccccggggtccaccaggtcgtacacgatctccgcggcctcgtttacctcgtacagcgtgaggtctgccgggcccgtgatgttccacacgatgcccgtggcgcgctcgatccccgtgtccaggagcggggaggagatcgcggccagcgccgcgtcgcgcgcacgcgtcttgccgctcgcccgcccctggcccatgagcgaggacccggcattagccatcaccgcccgcacgtcggcaaagtcgacgttgaccaggccggggactgtgatgatgtcggagatgccgcgcacgccctggcgaggggtgaggggagagggggtgagattggtggtgggaggtggggcgagagttggaatgaagggcgcggttgtggtgggggttgttgatactgaacgctggcgaggcgcccaagaagggtgtaacgctggtggatctggacctggaaaatagagtataaccaacaactctcatggccacgctactcaaatcaacccgaatnnnnnnnnnntcctgggaaacatagtataaccaacaactaccatggccacgctactcaaatcaacccgaatatggcatgaggagtgtccgggtgcaaagcctcagcgccagacgcccagcatcaagatcccagattggcccagaaagaatggaccagtctgtctcgcctggcgaaggacgtcgtctgccacgcggaaggcctcagtcactggcaggttggggtccaccgccgccaggagcttgtcgttggggatgatgatcagcgtgtccacgctctgacgcagcgcctcgatcgcctcggccgcctgggggaggtggtttgcgggaaacggtgaggatgtgtgtgaggtgggtggtctgggaagggggttggagaccgagatgcatggactggaatgggaaggccgctttggaggtcacagaagagacattgctgagatgatgccatgctagtgcactggttcagtggagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagctctgcaagcaactgcataatgactgaaagcaaattactcccttaggcacccagaacgcgcctggttccgacgcatgcggccctcgaaggaaaagggggtggtcacgatggcgacagtgaggatgcccagggacttggcgatggccgccaccaccggggctgcgccagagccggtgccaccgcccatgccggcctgggaggttggagacaattaaggggactcgatcgtgtcgattcttgtacaaagcaagcatacacacgtttgcaaccagatacgagccccatctgtgcaaatgaactgccacgtcaggcatccaacgctctggccacccttcatgcccactcaccgtgacaaagaccatatcggagccggcaagggcagcctccagctgcgccttgctttcctgagccgccttctgaccgatggcaggcttgccacccgcacccagcccccgggtcagcgtctccccgatctgcatcttgttggtggctgcgacaggggaggacgctaaggcctgcgggtgaggaagggaggccagggagggacgggagatgggtcaaaggccatcttggaaggcttgtcgtagaaaagcatgcactcagtagcagccaggagaagccttacaaaatttccatcaaaccacagacgccacacagcgctgctgccccctcatacccctctgcaccagcctggcttgcctgggcatcagtgttgagcacccaaaagtcgatgccctgcatgtcagctttgatcatgcggttcacggcgttggagccgcctcctcccacgcccacgacctggaagagggctcgtggaatgattcacggggctgcatgttggaaaggcgctcgcggcgcggtatggaggctcgccatcgtggcatgcaaagnnnnnnnnnnagtagaaaatcatgcactcaatagcagccaggagcagccttacaaaatctccagcaaaccacagacgccacacagcgctgctgcnnnnnnnnnnatcgtggactgattcactgggctgcatctcggaaaggcgctcgcggcgcgatatggaggctcgccatcgtggcatgcaaagtcaaactttcaaaaggtgcaggagtggacaccgccgggccaacggaccttaatgttggccttcccaaagagcgcattgtccacggagttggagggtggggcgtctgatggggagggcggactacttttggatgctggcgaggacgagttgggcccggcggatgccgcgagcctggagcagggggtgctggcggactttttaaacgggcccatcgcggggcagcgtgccttccaaggaactggccgggaaaacggcgcagttcgtgcgtctgatggcccagccatgggacgtggtccccggccttgggcctgcccgcaggcaaaactgacgctcatcgcccagggtgtgcagctaggcacgagatcagcgggcacaactcgcacgattccgttgaaatttctttaccgctcaggttccacgagtttccgggagcccttccctgccatggcagcccagcgcgagcctgctacagctgttggccctgcctcctgatccgtttggacttcgcgcgctgccctccacttcctgtcaccatcctgcatcagggcgccgaagggggcacactcgggccgggcggtacgcacaaacagtgcgagtacagtgaaaacgtgcaaaaccgtgtgcatgcattgggccctgccctccatccaagacgcccgcattctctgacactggtcggcgtcgtggccgagtgagggccgacgagacagcccctcccagacctccccagctgcctgcccagcacccgcgcggcgccacgggcccataacactgttcaccaccgcacgccgggcgttggttctcgcacggcgagaggtgcgcggaccggtcggtctgctgcacgccatggcggaggcggcaactgccaccccaccggagctgcccaccaagtgagagggcggcagcagcagggctgtgtgattgtgttgaaggaactccttatattgttttttacattggtgcatggccgggaacctcacgctggcacccctacccacaacacccacgcatacacaggcccatccccgagggcttcacagcgcggacagagggcaaggccaccatcctgcagcatggtaacgatgtcttctacaaccccgctcaggtgataaatcgcgacctgtccatcgcggtgctgcgctactttgccgccctgcgggccaccgagccggcccccacgggccgagcggcgcatcgcgcgcgtcgtgcctcccccacgaatgcggcggaggccgcaacccctcccacccgccccggcctgaccgtgctggagggactggccgcctcgggcctgcgcgccatccgctacgcgcaggaggtccccggtctggcccgcgtggtggcgaacgacctggaccccagcgtggtggaggccctgcgccgcaatgtggccttcaacggcgcccctgcggtcgacctggtggagcccagcgtgggcgacgcgcgcctggtcatgctgcgccgcgccggcgagttcgacgcggtggacctggacccctacggctcgcccagccagctgctggacagcgcggtgcaggccgtggcggacggcgggctcctgctctgcaccgccaccgacatggcggtgctgtgcgggaacaacagcgagacctgcttcgccaagtacggggcctacccgctgcacaagccctactgccacgagcaggcgctgcgcatcctgctgggggccatcgagaccgccgccgcgcgctacaagcgccacatcgtgcccctggtctcactgtccatcgacttttacgtccgcgtctttgtccgcgtctacaccaacggtgtgcggggggtgctgatgcacgagcgggggtgggagggcacgggaaggagggggagnnnnnnnnnncgtccgcgtctacaccaatggtgtgtggggggtgctgatgtacgagcaggggtgggagggcacgggaaggagggggagtgaggggaggtgcaaggggccgtggcgggagagcaatgcaagggttgtatcgcatggatcgagagggcgccgggatgacgtgannnnnnnnnnaggtagagcaatgcaagggttgtaccgtatggatcgagagggcgccgggatgacgtgagtagggtagattgagtgcaggctggcgtcgatgcgccaacacccaagaaactcctggttctgggttggcgcggccatgccttgccacttgggaaccctcggagtgagccgtnnnnnnnnnnctgagtgcaggctggcgtcgatgggccaacacccaagaaacttctggttctgggttggcacggccatgccatgccacttgggaaccctcggagtgagccgtaccccatgcaacccccctctgttctacaaccatgtccagcgaacgaggtgaagaactcggccacgcgcatggggtacgtctggcagagccagggctgcgactccttctactggcagcgcatgggccgacggctgatcaagggcagcagcgtcaagtacgcgccggggtccggccccgccgtgccccaggcctgccccgagacgggcgccggcttcaccatgggcggccccttctgggccgaggcgttgcacagcgccgaggcgctggccggcatcctgcaggtcctgcgctccgaccgcgccgccttcccagcctacgccaaggtgcacagcatcctcaccgccgccagcgaggagctgctggacgcgccgctgtatgtcaacctccacgacgtctgcaagacgctcaagtgctccgcgccgcgggcagaggccctgcgctccgccatcgtcaatgcggggtacaggtgcgcggctggatggaagagggagaggaagaagaatagggttgtgtttgggtgcgcgcagttatataatgcgacgtcgaaagggcagccatgcggcgtggcttcaatgtgtttcatggcatggggagcaatcacacatcccttgcatgcaaaccctttgcatgctgggatatcagcaacgacaacccgaaccagcagcttaccatttctcctacccgcaatcgcagggtgtcgtccacccacgcctgtgcgctgggcctgaagaccgactgcccctggaacgtcttctgggacataatgcgctgctggatcgccgaacacccggtcaagaacgtcctccccgggtcatgctgtgagtcgcagagggtgggaacgagcgggaggaggtttttgccgcctgccatgactgtgttcgtcgctgccgcctgagttcttggccttgtccttgcagaatactttactgttcggtggaccagggttggaatggtgctctgctgatccctcacacaacagtcgaaagctcaagagccacaccacnnnnnnnnnngtggaaaggtgctctgctgctccctcacgcaacagtcgaaagctcaagagccacaccacgcatggttgccgtgcacattacccaattgcccttcaagtatcctgtgtcccgaacacactttgaaagcctccccatgccccgccctcacagtggagaagatcctggccaaagcgccggagcacaaggccaactttgcgcgcgccacgtctgcgctgagcaaggcccggacctccaaggtggcgcgctacctcccgaaccccgaggccaactggggtcccaagcccaagcatgggaggggaccgaagcaggccgaggcaggggcgcaggtgggtgccgccaatggcgcacacaagccctcacctgacgaggacgggggtgcagaggctgttcaagaggtgaaggttgccgcgccacaatgatgagtggcagccagagcccactccctgacgcactgtttcccgctcatggccgcagcccagccgtgcccttccgcggcaggcccacccggtcacgtgtccttgagtgccgtgtcaactgatatgctgccggacatcttactcacccactgtgttctccctgctacctgtggagcttactggccagggtctctctttttgctgacagacatctgcaattgacaagtaacaccaactatcagacaatgtgggtcccccattcgccaggtagcaaggggtcaaaagacgtcaggaggggtaccagaggttcgtatgtactgccgctcatcgctggtcttgccagctcaatagcagggcttgcgctnnnnnnnnnncgggtcccccatttgccaggtagcaaggggtcaaacgacgtcaggaggggtaccagagattcgtatgtactgctgctcatcgctgatcttgccagctcaatagcagggcttgcgctcgtctgcctgttccagcagatctccagggcaacaaaaaatgccagtgcatgtgctgtggatcatgacatgatctggcgcaacgcgtcgcccacctgagtagcgaagggataaaggaaggggacattgactctgtcgagcctttgcatcacatcacttcgaggtgctctggctnnnnnnnnnnggcacattgactctgtcaagcctgtgcatcacatcacttcgaggtgctctggctccaatcaccacaagatgccactgtcatcctcccgtgccaggccctcgcatcacctggctgaacttgaagtcgtaccctgcctcctgagcccggagagggaggaccctctggccgtccagcaccaccgtggcaccctcacccaacagcagccggatggcaaagtcagggacggggagcaacgccggcctgcagggcttgtgtgttgtgtcgtgctcagcttggggaggaaagggccatgcagtgattgtacagctcagcctgaccgcatgcaagagggaaaatctggtatacttttgcaatctcttcagccctgcatcaaacatgcagctgtatcgccctccttctccactcgcctgcccatggccgctcccagctctgagcacagctggcccatgcgcacgggggagggggcggtggcgttgtagaccccggaccactgctcgtccttgagggcagccatcaggatgccaaccacgtcgtccctggcacaatggaatatcgaggggccgtgagatggacacagtgttgcattgcaatggtcatgctgcttggcatcgatccctgtgctgcctccaagtcccccttcccctgcatcagcctccccaccccaatcacaacctgtggatccaggagcaccactgctgcccgctgcccaggggtcccccggcaaagagagagaacatgggaatcatgcgccccagggcgccgccctccttgctcagcacgatgccgttgcgcaggatgaccacgcgggtattggcccgctgtgccgccgactcccattccttgcagacttccgccaggaagtctgtgccgcccccggactgctcgttgaaagtggcacgctcgctggtgccgtagtaacccacggcagaggccgagatgaaggcgggcgggcgctgggcctccggcagcccgttcatgatggcctgcgggagtcatgagggagagcagtggaggaggcaagttgtgaagatcgggtggccaagggcatgggaggcagtaaggtatgggacccatgcaatgcagaagctgccatagccctggggagggggcaccacagctttcatatctgtgctgannnnnnnnnnnnnnnnnnnnnnnnnnnnnnnnnnnnnnnnnnnnnnnnnnnnnnnnnnnnnnnnnnnnnnnnnnnnnnnnnnnnnnnngcggttggtggtctgcaggcgcgagcgcttcacctctgccttgacggtcggggaccaacgagtggcaatgggctcgcctgcaaaggaggagtgctcaaaatctaatgtatttgtactatgtaccatcacaccctccagctccttcatgcagtcggggcatggtcctccatggccagtaatggtagccagggcagccgcaggcgctcaccagccnnnnnnnnnnctgtatttctgctatgtgccatcacaccatccagctccgtcatgcagtcggtgcatggtcctccatggccagtaatggcagccagggcagccgcaggcgctcaccagccaggttgatcacaccggcagtgccggcgacggccgcgctccattccgggggttcagcaaaccgcaggcccctgatgcgcgacagcttgtcccgggcggtgggggcgtcccgagtgagcacccggacctcgtacccctcctcctgcaggcgcggcaccagcccagacccgatcagacctgtggcccccgccaccgcgacgctctggcccgcctggcaattgaccacgacgattcttctaccatgaaaattgcgtgggcccgagcttcgatgcctcggcgtgagggagtgggggattctgcatgccgtactctgagcccggctccnnnnnnnnnnggaccacgacagttcttctaccatgaaatttgcgtgggcccgggcgtcgatgcctcggcgtgagggagtggggggttctgcatgccgtactctgagcccggctccatgcagtcggcatcaaggatgcaggtcgcgggtcagctcctggcagcctcagtcaggatgcgagcgacatgaatctatatgcagagatggtgcattgacccgctagtagagaggaggcggattgtgcgtggatggggatccacgtgctgtcagatcttcagtgggcgcgctgtgggaggggtgggcctccacgtgagagcggccaacgaaaccctgcaggcacgcttgaccaggctggctgcgttgcatatacgcgtgtttgctgtctgtcatcactgtggtgtacgactcgcactctgtggcaggagcctagcctggcctttggacgcagttcctgtcacgcgtcgaaaaccgacttgcagacacacgaaacgacccgatggctctagctcaccaactacagctgcaccatctaggatgccttcataggtgaggaggaggaggaggctgcccggaatgaccttgcgcctcgggctcaccgacgtgaccgaaggcccggcccctcgtcactccccatcgcaggccgaccctggcatgcccctcacgactgcaggcctcctgcaatgccagccagaggtgagccgatgtcatctacaccatctatgcgggcagttactcggctctgtttgtgccctgctggctcctgtgttcaacagcacacccttcccttcccccgaccgctccaggaacgccgccgccctgcgcgccacccttcgcccctccctggcgcgcactgtggccaaggccgtcacggagacggaggccgtgggcgctcccacctcctccatcgactgggacaacctgggctttggcatccagggcgtggcaccggtgcgtcgattggagggtgctccaagtgtggagggtgcacattgcgccctgcctctgtggatggtatggcttttctaacatgctgcagtctagattcagtcctcctcagcgatgaaaccctctcctccccactcatcgnnnnnnnnnnggattggagggtgctccaagcgtggagggtgcacattgcgccctgcgtctgtggatgctatggcatttctaaaatgctgcagtctagattcagtcctcctccgcgatgaaaccctctcctccccactcatcgacaaaatcagagcatgtttgtggccacctttgacaccgaaacgggggagtggagcgagggtggcgtccagccgtacggcccgttgcccatgtacccctcggcccaggtgctcaactacgggcaggccatcttcgaggggctcaaggcccagcgctcgacccgcgaccgcatcgtgctcttccgccccacctccaacgccgagcgcatgcaggtgcgtgctgtggggtatgtgcacgagggtctggcgcagggtgtctggctgcctcctgggtgaggtttggatgggacatgtgcatttgtggggaagaacccctgctcccaccgtcgggaagcgtgcaagcgcgaagcatcatggcggcgcgctggggcagacctctcgagcctgccttgccctcctttgtcaactcaagcctgatgaagcatcggctcgttcgcaagggacccaacagccttcctcctgccccatctctcttcgtagctgacccccccannnnnnnnnncgtatgggacatgtgcatttgtggggaagaactcctgctcccaccgtcaggaagcgtgcaaacgcgaagcatcatggcggcgcgctggggcagagttctcaagcctgccctgccctcctttgtcaactcgagcctgatgaagcatcggctcgttcgtaagggacacaacagccttcctcctaccccatctctcttcgtagctgacccccccacctcacctcccagctcatccgctccaccctcgcactccacacatccacgcaggccggcgcggcgcggatgagcatggccgcgccgcccgaggacctcttcgtccgcggcgtggaggcggcggtgcgctccaacgcctcctacgtcccgccccagggaaagggctcgctgtacctgcgcccgctgctcattggctctggccccatcctgggcgtgggacccgccccctcctacaccttcatcgtctacgctgcgtcggtgggcgcctacttcaagggcggccagctcagccccatcgacctgctggtggagacgcggttccaccgcgccgcgccgcgcggcaccggcggcaccaagtgcgccggcaactacagccccggcctgggctcgctggccgcggccaaggccgagggctactctgacgtgctctacctggacgccaagcacgacaacttcctggaggaggtgtcctcctgcaacgtctttgccgtgtacggcaagaccatccgcaccccgcccctcgcggtgcgcgtggcaggaggaaagtttgttttttttggtggggggggggtgtagaaagggctgctagttgccattcatggttgttcgagggcaagtatatggatcgcaggggagtcggcctcgtaaatgaagactgccccgatgtgtcccagttcctgccacctgatgacgccatgactgatcatgccataatcccccccctccccacgaccagggcaccatcctgccgggcgtcacgcggcggtcggtgatcgagctggcgcgggccaaggggtacaccgtggaggaggcccccgtctccgtggccgaggccctggccgccgacgaggtgttcaccacgggcacggccgtcgtgctgtgctcggtggggtcgctgacctaccagggcaacaagcagcgctacggcaccgagggtcagccggggcccgtggcgctggagctgtacgaggcgctgacggggctgcagcaggaaaggacggaggatccctttggctgggtgcaccacgtgccgctgtgaggcccctcggattcgcagggacgcgagccgcagttttcatggcgcctcgtgtgcacctctcggggaatgcaatgcgagccagcgagggggggggagccgcgcatccgcagcgcaaggagatgtgtatcagtactgtcaaacggagaccttgcaccagggtcagaaggaagccttgggaggtgactctttacagggacgggcatcgtacatcgcacaccgcacgcaggccttcacagggacctagggctctcccagcgcggctcggatggcgtgcgccaccccgtgatcgtcgtggccggggaccaccaggtccgccgcctgcagtacctctggtaccgcgttacccatggccacgcccagcccggcgccccggatcatggcaaggtcgttgccgccgtcccccacggccatcaggtgcctggcatccaactgtggggggcgaggtgggacgcgtagagcatgtgcatgggcggaagaaggctttcatatgaaagggtgggggtgcaacctcagggcggcaggtggacaacccgtcaacacatgcgccgcaggctgccaaccccagttccctcctccatgggggcgaaacggtcgcacccgtcccacccctgctcaaggctggcttgacccaccttgaggtcggcgaggaggtgctgcagggaggcccacttgttccaaccgcgcgggacgatctccagcatgtttggcagggcctgcatggtctctgcaccagtccccgccagggcggcctgagggggttttgcagtgggtgctggaccgcaagtgtgggggtgtgatcgccagtgactcccgcgaagaactgacctccctcccacgatccactcccgggcgcccagcgccgccacaccctgcgcacctcccagtgcggcttcagctgggtgtcgacgcgctcggggtctgccatgaaaagcagctttcggacgccgtgctggccggcggcggccgcggccgtgggcaccaggaagggtagtggctcgtggtatcgcgtgtgcagctccatcagctccggcgtgagcctggtggtcaagcactcgtccccaagaaaggcacacagcgaccctccgtgtgcgtctggggggtgtcggataattttggaaggtggggggggtgaggagaccgcgtcttggtggtcttccctctgacccagggcacgaatgtacagtgcaaggctgcacttccccggcccacgccataccacaccctgccgctgcacatggcacatgccaacagcatttgtctgcacatcgccaaaggacactcaccagagtactcgaaggccgcctggacaacggcggggtccagggcggcagaagccagcaggagcccgccctggccgtacaccagcaggccctgcaggaagatgcccggcgcggcagccgaggccagctcggcgatgcccgtggcgcgcagcgcggcctgcgcggccggccgcgccttcccggtggccagcacgacgtgcacgccgcgggccagcgccgcgcggatggcgtcggcggaggaggaaagcacggaggaggtgccgtccaggagcgtgccgtccatgtccagtgcgatcagccggatgtcgtggggcccaggcgtcgctgtcgctcggggagagggcgccgcgagggagggggacagcctgccggcgccgagtgccccgggcgacggctcctgggcgccgccggcgggtctgtcggcctcagccaggccgatgaggccggggccgcgccagcccagcgccgccagcacctgccgttccaggtccgccatggcggccgcctccaccggtcctgcaaggggatggtgaagcttttcatgggtggtgatatgtgctcctgcatgccgccactccagcagaccccggcaagccggtcgcggccctcgcttacaactgcccatcccccttccctgggccccggaacagatgctcatcagctgccggacccaccctcttcgtggtcgtggccgaggaggtgaaggagaccatgcaccagaagcactcgcagctcttgctccagggcgtgcctcctttcctcagcctgccgcgcggctgtgtccagagagatcaggatgtcccccaggacctggactggcagctgtgggcaaggttgggtggggaggttggtgatgggcagcgcgtatgtgccggcgacgggtggcagaatcatgtggtgctggcactgcggcagctgctgagcactcggcaagaggggtcgacagagcagtgcctggggcagggactttacgacgaggtatgtacaaggcactgaccatgcagagcccaccagtttgagcacctcctccacactgcatcccctcgcagagaaccccaaccacgccttgcctttgggctgtcgtcctcgccctcatcgctccccatctcgaaagaaagcacgtctgtgggggcatccacgccgcggtactcggcgttgacctcgcggatgacctcatcgtccacgagggtgagggagagctccaccgtacctggcgtccgaatagggtggagcatgcagtgtcggaggagggcggcatggtgggaggaggaagcatctcccattctctgtgccaggcgcaccctgcaacgaaggagacggcgccagcacggccattgcctgtattgccgctgtggcatccgctctgagcccacccagcataccgtccagctcctcctctctgcaagcagatgaatggtagatgcccaagcttcagagcaccaactcagcagacgctccagagcggggtggggaatttgtgacattcatgatcacacacattaaccagcatggttgtaccttaagttgggaaaggtgccgtcgatcgacgatgcaatgctgacatccagtttcggtgtgacggaagggccatgctctgcagcgacacctcggctggtgcctacgcacgccagctgcgatcttgacccatgcttgcaaggatgagtatcatagagtctattcaatgccgattgtgtcctacacaaagctgcaaggcggctagtnnnnnnnnnnggtatcatagggtctaatcaatgccgattttgtcctacacaaagctgcaaggcggctagtagagggccagctttgtaactgagtgagcctgtagcccctcctgggcgagcataggaggcgtaggagcggggacgcccgcaggccacgacctgcagcctgcatggttccaaaccaccaaattatgatggtcccctcataaataccatccatgcatatcgttaaaagggctcctcgcatattcgcctagttgaaccgggcgtgagaacccacgtgacaccaagaccatccatcaggccggaaggtcccgcgcgttagggacccgagactcgtgcagcgcgcaaggagcatagagtaagccatacattatttaagagtaccggggcggccggcacgatctcgctgtcatggaggattcggagggtccccctcctcccactgaggtttcggtgttcacggcggaggaggcctacgtctatcgcatcccaccagcgacgactgtcggccatcgggccgagacgtggaatgtgaattcctggttgcaagaggtccgggtgagggttgtcagcagagacgaagacgcctgggtccggctggaagagctcgaaaccggtacggaacagtgttgaggaggggttgatgagcttgaacgcactggctcgcgttgcgtgggttgatgagagctcagtattcaatccatggagatgagggcatccttgaattgtttcccaacaggtaacctattcgctgagtgcccagtgcccattcacgtgcccctctcgacggtgagcgtagtatgagggatagagggtctagatctgttcaactcctattgtcttctgtgtttccgacatgtgcttgggtgtctaggggtgttgggatttccactcgcattggcgtaatcagggcatacaaggaaggaggcttgccctgcacacaccccagtgagcannnnnnnnnncccgacatgtgcttgggtgtctcggggtgttgggatttccactcgcatttgcctaatcagggcatacaaggaaaaaggcttgccctgcacacaccccagtgagcagcgacgcactgcacctcgcctttcatcacttagccacctccttcgcacgcacccctgcaggcagtggagcccgtcattgacagttcacgttattttgtgctcaagatcgtcgacagggactctggtcgacatgcgttcattgggcttgggttcaggtgagcagctatgctcggtgaactttacgcgtgtgggcattggcttggaagccattccaaagcatactgacttcaatttatgacaccctccaatcttgctctgcagggagcgagagaaggcttcggacttcaacgccaccctgcatgagcacatgcagtatgtgaggaggaaacacacggctgccggtttgcggactcagtacgaggaacagctggctgccaatctggccatggcagctccagactccctgcctcaggcaacggatttcagcatcccagaaggccagaacttggtcctcaaagtcccagcggtgtgtggtgtggcaatagtgaggatgcggaatgctgggcggggagggaggggaagtggagggctctattgaatgattccgtgcgcaagggagcttatcggatatacatatgtcgaacattattttccattttgaggagtgcttcctgcattgacatgaaggagatgctcgaaggggtttcccagagaagggggactttcagtacatgcacaacaaagcatatctcagcttgcatccttgtcccatcccctctgacaggcgcacctgaatgggggatgcagcactcccaagagcgggttcatttcttccaaccgaggtcggctgagcaagaccttctccctgctcatggatggcgagggcaatgtgattgcaggcatgtcgccacggaccacagtggacgaaatgggcctctctccctcctcctccacatcctctgcactgcctgatggggagggcagcattttcctgggattgccccgcctcagcggggccgctccagtgcacagggatgagtggggggactttgtagcatgatgaccccttggcgtcgtgccacgacgccgaggccctgccccattcccatagggttgcgagggtgcttgccgcaggggcctgtatggcatgcaggactcgttgcagagcgcgattttccgtgccagtgcccacttttccaagcctaaacatgcatccatgccccgcgcgcatgggtggtctccctcctgtactcccgctcctgccgttctgcctgtcctgtcatacaacatcacaccggttgactttttgtttggcgtgccccaaacctcctggatccgacttccctaagctctgccttgatgtcgtcagcctcggatctccgagcaaagtcgtcatgggtattctcagcaggggccccaagaagggcaaatagctcacgccatgtgtcaggaagcgaggggattgggaaaggctcaggagccctgccggcannnnnnnnnnaggccccaagaagggcaaccagctcacgccgtgtgtcaggaagcgagggaattgggaaaggctcaggagccctgccggcaccaaatatcacgcagggctgcaaagcgtcggggagcgggtagcccggtgccccttcccgtgtgctccagggtctgcagatcttcgtccgactcctcgtccatgttcagggacaggggctccaccagccctgcgcggcgagaagggggcagctgaggtttgagtgcgtggattgcgaatactgttgacccttgcgtcgctgagtggggctggcccttgctaaaagcaaaggagaatcgcgggccttgagccctcgccggacccaccttggtcgaggagctcggaggctgcttgggcttcgtacccggccgagtcggttgccaggaggccgtctggcttcccgccggataccacgctgcgcgccgtgctgggcgtgtccggctcctccaagctttccagcaggcctgggcgcgggatgtttggccccgggtgagcagggatgggatgggatgcaggggcaatgatcctcgctgtacgccctgcggcaggcttgccaggccggccgctggacaccggtcatccccgtccccggtccaccacctgctggcaggcggtcctcggcgaggtcgtctggggtatagcgtgagagcagcgccagcagcgtctccgaggacaggccgggcgcgagctccgccctggtccctgcatccagcagcgcctgggtttgggggggaggggttgtgttggagacccaaagccgggttggtgcgatgcagggcgtgtggcaggccggtaggatcactcaccaggccatttgggaccctggggtgggccgccgcactcggtacggacatcatactgactatcaacggcacctctccatccagccgctcttctccagggccccacctcactcttccaacacccccgccacccacccccctccaccaccnnnnnnnnnngtgccaggaggacgtctggcttcccgccggataccgcgctgcgcgccgtgctgggcgtgtctggctcctccaagctctccagcaggcctgggggcgggatgttttgccccgggtgagcaggggtgggatgggatgcaggggcaatgatcctcgctgtacgccctgcagcaggcctggcaggccggccgctggacaccggtcatcccagtccccagtccaccacctgctggcaggcggtcctcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactgactatcaatggcacctctccatccagctgctcttctccaggcccccacctcactcttccaacacccctgccccccc

SEQ ID NO: 45890 - DNA, 3355 bp, Chlorella protothecoides
  modified_base (776)..(785): a, c, t, g, unknown or other
  modified_base (1705)..(1714): a, c, t, g, unknown or other
  modified_base (2255)..(2264): a, c, t, g, unknown or other
  modified_base (2916)..(2925): a, c, t, g, unknown or other
  modified_base (2986)..(3160): a, c, t, g, unknown or other
gctgacaagggaggaatgcctgagaaggagtaggatttccttcttaagaatattagagacttagcggaggcttttgtttggggaagcctaccctggatgatgcatgttaggtattcctcattcaaaaaggcttttattgtggaatttgaaggggaagttcatcgcgacgggataggagcaggcctattcgtcgaacgaggtgagggggaagtgtttcaaaccggagaggatggtgattttctcttcggggaacgagggggggtgcccttctttggaggaggtgaggatctcttccttggaggaggagaggcggggctcctctttggaggagaagaggcggggctcctctttggaggaggaaaggcggggctcctctttggaggaggagaggcggggctcctctttggaggaggagaggcggggaccctctttggatgaggagaggcggggctcctctttggaggaggaggggaggggctcttcctcagaggaggaggaggtgagatcttctttggaggaagaggggaggggctcttcttcatggaagggggaggtgagttcttcttcgctggaggagggggtgcggtggggctcttcttcacgggagggggagggggggtcttcttcatatgaggaggagatggaggaggaggaggaggagagctccttttcatcggaggaggtgggctattcatcctggggggtggaggtgtggtgccatttctaggagctggtgggggactcttactcattggagatggggagggcggttcttnnnnnnnnnnagaggtgagttcttcttcgcaggaggaggggttacgggagggctcttcttcatgggagggggaggggggctcttcttcatgggagaaggagatggaggaggaggaggaggaggagagctccttttcatcggaggaggtgggctattcatcctggggggtggaggtttggtgccccttctaggagctggtgggggactcgtactcattggagatggggagggcggttcttgtgacggtggcgatggtgggggctgtgggcttggaagaggaggctgtcctcgaggaggaggggaagccagtgggggactggacactggtggagggtacttggtcgcaggagacggcacagatgcaggggagggggctgcgggcgtcggtgtgggaagggaaggaggtgtcgcaggggttggggtagaagcaggggatggagctggggtagaaggtgatgggctgggtgccggggcaggtctgggcgccacgggtgcaggggagggagcctgtatgaagactgtctccgcggtctggaggtctttcaactggcaagcgcttccgccctggctttccaagttgttgcacaccacatcgtctccccaatttccgctcccgtcagagtagctgccgtggttgtcgtttcctgcaggtgcagtggatgcaaggttgggggtgttggtgatgctccctctgccacacaggaataggagattgcgaggagtgtgacgggtgtctcgccagctctgttgccactcaccattgttgtagttgccatggttgttgtggcctatgttgccttttccccagttgccattaccgatgttgccattggaatccggcaagcacctctgcagccctgctggaaggcactccactatggacatggctttgcagatcattgatggcgtggggtggcaggttgccagggnnnnnnnnnnattgccattgccgatgttgccattggaatccggcaaacacctctgcatgcctgccggaaggcactctactatggacatggctttgcagatctttgatggagtggggtggcaggttgccagggtcgcagcatcaattgtgtcgatcaggaactgcttgaatgggtcgttaggcctcacttcatactcgatggaagtgcctgcacccgcaaaccccttgcgcctgagaagaatagagggggatgggggaatgggggaggaagactggggggcatccttgggaagggtcaagcagacagttgccatgggacctcgacctggccgctcgttctgaggcagatgcaccgcccagtggcatgcacatgtttgcatgctgtccctgccagaccattcgactcacttgcagaaaccatcggggttgtcggagctcgcgagatacagggaaccctcgaacctgcggatatggcgccagggtgtcaatggcgtggtccaccggtactgtgcagggactatatgcaccctcaggacggcccttggcccctgnnnnnnnnnnactgggggccacgggtgcaggggagggagcccctatgaagactgtctccgcagtctggaggtctttcaactggcaagcgcttccgccctggatatccaagttgttgcacaccacatagtctccccaattctcgcttccgatggcaaaattgccgtggttgtcgtttcctgcagtggtgtgagtgcaaagagcgggtggccatgatcatttgccatgcatgatgaggtccatcagagggattcttccaagcaacttgcaccaccggcaatcccctcaccgttgttgtcattgccatggttgttgtggcctatgttgttctttccccagttgccattgccaatgttgcctttggagttcggcaaacacctctgcatgcctgccggaaggcactctactatggacatggctttgcagatctttgatggagtggggtggcaggttgccagggtcgcagcatcaattgtgtcgatcaggaactgcttgaatgggtcgttaggcctcacttcatactcgatggaagtgcctgcacccgcaaaccccttgcgcctgagaagaatagagggggatgggggaatgggggaggatgactgggggccatccttgtgcagggtcaagcaggcggttgccatgggaccttggcctggccactcgnnnnnnnnnnaccttgtgcagggtcaagcgggcggttgctatgggaccttggcctggccactcgttctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccggcactgtgcagggactccatgcaccctcaggacggcccttggcccctgtctgcatgcagagggcccattccactcagactgcagcatgcacccccctccccacctgatggttggcaatgcaaagaactttattgacggatcacactcctgcccgggtggtgggggtgggggtggtggggaagggggtggtg

SEQ ID NO: 45891 - DNA, 102 bp, Chlorella protothecoides
agatacagagagtgatcaggacaggctcgacctctggctccagcatgcgacccgctctacaaattgagagttacatgaccaacctagatctcctcctattct

SEQ ID NO: 45892 - DNA, 80 bp, Chlorella protothecoides
aagtagcgaccgacgtcgaatctaccctccaaccactctgtgatcgggtctggcatggaattagctcctgtgcaattcga

SEQ ID NO: 45893 - DNA, 75 bp, Chlorella protothecoides
ggcgcaggaggagctggcgcccaaggagctcgaacaccatgatggtgaacccggaagtggccgcaatccgggagg

SEQ ID NO: 45894 - DNA, 28500 bp, Chlorella protothecoides
  modified_base (124)..(133): a, c, t, g, unknown or other
  modified_base (384)..(393): a, c, t, g, unknown or other
  modified_base (647)..(656): a, c, t, g, unknown or other
  modified_base (835)..(844): a, c, t, g, unknown or other
  modified_base (1345)..(1354): a, c, t, g, unknown or other
  modified_base (1572)..(1581): a, c, t, g, unknown or other
  modified_base (2892)..(2901): a, c, t, g, unknown or other
  modified_base (4452)..(4461): a, c, t, g, unknown or other
  modified_base (4548)..(4557): a, c, t, g, unknown or other
  modified_base (5007)..(5016): a, c, t, g, unknown or other
  modified_base (5107)..(5163): a, c, t, g, unknown or other
  modified_base (5907)..(5916): a, c, t, g, unknown or other
  modified_base (6665)..(6674): a, c, t, g, unknown or other
  modified_base (6994)..(7003): a, c, t, g, unknown or other
  modified_base (7231)..(7240): a, c, t, g, unknown or other
  modified_base (8500)..(8509): a, c, t, g, unknown or other
  modified_base (8871)..(8880): a, c, t, g, unknown or other
  modified_base (9764)..(9773): a, c, t, g, unknown or other
  modified_base (10595)..(10604): a, c, t, g, unknown or other
  modified_base (11145)..(11154): a, c, t, g, unknown or other
  modified_base (12891)..(12900): a, c, t, g, unknown or other
  modified_base (14218)..(14227): a, c, t, g, unknown or other
  modified_base (14384)..(14393): a, c, t, g, unknown or other
  modified_base (14492)..(14501): a, c, t, g, unknown or other
  modified_base (15207)..(15216): a, c, t, g, unknown or other
  modified_base (16005)..(16014): a, c, t, g, unknown or other
  modified_base (16785)..(16794): a, c, t, g, unknown or other
  modified_base (18212)..(18221): a, c, t, g, unknown or other
  modified_base (18383)..(18392): a, c, t, g, unknown or other
  modified_base (19283)..(19292): a, c, t, g, unknown or other
  modified_base (19962)..(19971): a, c, t, g, unknown or other
  modified_base (20838)..(20847): a, c, t, g, unknown or other
  modified_base (22090)..(22099): a, c, t, g, unknown or other
  modified_base (22469)..(22478): a, c, t, g, unknown or other
  modified_base (23258)..(23267): a, c, t, g, unknown or other
  modified_base (24526)..(24535): a, c, t, g, unknown or other
  modified_base (25131)..(25140): a, c, t, g, unknown or other
  modified_base (25215)..(25224): a, c, t, g, unknown or other
  modified_base (25290)..(25299): a, c, t, g, unknown or other
  modified_base (25973)..(25982): a, c, t, g, unknown or other
  modified_base (27142)..(27151): a, c, t, g, unknown or other
  modified_base (27337)..(27346): a, c, t, g, unknown or other
  modified_base (28420)..(28429): a, c, t, g, unknown or other
gggttgggagctcggtcatggctgctggcttgtccctgatctctacccattgctgcggtggcggttgagaggatcacccacacctcatcctccggtgactctcgccctcctcacccggtcccannnnnnnnnngactggagcgggcaggaggtgatgggccaccgttggaacgcactggccgggacaagatgtgaccctgtggcaggcctgcccctcagccccgcctcctctgcacttccatcgcaggacctcatcccgagcgggacgatgaggcagctcaccctggacagccagggcggcagtgaggagcccaggctggaggccagcagcgacgaggatatggtgagtgatggggttgggagctcggtcatggctgctggctnnnnnnnnnnggtgcagaggaggcgtggttgaggggcaggcctgccacaggctcgcattttgtcccgggcaatgcgttcaacggtgccccatcacctcctgcccgctccagtgtgccctgccgtgctcccacgcccgcaacaccttcctgccagtccacaccaagccccctcgaccagctctccgctcaccccatcatcctcatctgctcctttgccaaacgtgatgcgtcgctcagaccgcacccctttggccgacgtgccannnnnnnnnncgtccctgatctctacccattgctgcggtgggggctgcgaggatcacccacacctcatcctctggtgactctcgccctcctcacccggtcccatctttcccagctgggggccagcgcgatcgatgaggaggcagaggaggatgcggcaggcgtcgagcaggaggaggaggaggaggagnnnnnnnnnncctccttcccctttttcagcgcaggtttgatcccgccctggtgggatggagagggggaaggtgataggcacagggggaagggacactgcttcctgtgtgccacccggatcaatgtcggattcctctgaatggagcaatgtttcaagtcagagaccatgaaaccatctactgaccttgtgcaccctttcctccagcagctgcaggaagtccaggtagagttcggcctctgggctgcccgtctgtgggcggggccactctgcatgcaggcggggcaggagttgttatgagaggacttggatgtcgtgatagggactagggtttgagtcaattccctgtcagctcggtgtgccgtgcttgcaaaagtacccttctcgggcagggactcctcccagggaccgatcaggtggacgggagaagtgaaactctgtgcagcaacaaatcaaaccctgaaaccccatctgtcaccacaatcacagcctcacccctctctgcggtcgcctnnnnnnnnnnttgagaggactcggatgtcgtgatggggactagggtatgagtcaattccctgtcagctcggtgtgccgtgcttgcaagggtacccttcccccgtccacctgatccgtccctgggaggagtccctgcccgagaagtgaaactctgtgcagcaacaatctgtaccctgaaaccccttctgtcaccacagtcacagcctcacccctctctgcggtcgcctnnnnnnnnnncccgccgaacccggcagtaccgctgagcctgcgcatggaggcatatgcccctcccgagcgccttgcagcggatgcatgacagactccacgccgacccctgaccgacgaacgagaagaggctctggcatagtccaggcttgcgtgaccgccgtcttccaccttgcgctgcacagcgtgctgcgaccccgacctccccaaacatgtatgagccacgcccctgtgccgagccagcagagcacagcagcacatgtaatcaccacctcccccgtttcccatgtgatgagagaaagcataagcactgagtggtggccgcaggtgtccttcaggctggatcggggggctggtacatcccaaggaactcagggtgtacaacaagcatgtcgcatggggtctcagatattagtatgcaacaaggtacaacaacggccctcaggactcgtccagggccaggaagatgtcgctgacaacgtcgttggaaagcaggaaaccctcgggatcggtgaggccgaagtgcgtggcagctccctcgccgtctcgctccagccaggctaggccggctgcgacatgaggctcgagcgcggagagcagggccggctcgtgccgcctgtccccggcgatgtccttcaggaccgtcagccagacgccgtctggtggagggtgggcagcggcagtagcttgaggctggggtggttgtgcaaggaggttagggaacatgggtgaacttacagcaccaccctcacctctgagccgggagcgaagcatgacggcgtcaagaagcacgtccctcctgctctccgggggcagttctgcgccaggagattccctggggccttcccggtaggcttccagccagcgcaaataggcaggcagcgacttgggtcggctgaacctccgcccctgcttgccaggagagggagcgagagtgtatctgttgtgcgttcaggtactggaagactcatgtacagcttcaggtccaggaaatcagcattgtttctttatgcgtctgcccaggagcggaccaacatacacatcgtctgagagtccaccacaagagtctcacctggagataggatgctgcccccatgccaaacccataaaaggagctaccagaccagtacatggtgttgtgccggctgcgggagcccggcagggcgtagttgctgatctcgtagtgctcgtagcctgcgttgcgggtggtgatgtgagggtgcaactgagcgagggtgttgtggcaatcaaggttatcttgtcaactgtttactagcctgacgtgtgcccgcgtactccctccatcatgttctcgtcatcccnnnnnnnnnncttgactgtttactagcctgacgtgcgcccgtgtactccctccatcatgttctcgtcatcccctctcgcaccaggcccaggcactcagcccctcacctgccccacgcaggcattcgctggcctggccaaacatggcggcggcagcgtcgtcgctgggcagcggctcctgccccggccggtacatagcggcaaagggcgtccccgcctccacctgcaggtcgtagacggagacgtgggtgggcgcggccgccaccgcggcctccaggctggcggcccaggcaccggggtctaagcctggcagcccggacatgaggtccaggctccaggccggcacgcctgcggcgtgtatggcttcgatcgctgcgtggacctcggccacactgtgtgaccggccgcagcggtgcagcaggtcgtcctgaaaggcctgcacgcccacgcttaggcggttgacgcccagcgcttggagggagcgcaggcggcccgcgtcaaaggtgcccgggtcggcctcgaagctgacctcggcgccgggggcgatgccgtaggcacgctccagcgcgtgcagcaggcgctcgacgagcggcggcggggtcaaagaaggggtgccgccgccaaagtagacgctctggagaggatgagggttctgggcgggcgtggcggcgatctcccgttccagggactccacgtaggcctcgatggcggggacgggggcggcgttgtcgaccgcccgccccagcgcgatgacggggaagtcgcagtacaggcacttgcgcttgcagaatgggaggtggacataggcgcccaccgggtctgccgacggcgggaggcagaagctggggtggggtggggggcggaaggctgtgtggagccctccagcccgggcgcggctggcgcgggagtgctgggaggttcctgatgggcctccaccaccacacctcggcaccctgcccgcatgggtcaggcgctgcaccgcgctgccgatccgcacacctctagggcatgcatgcatgtccttcgaggtagtttcaagtatagatcttttcacgagcttgccctcatgaagcctcgggatagatttgatgctgtggcatcaacatgcacacgggtgtcggggtgtcgaagtggggccctcgtgctacctcgcaatgtatgcaagcattgcgcccctgcgaccctgaatagataacctggaacgttaaatcaatgcacataatatggatggtaaaccaatgcaagtcaatactctgacttcccttgctcaagggtgtgctgcgctgcgcctcatgctgaggtttcggaaatcaatcctgcagaagagactcataccatgctggaatgaacagacattcatttcaaggtaggaacggggcatgcacaccccacatcactcggtcttcttcacgcgtggcttcatgtggcgcttgaaatcgggcatgaggtgcccgaaaacagcaatcagggttgagaacaggttgtagtccagcacctgcacccatggatgcgggtctcttggtgcgcctctgtaacacaatcttcgagccccagggagggtgnnnnnnnnnncaatcaatgcacatgatatggatggtaaatcaatgcaagccaatactctgacttcacttgctcaagggtgtgctgcgctgcgcctcnnnnnnnnnnaatggatgcgggtctcgtgggtgtgcctctataacacaatcttcgagccccagggagggtggtccactgatgcatcctcactcagattgcacgacgcggcatcggaccttgcacacctcaccacttgtcaccgttttgctcaacctcaacccaccttcatcagcaggcggaagccaatggctgtgggtccgacatccctccacaccagtctgccgatggaggcaaatatggtgtctggcaggtcctctgggtccactgccatcttcttgaagaactccatagcgtccagcttgtgcgcctgcagtggtggcatggcgatccatcgtggatggtagatatgtatcaaggcgcaagtacatctactgtgcctcagcatcctcagcgaccgcgtcttcaaaaggaataacagccgtgagtaatgtcaggacaccaaggggggtatcttgcctnnnnnnnnnngtactgtgactcagcatcctcggcgaccacgccttcaaaaggaataacagcagtgtgtgttgtcaggacaccaaggggggtatcttgcctnnnnnnnnnnnnnnnnnnnnnnnnnnnnnnnnnnnnnnnnnnnnnnnnnnnnnnnnncgtagaagcgggaggccaccggggaagggtggaagacgagcacatcaatgccgctgggcttgacctccgccgccaaggaggcgccgaaagttgatatgaaggccttggtggaagcgtacagaactgagaaggggtttgggatggccgccgctgcggaggaggtgtacacaaagcaccccttcaggtgcttgtccagctgcgtgtgggggtatcggaagggagagctatgtgtggcggcagaatctagggtgcggggtgaatttttgtagtgcttggtccttacgtccttctctggatgaattgatatactttgagctgcactgaatttgtgccatgggcagcagcatgtccagaactcccgcagcttggtatgagattcccttggtgccccccaagctcctccaccctcaccagcttttggaggagcacatgggttatctggaccgcattcacggcgttgcactccaggttggcgttctgtcgctccagcgggctgtgggatgagtcaccatgaaacacattgatgcagagcatctctgctgcaaacgaagttcacccatggatcgaaggctggggtgagatgcccccctttcaatctctttgtacggctttctgcacaggcaaaagcttcattctgtcaagtaatcaagcagcagaccggaccattcacatgtggggcaccccctttcccccttgaaacttacacatccgcaaagaagcccgtgaggacgtaaccagcgttannnnnnnnnncgagggctggggtgagaggccccctttcaatctctttgtacgttcttttgcacaggcaaaagcttcattctgtccagtgaacacgcagcagaccggtccatccacatgtggggcaccccttccccccttgaaacttacacatccgcgaagaagcccgtgaggacgtaaccagcgttaaggaagaccacctggacatctatgccttctatagctttctcgatagctggcatgtagcctgggcgtccaaggtccaccggcaccttcttgagggtgacattgggaaaccgggcggagagctcctcatggctggcttccaagagcgggtctgggtatgccaccatgacgacattcagtccctgcgatgccagacggctggcaatagccttgcctatacctgattggttgagcgagagtggtgtgtttgggagggtgtcatgggtcggtgctcatctcttcgttggtggcccccccacttggtatgagggacggcaggccaagttcccaccgagggcaatgtgatcacactcgtaccgctactagcaccagtcaccaatgcccactgagcattgtacttcttcttcaggttttgcgtcttgtaaaaccaagcaacaaaggtgtgtgggatcagatagctgaggaaaataaaggctacaagccagccggcaatagaggctaggacagacatcctgaggagtattaaggaagactactctgcgagcggctcatcgcgcattggcagcggcctgcannnnnnnnnnacaaggaatgctactctgcgaacggctcatcgcgcattggcagcggcctgcatgtcccccattttactcgagctcgcatcgccctggcctgcttgcgtggcgtgacatggcgggttccctgtttggacttgctgatcactccttgtgccatgcaattaagcaacgtttcatgaagtgtattctaacatcatttcccattcaaccagtctcgacttataaatgcggtctgcgaggcgataggtccgatcataacgcttgggccgtaggcctcgactggacacgctcccttgcagcaccccaaagatggcagagtggcaggnnnnnnnnnncgcgaacacctggcgagctcgctttttcaatgtccattgtgcaatgtgaaacgccaggatcactctacaaacctcacaggatccggaacctcgggtgttctctctgctggtggaggaaggcctgtgcgaacctttgccacttgacactctgagaagggagcgcgacactcttcttcggcagaggcgaaggaacggtttggtctcttcgaatggacctcgagaatccannnnnnnnnncaaggcctgtgcgaacctttgccacttgacattctgagaagggagcgcgacactcttcttcagcagaggcgaaggaatggtctggtctcttcgaatggacctcgagaatccaggacctctgcagaagacgccgatgctgcggtgctggccctgtgtgacgtcagcgaagctgatgcccgtccagtgttccaaaggtgagggtggaccaatgcattatgagtactgtaaatatgcatgcatagattggaaaagattgtgtccctggcctcaccgcagcgcctacacctttcgactccaggtacaccagcgcggcagcgcaggcttttgtggatggccttaccccgctccctgcagcgacgcccttccttgccgcctctgcggcagaggaagccgctgcggaggaggccgtcttcgtccccaagcacgccgagcggctgcagacgcagctgggagcgcgctggctggccggctggtgccagcgggtggcatcgagtggcggagaagtccccgcagactccgccagcctcgtccccgacaacgacgcggtgcccaccgccgccgcccgcctgctcttggagcagacctccgaggatgtgctggcggccgagctgtatgacctgctgggggagggcgtgtttgcgcgcataggtgggtgggctgttgggggagaggtttggggatccagggacacctgcacctggatcactaagtggaggcgagactggccctgtgttttctcaactcaccctggcaacacccggtctggcttctgagaaatttacactcccagcgctgagcttgcgctgaggtggtttacccacagcacccaaccctacgactttctttctccttatcctacaacagaggagctgctgctggcccgcccatccatcgtcgctaacatccgaaatgcaatcaccgcgctgcgggagacagagcaggaagacgaccctgttgggtcaacagctggcatagcctacatgtccgatactgtgaccatgatgtcagagtctcaggtgaggtactaccaaggaaatcctggcaattttgtgcctgtgtgtcgagccacatggccctggtagttgtttttggatgggatggagcatgaaccaattggtggtaggcgtcgtacagcaggccaagccgtaccacatccgctgctcgctcggccccctcttccgcaaaccctgcccagctgcaagccttgctccagttcacccggccaccttttcattgcgcgacagaggctgctggccaagnnnnnnnnnntatctgctgctccctcgcccccctctcccgcaaaccctgctcagctgcatgccttgctccagttcacccggccacctcttcattgcgcgacagaggctgctggccaagtatgagcgcaaggccggccgccgctcggagcgcagcggcagggattcggccgccggcgtgcgacgcgaggacgagacggaaggtgcctggctgatgcgcgtggggctgcacgccctggttcaggaggaggaggccaaggacaccgcacacctcttcataaagtgggcctcgtatctgggcggggtgggggtatggcatggctggcatgccctggttgatcgcttggttggggcgagggactcgcactgatgtgnnnnnnnnnntcgcagcggcagggattcggccgccagcgtgcgacgcgaggacgagacggacggtgcatggctgatgcgggtggggctgcacgccctggttcaggacgaggaggccaaggacaccgcacacctcttcataaagtgggcctcatatctgggcggaatgggggtttggcatggctggcataccctggttgatcgcgtggttggggcgagggactcgcactgatgtgtgaagcagtgaaatggctgtgggaaaggatttaccatattagataattaagactgatacccccacttttcacctcctgctctgtcgcttatgatgccaagctcacataagtggtcagagcctcctctccgtcccatcgatggtctcgggtagccagaacgcatcaatgattggctcacatttttttctgaacctccacccatccctcaacaggctaggaggtgtggagttccggctgggcgacggagtggagggcgtggggggccggaaggccctgccaactggcacgacgcgcaagtgagtttggagagggagagttgggctgccagcatgagtgctggtgcaaccagtgaatgggtggcttcttgtgggttgggagccaggtgcctgattggatgtgtaccgcccactcaccactccacacacaggaacttcaaaaagtatgaggagatctttgtgccggccaccaagccctcggtgccgcctcccgaagaagtttccatcaaggtgaggtggtgggacattggcgtgcgagttggcgccagtagtacattgctgcacaggaagccatgtcagtgccatgcagatcttttcagatacattgaagtcaaagacacctcttagcctgaatccccccattctcctgaccctccacccaaannnnnnnnnnctggcgccagcagtacattgctgcacaggaagccatgtcactgccaagcagatcttctcagatacactgaagtcaaagacacctcttagcctgaattccccccattctcctgaccctccacccaaaatcatcctcctctgcagatcagcgacctccctgcatgggcccagccggcatttgcagggttcgagaagctgaaccgtatccagtcccgcatctacccgaccgcattcaacagcaacgagaacatcctcgtgtgcgcccccaccggtgaggtttggtgcagggaggggcacagtgtttgtggggctctggtggcggacgaatgtctgggcaaccagggcagagcgcctttcttggcatgagcctccatgtgtagatgtgctgatgccaggactggaactgcttcctcctcacaggcgcgggcaagaccaacattgccatgatctctgtgctgcgtgaggtagcccagaacatggtgcagggccggatccgcacccaggactttaagatcatctacgtcgcgcccatgaaggccctggcggccgaggtgacctccgcctttgcccggcgcctcgcccccctgggtaagcctgttggaccccagtggtactgcaaggggttgtttgtggtgggtatcatcaaggcttgggtttgagcatacttagacagtgtagtatatcgatgtgttgtatcctcccctgtccgtggttgtttcaggcatctcatcctctagtctctccaccaggaccgtctttccctcactgattttcccccttccctcccccactcatccctccataggtctgcgcgtgaaggagnnnnnnnnnnacccctctttccctcactgatttcctcccttccctcccccacccatccctccataggtctgcgcgtgaaggagttgaccggggacatgcagctgagcaggaaggagatggcggagacccagatgatcgtgaccacgcccgagaagtgggatgtgatcacgaggaaaggcggcgaggtgagcgtggccgccacggtgcgcctgctcatcatcgacgaggtgcacctgctgaatgacgagcgcggccccgtgatcgagacgctggtggcacggaccactcgtcaggtggaggccacccagtccatgatccgcgtggtggggctgtcggccaccctgcccaactatcaggacgtcgccgccttcctgggcgtcaaccttcagaccggtgtggtggtggtggtggtggtggtggtgatggtgtggggggcgcaggccgggggaagggcacgaggattggtggtggaatcaccagagggggggactcggcatggtggtggggtgtgtggcgaggtggcaggacctgccagccgcctttctcatacnnnnnnnnnntatgcggtggtgtggggggcgcaggccgggtgaagggcacgaggattggtggtgggatcaccagagtgggggactcggcatggtggtggggcgtgcggccaggcggcaggacctgccagccgcctttctcatacccctcctttcctgatctcagccgcgcaacacacacacccctcccttccccctgaccccccccaaaccccgaccccctcgccaggcctgttctactttgatgcctcgtaccgccccgttccgctggagatgcagttcatcggcatctcggagaagaactttggtgcgcgcacgaccatcatggacgacgtgacctaccagaaggtggccgactcgctgaagcgcggcttccaggccatggtctttgtgcattctcgcaaggacacggggaagacggcgcggtccctggccctgcgggcgcagcaggggggcgacctggacctgtttgactgcagcggggaggagacgcacgccctgtatgcccgggaagtccagaagtcgcggaaccgcgagcttgccgaagtcttcgaagcaggtgggttgggtcgagtggatgggagggtaacggggcgtgtgaggtgttttatttgtgatgagagacgcattggtttgcggcggctcggccagatcacgtgatcgcgcctcacctccctcctcccaaaaggcatcggcatccaccacgccggcatgctgcgctccgaccgcacgctggtggagcgcatgtttggcgccggcatcatcaaggtgctctgctgcacagccaccctggcctggggtgtcaacctccccgcccacaccgtcatcatcaagggcacccagctgtataacccggccaagggcggcttcaccgacttgggtgagcaagggtcgagcgagatttcaggaggggcgggtgggtgggaggaggggaagcggcaagaggcacatggcaaagagcgggcgggcagccatctgcagctttctgtgagggcccggcatgctgtgcgaggtcgtgccctcacccaaccacctgcaccgccgcttcctggctgaacatgtcgcgctctgtctgcgcacaggcatgctggacgtccagcagatctttgggcgggcggggaggccccagttccaggactccggggaggtgagccgtgcgggggtcctggaatgggacgggcagcaccttggcgaaagcggtgacatgttgagccaggtcagcatcctgccagatgagaaggcaagcgatgcgctcttaaaaccatcccgagccccaacactgccgcagggcatcatcatcaccacacacgacaagctggggcactacctgggcatgctgactcagcagacgcccatcgagtcgcagtttgtcatcgggctcgtggatcacctgaacgccgagctcgtgctggggacggtgagagaagggggaaggatgccagttgcaagggtccaggaatgagggatgagcagtcccactttcgtgggttttgagcgtgggcatgccctcagcacagcttgacatggccctgctgctctgcgtctattcatggcctacgggttggcggagacttgcggctgccgcactgcgttttccatcccctttccctgttccttcattgcacctctactccatccaaccccctgtcccttccacgaaattctcccctggccaggtcaccaacgtgcgcgaggccatccgctggctgtcctacacctacctgtacacccgcatgcgcaagaaccccnnnnnnnnnnctggcggagacttgcggctgccgcactgcgtctcccatcccctttcccttttccttcattgcacctctactccatccaaccccctgccccctccacgagattctcccttgccaggtcaccaacgtacgcgaggccatccgctggctgtcctacacatacctgtacacccgcatgcgcaagaaccccctgccctacggcgtgtcgtgggaggagctgatggccgacccgaccctggaggccgcgcggcggcgcctggtgggggaggccgcgcgggagctgcagcgctgccgcatggcgcgctacgatgaagccggcgggaacctgcacgtcaccgacctggggcgggtggcctcacactactacatcgccgcctcctccatcgaggtattcaacgagcgcctgcgcgcccgcctgggcgaggccgacgtgctggctatgatggcacgcagcaaaggtgggttgggttggctgtgcttggtggttggaggggtggagggtggtgggaggcgcgggcagcgttgcctggcaatggaataccaggggagggaagttgaggggcatgggaacaggcaccctggcgaggagggcaggcgcagtgcaggggtcctctcctctgccttccatgtgtggcatggtcctgctggaatattgtaccaaaccagccacccactgcacaccccgtaccttgcccttcacacaccatcactgcatctttagtttcacctgatgacctatactccctgccagagtttgacaatctgacggtgcgtgaagacgagggcgtggagctggacaccctggcccgctctgcctgtgtgtatgacatccagggcggcgcagacaccaagcctggcaaggcaaacatcctcctccaggtgatcgtgcatggttggttttataagggtagtagtcgggtgtctgggcccagtggtctgtcgatgccatgatgtcggtgccaggaagggagaagggtgctacccataacactgcaccaagcggatgaacgtcagtgcggcttggggcttgtctggatgccctcttcaactcccctcgtcaacgattccaccgcccacaggcatacatcgcacgggcgaggatcgacagcttcagcctgacggccgacatgaactacgtctcgcagaatgcgggccgcatcgcccgtgccctgtttgagatctgcctgcgccgaggatggtctggcgcggcggaggtctgcctcaccatgtgcaaggtaggtgggtagagggccacacttgccggcatggggaagagtgggagggtccaagcatggcagctgagaggcagggcctgactgttnnnnnnnnnngcacttgttggcatggggaagagtgggagggtccaaagatggcagctgagaggcagggcctgactgtttgttctccttgagaggatgcagatgcctgtggagcagcacggcggccgcaatcaccagccgcgtgccagccacccaatcaccctggctnnnnnnnnnngagggtgccacccataacactgcaccaagcggatgaacctcagtgcggcttggggctcgtctggatgtcctcttcaactcccctcgtcaacgattccannnnnnnnnncatgcctgtggagcagcggcgcggccgcaatcaccaaccgcgtgccagccacccaatcaccctggctcgtgcagtgctttgagaggaagctgtggccggacgcccaccctctgtggcagtacgagtcctccctgcgcttcgagctcatacagaaagtggaggacaggaacctgagcatggagcgcctcgcggtgggtgccgggaggactgcgcgctggaacgtggggatgttcttgtctggggctcgttctggcaacagcccgcagcaacatggagcagcgcttttccgcagcttcatctccaaccttttcacaccagaggatagaaacctctgccccacctcccaccaccctcacacccccgaccctgccgcaggagatgacggcgcaggagattggtgacctgctgcaccacccggcggccgggccgcagctggcagacgcggccgcctccttcccggccctgctcctggaggcccacccccaccccatcacgcgcaccgtgctgcagctggtgctgcgcatcacccccgcctttgagtggaaggagcgcgtgcacggcggctctctcaagtggcacatctgggtggaagacgccaacagcgaaaacatctaccactctggtgggcgatggaggttgcggggggggggagatgacgatgccccatattgccgacttggtaagggctgtgagcaatggcaggggnnnnnnnnnncggggggggaaatgacgatgccccacattgccgccttggtaagggctgtgagcaatggcaggggcacagcttgccacccacccctgctcggtccccacctccaccacctgccccacgaaccagagcaatggatgctgcagcggcacacagccagggccgggccccagaagctggagtttgtggtgcccatcttcgagccgctaccggagcaggtagggcctgaggtttgtcagccaggatgatccattgggggagacaaactgtggcagcaccccacttgccccctgccactcatgacctccccctaatccccccctctccccctccctcaatgcccgcacagtactttgtgcgcgtggtgtcggacgagtggctgggcgcgcaattcctcctccccgtcccgctgcgccacctaaccctgccacagcgccagggcggccacaccggtgaggcagtggcatgcattctgtaggagccgggcacgccttgaggcaatggaaccgtgtactccaaccctggtatagaatctatcgaagaataggtcatgagttcccagccgttccttctacccttctgggccccgacagacctcctggatctcacaccgctgcccacaacggctctgggaaacccggcctctgcctctctcttcccctttacacacttcaaccccgtccagacccaggtgggtgcggtttaacctttcaccagagggtcatcacccaagctttcagacctggaatactgtcgctcctgttcttactggctccgccagcccctcaaccatcnnnnnnnnnncacctttcaccagagggtcaccacccatgctttcagacctggaaatcctgtcggtcctgtccttactggctccgccagcccctcaaccatccgcatgctacattcctcacagattttccacgctgcattccattccaatgccaacttgctcgtcggggcccccactgggtctggcaaaaccgtgattgctgagctagccattttacgcctctggaagctctctcccgccagcaaggtgtgatggggggagagacgagggctaggaggatgcatgctctccatcccgtcctcttgcagtgtttcgcccagggacaacatgtgcgagccctgtcaacaacactccgtcgcgccaggtgctcttcatagctcccaaggaggtgattgtccaggagcagcagaggagctggtcctcaggattctgcaagacgctgcggcgcgcccttcttcgcctcagggaggaggtcgcagatgacgaggtgcgagggggaacatgaaggatgggtagtgtggtgccaagagctgcatagtgtaagtggaacgctgtgggccttggatcactctgtagagccgcaggtgcagtgctgacctgccccactaaactcccgtctgcgcgcgcaggctgccatcagcaaggcatctaccttcctctgcaccccaggggaatgggcggcactctccagtgctgggcacggcaatgctctcatgcagatggtgagacaaaggccttgtggcctctcaagcactgcaacacccagggagttgcggtagccnnnnnnnnnntcttcctctgcaccccagaggaatgggcggcactctccagtgctgggcatggcaatgctctcatgcagatggtgagaaaaaggccttgcggcctctcaaacactgcaacacccagggagttgcggtagccaggggtcaacagcgtggatgccatgtatccaacgaggtcatcttcctaacagccgctcctcgcattttgcccttcctgctctccccccaggtcggactggtcatcgtcgacgaggtgcacctgctgggagccgaggaggggcacaccctggaggtcgtcgtttcctcactccgccgcacggcccccacctcactgcggttcctgggtctggccactgccctggcgaacgctggagatctggcggcctggctgggcgtagcgccagaggtagagggatgtggaatgggcaaggtgcttgggagatgcgtgggtctaacaatgcaaagtgccagaccaggcctgtgaccaacgcaatggagagggctgcacagcgtgggacgctgcagccagttgccgaggtgcttcatactgatggggcccctgctctgcattacttgtccagctataacggacaacccataccccctcttctgccacacccaatcgcagggcctgtttgcattcatgccctctgccaggccggtcccgctggagtgccacatgcaggggtaccccagccggttctacagcccgcgcatggcttccatgaacaggccggcctatgtggccatccagacgcatgcacagagcagaccggtgcgtgtggttttttggcctgcaggcacagggagtggggcctgggctgaagggcagggtgacccgccgtggtaagggatacggtgatgttgcatccagggagcgccgaccaaccgagcactctcccggcaacccaggccattgtgtttgtgtcttcgaggcgccagactcgcgccacggcgatggacatcatcagccacgcggtggcagacgacaagccccgcgctttcctgcacatgacggaggcggaggtggaagacacgctgtactcagtgcgggtgggtggagagttgtggaggggtagacaaagggcaagggcttgttgagcagcagttgcccctgctcaatactaggaggatagttttacccctacacacagcaggccgtaggtgtgatcaatcaggaggaagggccctcaagctcagatggagctcccatgccatcaccgtgcaggatcctgtgctggcgcactgcctccagtttggcataggcctgctgcatgccggtcttgcgctgccagaccagaggctggtggcaaggctgcacacagagggcaagatccaggcaagcggctgagattgcggcgaggcaacaatcgttaggattgcttggcttgttgtcgtggaggtgtgctaatccaagaaaataatgnnnnnnnnnngcggcgaggcaacaatcgttaagattgcctagcttgttgtagtggaggtgtgctaatccaagaaaataatgcttcccgctgtggtgtcaaattgtcttacccggaatttgagccattccagggggaacaagctccctacctctgaataacatcccacaggtnnnnnnnnnnggttgtcttacccggaatttgaaccattccagggggaacaatctccctacctctgaataacatcccacaggtcctgatcaccacccctgcaatggcgtgggcggccctgcccccagcccacctggtcatcatcaagggcacggagctcagcgatcccgtgacggggtaaggcgggatggagtatacttcattgctgagtggatcaacatgcttccagagccacccgattccacccagcctttcccaaccatatgctgctgccctttaaagttgcccacaacctcctgctcaggcggtacgtcgactaccctctcacggacatcctccagatgctgggcagagccggacagcttggcacagacacacaggggatagctgtcgtcatggtaggcaggtcgagaagctccatttgctggccactcggatctgcctcgagcccgagattcctgtgtggcatggagcatttgtgactcatcagagcttgatatactcctaggcgtttaggtggttgtgcacgcaacagcttgtggtctcacctgcgtcagccttccagtgttactctcttcctttccctaccagtctcacaatccacccgcacaaaaccttcctcaggtgtacgatcccaagaagtcctactataaaaagtgcttgtatgagcccttgcccgtggagtcctgcctccagcagcatctggcttcctacctcctggccgaggtggcatcaggtatgggactgggagaatgacgagtggtttgcattgaggaaacgatatcggaattcagcctgaccacagtgcatgccatgccatgcttgttgcccctctcagcccatgtacaagaacgccatgcttcaacccacctcgacaggggcaatacagggctgccaggacgnnnnnnnnnngccacagtgcatgccacgccatgcttgttgcccctcacagcccgtgtacaagaacgccatgcttcaacccaccgcgacaggggcaatacagggctgccaggacgcaatcgattggctgtcctggaccttcctcgcgcggcgcctgctgcaaaacccctcctactacgacctgcggggcaccgaccaggcccaggtggaccgcttcctttcctccctggtcgaacgcgcggcgcaggaactcagggaggcggggctggtggcggcgcggggccgcgggggcatccagcgcctgccgccggcggggccctgcgcccggcacggcctcctgccgcgtggcatcccacggctgctccaggccctgcccagcgcgcgcagcgtggaggacgtgctcgccatcgtgagtggcgcagcggagttcgacgccctgcccgtgcgcttcaacgaggacaagctcaacctgcagcttgccaaggcggtgcgctggccaccgaggggtgcacgcatgggtgagctgggggggtgggagagcgagtgatagcatgcaggggtgaggtgtgcagggagggaagtcatgggcggtgatgtgcatgagaggtacaggcagcccgatcggcacctccctgaatggatgcggccccaatgcagcatcctgcatgtgctcgaatcccannnnnnnnnnggtcatgggcggtgatgtgcatgagaggcacaggcagcccggtgggcacctccctgaatggatgcggccccgatgcagcatcctgcatgtgctcgaatcccaccccctacctcgccaccctgcccacgcagacgatccacacaccaaggccggcctgctgctgcaggccggcctcgagggggtggccatgcccatcagcgactacaatgccgacaaaagggtggtgttggacaccgctgctcgcctcctccaggttggctggttgagtggtcaacccatccctggctcaggtctttactccactccattgccgcagcctgacgtatgcatggcctcgcaatattgcgcaggccatgggggagctgctgagtctgcaagggggccaagtgctggacgccacgctttcctgcgccctcctcggccagtgcctggctgaggggcggtggcatgaccagggcaaggggccgtctgctttgcctgcagatgtgctgcgtggtcgcacatccgaggcagccactcggcgccaggagaacggccatgcgccccgcggaggcagagggtccggcaaagccccggcagctccccttgccgtggtcgtcgaggccgagtgggcgacgcgcggggccgacgaagggagtcccactgcgtgccgcaccatctccatcagcatctcgacacgccaccccgagggagaggttgcattgagcaccgggcaggtgggcagctccacaggtcccaaggtgcgtccctggtgtcgtacacaggccatattatcatcgacaaagacgaccactgcgcccgctgacagtcacagccctgatttccgaccctcgtcatccaggcacactggctggtgatcgtcggcgnnnnnnnnnnacgtccctggtgtcgtacacaggccatgttatcattcacaaatacgaccactgcgtccgctcgcagtcacagccctgatttccgaccctcgtcgtccaggcacactggctggtgatcgtcggcgacctcgagtccaggaccgtgcatggcatgcagagcgtgggaatgggtgctaggcaatccagcacgactgtgcagtgagtggtggcagccctgggggcctggcgcttgattctggccaccagtgctgggctagcactatgttcgcttcaagggagtctggaatcaccacgggcaaggcagtggcaggcatggctgaagtccagaatccccgtacgcgacaattacccatgcaggcttgccgtcccaagtcagcaccagcaggtcgacgtgtttgtgctcaacagagaccgcctgggacaacagctgcatctccagtgctgaagactcaccaagcatcacacgaagaaattctgctgctgagcgccagacacaaatgtcgcgacggcaggggacgcatgaccaaccggagatcagggtcggagcgcatgaaattctgtaccatgcccggactatgccttcttggagcccttgacgtctatgtacttggctgggatgccatggtgtgcagtgaaccaaaccgccaccttggcaccaaggtccccctgcattgtgatctccatgtcgtgctcctgctttcctggcagttctcccacactgccagagtcggtgtggggcatgtgaccagaaaggccagaaaatcacccagcaacacctcgaccagagtttgcagtacttccagacctctcccacaagcgcactacatggtgccggccccccattcctgtataccctgcgcacccacacacctgcatgaggaggagaaggccttctggaagtccttggcaaggtcatcgggcacaaatccaaagctctccatgtggctgatggtggtgatggggtgcccacgcttcttccccgctgcaattgtaatggggggaaggacacccttcctcacggtgctcaccgggccctgtggggtgggacagaaggtgacatttggggtacacttacggtggcaagcacggctgcatgctccaagcactattgttgggccccatagcacggccccacttgccacccagaattcttctgtctcagtggcgtgggccagcagtcggccgccgatggtgcagaccctttcccctcatttccctcacctggggtgtttgccgggtcaagnnnnnnnnnngggcgtgcgccagcagtcggccaccaatggtgcagtccctttcccctcatgtccctcacctggggtgtttgccgggtcaagcggtggtgcagctgcagcttgtccgtcagcttggccaccagggcccgctccggaatcgcgctgcccacggacacctcttccttctttccaaagagcgctgagcgcaggagggcgtccagcgcgatggttccccccgcgccccagatccctgtcgggacacaagggagccaaggggtgtgatgtgaggcgccgcaaccaggcacgcctgcctgttccacaagaccccaaccagcacccctgccgagcccagtcatacgctgctgctgcgcgtagctggagagcgcggcgnnnnnnnnnncgagcgcaggagggcgtccagcgcaatgattccccccgtgccccagagccctgtcaggacgcagggagccaaggggttgtgatgtgaggcgctggaaccaggcatgcctgcctgttccacaagatcccaacaagcacccctgccgagcccagtcatacgttgctgctgcgcgtagctggagagcgcggcggcgacttccgccgcgtcgtacagccgatccttgtcggcggcggcctccgggccgaacagcgggcgcagcgtggctggcgcccggtagcatggggtgatgaccaggccggccgaggtggagggcccagcgggggcctgggcgggcgccaaggcgctggagggtgccgtggcgggcgcggccgccggggtgaagccggcgagctgcgggtgattccggtccacggcggagatggtgtcctgcttcctcaccaccttctgcgtgatcaccttgtccttggaaaacttgtccagcagcttggacagcttcttgtacttgctctgcttcaggtcaaaggtcacgcctaggagagtttgggggaaaaagagggggtagtgaagggttcaagctggctcaggccccccttggggaagctcatgtccctgccaattcctcgcccacgttgatgtcatcaagttctccacctgccgggcttcgaacccggcacaggcctacccacggacctctctcggtccagagttgccaccatgctaggctccctcccatagtccctccccttcaatccaccccacaatccacctggcggccggtgnnnnnnnnnnagggaagctcattcccctgccaattcctcgcccacgttgatatcttcaagttctccatctgccgggcttcgaacccggcacaggcctacccacggacctctcccggtccagagttggccaccatgccaggctccctcccataatccctccccttcactccaccccacaatccacctggcggccggtgtgccagcatgtgcttggagtaaaagtcggaaaactggatgggcagctcgatggccttcagggtctgcagaccacccagaacggcctgctccagcatctcatctaggccgagggcaccgtttggcggtggtgctgagctctcctcagccacgctcagggattcgatactgggaacggcttcctcagtctgatctggggagtcaggctccgcatcatcagacggggagtcgacgctggattttgctcgaggggaggcctcgtcctctggcccagcctgagcggtatgagagaaagcgcatttaagtttgccaggtgggttctcctgattttgttagaatctaaaagtgaacacagacagcctgtatgtggtgacggcatcaatctttggagcacaccagtgttgctcccacgatgcagctcaaagcagctggactaacattgtagacctgatgtgctgcagcagctattgaactccatcctcagcgagtgccaacacccactccccttccctcccctttccaaatcctgcagcctacctggtcaggcaagggatggatgcgggagggcgtgaatcccgcgttgggtgccgcgccgctgcccagctgccagagcaggtccccgaaggaatggagaatggtgagccccctccccttcatccccgcctgctgtgcctctgtcctgctcaccgccatcgtccccaccgcaaaggggatggggtttcccggcacgcaaagggctctcacgctgcccgccaggaaagcggggatgggctggtcggtggggaggatgaggccctggaggaagaggtcagccccgcccaggaccttgtcagacacgggggagtaggtgtacaacttctcgagcatgtctggaaacctcgccagcgtgtagacctgcatttgggaatgggtttcagtgaggagggggggcgcgatagccactggtttcatggtggggcctcaagggatgctggacgttgcatcgcagggtactaaatgtctgtactgcatgattcatagattcatcagatagcctgcatgcccccacacaccgtggggaagaggcgatcgccnnnnnnnnnnggttgggggcgggacagccactggttccatgatggggcctcaagggatgctagacgttgcatcgcagggtactaactgtctgtactgcatgattcatagatgcatcagatagcctgcatgctcccacacaccgtggggaagaggcgatcgccatggcctgtggggtcgaagaagagggggtcacccccctcactgccgtacacgagcgacctgttgttgagcttgctcagggtgatgcgtgtcttagaggagaacagatccgaaagctggtcttcgctgagagaggggcatgatttctttgctgcagccttcaggctcttgttgtctttgccaccaagcagcgacgtctggctcacggtgatatttttcttgaacatcgcggcgcccgagggtgttgctgtttgctctaagtctagcgttactccaacttgatcgtgtatacatggcgcaaccatgcaagttgtttcgcgattggctgccccgtgatgtacttgcgcgcccgatgacggatgacgtggagccgagcacttccttgaagtcttggatgtggcctgatgatcagagtcaggcggccgtactattggagattgattctnnnnnnnnnnagagcacttccttgaagtcttggaggtggcctgatgatcagaaccaggcggccgtactattggagattgattctnnnnnnnnnntgagctccttggagtctcggagcaattagttctgatattaagcacagattatacacccatatagtnnnnnnnnnnaaagtttggtcgaagaaaatcgcagctgcagtttttgtcacaaagcattgaatcgctgcacgcaacgagtctcgccgtggacgtgccccttgaccgtggtgcatgtgagaccctctcgatgagaaaatgacctccttggagtctcggagcatttggttctggtattaagcacagattatacacccatatagtatccagactgcacagcatggggttgcccgtcgtgggcgatgaccaagatcttgtccggagccggaccccctgcgaggccattatcgcgaggcttgagagctcgataggtagctaggctgtatgtgcacgccctgtggcacatggatacttgaaatacattagaataagtctattcactccccatcgtccacagctgacttcaatgtcgagaggcagacgctgctatcccagatcgcagcgtgtgcccggggcctccaacccgtccatgcccttcgccgacagctcctgaccgtcaccgcccaagccaatgatctccaacaggtgatctggagaagaattttgcatctatgagaatgtgttcaggaagtaacatgcatgtgtacaaggtaagtgtggagcaagggtggggtcaagtgccgatcttagggtccaagctccagagcacccccacgccacggcaggctctcaccaaggccaaccgnnnnnnnnnntatgtgtgcaaggtaagtgtggagcgagggtggggtgaagtgccgatctcagggtccaagctccagagcacccccttgccacggcaggctctcaccaaggccaaccgggacctggccaccgagaggcagcatgcgttgatccaggcaaacgagatggacaagtgcacatcgcccacccaccgccttgccaaggagacaagggtgactgtgcgaatgaatcacgcactgcccagtgcttggaccatatctgcagatggggagaataatccccagcaggccaccgatcgtgaggcggcagcctcgtgcggtcgcagtgataccgatagcaggtctcagggccatgaaaagcacattgcgaatcagctccaggagctgaaggctctggtgcagcagatggaggggacagagaaggcgctgtgccaggccacccgatcctgtatccaaggtcagtaggtggagtgtttgccagagtacgaccttggagattcacatgtcgaggggtgcaccctgggattggccactgcggggggtgcctggccgcacaccgagatgatttgcgggcccatcgtgtcctcgcctcgcagcccagcaagcccgggatgcagccagcctccaagccgcggagctttcctcgcgactccagcgtgaggaagagaggcaccaaaaggcgcagagggagtacgagcacgagatggctgccctcagagcggccctcttcaagcaaaacacagagcatgagcaggtgcctgcggggtggcctccctgggactgggggctggtcgttccctctgtggatggcgggcggggaggctgggttttggcccgatgcttcctaatccttgatacaaaagccgtgacacacggcctgcatgcccacacttgcaggccctgctggacgccaccaggtcgcatgctgctgacctggcggctcaggcacggcgcggcgagcaggcctccagatccctggaggcggcgctcggggaggcgcggcgccgcaacgcggccctggaggaggagttggctgtgttgaagcagcggcgcgctgccgatgtcgaggtggagtgcgggtttggggattgggggggggggaaatggggcacgggattgcgctgccgtgctgcactgagtgggtagggttggatttgctggccagggacgannnnnnnnnnagatggcgggcggggaggctggattttggcccgatgcttcccaacccttggtacaaaagccgtgacacacggcctgcatgcccacgcttgcaggccctgctggacgccgccaggtcgaatgctgctgacctggcggcccaggcacggcgcggcgggcaggcctccagatccctggaggcggcgctnnnnnnnnnncgtcgaggtggagtgcgggtttgaggattggggggtggggagatggggcgcgggattgcgctgccgtgctgcactgagtaggtagggttggatttgctggccagggacgaggcaatggccctgccgtgccgagctgccctttccctgtgaaccatatatccccatcttccccccgaccgccacccggctcagggctggacccacgacatcacggcccaccgcaaacgcctggccgcgctggagggcgcgctgcggcaggccagcgtgctggagcgcatggcggatgacgagcggagggatgccgtgctcgccaagcacgacaggcgggcgggcttgggatggggggccccctggggatggggtcggtcgggctgcggggattgggagagggcgcctgggtgggcatgcaggtcttgggtgcaatactcttggtgtttacatatccctcgcagcacaccccccatccctaccctctaccctcaagcaggctggtgaggcagcagcacgcggcggcttctgggcggcgccgcccggccaggtccacgcaggaggcccacgccatccgtgccggcctgctccagatggcggaggacctgcaggccaggctgtcccgcatgcggagtggggagacatgagttatacatgcttaagaggacctcttctggacctgctggagccatgtgcaagtgggaaagggcgccatgtctcacgctgccccccgctgctcttcctgcctgggttaccgctcgctgctcgattggctgatgtaagggtgttcccgtgtaagacggcgcccccgacagccgggcaggcaggcaaagacagcacagagggggatcagcatgccaggctacgcttcagcgggggcattggaggaaaggccccctgcctcgtcgggggcccgtggccggcgctgggcgggccgcggtcgaccctggccgcccctcctcccgcgcgctccagcaccgtctgggtcccgtgctggaccccgcctgcagtccgccgcgcgcccacccgccgcctcctcgccgtcgcggcgcggtacgccggcgcgcaatcgccgcgcctgggccnnnnnnnnnngcgcgcgcccacccgccgcctcctcgccgttgcggcgtggcacgccggcgcgcaatcgccgcgcctgggcc

SEQ ID NO: 45895 - DNA, 30787 bp, Chlorella protothecoides
  modified_base (713)..(722): a, c, t, g, unknown or other
  modified_base (943)..(952): a, c, t, g, unknown or other
  modified_base (1206)..(1457): a, c, t, g, unknown or other
  modified_base (1513)..(1522): a, c, t, g, unknown or other
  modified_base (4853)..(4862): a, c, t, g, unknown or other
  modified_base (6063)..(6072): a, c, t, g, unknown or other
  modified_base (6150)..(6396): a, c, t, g, unknown or other
  modified_base (6542)..(6790): a, c, t, g, unknown or other
  modified_base (6885)..(6894): a, c, t, g, unknown or other
  modified_base (7131)..(7140): a, c, t, g, unknown or other
  modified_base (8399)..(8408): a, c, t, g, unknown or other
  modified_base (8627)..(8636): a, c, t, g, unknown or other
  modified_base (8991)..(9000): a, c, t, g, unknown or other
  modified_base (9098)..(9107): a, c, t, g, unknown or other
  modified_base (9286)..(9295): a, c, t, g, unknown or other
  modified_base (10662)..(10671): a, c, t, g, unknown or other
  modified_base (10901)..(11002): a, c, t, g, unknown or other
  modified_base (11518)..(11702): a, c, t, g, unknown or other
  modified_base (11760)..(11769): a, c, t, g, unknown or other
  modified_base (12324)..(12333): a, c, t, g, unknown or other
  modified_base (12895)..(12961): a, c, t, g, unknown or other
  modified_base (13132)..(13141): a, c, t, g, unknown or other
  modified_base (15419)..(15428): a, c, t, g, unknown or other
  modified_base (15770)..(15779): a, c, t, g, unknown or other
  modified_base (16232)..(16241): a, c, t, g, unknown or other
  modified_base (16617)..(16675): a, c, t, g, unknown or other
  modified_base (16801)..(16810): a, c, t, g, unknown or other
  modified_base (17659)..(17668): a, c, t, g, unknown or other
  modified_base (18153)..(18162): a, c, t, g, unknown or other
  modified_base (19235)..(19244): a, c, t, g, unknown or other
  modified_base (19656)..(19665): a, c, t, g, unknown or other
  modified_base (20385)..(20394): a, c, t, g, unknown or other
  modified_base (20991)..(21000): a, c, t, g, unknown or other
  modified_base (21220)..(21229): a, c, t, g, unknown or other
  modified_base (22615)..(22624): a, c, t, g, unknown or other
  modified_base (23585)..(23594): a, c, t, g, unknown or other
  modified_base (25619)..(25628): a, c, t, g, unknown or other
  modified_base (26021)..(26030): a, c, t, g, unknown or other
  modified_base (27027)..(27036): a, c, t, g, unknown or other
  modified_base (27903)..(27912): a, c, t, g, unknown or other
  modified_base (29011)..(29020): a, c, t, g, unknown or other
ccccccccacacctataacccaggctacgcggccgacggctacgcgcgtgccactggcgtcggcgcggtggtggtcacctacaccgtgggcgggctgtcggtgatcaatgctgtggcaggggcctacgcggagaacctgccggtcatatgcatcacaggcgcccccaactccaatgacatctacagcaaccacctggtgcaccacaccatcgcacgcaaggggtccatggagcaggagctgcactgcatgcgccaggtgacctgcgaccaggtcatcatcagccagctgtccgacgcccacgagcagatcgaccacgccatctccgccgcgctgcacaactccaagcccgtctacatcgcggtctgcgccaacctggcggccctgcaccacccctccttcgacgcctcgcccgtcccctacagcatcacgcccaagcgcagcaaccctgccagcctggagcaggcggtgcgctgcgccgccgccttcctggccggcaagcagaagccggtggcggtggggggcgggctcctgcgcctggctggcgcagaggaggagtttgtgcgcctggtggaggccgcgcagtacccctttgccgtcatggcggccgggaaggggcttgtgccggaggaccacccgcagtggatgggcacctactgggggcaggtgtgcggaggtggaaaggggaggcagggattgagatttgtggcagggnnnnnnnnnntgcaaggcgcatgtgggaacctgggtgtggggggaacctcgcagggcttgcagctcagtgtgcatgcggtggggaggtcgctgcgggttcactctcatgcgcgtgcataaccagccctgctgtggcgtcggagtgacaactcatcaataacctgctcctggcctttcgcatgctaaagatcagcagcccattcgtcgcggaggtggtggagagcgcagatnnnnnnnnnngctcatgcgcgtgcatgaccagccgtgctgtggcgtcggagtgacagctcatcaataacctggtcctggcctttcgcatgctgaagatcagcagcccgttcgtcgcggaggtggtggagagcgcagatgccgccctctttgtcggtgagactggaggagcctgtgactgagagggcagtgtgtgcgtgcaacaggtcgtattagggacgacggcaggcccccgctgaacggcacctgtgcacctgcctgcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgaacaaattcataaactcctcctgcaccgcaggtctttggctgtgtccggatnnnnnnnnnngatgtgtgcgtgcaacagggcgtactatggacgatggcagccacccccctgaacggcacctgtgcacctgcctgcagccatgctgtgcttctccaagagtaccacctcactgaacctcccatgcatcctgaaccctccctgaacaggtgcacagttcaacgactatgccacggcagggaactcgctcaacctgcagcagtcacgcatgatcaaggtggagccctatcgcgtagtgattgcaggaggaaaaggagggcaggtcagtggaggagcgtgcatgggattatgggggtggcaggtcagatggctgtggaacatgggtgagtgccgtgggtgtgcctcatcagttccttgattcttgcccatgctggactcttgaacaaaatcacaaactcctcgtgcaccgcaggtctttggctgtgtccggatggacgacttcctgtgtggacttgcggaggcaatcacgcccaatgacaccgcccatcagatcttcaaacgcctctgggtgcccacgcccgtcgtagagcccagcgaggagggctcccccctgcgcaccaaggtcatttgcgcatgagtgggcactgtgattcttagtatgggtccatcagtttgaaggagatttataaaaccatgatgattacacggagtgagtttgtctagataccaggtcccaagtctctacctcactcaccatccaaacctcccgcagcatctctttgcccatgtgcaaacgctgcttgatgacaagactatccttatcgccgagactggggactcgatcttcaattgccagaaactcaaactgccacggggctgcacgtgagatggccattgggtgggagctggcagtccctgtatgcctcgagtacctaacagcacgagtgctgcagcgcttggagatccctggatgccaaataccaatcctcgctgaattctctcacacagcatgtgcacgggtgaggactaataatcgcatgcaacccacatcattctcaacatccacatccacatgccaggtacgaatggtcgcagcaatacgggagtattggctggagcgtcggtgctgtgctgggcgccgccattggaggcaagtcctggggatccagtcgcatgtcgtgtcccccaactcgctccctgccatcaaagatctgccaagcaatgcgcagccttcctttttcctcacctgcattggcgctacttggtcgcaggccagaaggatgggcggcgcgtggtggcgtgcatcggggatggcagcttccaggtgactgcccaggatgtgtccaccatgatgcggtacggacagaatcccatcatcatcctcgtcaacaacggtggctacacgattgaggtgcgagtggaggttggagttgcctgtgtggctcgacaggctgggcagccatgcacgtgctggcctcgaccagcagcggcgaaggtcacactcctcccacactgtcgagcacaggtggaaatccacgatggacccgctgacaacaactacaacatcatcaagaactggtgggttgtgatgttggcaggagtcccagaccctcggggtttggtgcagggtctaatgcccaattgtacactgagtttcccaaccgttctcaatcctgttcgcgctgcttccttggtacagggactatgtggcccttttcaaagccatgcagaacaaggagggccagctttttgccaccagggtgagctctttaaacgaggcatatgtctcagtgacagttaggacagttcatgcatgactgcctatgggtgccatgtttcgtcacgggggctgaccgtcatcactcctccatgtacctggcaggcgaagaccgagaaggacctggaggatgccatcgaatttgcgaagaacgaggctgctgattcgctgtgcctcatcgagtgcattgtgcacaggtgtgacaactggagtgggtgcatcgaccctgctctgggtagatcaggaggcgaatatctgtcaggtcaaggtgttgcggctgtcttgttgcatgttcaattctcaccaactaatccttggctttgcagggatgactgcagcagcgagttgctggagtgggggggcagggtggcagcggccaacagccgccctccacagtctgattgattgtgcgcaatctcagaatgacccggctgacaggacattccagaagccctgaccatgtgtgatctgccatggtggcacgcgatcagcttgctacatatgtacattgcaaggatggacgtgtatagtacatgcattctgcgcaggagcacaggcgtcagagacattggggcagggggctggcggggtcaatggagcaagtgtcgtgagtgctgtaagtaagtcgagaggcaaggatcactaggcggatgggtgtgcgtttctagggtgatggaggctacgacgcgcgagcggaggctctgggggctgaaacatgcagagggtggtacaggggggccgctgaaggtctgaactggacgtggcaagagggtgagcgcgcacagggggaatctccgttgcagccctcgtcttgggaagcggtgaatgctgaatactggctggcgcatgggctgagtgcagctgaaaacaagtcacagaggcccatcccggccctcagcagccgcccttccacggtcgcgacagggcggcgggccccgcctgcagcccggcccgggccccacacagcgctccgtgccgcggcgccagggtcagccccgccaggtccagctcctccccgtgctgactcagagcgagctgggagacctggtgcagcgtgaggtcgcgcgtgacgtccaggcgcacgctgcgcccgctgcgcgtggtcaggtgcaacgtcaccggcgcgtcggcggcggggtccaccagccccagagccaggcccaggcagtgcaggaggacggacagccaggcaatcgcggcccgcagcgcggcccaggccgccgcctcgccgggcgtctgcgcccggcgctcgcgcaggagcaggcgctggcggtcgggcggaatgccggcgcgcgcggccacgcttgcgcgcagcttggccaggctgtcatcgggggaggcgacgaaggccacccgcctgtcactcgccagctccacagtgacctgatttgtgtttttgtttttttggggggggggtagggcagggagcagcgacggagctagacgggggtgattaggttgtggaaagcaggagcatgctgcgggaggttccttcacgagacagatatcgcgtctcctgcgagtatcagtcccaccccctgccctgtctggctggttccctcacagcccagcccccccatccatacacacccacctttatggcgtcgctgcctgacnnnnnnnnnngcagcccttcccccatccataaacacccacctttatggcgtcgctgcctgacggctcccgcaggtggacgccgatgttctcctcggcccaggccagaaggccacggccccgcacctcgcgtgtcaggctctccggcagcaccagccagttgaaattgtccagcacggtccaggccaaccgccggcggtgcgcgagacggttggcagtggagcgcagcagctccttgaccccgggaggccctcgctcctctgcatcaattgtgaaaaggtaggtggctttggggttgaaaggcgaggaacgatgagccagtgcaatggtctataccctgcagccaaaggcagctgatggaaagaggtgaccaccacagtcctcctcaaatcaaggcaccacaccacaccttccacgaccaggctgaagcagtccggggtgctgccggcgaccttggccgcagctcccaagagggactccagcgagatgcctggggccatctccagccagctgtacccgccgccccgccgtctcacagccacatggatgggcgggggggtagggggctccggcgtggaccgtttcctgccaaacccggcggggaggagctgggaagcgcgctccatgacggcagtgtaggctgcagagccccggacccactccggagaagggggtggggtgggggaggactgctgcttcagctcccccgggaagctggaagtggggagaggcaccggccgggtggcaaggcagtccacgctcgaggacctcggcaggctcccatacctctgccccatggctcgcagtggtgaggctgtgatgggaatggcaactgggtgagcaggcgcggtgggttcccatgcgtgacccctcggtgccccgacacagtcgcgttgagcgccccgctccccagctcacatatgatggccagtaagtcactacggccactggtttcgatccttctccccatgccgccctcttcgtccatgctcgggggtggctggtccccactgggccagcacgggtgccagtaccaggtttgacgcggggccgctgggccgtgttcccgtcgcagtgggtgtcttgtaaatgtctcgaagactctttagagaacgcccgtcaagtgtgcaccgctcaatgccaggccgcggagttttacaagtcattacaaactcttccgccagggcgcgcccaggctcgcgtgggatgaacnnnnnnnnnntaatgccaggccgcggagttttacgagtcattacaaactcttccgtgagggcgcgcccaggctcgcgtgggatgaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtatccagtcactcctaggcatccctctctgcagcctccctccctcttcttttcacacaccccacccctcttttccccctgccaattaaagaaaaaaaactcccatcccccagaacccacctccgcaggcggccagactgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagtccacgcctcgcagcccgccgggcggcggcccggtgatcgtgatggtgtggggcgcccagtcgacgctcgcgcccatggcgcccagcaccnnnnnnnnnnacggagccgcacatcaccgagaaggcagacctggatgagcggtcggcaccacccccctcatcggaccgtcacaccctccaggacatcaaagtaggtgggaaaggtcttcctggtgcacccagggtccaggatggtgatgggttggcctgtagagggggtgtaggttggttggagattgtgagtataactcaaactggtaggggcatgcatgagccatcgcaggctcacccagggcannnnnnnnnnggagggggtgtaggtaggttcgagattgtgagtatacctcaaactggtaggggcaagcatgagccatcgcaggctcacccagggcatggctatttgcgccaggacccggggctggcacctcttgtatgcagtcacgcctagggatccctctccgcagcctccctccctctcctttttacacaccccaacccctctttcccccaccccacaataaaataaaaaacctccaatccccccaaaacccacctccgcaggcggccagactgaaggccatggccatgcggtggtcgtcgtaggtctcgatctccgcggcctgaaccccgcccaccggcggcgtgatcacgcaacttgtctccccctcctccacgcttgcccccagcttgccgagctccgcgcagatggccttcatgcgctccgtctccttcacccgccagctgcccacatcacggatggtggtggccccgtgcgcgaacagcgccgccaccgccagcgtcatggccgcgtcgggaatgtccacgcagcctgcgtccacgcctcgcagcccgccgggcggcggtccggtgatcgtgatggtgtggggcgcccattcgacgctcgcgcccatggcgcccagcacctcggcgaagcgcacgtcgccctgcaggctgtcggagccacagccgtggaccgtcaggcgcccgccggtgatggcggcacccgcgaggaagtacgatgctggcgtgtgtgtttgggggggaagaagttgaggttggtggggagggagagggtgggattgtgttatgggggggggccaaaggggcagaaagcggacgcctggtgccgggggtctggacattgcactgaacgacactcccagggttcccaatcctcttcaaacccccatccagaccacacgttcacacctgaggaggcgtcgccctccacaaacacggtgccgggggaggcgtagcgctggccggcggggatgtggaggtgctgcaggccctccaggcggtgcacggtcacgccaaagcgctccatcaggcgcagggtcatgtccacgtacggctggctgatcagctcgtcggcaatgcggatgtggatgccgccctcgccctccgccagtggcgcggccatcagcagcgcggtcaggtactggctgctcaccttgccggacaggaccaccttttgggaaagggcgaaagggggcaaaagggcggtgggggggtggtaatggagtaagtgctgaagaaatccgatgcagggatggaagaggcccnnnnnnnnnnggggaaagggcgaaagggggcaaaaggggggtgggggggggtggtaatggagtaagtgctggagaaatccgatgcagggatggaagaggcccccggcagatgctcaggatctggctccgcggtcgtgctcctggatgacagggcctccaagcgaccagtacaaccccatgtgacccacgtgatccaaacaccctccacgaccaacacaggcaggctccnnnnnnnnnntgcgacctgtacaaccccatgtgacccacgtgacccacccaccctccacgaccaacacaggcaggctccttgacatcaaagctgtaaaacctcgttatccgaccccaccacgcccacacacctctccagactgcaggccggtggcgtgcaggcgcacgggcgggcatttcgtgcccagcgtgcactctgcgtccacgcccagctggcgcaggccatccaccaggtcctggatgggccgctccctcatccggggcaccccgtccagcacaaacgtgccccgccccgccgccgccagtgccgccgtcagcggtctggcgggcaggggggaaagggggggggggggggcgctcgctgnnnnnnnnnngctgcatgtggactcaggagccctgctcggcgggctggggtccaactgaaagcgacccctccagctacctatcgatggcgccagccaggctcaggagnnnnnnnnnngcgctcgctgcatgtggactcacgagccctgctcggcgggctggggtccaactaaagcgacccctccagctgcctatcgatggcgccagccaggctcaggaggacacaatgtttcacacagacaccctgcagtgtcttcacagcaacccaccaacccaccgcatagcggtcccggcgtnnnnnnnnnnggttccacacagacaccctgcagtgccttcacagcaacacaccaacccaccgcatagcggtcccggcgttgcccaggaacagctcggcccctgttgagttgaaccgcccgccgcagccctccacccggatctgcttggcgtcccagtccacttccagctgcacgttcagctgctgcagcgccgacaccatgtagcggatgtcctctgaatcctgagaattgagggtgggccatgcggtgctcatgagcggtcggctcccagggcctggacatacgtgattagcaagggcacggagttgcatgaaaatacaatcattcctgtcggctccactttgtaaagcgcaaatgactaatcttgctgctcgcaataacctaccaggatgttgtccagggtggtggtaccctcggccagggcagccagcaacaatgctctgttgctgagtgacttagacccagggagggtcacctcaccctcgatgcgcttgatgggctggagcaccagctgggagggcgtggctgcgacggcagcggcctgagtcttggcaaccatgaggcgcggcttgaaaaccctggtggacgggcgaggtgcgtgcgtggcacgagcggagaggctcagttggctgtacgagtatctgcgcattgaaacattacaaaaatgcgccggaggcgcgttctgcgtcgtcgctgccatctgcagagatgcaagacagcgtgcagggcacgccatggtgatggacaaagtgccgcacaccggcctcctttgacctgctccaaggcaccgttatatgtgactttgggttttggttctgacaatgcacagggcataaacattcaaccctccggccttgtgtcacatcgggcccaacgtgatatcccacgtggatcaaggagggcgcgcgccggggaaaaacaaagtcagtgcatctgccccttgcgtgcacgccgagctccatcattgcaataggaacagaatgcggtgccataatcttccacaactgcggtgatttgagcgctcaccaggtcgcacctcaggccaggaaccgtccccgggcatcaagcataggagctggtgtagcctcgctgtccaagggctaatccttcaagatgggagaacgcaaaggtgacgatgcgattggcaggtgcgaccgtgaacagcctgtgccatgcgcgggtgcacccctcacctgccccgtcctgacaccaccccacagtgctgaacaaatactttccgccggatttcgatccggcgaagctcccgaaggccagccgtgtgcggtgagtgtgcaaagaagggggatgcattggcggccttaccttcatgagacatagtcggtgggcctgggacatgacaccgttcccggcctcccnnnnnnnnnngtgcggtgctacaatcttccacaactgcggtgattttagcgctcaccaggtcgcacctcgggccaggaaccgtccccgggcaccaagcacaggagctgttgtagcctcgctgtccaagggataatccttcaagatgggagaacgcaaaggtgacgatgcggttggcaggtccgaccgtgaacagcctgtgcaatgcgcaggtgcacccctcacctgccccgtcctgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttggggcagcccggcacccttcccgtcaaccacgattccaccccccctctccacgcctgcaccacgcaggtcagaggacaagcagatgaaggtgcggatgatgctccccatgagcgtgcggtgcaacacctgcggcacctacatgtacaagggcaccaagttcaactgccgcatggaggacgtgcgcggggagtcgtacctgggcatcaagatcttccgcttctactaccgatgcaccgcctgctccgcggagttctgcatgaagaccgaccccaagaacaccgactacacggtggagggcggggctacgcgtaactacgagccctggcgcgacaaggagaaggccaagctgcagacggcggcggagcgagaggaggaggagcgggggaatgccatgaaggtgctggaaaatcgcaccctggacagcaagcgggagatggacctgaccgccgcgctggacgagatgcagagcctaaaggtgtgttgtgtgtgtgtgtgtgtgtgtgtgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcggcggggcttggggtcacacgccccacatcctctcccacgtcctcaaaacactnnnnnnnnnntaacaactgacgggggactgtttgaccccagattgttcaaggggtttgggatcaggggagggaaaccaacggcgtcctaggatccgggtcgatttgcggccagcctccaaggcacctgcggcgtggcttgggtcacacgctccacatcctctcccacgtcctcaaaacactcatccaacccaccttataggctcggcacgcacgtgtggacaccgaggcggcgctagcggccctcagtcgcgcccgggagggcgatggggaggagccgccggacttggatgaggaggacgaggcagccgtgcgagccatgctcctgcaccgggcgggattcgtgcggcggctgtctgacagtgaggaggagggcagccctgtgggccctgggccggagggggggggcggcgggggaggggcagccaggccgcatgccccccgcctctcggtggcggcggccgcctgggacgaggaggaggatggcaaggagcctgcgccaggtggagagggcgaccagatcgacgctccttccagtagcaagagtggctctgagccggctggcgnnnnnnnnnngaggagcctgcgtcaggtggaaagggcgacgagatcgacgctccttccggtagcaagagtggctctgagccggctggcgagcgggcaaacggcgcgggcgagccggcggggctcgacgactaccaggcccccgcagccgcgccagcagcagccaaacccaaggcccctccggtcaataagcctgcgacagtcatgcggcgatttgcggtcaagccagcagccatcgtggtgaagcgcaaggcgccggagccagatggagagcctgctgtgcccgaggacgtcggcctgcagagccttctgggagggtacgactccagtgaccattacgagagccaatgatcatccatgcacgtgcacaaccttctctgcaagtcgatcttctagacgcattggcagaacaaagactcgatcttggggcgaggagttgccacgatcaacctttccccacgcggactcgccgcgatcttcccctccatggtacgcctgggcgacggcggcgcatcggccagcgcagacccatcggaaagctttggcatgctcgatgtcagcatcgaaacatcannnnnnnnnnnnnnnnnnnnnnnnnnnnnnnnnnnnnnnnnnnnnnnnnnnnnnnnnnnnnnnnnnnctccggaatcggctgcgcgcggcccatttcgaagttgggtggggtcccatgggcgtgccttagcaacaaaacgtgccgcgcatattggtagtcatctcaacctccttgaaacctctaattgtgttcaggtagaaatatttacttcaaattatcccaatcatcctgcaggcnnnnnnnnnntcttagtaacaaaacgtgccgcgcatactggtagtcatcccaacttccttgaaacctttaattgtgttcaggtagaaatattcacttcaaattatcccaatcatcctgcaggcggccgtctgtgacaatgtcgccgcaggaggagtcgtgggacacggtgggaatattcgtgttccctggcttcgagccgctcgatgcctacggcccaatggaactctttggaagcatgattcgagagggtctgcgcaaggtgaagcgcatcgtcttcgtggcggagaccgcgggcccggtcccctcatgcttcgggcccagcaccgtggcagagtacggcctcgacgactgcccccccctggacgtgctggtgatctcggggggcattggcacccgcatcctcatgcacaatacccgagtcgtggactggctgcgatcccaaatactcgatcatgacgtgcggcacgtgctcagcgtctgcacaggtgggtggggggtggggaccctgaaggcggtggactggcaaggtcccatctcagcacccccattctgtataagagaggtatcttacccgccacctgtacacccctcgccgcccaggtgctgccctcctagctgccaccggcctgctggacggcaagccagccaccaccaacaaggagctcttcacctacatccgccagctgtttcccgcggtgcagtggcagggaaccgcgcgctggatatcgcagggcaaggtggtcaccgccagcggggtgaccgccggcatggacgctgcgctctccatcattgagggcacctttggcgtggaggtcgcggagcgcgtggcgcgggacgtcgagtacattggcgactggaggcaggcaagcaacgacccttttgcgcaccattcctcctccgacgacggcgagggggccgggtaggaaggcaggagggcttcggccctttggggcctgggagtcccaaggcactcctcgttcccggaagcacctgcccccttcccatggtattcaagactcccctgccgctgtcgtaggctcctcagcccctacccagcacccgatcccagccatgcgagcgggcaggatttgtaccccccttttcttacatcgaggtgcccctaaacctgtcttttcaccattccattcaaacgctgccagccactgcgcgaccgctgcccttgtacatactcctgctttcctccactccaccatgcttctgccgactccaggtcaccctgtactcttaggtaaaacgattgagagcaggtgggagtggctgtgacggtcatgtgcaggaggcatggtgtggcgtgtgaggggagattctgggagcgcggcacagagagtagctaggggttccagacccattcgggcatgctgcaaccccttccggaactccaggcccgagcctcgccggatccggcagctggcgtgcgtggaccacatccggcgatgcgggaccgtggcgcgcggatggtggcccgtggcggcacacccgcccgcctaggcggaggctgcctcctgccgcttggccagggattcgctggagaggtccaggaccttgccggtgattcggaggtacatgtccagcacatcctcaatctccgtctcaaagtgcgaggtcgcatcgtacccacggctgatgaagcagccgtctctgcaggcaagccgacatttgaggaggcgaggggttggggtagaaagagagcacagcaaacatggtggtggtgggatactgtatgccgacaccatggtgcctggcagggcatggtacgctgctgtgcacgtcccatcgcaaccggcacgggcgccaggggagggcattctccggcaacaaccagggccgcacgcgcaggagccagacacatcacagaccctgctgcaggcagccccatgcccccgcctccatcgccccatcgcccagcctacctttgcccgctctccagaggctcaaacacgtccaccacctccacaaatttctcatcaatcttacccagcagttgaaggcctgcgtgttaagggagggggggcgcacaaggattggcatgggctaacgccgagcactcctgttcggaagccgcacgaggctctgtgcgccgagcagaatctcaaggatctgccggcgggttttatggggccagggaccctgcccctgtctgggaatcgccggcctttgccgcagcccagcacatcaaccccctccaccatcgttctccctttccaccctcagggaaacgcacctgccgcgagctcagcagtggggtctgtggtctcaacggtggtgnnnnnnnnnnttcgttctccctctccaccctctgggaaacgcacctgccgcgagctctgcagtggggtctgtggtctcaacggtggtggacacaaaggccagccacttgtccttgggcgccacatggtgggagtatgagcagcagaacacgtaaatgtcggagcgacggcccacctgcttctgcggcaggatcagctgcaggtggtagagggggggggaaatccaatgaggttgggggtgggcaggactacattgaatccctggaaacacttggagggatcccattcaagggcagctgagcttggttcaaaggtcagaatgttggaccggcgggtaggcaggcggtggatgnnnnnnnnnngattcaagggcagcagagcttgggtcaaaggtcagaatcttggaccggcgggtaggcaggcggtggatgccccaacctcgagggcctgcactcaaagccccgccaccgccccctccctgcccatccgcccacctgcacgctgtgcgagtcgcccgtggaggggatggggtgggacagcacgcacagcgcgcgcaccactcgactcgtgcgctggacctggggaccgatggggagggaaggcgtggagggtgaggaggctgcgtgcatgagcgtgcaagagctcgaaagcagaggacagtgggggggcggtaggcagccacggtggccaggactacacctcatctgtccaacttaccgactcacgggtccaccaccctaaaatcccaaaccctcacttccaaaaccccaccttggagggaaaatagctggcgtcccccaccacaaacttggcgnnnnnnnnnncctgtccaagttaccgactcacgggtccaccgcccctaaaatcccaaaccctcactcccagaaacccaccttggaggggaagtagctggcgtcccccaccacaaacttggcggtggcggtctggccctcgctcttcacgcccaccgcgcgcccgctgtcggcgtcgtacaccacctccgcgtcggccttggcgagcatgtaggtgccgccgtacaccgccgacaggcgggcaaaggcctggggcagctcgcccaggccgtacagggggtagatgtagggactcttcaagccctcgtaccgcatcatggagtcgtagtacagcttgatcttgagcaccgtctccagcgcgggctgcaaggcggagcaagtggtgggnnnnnnnnnnnnnnnnnnnnnnnnnnnnnnnnnnnnnnnnnnnnnnnnnnnnnnnnnnnctgggctgctcacatggtgtgagtcagggacatcccgggacagaaggccggcagcgccaggccccgatccgaatggcggcattgcccccccctcctttccccgaggcctctcacccggcgcatgtnnnnnnnnnntgccaggccccgatcctgatggcggcattgccccccccctcttttccccgaggcctctcacccggcgcatgtaggagtcgtcggagtgcagagccagggcgtggcccatgaagtccaccgtcatcgcatccaggccgtactgagagtacagctcctgcggcatgccatggctgggctgttgcagggcaggagcaaggtcaagcagccgagggaggggtccacccagcttggaagcattgcatgcctaaccctggcccggccccgccttgcgtcaagccaaatcgaggtacctcaccgccatcgtcaccctcctcaggtcctggcccttgtaggtctgggggtcggccgggtcgtactgctggacgtacctgcattcccagggacatgaagacatgccgtgagaggctaacttttgattctgcgatccaggaaaagcgcaggccccaccccgttgagatcccctgagcccctccactcaccccaggaactttgcagctcgccgcttttcaaacaggcccagcagcggcgacttgagcgcctcccagtccgaggctggcacctgtggggcggcaaaggtgaccaaatgaagccaagggcattttgggggcgagctcatatacatgcagggattgagatggccatggtgcgacccgcggcatgcagggcacttgatctggaccttcctcctctgggtggtgggctgaacccattccacggatgagttcgccccctcccatgcttcccttgccccaggaatttaccatgacagctcgctcagggctcctgatcatcttcccaccccttgcccaaatccaatgcatcaatcccaccttctccacgcggttcttnnnnnnnnnnccggcaaaggtgaccaaatgaagccaagggcgtcttgggggcgggctcatatacgtgcagggtttgagatggccatggtgcgacccgcagcatgcagggcacttgatctggaccttcctcctctgggtggtgggctgaacccattccacggatgagttccccccctcccatgcttcccttgcccaggaatttaccatgacagctggctcagggggcctgatcatgttcccaccccttgcccaaatccaattcatcaatcccaccttctccacgcggttcttgttcagcacaaaggacccatccacggccttgaactcgaggtacttggtcacatcggtgtggatgagcaccttgacaaggttgccgttggcctggggaacagtgtgggacagaggaaggaatgtcccagagtatttgagagatcgatgatacaaaagtcagtcctgactcatccaagattacccgctctcacagctcaccatgannnnnnnnnntaacagagtgggacagaggaagggatgtcccagagtacctgagagatcgacgataccaaagtcagtcctgactcatctaagattacccgctctcacagctcaccatgatgaacttcgggaccagatccacattaaagtccctgctgggacccagctcgggctggggcttctggccgggccggaacctctcaaacagctgggtggtaggtgtgtgttaagggctcagcgggggctgtgccaggcatcaggggcagatgccgctctgcaaagcctcgttagcggcatgtatgattgcaggaaccatgggacgcatcgcacctggttcaggttcaacgaggcagactgcccgccatagtagttgttccggtcaatgtgaagtacctggcgagggggaagcggaaaccactgggtggttgggaatctggccacagggggacggtccgtggtgtggtggagaacagtctgttaagcatgtcgctcaccttgtagccatcgacggacagcaggcctgagattatgcactccttcagccctgtgcccagcacaatcgcgtcatatgcttcctccatggctcacacgtcggcacccggacctgtctttggcgcaaaaatatcacgatggtgcacgagcgtacgaggcggggatttaatcagatctggaaacgggcgcgtgcgggtcggttccgacctggttcctctgtcccacagagttttggaaatcatggccaaacaagcgcgcctcgccaaaatcttgaatacgacccgggatgcacggtgggtgatcaggggccatcgcacctgcctttgggcatcatgaatcggacttgggctcgcatgtgcttctcacgcccacagaaagcatagcagtgcacctccaggatctgcgcggatcgccaggcgcactgcccaaggctctggacgaggcaccatgatgcagcgcttgccgcagacgatacccctgcagagtggatcggtcacagcttttagtgttgttcagagatctcggggcctcaatcgaagtcttcatggaccgcgctgggattccgcgcgtctggtcccggcagctcggaagannnnnnnnnngcccctgcagagtgggtcggtcacagcttttagtgttgttcagaaatcgcggggcctcaatcgaactctgcatggaccgcgctggggtaccgcgcgtctggtcccggcagctcggaagaagggagtgcgagaggccgatctgtatctggccgtcccccctgagccaccggcgtccgtcccgtggcaccagtccgttcccacgcctgtcaaggttcccgtcaccatcctagcatcccttttggcactccgcttcatcgcgaggtccctcaggagacgagggtgagtccatcgcccagggccattggtgctgacctgtaccatgatgcagtgagcagagcaattctttttaaaccggtgtcgctctgctcattttaccaccccctgacctgcagctcgtccacagtattggaannnnnnnnnnacccagggccattggtcctgacatgtaccatgatgcagcgagcagagcaattctttgtaaaccggtgtcactctgctcattttactaccctctgacctgcagctcgtccacagtattggaagaacggggatggaagcgcaaggagaaggcagccgacgactcccattacaagagtgtgttggcatgattgtcccagtttggttacgggagaggatgcagagtgggtcttgctgccctcgtgaagccacagagcatgcattgcattttccaaacctatcgtgcactccccattcgcgcgtacagagatgatgaagggcgtgaagacggtccagtatgaggcgctgacacccgagcagatcgccgaagcccgctcacgccgcaagcaagacctgggcaggtgaggtgcacggatgtatgggaggacatgctgggaggacacttccacggcatctggctttccttggtggctggcccagtggtcactcgctccatacatttcgcctcgctgccagagaaccatcacagcgattctttccttgcattcccagggactcggctccgctgggcatggacgcgatccacattccagacaaccatccctttgccatccgggctcctgtatctgcgggtgcgaggtttggagggcacatgtttaagatgctgggggctggcctcaactcaaggtgcctactgctgaaaactcaagatcaaacggccgannnnnnnnnngaacatgctggggtctggcctcaactaaaggtgcccactgctgaaaactcaagatcaaacggccgaagatcctgctgtcctcacactaccgtagaggaggaggcgctcatcgaggagcggttgagcggtcccaagcagcggcgccgcatctccgcagccgacctggagctcatgaaaaagctgcaggctgaagctgccgcagcggacgctgccgcagatgccagggcggcctctcggaatgagggcggatactgagcatagttgctgctaggcgtgctgtctgtagcagcacagagcccagtcggtgtttgtcatgcaggatcggccttgcgacctaggggaatgagaactgtccctgcgaatggctctcatggaccggcctcaccaaaacccaaacgggtgtgcaacatgatgtacatggacatattagactgcgagcatttgcccagggaaagtctgcaagaggcagtacacatgcagtgccagctaaagatgttccatggggcaaggcaaatggtattgcaatagcaaaaccttatagaagggatgaaaccatatcgacacgagccagaagggaccacagtctgagggatcttnnnnnnnnnngatgctattgcaatagcaaaacctaatagaagggacgaaaacatatctacacgtgccagaagggaccacagtctgagggatctttaagaacgtacaatatggcgcgcagaggtccactcgtacaagttcaccttgcagccattcccatgcctcggcatactgttgctatgccaagagataggcgtctaagggcaggggagccatggcgccgatgcagtcnnnnnnnnnnggttcaccttgcagccattcccatgccttgggatactgttgctatgccaagagataggcgtgtaggggcaggggagccatggcgccgatgcagtctgtcacccacctgggcgagaccagggcatggcgagaggcccgctgcgaccctggattgggcttggtctcgcacagcgtgacacagcgtgtgtcgctcccaccgcaccgctgcccggacggcgccagctccgcgccggcagcctgcgccagagccagcagctcctccctggcgctgaatgtgcctggcatgaatgaggggtggccatgagcggttggtgcaaaggaatgaggagcacgaggacaggggccgcgggctcgcatgactgccgggggaggcacgtgtcaggccgtcaatggggcggcgccccaccactccgtggcccagcacccacccgcgagtcgtatgctgtaccctgccaggggccccggcgctcctgcgcgtctctgctcccggctcagggccgccgcgcccctcccgccacagctgtcaccctccacctggcaggtgacatggggctgactggatcatgccgctgacactctggcaggcaggccccgccgccaatggccgctccgtgccctcaccaggtactcccgctcatccaccggtcggacttgcgctccatgctgtcgcgccacggcctccgcccaggcctcctgcacgacccaggcccccgaggccagacccatgaggtatttgaaggtgcgcctgtgcaggagggggcaggtcggactcctgaacggggtgatctccagggcttggccacccatgcagcgccgaggctggtctctcagaggcacagtaccccaatcctcatcaaccccagccgtgggcccctccaactcacgtagcagcgccctgcgcgtcgacgccacagaccacgtgcgtcacacctggctgccaggtgtcaaccacctcgaccccacaccgggccagctggcagagtgtcccgggggagggcacgttggagagcccggaccccagcgccttgatcgcgccgccgccgacctcaagctctccgcgaggatccgcagagcggctctcctcctcggcgccaggcttgcggccggcacgaccgcgcgcctcctttccagtggcgcgagacggcgcccgcgtgccagattgcgtgtcggggctgggcgcggtacacccaggccgcggcgcctgggcccgggcgccgccgcctggcttgggggtgaggcacacctcacacaccttggcctcgaactggttgtcatgcgtacagagggggtgtgccaggtgtgaaatttaacataaaaatggccttatcaatgttgaccctcgttttgaagtccccgcctcgcaagcccctgactgtaggacctgggnnnnnnnnnnggtgagattttacatcacaatggcctcatcaatgttgaacctcgttttgaaatccccacctcgcaagcccctgactgtaggacctgggctggggttaagaaatgcaaggtgtttgacgctcctcacctgccgaaccctccaagccactcgctcaccttgttctccagcgtgcaggcagagcagctccagggcaggaggcgggtggggatgcgacgcagccgctcctcctcctcggcggtcgcagctgcggcggcaggggtcagcatgtccaaaggcgtgcgccgcccctgagacggagcagctcccctgccgggctgacgtcccactgcattgccccgcccagacccttcgctcgtcctgaccctcggcggcgcgcgctcccggcaccgcgcctcgcgccgcgtgggtcctctctgccgcgaccgcttccttggcgggcgggcggggccctcggcgccggctgccttcccgctgaggggggcggcagcatcccgcacccgggggggtgaggccacgggggccgccgccgctccaggcagttctgaactgctacaggctgcctcgtcgcctgtgccggctcgccgactcagcgtcacgctggtctgggcggtgcacgcctcctgggttgccgtgctgccaggctcacgctggcgccgcctgagacggctcgggccctcggcaggcgcggcgtcgtggggcccgcggaccgcagttccagctgaaggcaccacgaagtcctcggcagcgctgccgggagcctcatgttcgggcgcaggggcgagctgggacgatgggacgcgccgcttcttgactgaggaggatgggaggtagatcgagcccgacagggggtctgctgctagtgtgtgagcgttgggcggactgcagggtgggacctgatcgaccgcgcaccctgccagggccacggactctaggagccctgtgccccgctcgctgcactccnnnnnnnnnntgctgggcggactgcagggtggggcctgagcgaccgtgcaccctgccagggccacggactccaggagccctgtgccccgctcgctgcactcctctgcggctccgggaaggagcacctgggaggtggcgggccgctggctctgcgtccggggcacagtcccggggcctacctgtcgcgcgagctccatcacattctctgcgaagcggtggagggtggatgcggttcaccttgacatgacttcgggaggctgtgcgctcacatctgaacaaacctgaaacccgctccctcgagtacagtccgtgaatctcacccttgtcagccttcagcctcgcaaaggcgttgagcaccgcgtccatcgcagcgtcctgggcgacctccctcctgcccacgcacgccttgcagatggggcagcgctgcttgtgctgcatcgcctgctggaggcatcgcctgggggaacatgtatcatagcaactgaaagcccattggtgagggtatgttttgtgcaggaagacggctccaacgagcatgggatactccctccccagctccaagagcaggtcagttctcacttgcaaaagtagtggcaacatggaaggcgtgccacgggaacaaggagcacgttcaggctgcgaggaggagattgaagacggggaattcggcctgaagtggtgactgagctggcttctgctctgcactcgccggggtaatcatcgctgtgcagacataccagatggggcagcccaagtcctgggcaagcctgacgatgctattctccgccccctcccgtcgtctggcagccagtccggtcttatctggagaggaatcaccgcacgccatgttgagaagatttgaagatggtatccttgcagcatgacatgtaagtgtacccatcgtctgtcccttccggcattcgagcgcactccgtccattctatttccacctcgtggctccgagattgatcacaccgaggagtggcagtgtcagcgtcatgcatgtatactagccttctaggaagctatcaaagcacgcaccggcttctgcaggctgcatgggatcgcaaccgaccccgtggatcacatcccggcaaaccctgacgtggaggttgttctggcacctactaccctgaatcgctcatccggaacggtttgtcgtcatggagattgatgcgcaggccgacgcgagcctagatctggaggtgggtcttgcatgagccctggccgtacgggagtggacatgtgcaacgctgcccctgcacctccttcacctccgccccttgccccttgcagagcctgttcagcggcgccaccggggcagcccggctggagcacctgctttttgtcgccgacaagttcaagggccaggagctggagctggaggcgctgcgcctggcagccgaccagctggcagcggcttccaacgtcaagctgcatcgtgaggtcctggaacgcatcggtggacgactggggcctgcgtacgttcttgacaggtgaggctgggcagcagtgccggcgggctgggcggtttgggacttggggcgtgtgagcgtgccagcctcgcggccttgttgtgtggagcctggcaccaccaagccctgcttgtcactccaaggtccttttggggcctggcgtgcatcgcacaatcccgccctgctctcctgcctctgcaatacctctacccccgaaccactcaggccccagctggaggcaaaggagcgggccctggcggcccagtcctcggtcctggatgccgacctggcggcggcccgagccactcagtccaaggatgcggtcagggccgcacaccgagccctggcggattgctgggcctcccagggcgccgtcaacgaggcgatgaaggggtacatgcgcatgcgcgagttctgcacccagccagaccatgtgctgacgatgtgcatcaggtgggcgcgtggcgggcgtggggggcggtggggatgtggcctcgctgctccgcggggctggtggccgggcatgcccaggccatccacaccatggtcccggggtccannnnnnnnnntgcgtggtgggcgtggggggcggtggggatgtggccccggtgctctgcggggctggtggccgggcatgccgaggccatccacaccatggtcccggggtccaagcacgcccccctctcccttccccagcatcatcaaatgtgcggtggcgatgcggcagtgggtgcatgtggcggcgtacaggaagcggggcgagtctgtcgtggcctcctcggtgggtgcatggaactgggagggaaggggaccggggccgcgctgacaggcacccgacagctcagtcgggggctgggagttcagggaggatgctgcaccgctgcagcattcgttcccatgcacgtccgtgagggggtccatgcctgacccccccccctgaagcctgctgtgcagaccgacannnnnnnnnntttctgggagaatgctgcaccgctgcagcattcgttcccacgcacgtccgtgaggaggtccatgcctgacctcccccctgaagcctgctgtgcagaccgacacgatggcaaagagccagctggcggccgctgggggtctgtacagcctgtcccaggcaaagttcgaggaggcggcacgcagctatgtcgaggtatggggggtggacgggggactgccaccaggtggcagtgggaaatcttgtgaaggatcggatgccgagtcggctcgtcatatccaggacggtgaattctcagagccgtcaaccctcgccattgacatcgtgacgcaggtatcccccgacctgggttcggagttctctgacgtcatctctgcccaggttcgtccgcgtgggtttctgccctagaagcaggggatgcggctggaggcggccttgcctgccgccctgtgttcctgtttggccacctcacaaatgctgtgcaagctgccctgcacagtagacacggtctgcaacccccctcccctcgggccccctccccccgggcgcattcccctttcctccacgcaggacatcgcgacgcatggggccatgtgtgcgctggcgtccctggatcggccggccctgcagagcctggtgatcgactcgccgggatttcgggagcacctggagtcggtgcccgaggtgggcgccgtgcggggctgggcgcggtttccttgtggccccggcaacttggtgggtgggggacgtgtggcacggcgcattgctgaaactcagctcatctcctcctctaccccgcccagattcgcgacgccgtgaactcgttccatgcctcgcgctttgcggactgcctccggcacctggaggcggcgaggtgggcgtgcttggtttgaggactgagggcatgatactgcaccagcctggcattgggcgacagcggaagtggtgtcatgcggccacccttgggaacgcattgcagcgcggtccactctcctcgatcnnnnnnnnnnatgaggactgagggcatgatgctgcaccagcctggcattgggcgacggcggcagtggtgtcatgcggccacccttgggaatgcattgcagcgcggtccactctcctcgatctgttccagacgacaccatccttggcatgcgaatctgcgccatcaacccctttgcctcccagcctcccttcttcaagcaaactccctcgtgttccacagacccggcatggagctgtcgccgcacctggccccccacctccccgcactgttcaaggagatccggcgccggggtctggagctccacgcccgcccctatgccaccctggccctgtccgacatgggcgccgcgctgggcctgatccccgccgatctggaggcggagctggaggcgctgatcgtgggcgggcggctgtccgcgcgcatcgacggcgcggcgggcgtgctgcgcgcgcaccgccccgacgcgcgcgctggggcgctcggtgccgtcctggcggcgggagaggagtttgtcgcggccagccggctcctggcgcttcgggcctcggtcctgcagcacggtctggtgcaggtacttcttgtggctgtatatgtggaagaatggggggagggcatgggaaccgaaggtgggcacggactggtgctgtgcgctgggagttggacgctgggcatgtatgcgtggcggcgcacatgggcggcgtcgacactagggttcaatgtagtgtgtgccgcgctgttggcccggcatagctgtggggccggggctggcaccgagggctgaaggcgcaccgggcaatggtgcaggcgagaaactacatgttaccgagcgcagagcctcccacacgacactcgcccgatgccagaggagccttggcgnnnnnnnnnnaagaaactacatgttatcgagcgcagagcctcccacatgccactcgcccgatgccagaggagccttggcgctggcccgggagctggaaggggggatgcgcagcgacatcccaggcaaagggacaggtgacgctctcgggaaggagtggtgtcatgaagatgaggcgcgcagtcgcagacagagtgcatgctaatcacatgcatctctttcccttgcagggtactgagctcgtgaaggggcttccctgtagatttatacattgactgttcgcatttgttgatgaaccaagggtgactaagaaatcagggtgtctatgcaggaaaactgcaagagggttgtactttaccatgcaggacctgtcggggttgcgcgctcatgctttcccccgaaatccacgttgtaccaacaaaccagcccttcaacccccgcatatgtggtgatcatgccacctacattatcttcctcctcgaacagtcccgggcctgcctcgaatccatattcctgcaaccatggcgaaggccgtcgacaagcgtcaggcatacagcattatcggacttgccgcactgcaggtgactgcagacgccgtgggagggtctagtggagttccgtatgtgaactcgtgctctgccaagggcactggagtcgggagaccacttttatgttggagaaagggcgcatgctctcggtactcgagcgtcagggctcccgtctccacctgcacattcggccgcccacggatttgccggtactctacttccttccctgccttacccactcttcttcaccacaaacaggtcattttccaggtcgtcatcggcgccgtgacgggcaccaagctcgaccagggggatctgtgccagctcaacctcgacccacagagcggccgggtgtgcgatttcgtgtacaacaccgtgggcttcggcctgctgttctccctcatcctgattggtacagtggtgagtgggggttgttttcgggactggggtctgtgtagaggctctgtgctgcttgctgcacagcttcctggagaactggggctggccaaacgccccaatggcccttgtggcgaggtgatctgtgggctcctccctcacaacannnnnnnnnngtcctgattggtactgtggtgagtgggggttcttttcgggactggggcctgtgtagacgctctatgctgcttgctgcacggcttcctggagaactggggctggccaaatgccccaatggcccttgtggcaaggtgatctgtgggctcctccctcacaacaaccactccctccttcacagcaaccacttctgcccgcacttcacccctgatgtgtttgcctctccccctccccgacagtactacaccctagccaaagcccgtcccgggaccctcacggcaggggccaccatcggcctggccgcctacgctttcttctggtacctggtgttctccatcaccatctccatccgcggccggcaggcgaccgatgctgggcagcctggcaccgtggaccgtaacactgtggtgggcctgtcctggatcgtgacctttgcattcctggccatcgccatcctggccatctgggagcgccacgtgaacaagctgcccgtggtggacgatgagctcaaacgctccttcctgtacaaggtggagaaggtgtcctccagtggctccggcaactcgcccaaggctgcggccgaggtggagtcgcggtccctgtccaccgtccaggaggcgcatgaggggctgaaggccaggccccagtgaggggcggcgctgtgatggaggggccagccgggcgccggtgggtcccgcgtagggctttacgacctacccccttcctgaagcttgacccggtcgggtcgatcctgcagcgcccagctccgaaaaccgaggctcaagacgaaactcaccagtgttactactacgttcctgctctgcgtatgtgctctgtatgtttgaagcagctatgacgctcctgcgcacatgccccttgcccgttgccgcgcgtgcctgttccttgaggcatgtccccctatgtattacatctctcatgaagtctttctgtgtcgaaattgggtgatgcggtctggccagggagatttcggcggaattgcagttggcagagaagggtcgagggttgcctggcggtgttgtgtataactcgagggttatggcagcacgtggtcgtcccccttcaggcgcgcttgcgagcaggcaatggttatatacctcggcaagcacacgccagacgtgtgaactggccaatgtccgagtcgtgatcgtgtgaccgccttgctattaatacaatttcgatgggacgcgctgcgaagtgcggaaatgctggtgagagtgtacatacctagctctgagctcggttagatctgtgtacatgatgcgtcgcttggccgatgtggggtgccccatctcacgctattcaataaatgctgagtgttacattacaggccttttgcatttgagtgtcgcattcctcattggtgtacagactcggcgccgtccggtccgggtggtgctctgaaaggagcagtagcggtcaaggttcggcacatcttgtgcgagaagcagagtaaagcattggaggctctctccctcatccaggctggggagccattcgataaggtgtcaaaggatggcacttttagatggctggacttcagcaggggcatgccatctgtgcgtcccagcatcttcatgaccggctggtacgactcgctcttcttcccactccccaggtggccagagaagtgagtgaggacaaggccagacaaggaggcgacttggggtggaagacacgcaaggagcttgtcgcatcctttgctgaagctgcattcgccctgaatgtaagtagaggtgcaaaagcgcccc

SEQ ID NO: 45896 - DNA, 198 bp, Chlorella protothecoides
gtgcatggtcttcagactgaggagcagccgagcaagatcagatgggagtccgagtttgtttactcacaattgttaccccagccattcccttggctgaccttcagcagacgaaggtaaggccaagaaaatgcccacaaatagtttccacggtaatgagccccgcattgctatcccaacctatactcttggcacaagctg

SEQ ID NO: 45897 - DNA, 99 bp, Chlorella protothecoides
ccaggtcccagcttctagcaccacaccacactcccactcccaaccccatacattccccctccttcctttccaccccagctgctcacgtcctcggacctg

SEQ ID NO: 45898 - DNA, 20766 bp, Chlorella protothecoides
  modified_base (637)..(646): a, c, t, g, unknown or other
  modified_base (1226)..(1235): a, c, t, g, unknown or other
  modified_base (2869)..(2878): a, c, t, g, unknown or other
  modified_base (4912)..(4921): a, c, t, g, unknown or other
  modified_base (5142)..(5151): a, c, t, g, unknown or other
  modified_base (6156)..(6165): a, c, t, g, unknown or other
  modified_base (6705)..(6714): a, c, t, g, unknown or other
  modified_base (7918)..(7927): a, c, t, g, unknown or other
  modified_base (8588)..(8597): a, c, t, g, unknown or other
  modified_base (9028)..(9037): a, c, t, g, unknown or other
  modified_base (9372)..(9381): a, c, t, g, unknown or other
  modified_base (9531)..(9540): a, c, t, g, unknown or other
  modified_base (10187)..(10196): a, c, t, g, unknown or other
  modified_base (10258)..(10267): a, c, t, g, unknown or other
  modified_base (10670)..(10679): a, c, t, g, unknown or other
  modified_base (10874)..(10883): a, c, t, g, unknown or other
  modified_base (11813)..(11906): a, c, t, g, unknown or other
  modified_base (12243)..(12252): a, c, t, g, unknown or other
  modified_base (12839)..(12848): a, c, t, g, unknown or other
  modified_base (14696)..(14705): a, c, t, g, unknown or other
  modified_base (17499)..(17508): a, c, t, g, unknown or other
  modified_base (18149)..(18158): a, c, t, g, unknown or other
  modified_base (18424)..(18433): a, c, t, g, unknown or other
  modified_base (19028)..(19037): a, c, t, g, unknown or other
  modified_base (19281)..(19290): a, c, t, g, unknown or other
  modified_base (20458)..(20467): a, c, t, g, unknown or other
  modified_base (20589)..(20598): a, c, t, g, unknown or other
ggcgcgatcccggaaggcgactcgccgccgcccacgtcggcgcaggcggccgccgccgccgagctcggcgccgcgccggggccacgcgacgcaaagcgggggtgaaggagcgtcaggctgccaaggcgtccaagggctgccctcaggcgccatccatcacgctgagggagggcagggccactttcttgcgacgcattgccccagcctggcggcgccgagtcctgctgtgtcccgttcatgctgcggatctactggcggcctccctccccagatgcacctgccggcaggatctcctccctgcacccaccagccagccaggttgcgtcccatcatgcacctgccagccttgcccatgcctgcacgcgcctgctccctcagcgcacccgcatcgcctgctcccttgtgggcccctcatcgatgctcgacatgtatcaagcactgctcgcgtgcttggctgcggctggccagcacatggcaaaccttcccccagccggatcactccaatcacccccaaccccatgggtgctccagcgctcggtgtgtctcggagtcgcaatgggcggcctgggccgagaggtacagaggctggagacatggctgggtgatgctttgcaaggcaaggggtggccgctggggnnnnnnnnnnctgctcgagcgcttggcgtgtttcggaatcgcaatgggcggcctgggccgaggggtacagaggctggagacatggctgggtggggctttgcaaggcaaggggtggccgctggggagtctgtgcccttggatgcgttattgcaaggtgggggttagggtgagggcacaggacgcgctacagtcactgggaaaagagccgcgacgccgcaacaggggcacgcagggagtcgatggggtggggcagagggatgattgcggagccgacgtgcgatggcctaccccaggtgggatggcgcgacggacgatcgcgaggagagggacgaccagcgcctccgaaaccctcctgccctcccccctgtgcgctcaatacgccttgtacgcgaccgggatgttgatcaaggctcctgcctcggtgccaggccccgcgcccacaccgtcgagccccgcttcttgctccgacacgagcgcggtcgcgatctgcaccaggggggtgttgaggagagtttgcggcagcactaccagtcggggtgccccgcaaccagcgcggccaaggattggtgggacgggaggggcgggggctnnnnnnnnnngaccagtcggggtgcccagcaaccagcgtggccgaggattggtgggacgggaggggcgggggctgccaggtcgagagcgaccggggcccgcggtgacatgctcttctccaggtcctaaaccctccctgtcctccattaacacacacacacacccctccagcacacctggtagacgtccgggtagaaggggtagctctgcacgatggcgcgcgccttttgcaggggggtgaagatggttttgaacacggtgccgatgaactccatgcccgccaggtgctcctcctgcaggttggctttcagctccacggtgcactcgttgaccttcaacgtctcggcgatgaccgactgcagggccagcatgcggtccggcacgctcacgctctgcagccggtccaggatggcgcggcgctcctccaccacgcgccgcatgcggcgcaggaagatggcgcgcaggctgaccacctgcgcgcgctgatcgggggcgagggccagcgaggcggtgactcctgcccagcgcgcgcggtcctccgagctgatccccgaccgcccgtcgtccagcgcggtggcgatcaggcgctgcatgttggtggggtgcagcaccgcggtgtgcatgcacagcgcgcccgccgcgtccagcacgcgggtcagcgtggcgctggcctccgcgtgcgccggcgccgacgggtcggggcagccctccagggtcaccaggatgttgcccagctcgcgcaccgtctccttccagcgcgagatgacggcgtcagcgggcatggtcttcaccgatgccacctccgaggccagcgcggcggacagcgccagcgggcccgacccccgcgccggcagctgcgaccccgcgccctggccagacccgggcaggccgccgccctgcagaccactcccgcccccgccggccccataccccagcatggcaggggcggcaggtcccggcccaagcagcttggggttgctggtctgcagatggtggttgcccaggtcaaacacatgctgctcgtcctgcaggacccggatgtgctcgtcgcgcagggccagcaccttctccaggatggaattccggttcttcagcgcgccgttctccacgcgaaggcgccccagctcggaggtcatgtcgtccagctcctccgtcatgtccttcatcttggccttctggcgctcgcggaagcgcttctgtgcgcgcctgttcttctcctggatggccgtggtcttgtgcgcgtcgggcccgcgcgaccgcccctcagcgtcgtcgctggagtggtcggagtcggcaggggggcgggaggaggtggccggcttgccgaagtcgggcatggggatggaggagaagaggttggccgcaggggcggccaggggggggtcggggaacaggggggcggagcccgtgggggtgcggggggggagctgctgctgcagcatttgctgctgcaggaacatggcgccgtcgccgaaggaggggatgggggtggtcatgggcccgaagaagtctgcaggggagggtgtatgtagggaagagggtgggcgatcactttgagggcgggggttgcttgtcgacggggcccgccgaccccactccttcatagataaatgtatatgatacatcactgggtgtgatgcgctgnnnnnnnnnnatgtcgacggggcccgccgactccactccttcatggataaatgcatatgatacatcactgggtgtgatgcgctgccacgcgccactcactcatcaggttgtccacatccaaggcgtcgagctcggccagggagttttccctgcccgtgacgacgggcaggcccccgccaaagtccaagccctgcatgtccatctggactcgttcctttgtcgaggtgcggggcagagtgttggctaggcacctgttgaaggggggcttatgctgcgaggagcaggtgcatacccccagggtctaagtgctcaccctcgacacggcatctggagatcacgtcgggctctcagatcatcagctgcccccaggtgagaaagtgaacgtgttccaaaggtatcaagcaacggaatgaaggtttacagggtcgagcatggtccagtcatgtgcagaattcctgtgggggggaggtctcgggaatcttccccggctcaaaggccggcgcacgccatgcagcgacatctgcgtccgtcccgtccaggctggcctggttcaagggtggctgctgagcctgacccagacctgctccctgcggtgtggcattgaggcccagggctgccatgctctgtccttcgtatgcaggagggcttggagtggccccaaagcccccaaagctcgggggtgcagcggctggtgtgggcaccccagaagctccaaaggggccggcgccaggcgaggccccgaatcctgctggagcaggaggcgcaccaccaaatgtgcctgatggggtgggcgcattcccaaagccaggacgcgcggcagctgccccaaagcccggctggatgatggggatgcttgcaaagccctgctgaggggctgctgccccgaagcccggctgagcggctgctgccccgaagcctggctgcgcgactgctgttccgaagccctgctgcgcggctgctgccccgaagcccggctgcacggctgctgccccgaagcccggctgcacggctgctgccccgaagcccggctgcgcggctgctgttcggaagcccggctgagcggctgctgccccgaagcccggctgagcggctgctgccccgaagcccggctgcgcggctgctgccccgaagcccggctgcacggctgctgccccgaagcccggctgcacggctgctgccccgaagcccggctgcgcggctgctgttccgaagccctgctgcgcggctgctgccccgaagcccggctgcgcggctgctgccccgaagcccggctgcacggctgctgccccgaagcccggctgcacggctgctgccccgaagcccggctgcgcggctgctgttcggaagcccggctgagcggctgctgccccgaagcctggctgcgcgactgctgttccgaagccctgctgcgcggctgctgcctcaaagcccggctgggctgccgagggcactccactcccaaatcccgatacagggcgtgggccgaagggtgcggcagccaggggtaacggccccagccctgcagccgctccaaaacctgtctgactgggcggagcgggcgctgccgtcgcgccagcctgcacgttccggaaggcagccccgaagccccccccgccacccatctgttgggccacggccggctgctggggtcggggctgctcgctgatgccggcctgtgctgcagggtagggcggggcagccactgcgcctccacccctgctgggggcttggggtgccttcattagcctgtccatgcagttgatgcgcgcgcgtcgagcgctctggaaatccgaggccagctggcgctgcggtgccccacgccgcatgtccatccagcgcacctgtggtggggtgcagtggatcctagtcataacgggaatcactgtacagtcacacccatggcatcatggcatcagaaacattcccagtggcctggaatggcatgtacatccgcgcccatggcagcatccactaccccgtgtagacctgcactgccctcttccccgcccgctgctgcgctgccgacctcttcagggctgacatnnnnnnnnnntgcccatggcagcatccacaaccccgtgtagacctgcactgccctccccccagcccgctactgcgctgccgacctcttcagggctgacatcgccggtcagatcgttggcaccctctcgtgcgtgtccgtagcacgacagcacccagaagggccgttggtggatgaggtcgtccctcacgacatcacgccagagcgacggtgccctgcgagcacggtggggnnnnnnnnnngcagcaagaaccttgaataaaggcacagatgtagtggtccacttctcactcacgcattattgccctgattccgagacctctgatctccgtgctggcctggtgaatgggagatgggataggctcatagaatactatctttcaatgaggatgatcacacatctgcactgcaatggctccatgtaccaccttaccagtcctattcgcgttctgccagcctcccctctgtccatcctgggatagaaagtatgggaggcgtatgctgtcatgcaggttcacttgtgctcctttcatggcacggcattataaacttttcacctggttgctgctgccccggtaattctgccgcgacatcccaccacaaagcggtggcctgtcaagcttgcatggatacttattatcttgtgtcaagatgcaagaaattacctacatgacgtcggaatggaatacgtaggctgtgtaggtcgtgcgaggtctcccgagacacctcgtcgtgctctgcatgagatgcttttgaagagcacggggacagcggggagcagatcgtgagcgatacaggatgttactcgtgactttaaaagtgaggtgcaagcccatatcgccagcatcagcgaggaagcctatcacgcagggacgagggcggtcgtggtcggacgagggtaccaccatccgagacggagatccaacacggggccatccgccgcacaccgatacgcacgcgcctgcctttccaagtcctcgaatccaggtcatcaagtatgctcaactcctggagtgaatgagagattaggtagggatcgccagctcctaccatcagtttcagcatgccgcccaggctccaactcaacatcctcaggccagcgtctccccaacgctccagctgggatggcgacaaccaggatcaaaatgtaggaggttatctgcgttccctcgtgcatatatatcgttctcaaggataaagtttttgcctttcttccatgcggagctgtgcttgccgggcgagcaggnnnnnnnnnnacctcgtgcatatatatcgttctcaaggatgaagcttttgtctttcttcgatgcggagctgtgcttgccgggcgagcaggctcagaggggcacacagtaatgtctctttgaacgtctctcctagccaggccttcctctgctcgtcctcccaccaaacagaacctccttgcgccctccatcgaggtgctccccacgggcacgctcaagctctacaagtccatgcaggcctttgagttcaatccacggggcatgatcgccgccgccaccgcagtcgcccccaagcagacgcactcttacaaggcgagagcggcgtgcggtggtgtggggggcgctaggggcttgcgttaaggacagggccatgtgctccttgtggaaatgcagagcaaatgggttgtgtgcagacgggaagatgcctcccagccatgtttatcttgatctggtacgaaccacaatcatcgccctccttcacgtctagctctcagccaatccccccctcatcaccctcccccgcccacccctccgtctgccagatcagcgagnnnnnnnnnncggtgtggggggcgctaggggcttgtgtaagggacagggccatgtgccccttgtggaaatttaaagcaactgggttgagtgcagacgtgaagatacctcccagccttgtttatcttgaactggtacgaaccacaatcatcgccccttcatcaccctcccctgcccacccctccgtctgccagatcagcgagtgcgacgtgcgcatgctgcgccagctgggcgccggcgcctgcggcgtggtgcacaaggcctggctgccgcgcgaggcgcggttcgtggcagtgaagaagatcagcgtgctggaccgtggcagccgccaccagctgatgaacgacatcaaggccttgtgcaacgcgcccccctgcgacggcctggtccagttccacggcgcctaccacgcggccgaccggggtcaaatcgctgtcgtgctggagtacgtagacggaggctccctggctgacgtcattgccaaggtggattattgttgggatggcatggacgaggtctggtgccagagtctccgcccggacccctcccttgtgatgccttctggtgatgaaagaatcattagaatgatatgctcgcccctcagctcttccattcaccgcaaggcctcccggacccccttcccccaaacgaataaggtgggcgccgtgcccgagcgcatcctggcccccatcacggcgcgcgtgctgcgtgcgctgggcgcgctgcacggccgccgcctgctgcaccgtgacatcaagcccgcaaacgtgctgctgacgcgggcgggcgacccgcgcgtcgccgactttggcatctccgccaccatccccgatgcgacgctggccgcctgccacaccttcaccggcacggtgacctacatgtcgccggagagggtagacggcttgccctatggcctgccctccgacgtctgggccctcggcctgacgttgctggaggcggtgacgggcaagtacccctacgacgccagcgccggggtcatgcagctcatggtccaggtgggggggagagaacggtgatgggtgggtgacgtgggagcctgtcaaaggtggggaatggccctccagggggtgccaggcacacgcgtgggtggcctaccacctcagacccgaaacccacagtggtcgtcggccagtccatggccttgcgcacaggtgcagggacgcccttgcaccattcgatgacccccaggccagannnnnnnnnngacccacagtggtcgtcggccagtccaggggcttgcgcacaggtgcagggacgcgcttgcaccattcgatgacccccaggccagaatactcacccccgggggccccccccgtctcctcacgcccggcaggtgatggaggaggagtgccccctgcccgcgcccggcgccgtctcgcccgcctgccgctccttcctagcggcctgcctggctcgcgatccgacaaaacgcgccagcattgaggagctgctgcgccacccctgggtcgcggggtcgggcgcgcagggtggcgtgctgcagcgcacggcgatggcggccacgctccgccagttcatgcgctgcacgcacgacgtggaggaggcgcggggcgacgccgtgctcgccgcctgcgcccgcttcttccgggccctggccaccagcgggcgggcgggcgaggcggggctggcgccgctgctggggccgacctgcgtgagtggcggggatggaggaggtgggaagagggccagggtaaagtaggagtagccgcatgtgcacctttaagtcttcacaggccgacaggttggcgacgccaggtggtcgcctgccgcccagcaaacaatcaattatcagggcctctacgaacatgacccacagacacctccctccacatgcacaggcggtgagnnnnnnnnnncgccgcccagcaaacaatcatttatcagggcctctacaatgacgaccaacaaacacctccctccacatgcacaggcggtgagggtgggtgccacagagcactcggggcggtacaccgccgccaagaccgtggagcaggcgatgcggcgtggggccccggcagatgtggagctctgggtggaacgcgtggactggaagagcatcacggtgcgtggcaggagtgcagggccgcatctaggccaggcacccatttgttgtgtatgacagggaggcgaccgtgaatggtgggttccgcctgctgcacactcctgggagcgaaatgccccgagtcatgtggcgcaccttcccttctcaagcccaaaatgggaaggtatcttcattcgatcaaatcaaggtccaggacaccatcctcatcctcgctctcctcttccnnnnnnnnnnagaagtgccccgagtcgtgtggcgcaccttcccttctcgaaaccatagtgggaaggtgtcttcattcgatcaaatcaaggtccagaacaccatcctcatcctcgctctcctcttcccatcccccaacgctggtttgtgctccgtaggaagatgttgtggcggtgactgcccacctcagcattcaccggcagggagagaaccaagggccaccactggcggccagggccaagctgcacatgcagttggcaggggcggaggaacctgggccaggcagcgccacggtcttattgctggacctaggaggactgctgggtgtgtggagctgattcagtcannnnnnnnnnctggcaggggcggaggaacctgggccaggtagcgccacgatcttgttgctggacctaggagaactgctgggtgtgtggagctgattcagtcatgcagtagagcagcccagaagccccatcctttgtgcgccctaccgagggagggtgacnnnnnnnnnnccagtggagcagcccagaggcccctccctttgtgcgccctaccgagggagggtgaccatgtcccagcaaattccagcaagttccagtggcgcgcgcgccggaggccaaccctaccgcattgggccgaccggcccccggcagtcaatagcgacgtgccatgcctgttttatattgagcgcggagtccttgtgatctggaacaggttcgtattgtggcgatagagtgagggatcccgcctcataatggcggagggtgaggatcagagcgggctggcggacaagctgaagtcggccctggacgccctggggctcgccaacaaggcacaaccaaagaataattatgcattctggagtacacagcccgtatcgcagtttggcgaggaggccagcacctcctcggtgcgtggcgcttggggttagggaatggggtcttggcagacagccaggagagcaatgttttgccgcagcctgagccccttcctctcatgctccatgcagagtggtaatgggcccatcgatacgccgaagacggtcgctgacatccgccaggcaccaaacagcctgcctgacaagtgcgtggagggttggactggcagcgtgggcgcggccgcacccatcgcctgcttacagccgaagcctgcccgccannnnnnnnnntttggctgacagccaggagagcaatgttccaccgcagcctgagccccttcctctcatgctcnnnnnnnnnnggtgggggcggccgcacccaccgcctgcttacagccgaagcctgcccgccatgcgggccatatccagcatcagggctcactgccatccacccaacgcctgcaccgcagcttccattgggacaactgcgacattgatgacgacaagcagctgacggaggtgtacgacctgctgtgccagcattacgtcgaggatgacgagaacatgttcaggtgggtgcttgggggtgttgacattgtttcaatgcatgtgaagcatcggctcagagggcccaagggcctcgtgcgtgtttgcagctgggttggtacctgatgaactcagtgtcacgctgcgtgcctgctcggtggggactctatttgtgccagctccacatgatgtgagattctggcaccagtgtatacaagnnnnnnnnnntgtgcgggtgacgtgagtggtggtggatggagggcagcagggggagggagcgcggacgtgtgcatgctgagattcggcaaggctgactgcaccgcagcgcgattcgctggcaagcattgcagcgaggcaggcttcccacccgcctcgcctagcatgcactcggtgttccacggccccgtcccagcatcaccagcnnnnnnnnnngggtcacctctcctcgccctcctcccctccaaggtttgcctactctcccgagtttctgcgctgggcgctcaagccacccgggaccaggagcgagtggctgtgtggcgtgcgggtgatgtgagtggcggtggatggagggcagcagggggaggcagcgcgaatgtgtgcatgctgagattcggcaaggcaggctgcccacccgccgcgcctagcatgcactcggcgttccacggccccgtcccagcatcaccagcaccctcccacctgcacccgccctgccaatgcacctgacaggtccagcgggaagctggtggccttcatctccggcatccccatgcagacgcgggtggatgcacaggagctgcccatggtcgagatcaacttcctgtgtgtgcacaagaagctgcgacacaagcgcctcgcccccgtcctgatcaaggttggtcgctcgagggtgccaatgggatgtcaactttgggaggagtatgatgaagggcaggcaatgggaatgggcccccaggcttcatcagatgggacagcgctgcagctgtgtctgactagtcccagcaacggcagccccagccgctcagtggaaatcctctatcggctcccgcggagggggttgaggaccctgcccatgatcacgtttcaacccctcgtcagccgctcgcggacgacggccagcggcctccctgcagccaatgcgcacataccagtgcagacgccctcccacaccacctcctctccctcgcccctccgcaggagatcacgcggcgtgtgaacctggcgggcatctggcaggcggtgtatacggccggcgtgctgctgccgcgccccgcggccgaggcgcagtactggcaccgcacgctgaacccgcgcaagctggtggcggtgggcttctcgcgcctcgccccgcgcatgacagtggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgtgcggcccatggcccgcgccgacgtgccggccgtggcggcgctgctggcgcgccacctggcgcgctaccgcctcgcccccgtgctcagcgaggccgaggtcgcgcactggctcctccccctgccggacgtggtgcacagctacgtggtggaggacgagggcggcgccatcaccgacatgctctccttctacaccctgccctccagcgtcatcaacaacaccgagtacaacacgctcaaggtagaaagggggaaggggaggctcaggagtggggaggtgggagcgtttggaaggcgctgtatcagtctgtgtgcgcatggctcctcaccaggcannnnnnnnnngacacgctcaaggtagaaagggggaagggggggctcaggagtggggaggtgggagcgtctgaaaggcgctgtatcggtctgtgtgcgcatggctcctcaccaggcatgccccccctctgcggttggcttgtggacagaacagggaatccacacgcatacaccgacacaaccagccgcaatcgcgtggacctcgtcgctccacggcagcaccgctcaatttccctccccctccctcccaacgccaggcggcgtacatgttctacaccgtggcggccaccatcccgctgtccaagctgctcaacgacgccctcatcctggcgcatactacggggcatgacgtttttaatgcactggacatctttgagaatggggaggtcctcagaggtgggtggaggtctttctggggcatggcggcgactggtcctgtcagggactcatgctgccagaacatgggggtgggagtcggggagggcagccgggtgcttctggtgggctcgagaaccggtccgcaccctggatccagcctgcatatgccgaaagacccacacttccacatatggaaccacttcccaatcacagacctcaannnnnnnnnnagggggtgggaggaagggagggcggccgggtgcttctggtgggctcgagatccggtacgcaccctggatccagcctgcacatgacgaaagacccacacccccacacatggaaccacttcccaatcacagacctcaagtttgggatcggggatggcaagctgcggtactacctctacaactggagggtgggcaagacgctggcacccagcgaagtgggcctcgtgatgctgtgaacaggcacggtaccaacccctccaatccggggggtgtacaagagatcccatggcagattcatttccgggtggtcttccgggatagctcaaggcgtgccgtgcctctccatccttccagcactgcttttcgaaatcccaaacctgctgagtgtagaagccttcgccgggagagcgaggtgatgagtggggcagaggccaccccgggagttcgtcccaacctcctcgtggcctgagacactggcccaagcgtgcgatggcgcgatcggtacgctagcgcggtcacgccaccagcccccagttctagggcggccgctcggggggccattcgcgcgtcccgtcactctgtgtgagcgggcccgggggggcatactcagtcgtcccgcaccagctgggaccctttgtgtcgtatcgggagtgtctgtctgatccaaaataccaatccttgtgcagtggccggcgcggggccgaggcctcggaggtgcctggcgatggccgcccaggcattcaggcctgcaacgcagggccagctgcgtgattggctggagggtcatggggtcccgaccgctccttatggccagggccccaccaagagcctggaacatctgctgaccgaggtcctggatggggagtccacactggggctggatgcgggggggcagccgcagcgccgtgtctcggtggtgtcggtggagatccgggacgcgcggggacggacgctcatcgaggcccgacaggtgctccccagcggtgctcagcgggcccgggccctgcccctgtccgagaagctgcttccgggcgaggcgtgggaggcggcagctgtgcgtggcgtgcacgaggagctggccagcgtgctgcccccctcccctcaggtatctctgaacacctgtgcatgcacctgctgacctggcccaggccagcagggcaggttttaggaggagaatgagcagatccaagcagatgcttcaatgtatagggtgcgtctttgctccacacccctgtgcagatcagcatcaagactgagagccacaccatgacggaagacaggagacccagcctgtcgtatcctgggcttgcaacctgctacatctgccacagagtagaggcagaggtccagggccttcccagtgaggcctttcgcacggaggagcagcgtcccgatggcatcctcactgctttctgggagtggatcatctgaagggggcgcatggcgatggcttggcaccagctccggcaactctggtggctggggtgatgtgagttttcaaccggaaccctgtgtgtccccatcattgtccaatcctgcatgtatatataactcaactggcaacgaggtttatcgggaccgcatgaagtttacctggtcgtgtcgtgcgatttcgaaataagtgcctcgatgaaacacgctggaatcgaattcggcggcatgaatcacatcgcaggtacccagaatgcaccctgttgcaagcaatagacgatcggggcgtcatagataactttaaagcgcttcataacttgtattttttcccgcgacattgggccctggacctccaagtggtggtcatgaccgcgatctcgctcaaaactgcagctgtcacggcaatgctggtgctcacgnnnnnnnnnntcccgcgacattgggcccaggacctcatgacggcgatctcgctcaaaacggcagctgtcacggcaatgctggtgctcacgcaagtcgatgcgcacggctacattgccgtccctgcctcgagaaacttcttgcataacaccgactactgccctcactgcctgaatgccggaggtaggtcgtgcaatctctgtcagtcaggctgatcagcagatgccatctcaactcctccacttttcatgtttaccagggacccgagccaccagcgagggtggtgcactgaggtggccactttcccgtcacggcatctgcggggacccttttgccggggagcgaaagcatgagtacggtggcgtctctgccaccggcaccatcaccgggaattatactgagggcgacaacatcaacattaccatcgtgatcaatacgagccataagggacggttctccttcagaatctgtgtcatctggaacccttccctggagctcaccgagctgactgaggattgtctgaacgagcacatcctggtgagagctgaatttggggggggtgagtgggaggggtggactggaatcaccgccgtccgtgcagagcctgggtgcaaaaagcgaccggttttctttcactcctccagttgatgatctgcatgccgatgcatcagtcgggtcccactctccattgctcccaaatcctgccctcgcaggtgcaagctgacgttccgggggctcagaacccaggaactgctcactggtatgacactggctctgacgccacaatgacctacaagctcccacaggggctcacctgtgacggtcagaccacacgatgtgtgctgcaatggtattacctcactggtgcgctcctggaattgcgcgggcattcagtcgtcccggggatgctctggggcactccatgcgggggcaagactgttgttgcaattgctgtcgacctccctccccgtgctgcaccctgcaggcaatacatgtgacccccccaacaccgaccccagctatgccagtctctggctgccgggctgtctggacgacggcgcctcctaccctgaagaggtaagcggtgtgcttatgcttgcttggtggcaggggtacaaggaaagcgctctgtacctatcctgaggcctggtgcttgctcatctgcttgagcttccatcttccagcacgctgttgccaaagtatatgcttctccctccccacacaagttctggaactgcgccgacatctccatcgcgccggcgtcctcagaaacctcctccagcacgtccagcccgacgtcattatctccatcgccagtgtcccaatggtcaaccccttctcccagcaacgattcttcgtccccttctcccaaggacgactctccattcccttttccgagcaacgactctccgtctccttctctatctgacacatcctcctccacttccccacctgaagtctccccctccccgtctccaggcatcattcccccctcacattcaccaggcaatgcctgatagccatttctacctatagatggcgcaccggcaccagcatggatatcaggaatctcttctgccgacgacatgggaagtatacttcactttcaggtttgcaagtaaagcaaatgcagcagccgtaccagctgaacttctcactcatttcacagccactgtggcccctaccccccttcaatctggcttccaaacaaagtggctgggcgtcaggaggatcatacaatgacctgagggctttgcgtaccacgccgccacagtacaactactgcacgggactgacacagatactactaacagccagatcgtaccctataccgcctagcctgcaccagatttgacccagtagctgcctgccttcgccggcttctgcagtgtacgtcatgaaagatgccaacactgtagtgttttattagtgtagatcgctttttactcccaattttctgcagagcacaaaataatgagtacttcctacatataatgttactatgcaagagatgttgtgaaacatgttttctatcttccggtatcagaccagtctaaggtgcagtattcgttgaataatctggagattcacacaggtacagtcacagttggaggctcggcgtagtaaaccatgtgtcgacagcagactgctgcaaacttcaaaattctcctgaacctacacatgaatttgcccatttggttattcacacatttcacttgcgcgcacttgtgtaccattcgccggcagagagactctcacctcgctgcgttcactgtggaaaagagccaagcgtcgcacgcaagaggactctttgccattgtcaccctacaggaccaggtgcctcgtctaggagttcatagttctgtgaacgctcgggctaggaggcaagttactcgtacatcaattttggcggttatcaagcaggttatgttgctgttctgggcagtactttcggcaacgcgaatctacgaggagaccaatccgctgccagtccacaacattggcaacatctggaaataatctgcaaagacaatgcaaaattgctgctacgcatgtgcatgtaccgcttcgtggcgtcggcgagaactgcatacattttcaccgcgttaagatgcataggcgtccctgttggtcgtgacgcgaggacgctgttggcaagcaatgaagcatcgcgtcgaggaattgattgtccagcttaccaccaattcgaagactacatgataagcataggctacggggcctctctgggaagctcattcgattatccaatcgtctgaacgattagccttccggagacccggtcgcnnnnnnnnnntaattcgaagactacatgacaagcataggctacggggtctcgctaggaagctcattcgattatccaatcgtccgaacgattagccttccggagacccggtcgcaggggcgcggcgccgagaagcggcacgcggggtttacctgaaaattgatccgatgtcgttcagtccccgtgcaccgcgccaacgcgcatcaccttacaccaggaactagatcgtgatgatccactggatcgataatggtgcagagtctgcacctgctttgtcacctgttgccgacgatccgaggggcgatcaggttggaaccggaagatcacgaaagaacaggcctcagtgcacgatttttaacaaattggacacccatagcgatgctttggaaggaattacgaaatattttattgatcaaaggaatagaaaatgggtggcatgggagaaattcgaggttggcgcggcctctggcatgaggggtagtcgggcaaagggccgcgggcatctgcagatgcaactctcatccggagctgggcgcgatgaaggatcacatctggtacggagaatttcgcatacagaacaatataccaccaaaataaaactcgcaatctcataggaatgagctgaccaaatcctgacagaggattgcaccctnnnnnnnnnnagggaatctcgcgtacagaacaatgtaccaccaaaataaactcgcaatctcataggaatgagatgaccaaatcctgacagaggattgcaccctgaaacatgaaattataatggcaaagggtatgctgacagatgttccataagcgtaatgcttgccaagcgcataattatcgaggcatgcggaagcatcgagtacactttgcccatttgttttgttgaaaggctgactgactgcaacattaagatggggaccacctgctgggccgnnnnnnnnnnaattggacatttgttttgttgaaaggctgactgacttcacattaagatggggaccacctgctgggccggagtggaaagagggtggtcctccggtcagtgcaccttccccccgtggagttagggcggaaacagatcgagatctctcgactccatataaaagagacctcgggatgcccatatccaaacaatcgccaaccgcccacatttcaagcaaggaacctcaacttctccatactggcacgttcccgcacaccacccgcttgatacattatcgtgagactttaacctcgcaatgcgcacttacgcgcgggccgcctcgctggtccttgcccttgccgtggctgcctgcttgctgcagcgtgtggaggcccatggctaccttgctgtgcctctctcgaggaatgccctgcacaacaccgactactgcaagcagtgcctcaacgccggaggtgagggtgcgcgaacctagaataaatggcgacgtttacacatcgggttcccaccctgtcaaacccttaacaccttggacaggaccaagcgcttgcagcgccggtgggtccttgcagtggccggctggtcgccatggaatgtgcgnnnnnnnnnncttacacatcgggttcccaccctttcaaacccttaacaccttggacaggaccgagcgcttgcagcgccggtgggtccttggagtggccggctggtcgccatggaatgtgcggggacccttacaccggggagcggaagcacgagtacggcggcgtctccgccaccggcaccatcaccgggacctacacggaggggcaggtcgtcaacatgacgatcgtgatcactgcagctcacaaggggcgttnnnnnnnnnnagcgccatcaccgggacctacacggaggggcagatcgtcgtcctgacggtcgtgatcactgcagctcacaaggggcgtttcatgttcagggtgtgcgtcattcaggacccaacctcggagcgcgcggagctcaccgatgagtgcctcaaccagcacatcctggtgagtggaatctagctccgtccatcccaggcaaacctcctttccctttcggtgtacacccccagggagtccattctgctcgggtcctgaggtcagtaacctgcgtgagggactcctcaccattcaagtggagtcgagagacctgtccaccacgtcacacccactctaaagtctaaaggagaccccaacccatccccccttccccccgccccctggactctggcttcccagatgcaagctgatgtggctggagcccagaacgccggcagcccctactggtacgatcgtggagtcggatcctgggacatggcctaccagctgccccagggtctcacttgcgatggcgtcaacacgcgctgcgtgatgcagtggtggtacctcacaggtgagggcagcactgggcggtggaaggtgatggaactcttgattgccctgggttctggggagatgcagggcgttgcggtgtgcccatcagtggcaaaagtcttgccgtgcaccggggacagcattcccattaccctccccaccctcgccacgcctctgcgccgcaggcaactcctgtgagcccccaaacaccgaccccaagtacgccagcccacagctgaccaagtgcgggaccaatggcgcctaccctgaggaggtgagactcgggtcggccctgcatgccagagcgctctgggtattcagaactcacaggggaaattggcccaacctgacgtcctgaatgaagcaagaccagtccaacactcctgccatgctgctgagatgatcgtctcgtaccccatccctccgcactcccaccatgcctctccactgcagttctggaactgtgccgacattgccatcatgcccgcctctcctggcacctcaccctccaccacaagcccaccaccctccaccaaatctcccaccgcttccccctcccccacctcctcacccccgcccccctcgtcttcgcctgatgcctccccctctcccagtccatccccctccccctcccccactnnnnnnnnnntgtcggccctgcatgccagagcggtctggggattcagaactcacagggataattggcccaacctcacgtcctgaatgaagcaagaccaattcaacactcctgccatgctgctgagatgatcnnnnnnnnnnaccatcaagcccgcctctcctggcacctccccctcccccacaagcccaccaccctccaccaagtctcccaccgcttctccctcccccatctcctcacccccgcctccctcgtcttcgcctgatgcctccccctcgcccagtccatccccctccccctcccccgaggac

SEQ ID NO: 45899 - DNA, 90 bp, Chlorella protothecoides
ccagctcacaggacagaggatcaccctgcaaccggtttcccaccaacaatcctattgttccccctcaggatgggagcctcggtcctacgg

SEQ ID NO: 45900 - DNA, 76 bp, Chlorella protothecoides
ggcggggggtggagaagggatcccacggcctcttgtgatcgcaggacagattgcccaagtttcagcggaagccaag

SEQ ID NO: 45901 - DNA, 62 bp, Chlorella protothecoides
acggtcagagcacttgtgctgccctgtccaatcttgacggccactacttgggcgtacgacgc

SEQ ID NO: 45902 - DNA, 65 bp, Chlorella protothecoides
gggtgctggggcccatgtgtctctgtgcatccactacactgtggccatccatgacgctcgtcaac

SEQ ID NO: 45903 - DNA, 38330 bp, Chlorella protothecoides
  modified_base (395)..(404): a, c, t, g, unknown or other
  modified_base (831)..(840): a, c, t, g, unknown or other
  modified_base (1097)..(1106): a, c, t, g, unknown or other
  modified_base (5345)..(5354): a, c, t, g, unknown or other
  modified_base (5723)..(5732): a, c, t, g, unknown or other
  modified_base (7353)..(7362): a, c, t, g, unknown or other
  modified_base (8748)..(8757): a, c, t, g, unknown or other
  modified_base (9598)..(9607): a, c, t, g, unknown or other
  modified_base (9904)..(9913): a, c, t, g, unknown or other
  modified_base (10066)..(10075): a, c, t, g, unknown or other
  modified_base (10609)..(10618): a, c, t, g, unknown or other
  modified_base (11055)..(11064): a, c, t, g, unknown or other
  modified_base (11686)..(11695): a, c, t, g, unknown or other
  modified_base (11872)..(11881): a, c, t, g, unknown or other
  modified_base (12514)..(12523): a, c, t, g, unknown or other
  modified_base (13143)..(13152): a, c, t, g, unknown or other
  modified_base (13840)..(13884): a, c, t, g, unknown or other
  modified_base (14304)..(14313): a, c, t, g, unknown or other
  modified_base (15424)..(15433): a, c, t, g, unknown or other
  modified_base (15683)..(15692): a, c, t, g, unknown or other
  modified_base (16866)..(16875): a, c, t, g, unknown or other
  modified_base (17691)..(17837): a, c, t, g, unknown or other
  modified_base (19746)..(19755): a, c, t, g, unknown or other
  modified_base (20517)..(20526): a, c, t, g, unknown or other
  modified_base (20900)..(20909): a, c, t, g, unknown or other
  modified_base (21322)..(21331): a, c, t, g, unknown or other
  modified_base (22154)..(22163): a, c, t, g, unknown or other
  modified_base (22478)..(22487): a, c, t, g, unknown or other
  modified_base (22996)..(23005): a, c, t, g, unknown or other
  modified_base (24082)..(24091): a, c, t, g, unknown or other
  modified_base (24507)..(24527): a, c, t, g, unknown or other
  modified_base (25274)..(25283): a, c, t, g, unknown or other
  modified_base (25790)..(25799): a, c, t, g, unknown or other
  modified_base (26099)..(26108): a, c, t, g, unknown or other
  modified_base (26593)..(26602): a, c, t, g, unknown or other
  modified_base (27062)..(27071): a, c, t, g, unknown or other
  modified_base (28186)..(28195): a, c, t, g, unknown or other
  modified_base (28495)..(28504): a, c, t, g, unknown or other
  modified_base (29101)..(29110): a, c, t, g, unknown or other
  modified_base (29549)..(29558): a, c, t, g, unknown or other
  modified_base (31496)..(31505): a, c, t, g, unknown or other
  modified_base (32195)..(32204): a, c, t, g, unknown or other
  modified_base (32546)..(32555): a, c, t, g, unknown or other
  modified_base (33555)..(33564): a, c, t, g, unknown or other
  modified_base (34938)..(35096): a, c, t, g, unknown or other
ggccccgcgtcatccgcgacagcgggcccagcagccagaagggcgcggccggcgcggggcgcggcgcctcgccccacagcagccggtccacgacctggagccggcgccggcggtcgcgggccagggccgacgcgcggtcctcggccatctgcgccgcaccgcgggcctgggaagaaaggagggagagaggggtcggggtgcaggaggagggacgcggggtcatcaggcgtgacatcagatggagaagacgacgctggcgagggaggcaccaacacagcttgtgaggcaggcagcgggggctgcagatcacgaggggcacaacactaggtccagcccagcaggaatccaggatgacccaggcgtgcagtgctgctgcacggggggagcttcaggcnnnnnnnnnntaacactaggtccagccccagcaggaatccatgatgacccaggcgtacagtgctgctgcacggggggagcttcaggcagcgcggccgctgaatgcgtcccgaccgccctccccattcctttcccccctcctacacacacacctcgggcatgcgcagctggcgcagctccacgctgatcccgcgggcgacgacgcgaagggggcgggtgaaggagggcaggtccagctccaggtggcgcagctccgcgctgtgcagctccatccccgcggccgacaggccccccagcgccgcgccggacaggtgtaggccggagagccggacccctgtggattgcaaggatttggggaggggggcagggtgacgagcgtgagcaggcctgaccaacagagggcccgaaggcccatgcaagcccatgccaccctctcannnnnnnnnnaggcagggtgacgagcctgagcaggcctgaccaacagagggcccggaggcccatgcaagcccatgccaccctctcagaggcctggctagtcttaacatcaagccctgacatgcccatccggtaggaacagggccgcatcaccctgacaggctgcccacctgtggctgtggggaccacatttagcttgggctgctggggctccccagtgtccagcagattacgcagtaggcggtccaccacccccgctgcgatgcggnnnnnnnnnnaaacatcaagccctgacatgctgatccggtaagaacagggccgcatcaccctgacaggctgcccacctgtggctgtggggaccacatccagcttgggctgctggggctcccccctgtccagcagattacgcagcaggcggtccaccacccccgctgcgatgcgggagcgcacgtggaagcgacccgagaagagccagaaggcgagggtggacaggagcaggctgcccagcagccataggagggtgagtagcatggcactctgcgctggctacactcccgtcaacagcaagaaccccgcatgcagcccggggcatgcccggaatgaaactatacagagcatcgtatctggtacaagggaatgaatgtaggagatgaggctgtgcagaccggggttgcagtggggtactccccgtcccgtccgttcgtgcgccgaaagctagagggtcgttctggaccccttcctgcccgaacaacgcggccgatgttttgctgtcttgctgctcgaatgtattgatgtatggagagggttcgtacaggtgtctagcaaggcctggcgatgaattgctatgtacgccattcggatgggagcgggacttaaatctgatcgggggcgcagtccctcaccaattcgacgtgccctccccgaaggaacctgtatgtgcgttcataacgagtcagcaaggagcgtatgcagtctgataattcggcgattaaaaactgagtaataatctcgtgatcatgagtgcggctggaccggtcaccaccgccatcgccctcgacaccgagttcgccaatcgaaagatctggctggtcaaggtacagggaggtgggggtccaccgagcgggtgtcgaaacaaggtgcccgccagtcactccaacccctatccaccccaacccccctcaaggtcccaaactttgtggcggagcggtggagggccgtgtgccagaccaatgcccatgactgtggggaccccgtcggccccgagctgggccagatatcggtggacaagcctgctgccggtgccaaggaggccagcatgcacctgagcctcacccactccgacacggagggcctcccaaagaccttcctcatgaacgtcgccactcaaaacatggccagcatggctgcctttgcccagaccgggccctgcagcgtctccgccgtgggcagggtgtttcagaagtttgacgtggtcgtggagcggggcgccgcgggggcttccacctccggagcggacggggtgatagacccagagtaccgccagttgtcacgcatgcgcgccaaggctgcggccacaaagtcgcgaacgacgcagctcatcagccagccgcagtttaccaatcttcggcaccccatgcacatcggaaccacaaagaagagggtgcgcagggttgatgttattgttggctgggtcatgattggagggaggcctgctcggtggcgaggttctgctgcagggtactggctgcaaggaggctggctctgccatatgatggcgttagcacagacacccttcaatgggccctgggcaacactggtgaggctgcctgcaatgcggaacagctttgatcagctatgtcccatgtgcttcattaggacccgacggagaagcgactggccaagccggcagaggagctgactgccgacctcttccggctctttgaacggcaaccgcactggatattcgcccagctacagcgccagacagagcagccgacgcagcacctcaaggtgtgcggggggagcgtatgggtgaaggggcgggccatggggtcacaacgctggcaggcttgcacagaaaatgccgctgcgcaccgattccatcgcgctcaaggttgcagaggggcgtacacaagatgcaatacccactgcatctcacattgtgccctgcaggctgttctcctggagattgctgtgcagaacaagaggggaccctacaaggacatgtgggagttgaagaaggggtatcgactcaccggtgatgcgtgagtgcatcttctgttcttgtgagagagtgcacccatcaccactcggagaagcatggaccaccaacaggcccgacagatctgaatcactgctgttgacacgggcttggcgcccgcgcgctgggtagggttgtgccgagaatcggggcaggcgcatttgccggtatacgagagcggctgggtccacgtggtaaacccacggcggtagagcgcgaatacgtcgcacatctctgctacaagtcccacgctgtgtgcggtctgggcatcactcacatcgcccttccccgtccgcccatagaccaaggtgcgaaaccttgacaaaccctcgcgcccctcggctggccatgcctggctcgcatccctacatctgacccatgtcaagcccaatcctcccaggcccacattccctccctcggcgcaggtcggccatgccaccccccggggcctgcaggcccacttacgtaaggccctgatgtctgggacccccccacacccctcgccccccggcgtggtgcgcacccgggcgaccctggacccgggtgggggccatgaggggttcaatccccgcgccatctccatcggggccagcgtggagtccctgtcctacagcgtggacctcaaccgcgtgggcctgcgggcgatgcggcgcgacgccggcgcgccgcgccacctctacggctactcgggccggaccctgatcaagctgctcaccaccgtcacctcgggcgtgctcatcggcctcaccgccgtcgcgctgggcgagtccatcgagagcctggtcctgctccgcaacggtgcgctgaaagcgctgctgccggagcacggcgcccggggcgccggcgccttgcgcgccgtgctcccggccctgggcctgcagctggtcgtgtccgtcgccgcggcggtaggcgccgcggccctggtgcagctggtggcccccaaggccgccggcgcgggggtcacgctggtcatggcccacctgaacggcaatgacatccccgacgccctcaccgcccgcacctacgtcgtcaagttcctgggcaacgtggccgcacgcgtggcgggcctggccctggggccggaggggcccatgatccacctgggcgcctgcgtcgcctcctgcctctgcgccgctgaagaccgtacgctgagggggggagcgggctgggatccacgaagtaggatggtgctgttcccagcaatgctcctccagacctggccggaagtcattgttggagcagtctggccgtccccccaggcgtcaagggcggctgccaccccacgtcaacacgcccctccccagtcaacacaacagaccctcacacctcttcccccacaggcttctggacgcacgcgtcgcgcccctccgtcacccgctcccgagccgggagcctggccctggaggcccccgcgtcgcccggggaccgcggcggcgggcagagctcgcaggagggcattggcgtgccgagcggcgcgcccgggccaaacgggtacgagcccctgccggccgaggccaccccgcggcgctcctcgccgctgcccccgcccccccgcgctggggtcgagggaagcgtcagctgcgacccgagcgcacacggcagcgccggcacgcagtccaccccccgcgccgccagcctgccgcgcctgtcctcgctgctggcacagcgccgccgcccgcacggcgtgcccttcttcagcaacgcggaccaccgcgagatggtgtccgccggcgcggcggcggggctggcggcggccttcggcgcgcccatcggcggcgtgctcttctcgctggaggaggcctgctcccactggtcacgcaacatcggctggcgctgcttcctggccgccacggtggcctccttcaccctctcccagctccacccccgtggccgctccggcatcctgggcttcggctccatctccgcgccggacaaccgccagtggctgctccagctccccttcatcatcctcgtctcggccctgggcgggctcatgggcgcactgttcaacaccgcgcgtggctggctggcggggtcgcggctcaaggccccgcgcggcgctacgccggagcgcttgctggaggcgggcctggtggcggccgccaccacgctcgccacctttgcagtcagcagcctgtggggcacgtgcgttgttgattcattccttccttggggggagggggtgagggggagggttggggtccagggtcgttttgtgtgtatacggggggggggggggcaatcgtcctaaagcagnnnnnnnnnncctttcttttcaggggggggagggggagcgctggggtccagggtcgttttgtgtgtgtaccccggggagggggggggagggggagggggcaatcgtcccaaagcaggcttgtgaggccggtctggcgatgcagccgcccactccagatctcgatgccctgccacacgccccgggacccattgtcatcctctgggctcttccaatcctcttcccgccacaaccctcgagcaggattctcaccatcacaagtcttactgccccctcccccctcttgcgagaccactcagtggacaccctccccgcaataccccctccgtccactacccaggtgcctgaccgtgcccaaggagtgggacggcgcgctgctcnnnnnnnnnnccatcctctgggctcttccttccctcttcccgccaaacccctccagcatgattctcgccatcacaagtctttctgccccctccccccctcttgcgagaccactcaatcgacaccctccccgcaataccccctccgtctatcccccaggtgcctgacggtgcccaaggagtgggacggcgcgctgctcatgcagtacacctgccccgccgggcagtacaacgacctggccaccatcctgctgtccaccagcgtctacgtcatccgcaacctgctgggcatgggctcccgctcgcaccccgtccccgccgcctgcggcctggaccgtccctgctacttctccctggccagcttgtgcattgcctcggcgctctacctggtcctcatggtggccgccgcctccaccgcctcccccggtggccttttcatgccctccatcatggtgggcgccacgctgggcggcgccgcggggctggccctgcacgccctgctccccgccgacttcggcatcaagcccggcatcttcgccatcgtctgcgccaccgccacgctgggcggcgtcttccgctcctccatctccctcgtggtcattgtggtggagggcacgcagggcatcgagttcatgtttggcatcatcgtggctgtggtcatctccaacgccatctcccagctgctgaaccgcgacgggctgtacgagggtgacctggagcgggacggcacggtgttttacctacgccacgagccgccgcacccgctgcgctacaagaccgccgccgacgtgatggccagcccggtgctgggcttcaacgcggtggagtcggtggcgcgggtgctgcaggtgctccagcgcagcacgcacagcgggtttgcggtgtacgatgacagcagcggcaggtggggggtggttctgtggtggggagttttgtggggcagaccccaggcctggggacagccgtgcatgatgcgctgcacgccctgctcccccaacacacccacaccgttgaggagtggacaacaaaacccacaaaaacccacagggacccgatgctgggctcggggcggctggcgggcctgatcacgcgcacccagctcatggtactgctgcggtaccgcgtgtactgcgacgcggcggggcggtacctggaccccgtccccgacccggtcctgctggaggagtggctggcggcggagatggccgcgcgccaggccgcgcggcgctcctccaactccctggtccagggtgggcggcgctcggcgccgcaggtgcgccgccgccggcgctccgaggatcggtcgggccgcggcctcttcctgcggcgcgaacgggagcacgcgtgccgcccgggcgacgccgcggcccgcgcggcgcagtacgccgatcgcctgcccagcatgttgatggaggaggccgacgcggcggcgctgctggcggcgctggagtcccagggcgtctccgaggcgccctccgaggccgaggacggggtcgaggcccacagagggagtggcaggggcccggcacgcggggcgagggcgggtgacagcggaggggccgggcgagaggcgcttggaggcgacggcggagcggcggcccgggaagcgccggcgggtgcaggcgcgccgggcnnnnnnnnnnaccggcacgcggggcgacggcgggtgacagcggaggggccggacgtgagctgcttggaggcgacggcggagcggcggcccgagaagcgccggcgggtgcaggcgcgccgggcttccctcgcctgcccaccgccgggcccccagaccaaaaagagtgggagtacgcccccagccgccccggcctccgcccctcgccctccaccgttgaggtgctggcccgcgccgacccgccacagggcgcctttttgaacctggaccccttcatggcctgcgcgccgctcaccgtgcgcaccgccacgccggccaatgaggtgcaccagctgttcctggcgctgtcgctgcgccacctgccggtggtggaccggcgcggcatcgtatggggcatgatcacgcgcaaggacctggaccgcgcggctgggcgtgggtggtggaggtgggtaatttctttctttctttgattttttgtattttgttttgggggatgggggccatggcgagcatccagagggcagggcaccgagagctgcggtcggctgtccctgcagcctacatgcatggtacccccctgcagtccacaaccccctttccctcctcactgtccctctctcaacccccagggtcaacaacccgccggccacgccggagctggggtcgcccctggccgtgcggcggccgagccccgaatccccgcgcaacctgctgtcttccctgatgcgccgcccgcggtggctgctggacgcgctgacgcaggacgcacgcgcgcgcctcggcctctcccggcactcctcgcccgatgccacggacgacgaggaggcgccgaggcgcgtcaacatcgtacgccttgctgcgaatgcaaacggcgagcacagggggtcgccgtttgcatgaccaggtgcctggtgcccttcctcccccgcctcgctggagtgtgctatgctggctcccagtcccaaaccctgacagttttgccgatggcagcatacccggctgtacatcggcccttgcctcttttcccaggcccttgcctgcaaactgtgtataccccttttcatctggagtggcaaggtggcacagggtgccatactgttcccccccaaacccatcatactcgtcacctctggtgtgtcgccctgcattccataaataccccgcctgaattcagaggtgcccaagagtggatgcatgggggtcacaggtacctagccccccctgcagtacgcagtcagtcgctgagcaggcaagctgcctccctttcatcttggcgctgttgaatggaacaccccgcctgactgccgcctggcgtgtagcccttatctgccaaactccttgccgggctttaattcaacttacacatccattcacgcgcggtgctcaaaggggagcaggnnnnnnnnnngagctgcctccctttcatcgtggcgctgtcgaatggaacacgccgcctgactgccgcctggcgtgcagccctcatctgccaagctccttgccgtgcgttaattcaactcacacatctattcacgcgcggtgctcaaaggggagcagggcgcagccctgcctggcggacgccagcaccgcgctcagcacccgctccgtcagcgccgcgatgcgcggccaatactccggtgcgcggccgccggcacgcacgacctcgatctcgcgcgcgaagcgctgccagagcgctgcctcctgcgtcactgcgttcctcaccgtccgcgtctcctccaccgtggcgatacgggtgtcgccgtcggccaggccgttggcggtggccatgacaaaggaggcctcgtgctcggcggtggggatgacaaagtcccgcaggcgcagcgacccccggtcgccgtacacctccagcttggaggtgaagacggtgtcgaaggccgccaggaagcgggccttgcgcccgccggggaagagcagcgtcgccgcgatgttcagcggcacgcccgcctcgttgaacagtgcgccgtggtgggcggccacatgggtgggcggcgtgaagtcgtacgcccacaggatggcgcgcacgcagtacctgtgagggttgggtgtgtgattaaaggggtttgagtgactttggggggggagagtgcagcgtgtgggtgaccacggctgtcatccccagactgagccagttcgtaatacgaaggccccgcagccggcggcggaatcgagctccgagctgcgtgacatccgcaagattgggcactgagggtcgagtctgtgcacaccccgtnnnnnnnnnnatgtcatccccaaactgagccagttcgtaacacgaaggccccgcagccggccgcagaatcgagctccgtgctgcgtgacatccgcaagattgtacactgagggtcgagtctgtgcacaccccgtccctccctcctgcaatacccaccagcccacgtcgcccagtgcgcccagggggtcgccgtcggccttgacccgcacattgttctccaggaagtcagcgctccctgcatgggtggtgcaaaaggttgcttgcacatactctttccagccgcaagcttaggagccggactgtcaannnnnnnnnnattgctcagaaatactctttgcagccgcaagcttaggagccggactgtcaattgccagtgctccctggaggccgcacaaagcatgccgtcagcacactgcgtcatccccagcccctctgcaaccccgctcacccttgaaggtgaaggcggaannnnnnnnnnccacactgtgtcatcccagcccctgtgcacccccgctcacccttgaaggtgaaggcggaatccacatcccacaccggcccgatctcctgcagggcagcctccatggctgcggtgcgcggatggtgcatccacatggtgccgtcgaagagcaccacgttggcgtcggccgccgccttgacgatggcatccacatgctcgtcctcgatggcgatgggcttctccagcactatgtgcaagcctttgctggcggccttctgcacccattccacgtgcagggcggtgggcagggggatgtacacggcctccacgcccgggaagtccagcacggcatcgtagccagccacgggggaggcatggaccagcttgttgcgctcgatgaaggcagcggccttggaggcctcacggctgccaaccacaattactgaggggggcccaaggggtgcgagatggtcacaatgtaacccaaacccaagtacgaacttccaaaagaggatttacatgatcttgcaacatctctacctaggaaggcgaacnnnnnnnnnngtaaaagagaatttacatgatccttgcaacatctctacctaggaaggcgaaccttgcgcgacgtcgggtatggagttgatggcccggcttattttgttggcgatgttagcgccccctaggatgcccaccttcagcaccatggcagtcgagtgatgggttttcaatttggaatgtgtcgatgaggagaagagagtagggtcatagatctgtgggcgactgtgatctcgtccaggcccggcttccagatcactccccagcgtcggatccggttgggacgcctctcttcacactgtccgctcctcctgctggcccaccatgcacatgctggacaaccacgaccaacagcagagacccacccacacttttctatgagaggtagatctacttacaacatgggcaacccaaatgctcagttccatggagagacaggcagtggnnnnnnnnnncagatctgcttactacatgggcaacccaactgctcagttccatggagagacaggcagtggctggacaaatcatacaggaagcatactgctcaaacttggcacacatgaacagggtcctgcactcttgcaagcctgcggccaccccacgggcgacacaccttgcgccagcgtcgtgacccccggagctcaatttcttccctctcagcgatccagacgcaggtcggtggagctcagcttcccgcttgagctatgctggcccctcaccagacccaccaccaccaccaccagcggggcaaacccgcgctccgcccgcccggcgttgatggcctcagcgccgtgtatcgtttcctccgacaccacgatggcttcgaagctggggtcagtggtggccagcggaggttccttcgggtccagcagggggcccgcagtcacccggaccccagggtgggttgcctccatgtagcccacggccgcgccgctcctgacttcgtacgcctccagccactccctcccctgcttgttcaccagcaggcggtccgctgcagggcggcagaaggtgggggtgaggggacgcggtggatgccagggatgggcctgggctccacggcccaagcgccaccannnnnnnnnngggacggcagaaggtgggggtgagcgggacggtggtggatgccagggataggcctgggctccacggcccaagcgccaccacagcgggatcagatggctggctgcacagccgccataactatgcacgggtacatcacccacagacagacccggacccccatgcactcaccagtgatgnnnnnnnnnntaatatgcatgggtacatcacccacatacatacccggacccccatgcactcaccagtgatgcccacgaagatctccgcgctcgcgaccgcagcggtggcggccagcagcaggcggtgcccggcgtggagccggtcaaaggtgccccccaccgccacctttttgaacgacagctcccggtccagggcagtgcccggctggccgtggatgcgggcctgagcgccgctgcccggcgcgcacatgccggaaggggacccgatgggcgcggcggcttcctgcgagccgacctccaggaacaggggctccacgcccagccccaccgcccccagcgactggagctgcgtcagcagggcgaggcccatctgcctcgcaggtgctgcggcgtgcacggccatgccccgcagatccgacctggacgccagtttctctgtgtcagggacgcggcatcagaggggtacggcgttggactgcgagatgcaaatgcaagcctctgaagaagcacatagaaatcatagaggaagagggtccctgtgggtccctggctgcctaccaggggtccagccgagccgaggcatgagtacacagacggacagctggggagatttccagccgacggccgcaaacaagtctttcannnnnnnnnnagagtacacagagggacagctggggagaactccagccgacggccgcaaacaagtctttcatgaagtccagggtagcgagcgtgacagggtccctccccaggtgccctttgagggtataagaggggcgtgtggttcaagctctgggtgatgttgtgagaggttttagcactgggattactagcacttgccatgggaaggtgaccaggcacatgcactgtgcgttatattattggccagcatgctgcaccctggtgttaccacccccatgcagcctgaaattcatgcacctgtatgatacaccagcacatctgcgaagcccggctgtagggcttctcttgcaagctccgcaacctgccaggcaggctcgtcggcaactgggagcaagatggccggcatggctgtagcagtgagactctggccctttgcagaaccggcgcgccggtgtcgctttcctggggaactgccgggaaatatggagcagtaccgactgctcggcctggccgacgtcacggccttgacggcatgacggaccacccctgctggcgcatccgtaatgaagaggtgatatttagcgaggactctttcccgatgcaagaaaagtatggtctggtcgctgattnnnnnnnnnngatgaagaggtgatgtttagcgaagactctttcccgctgcaagaaaagtatggtctggtcgctgattggccgtagtgaatatgtcgtgggcggtcccggcaaccccacagatgacgtggcagatttttgaagttttgccgtatgtcgtgcacgaatgagcggcagcaaatggcccaacaggaaaggcatacagccagctgcaaagggagcatcttcaatgtagaaaaggtccaagtgatacactgtcgctttgaggaggatgaccacggatcctccctccaaacggggccggtctgaggctgtcacccatgatgccaacgaggtcatcgagcttgtcttcgacgtcgggatggagtccgaggagcaggcgtacaacccggacatgtgccaccagtacgtcatgaaggcggcagagcctgcggaatgcgaggagagtgccaggtgcagtcccggccatgcgtttcgattacctgcccttcccatgcaggctattcggcgaggaggagctgatccagggccaccccgagcctgccataaccctcaagctgtctgctgccttccatgccctcctggaggtcgactctggcggcaaaaaggagccgggcgcgacagatgtggtcgggcctttcaaggaggcgttcagtgatgccctcttcacggacgaggaagccttccaaagggctgccgnnnnnnnnnnnnnnnnnnnnnnnnnnnnnnnnnnnnnnnnnnnnngctggccagcagcatcgccagcgccaccccccagctcaaggtgcgtgcagggaggattgagacatgggtgtccaacatcatcaaacagccgggcagccggggggcctccagggaagctcgggttgtgtgctgacggcttcatgatccccccttcaaaacatatgcactcgcaggccctgcacgcccgcctgcagcccctgctgctcttctacatcgacgccgccagcatgatcgatcaggaggacgacagctgggacctgatcctggccctcgccgagaccccgggcggccagcgcgtggtgagacgcggtccttgctcggtggaaatgcgaatgttgcgtcagcacctctcaggtctgcgtgatgtcatgcaggccaagcctcacgcaaggcccccccccccccccccccccccccccnnnnnnnnnntatgatatcatgcaggccaagcctcccgcaaggcccccccctgccacccccccaaatcccaacaggcggggtttgcaacgctctactccttctttggctggccggacagcaaacgcatgcgcctgagccaggtgttcgtgatccctgctttccagaagcgaggggtggggcgggccctgctggccgccgccacggtccacgcccaggcggccggagcgctggacatgacggtgcggctggtctcgtggtaccccctggcatgctcgtccggctgggactgggctctgacgccgaggggtggcaaggggagctgcaagtcccgataccctgcattctgtttgcccgacatgttggccgcagcgatgaggcccatggttctgtgccaggctgctgcctgcagcgagttcctgtgttcagctgcgtcccgtggctgggatcccttcaacgcacattccatgcccatcatcctcccacctcacagtgcgaggacccgaccgaggacctgcagcgcctgcgtgaccggttggacgtgcagcgtgcacggcatgcaccgtggctgctggaagcggccaggagggtgggtacaggggcgcttgaggttcagccaagggtggtgtagaagtgtgtggcgtaaatatcagctcaacgtttctgacccatgtgcgtgagatcgaattgcacgctctgacttcctgcctctgccacaacaggtgtctggtctcgcacctggggccacaacagccttggaaggcaagggtgaagtcggcgaagggcaggcagccttccacaccaccatccccgccgacataaccaagcgcgcgcgtcaggagctgtgcctctgcaagcagcaggcgcagcgggtctgggaggtgctgctctacgagttcctgcgtgatgccaaggggcaagacggggcagaccgagccatgcagcaagccatccggcagaaactgtcgaccgccatctctgcggccgagaccggctcgaaaggtgaggctcctgtgagcaacctggacatctcaaagaaccggctttggtctgctgtactgttcagagcagtgccacacacactgctccctaccaccctccgccgcaggcaaggtcacgcagnnnnnnnnnncctcaaagagccagctttggtctgctacactgttcagagctgtgccacacacattgctccccgccaccctccgccgcaggcaaggtcacgcaggaaacggagtccggcttcatcctgcacaagcggcggcggcgagacgcagggcctggcgtcggtgggaggccaggaaacccatgcgtacccgtagaggaagggtccgccgaggccaaggctgcggcggtggagcaggccgtcgaggcgcggctggatnnnnnnnnnntgtcctgcagaagcggcggcggcgagacgcagggcttggcgtcggtgggaggccagaaaccccatctgtaccggtagaggaggggtccgccgaggccaaggctgcggccgtggagcaggccgtcgaggcgcggctggatgccatcgcgagtgtggcgcagcggcgaggctcgacgctggcctgacggcggtccctgtgttgccattcccatggagtcttgccgatgcactgctgcagcgggcagacagcctgacgcagaggacaccaagcgccaagggtgaacaccaggcgctgcgtcctcccccatcgggtcgggcacaccccttccacccagtgccccctcacttgctcccgaacctgtaaaactgccatgcaggggtcttacaggggcacccagtcaggtcttgcccgaggatatcttgcagatgtcctcgtactcaaaggagcggacctcccgcccctccccctccagctcgacctcggcctggaaggccgaggtgtcgatgcggaccagcagcccccgccgccccgcgagccggccccgcacgaccagcacgctgccgcctggcgtggggatcacgctttccagctcctcctggtccacacgcacgatgtcgcctgcaccagggaggggtggattagtcatgggcctgaccctgctatgttagaggggtggttgtgtaatgcccagcatgctgggcaagcacctcctccccccagtcccccaaccccccctccctcgagcacccgcaccgctgctaaagagctccacctcgccgatgtacttgtccagcactcgcagcaccagccccttctccttgtagtacccatgcgccttcaggccggggctcatgaccttgaccgtgagcccctccaccagccaggcctccgtcttgcgcggcgggggggcggcggggccttgaccacggggcgggggctgccctgcggaccccgtgccccccaggcgcgacggggcaccatgagccttggccagcttgtcctggggcagcgaggaaaggcagggtgagcgccagggagtctgggacaacagctggcgcagggagagtgccgggtcctggtgctgcaacgccggcaggcctctcatggcagtgggctgcccaggaacctccaaccagggccccggtccagagagccgctgcacacctttgccatnnnnnnnnnnaaccggcaggcctctcgtagcagtgggctgcccagaaacctccaaccagggcccctgtccagagagccgctgcacacctttgccatgagctcctccagcttgctacgtttctggggcggggcagccgccctgctcccatccgcgcgtgggccccgccctgtcgcgtcctcgccgaaggcgaggggcaagggttgcgcctgggcccgggcctccgactgtcgcgccggggctgccagggcaaaggcgacgggcgcgtcgtcgagcctctggaggtcggtcgcgccctccgaggacatggtggcgggctggtcctcccctatgatcagcgggcgggcaactcgagctgggcacgcattgttctaatgttgatgagcaagacaagaacttgaacgaacgatctcagcgacagctgctgcttcgtgaccgcgtcagagagcggccgcccagcctatggcgcggagtgcacgttcaaagccagctctgcgatgacaagctctcaagagtgctgagcctggccaactccaagcgcccatcactgctgcgcaaaccatggaacacgccctgccgcgcctctcacctggctgactggccctggctcgggccacctgggcctcgagggctttgttgtggcgctccgactcttccagctcggccctttcacgcttcaggcgcttcttctccaacagttcctgtgccattctcggagcaccggaaggagttgacgatttgagagcaggctagcaggtcgccttgtctcggcatggagtacgcagccatcatccaatggagaccgcctcaagtcacagaagccactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcagcgtccttctggatgagggacatgaaccaccctttgggcgtctcatccacccggcagatgcccttcttccccaggtacttgacgaactccgtcagggtcagccacttggtggagttcatgtgcacgtgatgccggtccgcgatgaactcgttgtacaccacggtggcctgcacccggctgaaggggtgggcgcggcgtaggtgttccagaaaagactcctcgaactcctccgagtacccctcgatcacccggtccgggttctgcccaaatatctccatctggcgccggtgagcgtccgaggtgaggtggcacttgaagccgttctcatccctgcaggacttgccgcacatctggcagtaccaccgcagcttctggaggcccttggccttgatgcggttcgctatcgccttaggggtcaggaaacctgcgatgcgagggcggaggcgcagttatgatgaggacatagagtcaaaatgtcgcggaacacgcgagaccgggttgcgctccagctctcccgacacaccattcttccccatcctggctcagcagcgtgcgccagcagctgatcaggcactttcggccataatgatatatttccgtttgccgaacgtggagatgggggtaatgaactcaccgaggagccccttttctcgtgctggatccctgactgcaagattgggcgcgcgcgcggttcagcttctcgagaattcgtcgtcaccaggagcacaagcatgttgatcgcgtcagattcaagcgctccggcctgatcatgccagaaggacccgtgagaagtcctggagtgctctggatgatgttggttcgatacctacgtggcagggcccctgcttgtcagttccaggggcctgtgctcccccgctctgtggcgcccacatgatcctgacgggcatcaattacaggaggggtgggtgtcatacaggaaacaggtcgccgccgtgcagggggacaagaagtggtggatcaggggtctgagtcagctcgccagcaacaacaaggtctcggtctgtccgggggagcgaggggtccacacatgagtgggtccaagggtgttccttcaggatcacgagcgcgagcggcgcacccgcgcacggggacgaagaggtcgacgacggcgcgcgcgtcgaggctttggcctcgcaaaatgtgcagggcctcgcatcagacgcgcgccacggcgcaggacatggcggctgcggtccccggcagcggccccgagggcgcgagctgcacctccagggccgccacggccgccgccagctccgacagcatgtccaccaccgatgcggaggaccgtggccccaccgagctggccatggaccccggtgacgtggcgctgggggtgggcgccccgtccgtggccatgcgtgggggcggcgtgggcagcggccactccagcccacgcgcgacctcgccgctcgacaggtccagcggagggacctggcgccgagggcggcgccgccgcgacccctggccatcatctgccgtgccagggctgggaggggagcgggcgctgcttcccggcatcgagccggccaggaaggcgcgtggccgccgaccgatgatgagcgacgcctgggcgtcgtgcgcgcggcgaagagccaacgccggctcccgcaccctcgaagcacgcggcgaggcaccgctgctctggcgcgatgtagtcgggaggctgcctaggccggaaccgctcgccgcaggggaggcccccccaccgcccgagcgcgccgcggtctctgcagtccgaccgcgatgatactcctccccccgctcatcacccgtctcgccagccgaggagggatcggtcgagtccagcagcctccgcccggaccgagcgggcaggtgctgcgcgcgctgccgccggcgctgcgtcgtgtcctcggccggggnnnnnnnnnnacggtctctgcagtccgagcgtgatgatactcctccccccgcacatcacccgtctcgccagccgaggaggaatcggtcgagtccagcagcctccgccccgaccgagcgggcaggtgctgcgcgcgctgctgccggcgctgcgtcgtgtcctcggccggggagcgctgatgctggcgtccggagggccgagaggcggcgtggggcgccgaagccttgcctccttcccagtcggcagcgtccctgctttgcgaggcatgggacgccgtgctggggctggagggccactcggcgctcacacaggaactggagcagtctgccgcggcaccggcccgggccccgcgcgggcgcctggcacgtgccggcaggctcccggccgccgcctcggccttggcggcctgcagctcgcatgcgagcatggcgacctgctgctcggcggccagcctccgaacctcgctggcctgaagcgccgcctgcctggtcgccagctgcgcctccaggccacgggtcgcctccgcctggcaggcccagcgggcctccagctccgtcagctgcgctgacacggcctggaccagggccgaggcggagccctgcctcgatgatgccgtcgccagggcgcaggccgtggcagccaggcgaggggacattgaccgcgtccactctgccacctggggcgggtggggagaggggggcaagcggtgaagagttggaatgcggaactgagcaacaagagacaagagttgggtgatcggcaccaggggatgnnnnnnnnnnggagttggacagcggaactgagcagcaagaggcaagagttgggtgatcggcaccaggggatgcaggaatggctggccagctcatggtgagacgtcgctggatgaggcaggacccccaaacacatggggatccccatcattcagccagtagctcacctctgcgtctcgggaagcgagggctgcagaggcccgcttcgactcccgcttgcactcctccagcgacctgtgatgagaagagagctggtaagtggcacgagcaagacatccatgtaaccgcgagcacctagggacccagatcctgcaggcatcacctgggcatgccaccaacttaacggttgatcaggatgataacaacccaccccaggacccaccttnnnnnnnnnnacatgtaaccgcgagcaccaaggagccccgatcctgcaggcatcgcctgggcatgccaccaaccaaacggttgatcagtatgataacaacccaccccaggacccacctttggagttcatggatggtgttctggcgagcagccgctgcggtctggaaggctcgggtgcctgccagcgccatggccagctgggcagcatgctcgctggccgcggcctgcgcggcgcggaccagccccagcttctcggtctcggacgtggccagggacgctttcagggcgcgggcctgggcccggagcgagcgcagcaaggccgcgaggacatggagctgctgcgttgggtggatgccgcccgccaacctcctggtatctgatgggggaccgaccgtgtctgcagctggttcggcgttgggctcgnnnnnnnnnntgttgggtggatgccgcccgccaccctcctgatatctgatgggggacggacagtgtctgcagctggttcggcgttgggctcgcggcagggcgagcagacgctctctatcccagcctccaacatggacctagagggagaccaggtactattctaggtataaccgccgggagtcggagggatttgcgcgcagctctcagccaaccaccaacaagtccgtcagcacggccaggagctgatttcgtccagggcgcagcacaaacggtggttgggccgagatctgacgagtcattgggtatcgcagcccataattaggaacaagtggcgcgcccttccgccattggagaagccggactgttctagttcggagcgtgaaggcgcgcaacagccgatgggtgccgccagacccacgcgagtcatgtggtgggtgttagttatttggatgcgatgcgtcgttgccacgtcaagatgatgggcatagggtaaaaatgcgcaaagagatctcagaaaaatacaaactgttcggaagaaaggacagcacatggtcgcaagggaatggtggttgcaggaatgccaccgtgaacgtatattattacccgcaatgctctagcaagcataccatgccttggaggcacgatgtgaacatgacactgcaagtgtgctgacttgcccgatgttgtcagaagttgtgtgtctcacaagcggagtggttgcctgcagtttccacaagtgtaggttcacctgaccaacaaacatgctgtttatagaaaatccaactcactctgcttcctgccaagtcactgaggtcatggggacgtgctgccannnnnnnnnnaacaagttgtgtgcctcacaaggggagtggttgcctgcagtatccacaagtgtaggttcacctgaccaacaagcatgctgtttatagaaaatccaactcgctctgcttcctgccgagtcactgaggtcatggggacgtgctgccacatctcccagggcaagctattacagcattacgtaaccggaaattcgagtgtcggagctgccacatgggtcgctgctctccgtcacgccggcattctcctgaaacttggaacagttttcaggaacgtatactcaacagtaaattctgacatgtcgatcgcgggccaccccnnnnnnnnnngttatagcattacgtaaccggaatttcgagtgtcggagctcccacatgggtcgctgctctccgtcacgccggcattctcctggaatctggaacagtttccaggaacgtatactcaacaatcaattctgacatgtcgatcgcgggccacccctcgatgtcggtgtcgagggccaagatcagtagggcttcgcccctggcagggttcgagacaggtgagcgtgaagccctttcttgcttgtaccttggcagcaaccctaaacatcacatccagattcgcgctccctcatccacgatgcacggcagtgaggactccaaggtcggtccgctgtgcacagcgcactgcgatccatgccagcgggtccaatggcgcagctcctgcactggtgaggtcccaactcgcgcatctgtattcatattgtcacatcatatctcccgttgcgttccaagcaagctaggatgaagctgacggggcacaagcgtgggttgctgcccacaggtcaatggagctnnnnnnnnnngcatagctcccgttgcgttccaagcacgctaggatgaagctgacggggcacaagtgtgggttgctgcccacaggtcaatggagctgtggcctctggcccagacctgtcggtcactgtcaacggtttgaagctgccaaacccctttgtcatcgggagcggacctcctggcactaactatgccgtcatgaagcgagcatttgaggatggttggggcgccgtcattgctaagactgtgtccctggactcgtccaaggttggctggggcaccgggggggatgatggaggactgcatgctgttagatattactggcagtggccatgtctgctgtgcttgtgggccacaccggcagtcatgcggatggtgcgtcttcagtaggcaatccattgcggcagtgatcagtctttgtggatgcctgtgtcgcctcagtccagaaatccagcacaataaaaacacccccctgtcctggactcccaggtcgtcaacgtcacgccacgctatgcaaagatgtttgcccccggctccaaaaaggacgtgattgggtgggagaacatcgagctcatctccgacaggcccttcgagaccatgctggaggagtttaagcgactaaaggccgagttcccagacaggtcggggctgaattttgttccttgggtggtggcatgataatccccctccattccgactggcatctggagaccatgtggccagcaaagctcctcgtcctgtctacgcttggcccccacagggtgctcatcgccagcatcatggaggaggtcaaccgtgcctcctgggaggagatcgtggagcggtgccaggaggcgggtgccgacgcattcgagatcaacttcaggtgcggggggggatgggatggtgcactgtgccgcatcaggaaccgtgaaggtggcgactcgagttttgacatctccgcttagcctcatggtgccaggaatccctctttcacatgcaccctacaacccagttctcagcatccccttgccatcccactgtgaactgcctctcccagtaagagggccccgccctaccccctccctcaccgcccccccttgtcccccgcnnnnnnnnnnagctcccagtgagacgcccccccccctaccacctccctcaccgcccccccttgtcccccgcaacagctgcccgcatggcatgcccgagcgccgcatgggcatggctatgggccaggacccggacctcctctccgaggtctgctcctgggttaacgccaaggccacggtgccagtctgggccaagatgacgcccaatatcaccgacatcgcggtacccgcggccgccgccctgcgtgcggggtgcgagggagtgtccgccatcaacaccatcaccagcgtcatgggcgtggacctggccacgctgcgcccgcagcccagcgtgcagggccacacgacgccgggcggctattcctacaccgccgtcaagcccatcgccctggccaaggtgggggaaaggggtgggggaagggggtggnnnnnnnnnnnnnnnnnnnnngggtgaaagggcatgtatcacaggatggatggggaggggcctgggcaggggtgggctggcttctagtttgggtgggaagaaaagagtgcaggggttgggcaaacgtccgtccagcacggcctctgtggacgccgcggagctgggtcccttcgagagggtaacgtttcgaccgcctgtacgtcccgtcccaccccctctgctcataggtcatgtccatcgccaaggccatcgcggcggaccacccgggcgcctcgctgtcgggcctgggcggggtggccacgggaagtgacgccgcggagttcatcctcatcggcgcagacaccgttcaggtgggggccgggggggcgggagggagggctgggtgagtgggaggaaggaatcctgtgtgtggcgctgcccgttgccagccgagctgtcagtggagactgaggaggggcagctggggttccaaatttcgatctagcagcatcgagcaccccttacaagacccccaccttctcccatcatcaggtgtgcaccggggtcatgctcaagggatatggtctggtgcgtgacctctgcgccgagctgcaggacttcatgcggcagcatgacttcaagagcattgacgagttcagaggtggggaacatgcctggtgcctggtagggtgctgggatggtagtggccgttgcgcttgccactgtcttgccctcgtcaccagcgaggtcatggcgatgggcacgtctctggccccctgcgagagccannnnnnnnnnatggtagggtgctgggatggtagtggccgtcgcgcttgccactgtcttgccctcgtcaccggcgaggtcatggcgacgggcacgtctctggccccctgcgagagccatgtgcgctcccctcacgctaccccgcccctcatacgaccctctcatcccccccctacgaccacacatcatccacgctcacaggcaaggcgctcccctacttcaccacacaccacgagctcgtcaggatgcagagggaggccattgcggagaagaaagcaaagcgagtgggtctgtctcgcgacgatgactggtccggcgacggcttcgtgaaggaggccgagtccatggttgcgcagtgagcaggcgctcggggctgcgcccgtaatggggtgtgcatgggctggctccacggctgccttccagacgcctcgttgcatgcagcagatagccgggcccgtgaggtgcgcgagcgagcctgcacgacctcaagtacaccctttgttggtgaagaaacaacannnnnnnnnnattgcatgcagcagatggccgggcccgtgaggtgcgcgaacgagcctgcacgacctccagtacaccctttgttggtgaagaaacaacattacattgaggttaggaagacataatataaacagcgggggagagtgcgtgatagattggtatttgtggagctgggaaccctactgcccgagtcaagagaagtgctggtgagggcgccaggaccaggatgcgcgtgagcacatgacaatcacggaatttgcagccggcggtctctaccttgcacaaaaggtgtgacatcaccacttcactcgnnnnnnnnnnaaatcacagaatttgcagccggcggtctctaccttttacaaaaggtgtgacatcaccacttcactcgtactgcaagcctgtcggggcctgcccgctccggatgcgcgagggcatcactccccccggcttagcgccacagcctggggcgcagaggccaaggcagcgccgataacggcatcggcccgtcatggagcgcttcctcacgcaggccatgatagtgtgcttcatcctgggctcgtcgagggtcgcggctcagggctgcaatgagctgcaccccgtgaccagccccttcaacgagagcgcctggctgtcatgcatcgatggcgtggagcccgtggtctcggcctccacccctgatgccttgtatgacctcctctccaacctgggcgctgcggatgtgaccgtcgtcatcacgggtatgcacgcgatggcggtggtggtgatgggtccatgtttgctgggggctgcatccctgccaggcgccnnnnnnnnnnatggtggtggtgggtccatgcttgctgggtgctgcatccctgccaggcgccccaccgcgctcggccccgcgatgcccggccgccgctccatcgcccccactcctcccgcaccctcctcagctgacatgagcctctcggactgggccctcaaggccacccccgtcgtcgtgtcccagaaccagatcgtggtcctgcgcgccgagctgacctcgctgcccgacgtcacgcagggcctccccgccctcctggcggcgggtgcccgcaatctcagcctggcccggctccccggcttgttcgaggtgcagaccggcggcaccctggccttggtcggcctggtgctcacccacccgcccagcgccgcggcctacaccgccgccttcccggcaggcaccatccgtcccgccggcctcgacctctacccagcagtcctggccgacgaccgcgccgtggtggccacctnnnnnnnnnngggcaccattcgccccgccggcctcgacctctacccagcggtcttggccgacgaccgcgccgtggtggccacctcctacaccagcgtggactttgaggacgccgactgctcccaggctctgatcaacagcctgaccttcctgcgcggctccgcgctggcctccgcagacgcggtgggcgaggtgccgggcgcgcccacgccggcatactacaccgacgaggtgggcgcgcttaccctggccatggtcaactcaagcagcctcctgcgcctgcccgggcaattcatggtccaggtgctggggccctccctcgagtactgcatgatcactgcggacggcggcggcggcgacaacggcggcggagggggcggtggcgggggcctccccgcatgggccatcgcgctgatcgtcgtgggcgccgtggcggccgcgtcgctggccgcccttgcggccctcatcctcctgcgccggcggcggcgccggcggctggccaagcactgcgggcccgtgagtgccggggtggccgccagcgccggggtgcctctgggcgggaggttgcggggtggcacatcgtcgcgcgcccccccccctcgcccagtgcgcctggccgcgcccgacggtgggtgcgcgccatcggccgcgccaatcgccgccgggcttgccgcggagccctggccgggcctggggttccgagacggcgtcgaagagccggccccggtccccggcctggcctccctcgacgcccagacctgtgacgtagacctggacgcagacctgacacgcctggcggccctgcagtccacgtggcgcggggcggtggcctcctccctggacctggagttcctggagacgctggcgcacaaccgtggcgccacggtgtggcgcgggcgctggcgcggctcccccgtcgccatcaaggtggtggaggacccggcacgcgccgcggcgctggcggccgagggcgacctcatccagtcgctgagccaccccaacgtcgtcagcgtttacatggtctgcgccgcgcgggggttcgacctgggggccggagcggaggagggaggccgccccgaggcccgcgcagcagcaagggtcatcgtcatggagctctgcgaccggnnnnnnnnnnggcggaggagggaggccgccccgagccccgtgcagcagcgagggtcatcgtcatggagctctgcgaccggggttccctccaggactgcgtgcgggtggggggctgcggactctggggcgccgacgccgcacagccgaacgaggtcagtttgtgtatggaggggtagagaggatgccgaggtagtgtgctgccatggtacaagggggggtgggggggaggttcagagggtgggcgcatgtcggtccaaggatgtttgtggttccgaatgcagtgcctgcaagaggcactccccatcggcgnnnnnnnnnngtggaggggtagagaggatgccgaggtagagtgctgccatggtacaaggggggttggggagggggggggtgttcagagggtgggcgcacgtcggtccaaggatgttacgaatgtagtgcctgcaagaggcactccccatcggcggccagtacgatcccctcgaccccgaccccccacatctcccgcccgcacaggaggcgctgctgcgactcttcatcgatgtggcgacggccctcgactacctgcactccagcggggtcgttcacggcgacctcaaaacaggtgtgtgtgtttcataaggtccgtgctgatcggagatcccggacgctgcgattgcagcccatgaatcgatgtccatggtgtgggcgtggggatcagaaaaaccttcagaatgcgtcttgactgtctgtcgtcttgacatggttcggcccgggggttggaagctgctggcccgaccctcgcaggacccaccagcggcaccatgatgtgtcgtgcgactggggggctcagcagacccggctagaaacccccctcacccccccttccaccttccccgtccaggcaacgtgctgctcacctcggcagccaacagcaagnnnnnnnnnncggtcccagcagacctggctagaaacccccctcacccccccctcccacccccccgtccaggcaatgtgctgctcacctcggcagccaacagcaagcggggctaccgcgccaaggtgggggacttcgggtgcagcagcaagctgtgccagccgactggcagtgtcgaatgcgggaccctgtcctgcctggcgccggagattttcgccggcgccgctccctcccctgccgcagactgctacgcctttggcatcctgggtaggtttcggaggggggagggggaggagggggattctgtttctggtggtcctagggggggcttgccgtgtgggagccgtgagcagggctgaatccccgctacccaggacagcgcacctgccagcacacacctccctcgacccatggccgtggcctggggccgggcacgggttcccacgctccnnnnnnnnnntgtgtgggagccgtgagcagggctgaccccccgtaacccaggccagcgcacctgccggcacacaccttcctcgacccatggccgggccctggggccgggcacgggttcccacgctccgcttgccgcgtggtgcccgtgtgatgccccctcgatcgacccctggcgaacgccgccccccacacctgcagtgtgggaggcttggacgcggcgccgggcctacgagggcatgcccgccctgcagatcatggccggcgtggcacatgaaggcacgcgcccgccgctccccgccgacatgcccccggccctctcgtccctggtctgggactgctgggtcgcggaccctgccgcccgccccgactccctccagatcctgcgacggctcagggcccagctggcctcgctcggcgcggacctgggccgcccccgacactccctgccccacgtgtgagcctgctttggcgggccaacgctcttttcccaccgccaccccacgcgcaacgtatcccctgcatgcgggccccgcagcatgacgccaattttcctagctgtaggcccccggccttgccctgtttccagccctcgggcccctgctctctccaggactgctcagctgcaggtgggaaggccgcgcgccccaccccttccccaccttcccccaaacccatgtttccacacctccaaacttgagcttgctgaggctgtaacaacactgctcggtcactgcaacgaggaagggcgggcgaggccgttgaggggtgtggcatgctatggccgagggggccaagcaagagtaatctagaatgaaattgacaagtctgagcacaagggtgggggaatgcggggagggcagcagcaagggcacaggggtgtagatggggtgatcaaggattcgttgaggacggtgactacgtgtgagggatcctgcacaatgacagcggctgggggcgctgggcggacgtgtacgtgaggcggctggggacgccgagcgggcatggatgctgggcggctgggaatgccgagcgggcgcggatgctgggcggctggggacgccgagcgggcatggatgctgggcggctgggaatgccgagcgggcgcggatgctgggcggctggggcatgctgagtgcgggtaaaggcaggcatgccggcgagagtgccgacgcagcggattcgccgtccgttacgctgccgccatgccctgcgacgcgtcgccaccttggccgttgacggccgcatggccctcgccccccccgaccagctgcactgccacgcccgcgcctttgcccttgccggcatccgccgccacggcgtcggcggcgctggcgtcctcggccgccacctcgtcgacggtggctcccccgcccccgccggcggcagccaggttgaccccgatgccgcccgccgcctgctcgtccgtggcaccggcgccctccgcctcgcctgctgctccgccgaccacctgcccggcaccttccgcggccctgcgcgccgccaccatcctggcgaccgcctccacgccgctggctctggcgcggtcacgctctgactgcgcgtcgtcccgcgactcgcgctgccgtcgcgcgctcctctctcgcaggtgcctcagcgcggcctcccgccccccctccccgtccgcctgcccgacatcggcgctgtcctccaccgcctcgtcctcgatgctgccctccagagcggcaatctgctgcgcggccctctgcctcctctcgatctcctctgcggcgaagagatgcggggaggggtgtctcggtcggcctctcttcctccctgtcaccccccttgcaggggcccagcggagtgcccccccatcaagtcacagaccccattgcaatcccctcctccttccctgcaaccccccctcatccacccccccagccctcaccctgcgcagcgggggggtagtgctccttgatggaggccnnnnnnnnnncgcaggagcccagcggagtgccgccccatcaagtcacagaccccattgcagttcctcctccttccctgcaacctcccctccatccatcccccaagccctcaccctgcgccgcgggggggtagtgctccttgatggaggccgccaggccgtccacggggcgcgtgcagttggcagcgcgcgcccccacgtgccgcatcttggtgggcgagtcgatcttgtgcaggatgagccaggggtcgtcggagcagaggccgcgctcaaactccgggtccagcgcaaagcgggtgaccacgcgccgcccggcctttcgcacgggggccttgaagcagcagggcgctgcccaggtgtagaagcgcgggtggtcgatctggcgcaggtccatggccgacacccagaacccaaccgtcgcgtcctcgatgggcgtgaacttgagggacatgcgctcgtgggtgtccaccagcaggcgcgccacctcgccgctcagcacgtagccgccgcccatggcgtaggtggggtacgtcttcaggcctgcggtgtttgtcggggagaggggggtagcagagtcaagaaagggaaaacccgacgcgctggatgatgagccaatgtgtgtaccagggcaattactcaacatgcacactcaagtgcgcatggagcaggttcagccgtcggacggctgatgatcgatgccgnnnnnnnnnngggtgtttgttggggagaggggggtagcagagtcaagagagggaagtctgacgcaccggatgatgagccaatgtgtgtaccaggggcaatcacttacatgcacactagagtgcgcatggagcaggtgcagccgtcggacggctgatgatcgatgccggtcaggtgcagcaaacccaggcgcctccaccatgcaatccaaacaccgtatgctgcaggcagtggtcatgcagatcgccgaggaggggtcccgggagccatacgctcctgattccagggccctccgcgcagtcttgcctcccagaaagaacaccaccacccaccggtgtggttgtaaaagatgtnnnnnnnnnngagccaggagcctttatcatgcaatccaaacaccacatgctgcaggcagtggtcatgcagatcgccgcggaggggtcctgtgagccacacgctcctgattccagggctccctccgcgcagacttgcctcccagaaagaaaactaccacccaccggtgtggttgtaaaagatgtcgttattccacttgtgcccctgctgcagcaggacctccgagtggtgcgccatgcggcccatgtagatgcgctcgccctcgcagtcggggtgctcgcagagggcccgcagctgcgccaccaggggcgccacatagatgaacgcatcatcgtccgtcttcagcacaaacttaacgtcgtagtgtcgcacggcatactccagcacctacgtgagagtgaaagtcaggaggctcggcttggaaggtggagcagagggtgcgttgatggcttgtatggaaggacctatcataaggacatcactgcaggaagctcccaagcaggtgcggtcagtatacttgtatgtgatgggccggttctccctgcatgctcatgacatggttgaacatagacacgacggcatgcgcatctgcgctgccagcaagcccgaccccttccatccccaccaccagcgcacgtggtaggtcttgtagaggatgctcttgtagttcgtgcgttgccccacaaagatgatgtcctggaagctgtccacctccttctccacctggggtgtgcgctcgtcctccgacagcacgaatttggccaccaccgcgccgtgcctggtggcattactggaccaggcatcccgcaccgccaggcgtcgatgccggtacccccgccccgacaggatgccgatgaagaggaagaggggctccgccacgctgggccgaggggtctccccctcgacaacctccacctcacgatccggctccggctcttcgaagggcagcgtggaggacgggacctccagcgtccctctggccgaggggtccgttggctgccattggcccatnnnnnnnnnntacctccacctcacgatccggctccggctccccgaatggcagcgtggaggacaggacctccagcgtccccctgggcgaggggtccgttggctgccattggcccatgcccaccatccggctcctgtggaacatgacgagcatggtcagcgccatgaagatggtgggcaaccaggctgcgaggccataccggtgccagccgggtcgcggggagccgtttcgcctcggcttcatcccggccggccctgggattgggtcccgggcgatccgctatcaacacaattgtcctgtaaaaaggtgcatcccttggtatttgtatagatccaaggtgcgcgtcgcttgtgcgtgcgtgcggacctggggcgaatttgacgctccacaggtccccctccccgattcaagtttccgagggggtgcatggcgggaatgactttcgtgcaggacatccctcccagggttggctggtcacctcctacgaggcacgcatccccttgctcctcacactgattcacgatgcttccccactgtcctctccctccattcacccccccctcccacttccaaagcccggcaccgccattacaccaggaaggggctgtccagcacgccataccccgcggccacccccccctcatccgactcggcggccttggtccgcaccaggtgtcccgccccccggctgaccagcacctcccccccgcggcgcaccaggacgctgaagatgcccagctccgacagggtgtcggcctccacggcttccccgccccgcaccattaccgagcggttgatgggtggcaggatgcgctgcatcagcacgtaggctcccaggcccggccctccgcgctccagtcgcgcgcgcagctcggcgccgtacaggttgtgcccgccgccctcgcgctgcggcttgagcacgaaggcgccggggtcgcgcagcgcggcgcccaccgccgccgcggtgtctgggtctgccaggtcctccaggccccacagcccggcaaagaagcggcgcaccatggcggcctgcgcctcgtccggcaggaagcgctccacctgccccgggcgcgccaggtcctgctgcaccttcttggcccccgccagctggtaggccacggaggggcacttgaaggcgtcgctgcgctccacgcgctcgcgcgccgcccactccgcctcccccgcgtagtcctcgggcacgtaccccgcgcggaagtagaccacggcggccacggcgccgcccacgcgcaggcgccggtcggcgcccagctccgcgtcgcgcgccagctcgctcagcgtgcgccgcagcgtgcgcacgccgtgccgctcccacaaccgcgtctgggcccactgtggcaagggggtggggggtggggtggggtcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagtgatgtttggaccagggcccgcagacaggaaacacgaacagcagtcgcctgtgcttgacccctctcaggccccctcccagctctctggccccccccaccccaccccacccacccacctgctggtcgtacaggttgcgctccccgggctgcaccaccatgaccaccacggcgccctccacgccataggcctgcgccgccgcgcccagtgcgtccgccaactggtccagagcgtcgttggggggcagggcggcacgctcggcggcgcctgcgcccagccggcccaggaggtggccgtgcaggcaggcggtcaggccccccaggcaggcaaaggacacgccgatggtgttgatctccacctggagcagggacccggtgggcgtgtgcagcatgtagtcggagcgcaggtgggccagcacgccctggctgccgcggtgcgcggcgcggggccccgcggtggcctccagcagcgccagctggcgcgccacgaagtcgtcgtgcgcggccgtgggccgcagcgtggccagcaggtaggcgtcgtcctccgccaccgcgtccaccagcgcggcaaaggcccccgccgcggcctccgcctcacggaaggtgcccgcggggaaggggaccggggtcagcgccagcggcgcatgcaccaccgccgcggcgggcgtgggcgtcgccaggcccatcacctagagggggtggggggggactgtgtgggggggcatggctgctgggccagcacaggtcaggtgaccaggcctggggcgacacggacgcttcaaggtgccgggggtggtgaggcggcagggagaggggcaatcagaacccctcaggtgcagcacatgcaatcctttgcggatgcgagccgactgcaagaccatgcatagacaacacgagacccgtgcggggcctgtcaggagcgccagaggagcacggtatgtgatcgatccccccctgcccccacccacacaatccgcaccaggccgtgctgggtggcccagaccacagcgtcctctgtcagatccttgagtacttgcggatctttgagtttctgtaagagatccatgtgctctgcggcagtgacctctgcttgcagaggcatcttctggtgtgggggttcgccacccagttccgggcgcagttgtgattgccgtgtcaccacagcctcacacgggcgtggcaaggacctgggttgcagatagtcgacaaagacggatgatcgtgctcgcgcaatcaggggtcgcagccgatcgtggggcgttgtccggatccaaatgagcacatggatcacccaaaccaaaatacaattccgagtctccatgatcacggagcatgcgggattcaatgttgtggcaggggagcagttccatgcagcacatggcgaggacaaatgatatataaggggcagcattgcacgtcgatgggcctcgctcgtgatctttgcttggcacaggtcaaggtcaacaccgtgggtagggcgtagcccctggtgggtcatggagctcccctcccgacccctcgatgaaggtcagcaagtgggtgctgcatgaatgtattgcgagtaagtctcccctcgatgtgcggatgcctcgaggaccatcttacaatgatgtgcaccccccaaagcctcagtgcaccttcactcccacccctttccccttctccccctctcgccaggcgaggcaggagccgtctggcggtcccaccgcctccgcaccctggagtctcgcctgcagggcctggacctcggggatgagcaggcagccgaggtggtcgccctgctgcagcgtgttcgggaggaaaccgcagtgctggacgccatgtggcaagcccagcgcgcgccagactaccagccccgctggtggcaggatggcgagctggaccgggagcgtgccgacaggtgctgccgcgtttggtcccggcaggacatggacgggctgtgcgctgagcgtgtgcgctgatggcttgtgccaccaaggtgcagccctgtttcttggggtcccaagggctgcgcaaggcacagataacccttgaatcaccgtcctcctctccctcctccctacccccctgtgcaggcacaacgacgccggcacggccgccctcgccgccggaaacccgggccccgccttcgaggagttcacgcaggcaatacgcctctggccctcgtcccccgcctaccactccaaccgggcggcagccgccctgaagctggccaggtttggggtggcggccgaggacgcccgggacgcgctgaggctcgaccccggcagcgcgcgcgccgcgctgcgcctggcaaaggcccaagcaggatcacgggacccggccgcggcggtggaggcttactcgctggccctgcagctggcggagatggggagccccgaggggtcgaccgcccgcgcggcgaggcggggcctggccgccgcacgggcggccctggaaagcgcggacgcggggcgggtcagggaccgcgcggaggcgcggcgtggcctgcgcgccggcatcccccgccggccgctcgaccctgaggcggccgccgcggcgctggagtcagcgcgggccgtggtgggggcgaatcccggctcccacgctgcgcacgctgcgctggccgaggcggccatcgcctgcggccgttgggaggacgccggggcggccgtcgccggcatgcacccggggctggacgccgactacctgcaggctgaggtggcgtggcggcgcggggatgtggcctctgccctgaccctgttgggccagggcggccagagtgggacggcggcagtgccggatgacgcgagtgatgggtcgaggagggccgcagggcacgaggccatggcagaaggctccagatctgcagcggagcgagggagcgtgatcgacggtcaagatgtcacggagcctgggagccctgagcagccggcacgcacgcccgggcccccgcccctcccggataaaatgaaggacctggcggcgttcctggcccccatctcagtcctgctggcagccgcagacgcggccgaggaggaggaaatccaggaggacgttgcggacgcatgcggcgccgcgctcgaccacttgctggcatgcgcgggggacgggttgcgcgcggtgctgcatgcccggcgcggcgcggcgcgcgcggcgcgcaactcgttggattccgccctggaggacgcccgggccgcgctccggctagcccccgggctggcgccggcgctggcgctgcaggcccggctgct

SEQ ID NO: 45904 - DNA, 108 bp, Chlorella protothecoides
acctgtgcactaaagcctctcctttcactgtcatgagcacgttggccctggagaaaagggtgtccacctgctgaaggaatccagccttgcacctcaagtttaccacca

SEQ ID NO: 45905 - DNA, 71 bp, Chlorella protothecoides
gtgctgaggagttgctgacgattgccatgtcagcatgagatttcctcatcgtaattgcctggctctctagc

SEQ ID NO: 45906 - DNA, 167 bp, Chlorella protothecoides
gaatttgaggcgtaatgtcgcacgctatctctgaggaaaagtcatgaacctcgtccatccggacattttgctccggatacctcgaaccttgccatggttgtgagaaccttgagggaatgtcccacaaggttcctaccccttggcagattgcatcatgcacattcggc

SEQ ID NO: 45907 - DNA, 61 bp, Chlorella protothecoides
ggtggagggtcgggtgacagaggctgggggggggctgcctctaagcgatcaacatctgctg

SEQ ID NO: 45908 - DNA, 61 bp, Chlorella protothecoides
gtcctggatcttgatgtcgatcttggggccgtagaaggcgccgcccccctcgtccacactg

SEQ ID NO: 45909 - DNA, 77 bp, Chlorella protothecoides
ccacacaacaacaccccacccccctcaaaaacaatacacaacaacaacagcagcagcaaccaaacgtcttcacctgg

SEQ ID NO: 45910 - DNA, 69 bp, Chlorella protothecoides
tcgtagagtgtgtgcacacgcttcaaacagcgtggcgaagtgacctggtgcgcgccagagttgcctcgt

SEQ ID NO: 45911 - DNA, 102 bp, Chlorella protothecoides
ttgcatcggtgatgactgatcaggtcgaggtccggtgttcgatccaccgtgggagcaaccccaaagctcctatagctcagtggtagtagcgcgactttagta

SEQ ID NO: 45912 - DNA, 71 bp, Chlorella protothecoides
gccctagccagttgaagggctgctggggagcggcaagccctcgcgcggtatcgcctggcacccaccccttc

SEQ ID NO: 45913 - DNA, 80 bp, Chlorella protothecoides
acacaggcatctcggctctctctaaggtatcgaggccctatagctgcaggctcctgtctcaaccagccaggaggtatgcg

SEQ ID NO: 45914 - DNA, 61 bp, Chlorella protothecoides
ctgcagctccaggcaatgctttcaccctacacccgccaaactgcccaccttatctctccca

SEQ ID NO: 45915 - DNA, 61 bp, Chlorella protothecoides
ggagcggcggggtcggggagcgacgtggaggaggacggccgcggcgcgccgggcgacgctg

SEQ ID NO: 45916 - DNA, 61 bp, Chlorella protothecoides
aggacggccgcggcgcgccgggcgacgctggcgaggacgacgctgacgaggacatgctcct

SEQ ID NO: 45917 - DNA, 61 bp, Chlorella protothecoides
tgcatggatgtaaattcaagatagattggacgcaaattgggatgcgcctccaatggacacc

SEQ ID NO: 45918 - DNA, 77 bp, Chlorella protothecoides
tctattttctgagcaaccccttctcgggttagcaatgagggaagccatcgaaagggagggcgcgagacccagctgat

SEQ ID NO: 45919 - DNA, 76 bp, Chlorella protothecoides
cgctcgcatgcctaaatagatttgtgttctcggcttgggtgctcgcgcatgtcaccgcccgatgcctcccaatgct

SEQ ID NO: 45920 - DNA, 77 bp, Chlorella protothecoides
gaggtcaggggaagcactaaaccatctagattctgacaatgttatcgccggtggatacaatagctgatgtggggtgc

SEQ ID NO: 45921 - DNA, 105 bp, Chlorella protothecoides
gctgcatgcaatctaatagtatctgagttccaaagtaacgtctcctgagtcgttgctactccagccatcctgccactatgttcccatgcacttcgcgccctgcac

SEQ ID NO: 45922 - DNA, 78 bp, Chlorella protothecoides
gatgggcggtctgcggccggggtctacgtgacgattcggggtcgggctctgcgggggctgcagtgccaggcgggggcc

SEQ ID NO: 45923 - DNA, 66 bp, Chlorella protothecoides
gccgagctgcatggccgctggtcgatgcgcggtgcggccgagctgcatggccgctggtcgatgcgc

SEQ ID NO: 45924 - DNA, 78 bp, Chlorella protothecoides
tgggaatgggcgcaggaggcctcgggggcatgctgtcgaggcttcattgtcaagcgtgcggtgtcgtggatgctgcac

SEQ ID NO: 45925 - DNA, 74 bp, Chlorella protothecoides
gccaccagaacggcgtgcgagtgtggcatatagagtaggcccccacccggaaagggggtggcagcattcacatg

SEQ ID NO: 45926 - DNA, 125 bp, Chlorella protothecoides
caactggtcggcccaggaccgagggggcattatgcgggggactccgcctgggacctagatacgcttcttgcgacgccttcggcgggtgtgcaggatggtggtgatcgacgagcacaggacttcca

SEQ ID NO: 45927 - DNA, 80 bp, Chlorella protothecoides
cggttggacggctcaggtagttttctttgggtgcagagcaatggagactatggatggtatgtgcaagtttgttgaacaca

SEQ ID NO: 45928 - DNA, 61 bp, Chlorella protothecoides
gggaacagagggtggagctgcatgtggtcctctggcagcagcatcgacaggatgaggctgc

SEQ ID NO: 45929 - DNA, 422 bp, Chlorella protothecoides
  modified_base (108)..(341): a, c, t, g, unknown or other
cacccgcaggtgacgccattgagttcaatagtcaatattataacctttttggtgggaaattcccccaagcaagggtggtgaatgtttacgacgatgcttatgtcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtcttgagtcagatggtcatccaaacgggctgtggtaattgtcgatccacatgtaaagtgacacttcgggtatccgaagt

SEQ ID NO: 45930 - DNA, 61 bp, Chlorella protothecoides
tcatcatccagaacattgtgaggaagggaatgggctggcctgagcagggcaagctgcatcc

SEQ ID NO: 45931 - DNA, 61 bp, Chlorella protothecoides
cggcctgcgcgcctggcgtcgtgccctgccaccttccaatgcagccatgcaaacctggtgg

SEQ ID NO: 45932 - DNA, 61 bp, Chlorella protothecoides
cccctgttcctccattacgtggagggctccgcagtacccagcagagttttgatgtcctatt

SEQ ID NO: 45933 - DNA, 100 bp, Chlorella protothecoides
gcacaacattatattttgccctctccttcgccaacgctcatttttttggaatactaactttttaaagctttcgatggtcctgtgcgctggtagtttgagc

SEQ ID NO: 45934 - DNA, 61 bp, Chlorella protothecoides
gcgcctgaccgttcggtccggcgaggagggtgccggcgccgacatggcgcccgattccctc

SEQ ID NO: 45935 - DNA, 61 bp, Chlorella protothecoides
cagccccgaggagtctccctctcctagccctagccctgaggagtcgcccagccccagcccc

SEQ ID NO: 45936 - DNA, 61 bp, Chlorella protothecoides
ctcccgaccctttgccagtgattatggcgcctgtgtccgagctcgtcgcagccgcggagga

SEQ ID NO: 45937 - DNA, 76 bp, Chlorella protothecoides
caggatgcatgcgctctcgctcgccggatgtttgtgtttttttcgttctcagatctatgtgatgccctatgctggc

SEQ ID NO: 45938 - DNA, 79 bp, Chlorella protothecoides
gcgcccgctcctcgatccccttctcagccgcagactggagggtgcggcaccgacgctctgtcgcctgcgcctccctctc

SEQ ID NO: 45939 - DNA, 77 bp, Chlorella protothecoides
cattaccctcggacgggcgatgggggtggggtttccccccaggcaccgctcttggccttctgaggccccgaccgggt

SEQ ID NO: 45940 - DNA, 61 bp, Chlorella protothecoides
ttgggctgggacatcaaatgtcttgcacactgtttactcctcatactttgccgcgccaagc

SEQ ID NO: 45941 - DNA, 92 bp, Chlorella protothecoides
agactgtctcttggagtcggcccctgtgtgtgccaaccaaatgtggtccttggatttcaacatcatcactgcgctgacgctgcccccaggaa

SEQ ID NO: 45942 - DNA, 61 bp, Chlorella protothecoides
gcgttcgagcacaaggcctgaagcaaggaactgtagctggatcctgcatgcaatgcgctgt

SEQ ID NO: 45943 - DNA, 76 bp, Chlorella protothecoides
ccctgcatcaaactcccctggcacggaaccccagccacgtctgggactgttttgaaccgagcgccccaactcccaa

SEQ ID NO: 45944 - DNA, 4741 bp, Chlorella protothecoides
  modified_base (414)..(423): a, c, t, g, unknown or other
  modified_base (536)..(545): a, c, t, g, unknown or other
  modified_base (733)..(742): a, c, t, g, unknown or other
  modified_base (1684)..(1693): a, c, t, g, unknown or other
  modified_base (1790)..(1799): a, c, t, g, unknown or other
  modified_base (1886)..(1895): a, c, t, g, unknown or other
  modified_base (2467)..(2476): a, c, t, g, unknown or other
  modified_base (3153)..(3346): a, c, t, g, unknown or other
  modified_base (3412)..(3585): a, c, t, g, unknown or other
  modified_base (4010)..(4019): a, c, t, g, unknown or other
  modified_base (4281)..(4290): a, c, t, g, unknown or other
  modified_base (4343)..(4593): a, c, t, g, unknown or other
gggagggcggcccggcgcaggcggcgcgcggcaagcgccgcccggcgccgcccaaggccgccgcggaggcgggaaggccggaggcggggggcgtggactccgagggcgcagctcctggtgccggacagcccaagccgagtgagttgacgacgagggggggccggcttgtgccgctgcatagggaagtgtggaatgtcacacggccgccagggcgcgcgactgttggggacacgcgcctgcaagaccgtggttggggtcatgaaagtttgggcatccctttcctcaacgcccttcctcgtccctcgtgcgcagagaaagcgggatcccggtctcagcggcgaaaccggcctgccaaggcaggcgcaggagaaatcgctggcgccgccgtgcccgccgaccggggccctgctgacnnnnnnnnnncagggaagcgtggaatgtcacacggtcgccagggcgcgcgactgtcggacacgcgcctgcgaggccgtggttgggttcatacaagtttgggcatcccttccctcaacgccctnnnnnnnnnntcgccgacgcccggcccgtgagcatgctgcccgtctgctgcctgcccggcagcactcccaaaaactagtttcccctgccctagcctgcaaccggtccctttcccccttggggacagtgtacacgcactcccttcagaacagttgtggggaaggtctgggaagacctggggaggcgcgcatggccacgnnnnnnnnnngcgcccacgcccggctcgtgagcatgcagcccgtctgctgcctgcccggcagcactcccaaaacctagtttcccctgccctggcctgcaaccggtccctttccccctcggggtcagtgtacacgctctcccttcagaacagttgtggggatggtcttggaagacctggggaggcgcgcatggccacgctggttaccattcagagcggcctgccacatgaggcttgacttccacgtttcgaggagcgtgaggagccacgctgccacccgtgtgccggcacggcgcgcctcggtctttgcagcgatgccaagtcacctccacgtcaggctgcggcctcgcgccccagcgccttgcgtgccacggcgccttgcgcaccaaggcggccgctgtccccccttgcgccttcctttcccccctcctctcaccctgcgccggctcacccctcgccatcgcgcgcgtccacggcggaatcgttcagggcgcaggccaccacgcccttgtggtgtcccgagtagacgcggatggcctcgcctgaggccaggtcccacagtcgcgcggtgcagtcggtgccggcggtgaccaggtaggcggcgtccacggagaagacgcagtcccacacccaccggctgtgccccgtcagcgtgcgctccagcgagaagccatccaggttccacagccgcaccgtgcggtcagaggaggtggtggccaggtgccgcacgtcggggctcagcgcgcatttcaggatgtagccgccgtgcgccttgagcttgtgcagcggctcgaagtgggtggacaggccgctgccgcgcatggcgcgccagacgtagcaggtaccgctgggcgcaaggatgggaagaaggggggggggagtggtttgtcggcagcgttgcgagcaacaggaaggagagggcggggatgggcgggctgtgagctcagcatggtnnnnnnnnnncggatgggaagagggggggggggagggtttgtcggcagcgttgcgagcgtgaggaagaagagggctgggatgggcgggctgtgagctcagcatggtnnnnnnnnnnccttgcagcatgtgcggtcccctgcgcacttctagctgctagggtctatatccccacgcgaagaccaggtgccacccccctcctccnnnnnnnnnnctgctcccgatcacagcgagcctcgatacccaaatggggcactcatcaacacgccaggcttgcagcatgtgcagtcccatgcacagttctagctgctagggtctatatccctgcgcgaagaccaggtgccacccccctcctcctccctgcgccccacccaggtcacatgggacctggctcctctgacctcacaacacccacctgttgtttgcggccaccatgaggctgccgtccactgctatcgtgagggagcgcacgcccacgttgagctccggcaccagctcgcaggagcacgcgttggcggtcaggtcccagactcggatgttgccgtgctggtcgcctgacgcagcaggggggggaggtagggggttgagcacgggcttggcatgcagacgggtctttgtttggggaggaatcttggtgggagatcggtctcttgttgaactgaacagagcctgagtgtgtggctagctctggacccctggggaggcagcgcccccacgtcagccacgcacacaccgctgggtttagatacacgctgccccagactcgacacgattcccaccccgctnnnnnnnnnntggagagggtggggggtgagcacgggcttggcatgcagacggatctttgtttgaggagagatcttggtgggagatcggtctcttgatgaactgaacagagcccgagtgtgtggctagctctggacccctggggatgcagcgcccccgcgtcagccacgcacacaccactgggcttagatacacggcccccagactcgacacgattcccaccccgctggaaggaccccactccacacgatacacgacctcgccccacacccatcaccaacctcgacccacccgatatgagctcgccctgctgcggatgcaggaccacggtgttcaccgccgcgcgactctcgtactctcgctggcacccgggcgcgcgcatgtcccagatgcgcaccgtgccgtcctcggacccggtgtacatccacttgccgtccttctggaagccgacggcggtgacgttggcgctgtgctggtcgaaggacagcaccggctgcgggttggcgctggccacgctgaacaggcgcacgtgggggttccccgcggccgcgatcagggttttgtccgccgtgatctccagcttgttgacctgggagtcggggaactgcagggtgcggtagcagatgccgctggtggcctcccagaacctgggagggaagtccagatggggcagaggtgaggggtgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttctgggcaaatctttctttaagattgaaaggcgcgatctggtccaagtcacggtgatgaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcccagcgcgcgcggactcgttccccatgaccgttgccgatgacagcaacacaccccctttgcacctttgatgtaagtcgttaaaacattaaagccacgtcgatccaacacatgagtgcaagctcaaggcaaggtcggtatgaaaaattcaagtacacaattcttctgcgcgcgagcagacggagcgtcaaagacgaagtattagcatcatttggcagccgccttgaacgggagccaaactcccccatggatccagcaagagccgaccgcacatttgggtctgagcgtcaggatccggggaagttgtgtgcatagtggggagagatgctgtgggcgtgggggggctggggtttggggagaggggcgcccgtgtttgggtgggcgtatgccgcgcatgggtaaaggctagggaaacagtgtgtnnnnnnnnnngcggcaacggtcacggggaacgagtccgcgcgctgggcaggggaaggggggcgagcccatgcctcctgacagttcgatgaagcgatggccacccaccatggaaaccaggactacatcataacagcatgcgatcgaggctctgactcatctgtgcctctgcatcgcgccccagttgcgtctcagtgccgcgagctcacccctcggcggacagggcccaacccttatcccctcccttcatcaccgtgacttggaccagatcgcnnnnnnnnnnatggccttaatgtggtatgacctacatcaaaggtgcaaagggggtgtgttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccttaaatcttaaagaagatttgcccggaagcgtgcatgggcctggatctcaggctcccggcctgagccgccctcccgggtgccatggggtcttcggtggtcctggccaccgccgggtatgaccacaccatccggtgcgccatggg

SEQ ID NO: 45945 - DNA, 61 bp, Chlorella protothecoides
cattgtgctgcttctctgccgtgactgcgagttgcgtgcagtgtcgcccatttcatttccc

SEQ ID NO: 45946 - DNA, 73 bp, Chlorella protothecoides
cgccggcctggtcaactacggtacccagaactttgcctctggctggcgcgtgtctctggcgctggcggccgcc

SEQ ID NO: 45947 - DNA, 95 bp, Chlorella protothecoides
ccctgccctggagcgggctctcgttgtgcttgccacgctcagagccccgtgcctcgatctggctactcggctgctgcttccccttatttgcccct

SEQ ID NO: 45948 - DNA, 80 bp, Chlorella protothecoides
tacctgcaccatgcccgagtctggtgagggactgcggggctgccttgatgaccatgcagcacctcaaagaactcaccata

SEQ ID NO: 45949 - DNA, 75 bp, Chlorella protothecoides
cctccgcgctctccaattcatccttccacctcctccattcaccccaggtactcacactgcgccatgtacgttgcg

SEQ ID NO: 45950 - DNA, 61 bp, Chlorella protothecoides
acctagtttcaccttgaccgccagaacaacagcatcccagggttctgggttcagcttgacc

SEQ ID NO: 45951 - DNA, 78 bp, Chlorella protothecoides
tgtctgccacagaacccagctttcaagagtgaagcctctctctgacgaccaaccctgcaccatgaccgccacaatgaa

SEQ ID NO: 45952 - DNA, 84 bp, Chlorella protothecoides
aggcttcttagctactcagtctggccaaatgccctcctgaggttggcagctgcggtacccgcgccatgcgtcacgccagccagc

SEQ ID NO: 45953 - DNA, 80 bp, Chlorella protothecoides
gaagtccttgtggcatgcctaaattggaaattcccttgcaccctcatcaagtaccccttgagcggccacccaccatgtct

SEQ ID NO: 45954 - DNA, 73 bp, Chlorella protothecoides
cgagcgggagcctgaagcggtgcatcgtcgcttggtgttcttttctgcgcctccgcaggcacaatgctcgcag

SEQ ID NO: 45955 - DNA, 66 bp, Chlorella protothecoides
tggaatgctggcgacagaagacgagcacaacagtccattcgcctccttagtctgtcaaagagcgat

SEQ ID NO: 45956 - DNA, 72 bp, Chlorella protothecoides
acgcgaagtctaagacgggctcagcagctgcgctggcgccaatcgctggggtcgaggttgcctggtcgggag

SEQ ID NO: 45957 - DNA, 141 bp, Chlorella protothecoides
cctgctgcaggtagggtgggcgaagctggtctctatttccggtgttctcatggatgcagaagggaggagaaatggctatgcgtgccccatgcatgctaccgccgggcggctcgtcatcctgcaccctccgccgccctcacg

SEQ ID NO: 45958 - DNA, 78 bp, Chlorella protothecoides
ccaagaagtcaccgccaccatacgtcggaaaatctccacccccacccaccaagaagtcaccgccaccatacgtcggaa

SEQ ID NO: 45959 - DNA, 113 bp, Chlorella protothecoides
tctggtaaatgagcctgcaaacctgcatgtttcagaggccgtcagattgcctcctaatgcacctaatccgcaagccagaactgtgattcccaggacgattgccttctcaattc

SEQ ID NO: 45960 - DNA, 90 bp, Chlorella protothecoides
ccgccaccgaccgcctgcaagtgtgaatggggaggggatgtgggaatcttggcaggtctaaggaggcggcaccccatcatcagctgggtg

SEQ ID NO: 45961 - DNA, 143 bp, Chlorella protothecoides
cgcgaggtgcattggccggtggtctgcaagcgactgactttgccagggcgctggcgctcacatggaagccagcggcagcatggagcaactacagagcactttagggggggggattgtagcaacgcttacatcacgagcatgaa

SEQ ID NO: 45962 - DNA, 61 bp, Chlorella protothecoides
atcctcgttatttctgtgtattcggacgtgctccttgctctcaacaggcctcgtagctagc

SEQ ID NO: 45963 - DNA, 61 bp, Chlorella protothecoides
caccccgctccccgtgctccaacgccgcggtctggtgctggtgggcctggcggccgcgccc

SEQ ID NO: 45964 - DNA, 78 bp, Chlorella protothecoides
gtctctgagtgtcagtgctggctcagattcctgtacacggcgggtcacagacttgagcggtcctggaggacggcaggg

SEQ ID NO: 45965 - DNA, 114 bp, Chlorella protothecoides
ccccagtgatgcacaccattgcctgccacaccgcaccccagcacccccctccctgccaaattcaacacttcacaaatcacaggcgtgtatgagcagctggaccgcgtcaccaag

SEQ ID NO: 45966 - DNA, 140 bp, Chlorella protothecoides
tggcgggtggggtgagtgcagggtgttggagaacaaggcgaccatgcaggagaagacgatggaggaggagtgacaagaggcgcattcatttgtagggacccttgcacggcccctgagggcagagcttctgccgtactgag

SEQ ID NO: 45967 - DNA, 111 bp, Chlorella protothecoides
ttggagtgcacgcctgcgctgccgtacatgatgccggagggaggagcgagcccaggcactagagctggtgggacggtgaggaggtccgaggggatcccggtcagggaaggg

SEQ ID NO: 45968 - DNA, 66 bp, Chlorella protothecoides
ctgcaatggtgggtgccctggcagcctctgcaatcgttttttacatgggcagtccctgggcaagat

SEQ ID NO: 45969 - DNA, 1058 bp, Chlorella protothecoides
  modified_base (140)..(332): a, c, t, g, unknown or other
  modified_base (440)..(662): a, c, t, g, unknown or other
  modified_base (730)..(979): a, c, t, g, unknown or other
agcccacgcctgtgaagggagggcgcatggaggtggcatgctcaacaggccgacacatctgcagctgtctgtcatccaacattcacgccgccgcccatccgcaaggtccttcaccagggtgccccacagcccaaaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcgggatgaaaagagcgcctgagccggcaaggtgtggccggcgtcgtgtttgccccagagccaatgctcctgcaatgccacgcaccgccaggcgcatgtcgcgagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcatccaagagcagcggtcctggcgccacagagacatcaagctcctgcgccaccacgccctggatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactggtgtcccagtgtgcgaaatcactgcgaccgaccaagtccacagtctcgggctcccggggactgatgaccagcca

SEQ ID NO: 45970 - DNA, 6082 bp, Chlorella protothecoides
  modified_base (379)..(388): a, c, t, g, unknown or other
  modified_base (1188)..(1197): a, c, t, g, unknown or other
  modified_base (2690)..(2699): a, c, t, g, unknown or other
  modified_base (3328)..(3337): a, c, t, g, unknown or other
  modified_base (3566)..(3575): a, c, t, g, unknown or other
  modified_base (3709)..(3718): a, c, t, g, unknown or other
  modified_base (3776)..(3785): a, c, t, g, unknown or other
  modified_base (4153)..(4162): a, c, t, g, unknown or other
  modified_base (4253)..(4262): a, c, t, g, unknown or other
  modified_base (5021)..(5030): a, c, t, g, unknown or other
  modified_base (5486)..(5495): a, c, t, g, unknown or other
  modified_base (5552)..(5665): a, c, t, g, unknown or other
  modified_base (5735)..(5744): a, c, t, g, unknown or other
ccgccgcgcggcgcggggccacgagcgcgccgcgcggcgcctggcgcgcgtggaggaaagcgtggccgaggcgcggggcgagctgccggacgcgcgcgacgccacctggcgcgccttcaagcgcctgcttggcgtgctgggcaaattcggcgccctggacatgggtgcggcggcggtgggcgccgcgctgctggcctgcgaggggacgacggggggccccgaggtggacgggcgcactgcggctggcgcagggggcggcggtgcagcggcccatggtgcccaagtgagtggcgctgcttcacgcggcgcagggattgacggtgtcgcgccatcccaagtacagacggccaagcacgacgcgacgtccgaaggccgcatnnnnnnnnnnatggcgctgcttcacacggcgcaccgattgacggtgtcgcgccatcccaaatacagacggtcaagcacgacgcgacgtccgaaggccgcatgggcgacacgaccccaaagggcaccccccccacccccccgcgctccatcccgctgtcgccgctgggcgaggctgcgcgccagctgcacggcggcaacgagctgtggctggcgctggcgctgacgcacgcggcgctgcaggacctggcccccgagcacctggccggtgcgctggcggcgctggcggcgggcgacgcgctttcccgccctgggctgcgcgtggcctaccccgcagcgcccgccgccgcggcggcgctggaggcgctggagggcgcgcggctggagctggagcgcgcgcaggcgggcgcgggggtggaggtccccgtgaccctggatgcacgcgtggcggggctggcgcaggcctgggcggctggcgcgtcctgggcgcagctggccgccgacagcagcctggacgacggcgacgtggcgcgcctgctcatgaggacggtggacctggcgcggcaggccgcgcactgcgagcagctgctgccggaactgcgtgccgccgccaggaaggtggtgcgggccatggaccgcagccccatctccgacctggtgcactaatgacgatggggcttgagagggcatcatgccattcacatgtggtactgctcttcatgtagactgtcatctctgactcaagatcagacaattgcatcaacctccgatcagtctcaagccatgggactgggatgggtttgtttgtgccgnnnnnnnnnnatgctcttcatggagactgtcaactctgactcaagatcaggcaattgcatcaacctccgatcagtctcaaggcatgggactgggatgggtttgtttgtgccgcataatgcatactatgtaggaggggaaaatccatgcgctggcctccatttgttggatcgactcctccggtggccacgccgaggctcagcacacctcgtacaaccacattgccaagcgcaggccatgacgctttcagacagcgcagtgtcagcaaatactcccagtgccgtcgatcctgctatgtacccccatgtgcgagctccatttccgggctgccctcacggatcatgctgactcgactaggcgtccgccgttaatccccggaaatgtgtgtttcgagctgatcggaaggggatatgtattttccccttgctcgcaccaaccgcattcccggctcctgacgctgcattctgctcaccgacacccttactgaccgtaaattgtctcagaatggtgcgcttcgatgtccgccccgagctgactctgcatggtaacaatgagacgtcggccagggtgaacttccgtttcaaccacggcccaaaccagattgacgtgcgcgtcgccgaccgttccatcaagaacgggaactttaccaccgatggcgtcttcctggccctccgtaacgggcaggggctggagctcgagtacggtaagcgccgacagctgccccccatgtcggaaatgctgaggtgggcacacgacccacccacctttccacgcccctactccagatgtggccaccaagtccccactcgtgcggatcaagtcgagcgtggttgtcgccgaccgcctggtcttcgtcaagtacgcgcatgccctgaagtccaacggtgagtttcatggtgaccggagcccgggaccgggcgcggagaaatatgcctgtgtgcaaggtgctgaccccgtgctccacaccgtcttcctctcgccctgcagctgcgcacctccgcctggagcaccaggtggatgccaacaacatcgcgaagctggactacaacaccgtcggctttgaggggtgagcgttggaggcggagagagggaggcactcctggtataggaggagcagttcttctgatggatgccggccacctcctcggcttgcctgctaccgtgttgtctggctgaagatgctgatcctcaattactttcccgacggcatgtctcaagctgtattttcatcccgcaccccttccgtccgcaggctcaacagcaaggacgtgacgctgcgctggagccatcgccagggcgacttcatcgtggagccctccttcaacctggtgcgggagtggcgcacttgcttttggtttatcgatcgtaccgtttcgtgtgggtccccagagcagcaacctgggtccggctgcagttgtatatatgctgattgttcttgcagagtccccaacacacatgcacccctcactccagcaagcatgttgctcagtctaggtgcccacctnnnnnnnnnncatgtatgctgattgctcttgcagagtcccaaacacacatgcacccctcactccagtaagcatgttgctcagtctaggtgcccacctcccatcaacacagggtactgagagcgccgcgatcactgccaggtacaacctggacctcaacaaccgcgtgaccgcccacctcgacttggtgaggaggggtgtaggagcacgatgattgttttcgcatggcatgagactgttatcaatgacgcatggccagtgagcttgtgctgaccggctcccttcccaccccacagggcaccaacgttggcgtcctggcctggatcaaccgcggcgtggatggcgacctgagggtaggttggtgtggaagtgaactggaagtttggctatgctgcagctcctgtccctgacagaccattcaagctgtctttggctcccacccttcacccggcgcaggtggttgctcgcgctgagctggacaaggactccacgcagtcccgaccggtgagggtctggctggcgcttgtgactgacttcttggccgatggtgcagctcacggctggtcgtgtccctctgcagatagatcgatcctatttttcactctccgtaccatcccagtctcatgccttctgcatgcccnnnnnnnnnntgatcctatgtttttcactctccgtgccatcccagtctcatgccttctgcatgcccatcacacacgccccagtccggggtcgcacacatgcctcccgtttcacttcccacttccacccccaaactcccacagaccctgaccgtgtccaagacctggaccctggacaagtaggcagcacgcctctcgcgtcaaccctggcccgtcccctcctgttgctcccctgacgcgnnnnnnnnnnccgcctgtcgagtcaaccctgccccgtcccctcctgttgctcccctgacgcggcggaagggccgctcctcatcgtcatgacccagattcgccccaccttacacaccttaccgagcattgcgtcgagagataccnnnnnnnnnngggtgtttcatgccggggcctgctggccccggcatgatccctgacgcccatgcattgnnnnnnnnnngccccttgtgcaggaagagacgaggagacggagacgtgacgatgtgctgactgctgcatgacccgagaattttgaaagagcactcccacccgcacggggcggcaggtgtttcatgccgggcccagctggtcccggcatgatccctgacgcccatgcattgtcctgccatcccccacccccttcctgtaagagagtcgttcagtgaaggaagtttgtcacggggagtggtcaggacagggaagaggagaggggcatggggcgcgagtgcattgcaacacaatccgcgctctgccagtcaattcacggcctaccagctcagggagcggccatgccccggttctgcttctgcgccgcccggtccttgcggnnnnnnnnnntgcggcgcaacattgggccttggcgcggtcaggggcttgttcccgccggggccaagcccatggatctcccgcctgccggcagcggcctgcnnnnnnnnnngggacagggaagaggggaggtgcatggacacgagtgcattgcaacacaatccgcgatttgccggtcgattcacggcctgccagctcagggagcggccatgccccgattctgcttctgcgccgcccggtccttgcggtggtggttccccaccgccgccttgtgctggtccttcttcttccgatcgcggtccgaagccgggtccccgcccccaccccgcctggggccgggcccgccgcggcccccttgcgccccgtcaggcccctgcctcccctgctcctgtccggccgcctggccgccgctcgcagcggcagcggccatccgcggcgcaaggtcgggcctcggcgcggccaggggcttgttcccgccggggccgagcccgtggatctcccgcctgccggcagcggcctgcgccagcacctggcggaggtgctcctcgctggcaaccggcgtggcgccctccttccggtagttgtacacgcggccgtccagaacccagcggcgcggcggcggcgcattgccccgcccgccgcgtgcacccgcgccgtctgcaaagcgcggcgcgggccccccccgctcggggccggcgtcgtttctggccctgccggcgtcggcctcggagccgccgtccccggcccctggcgcgagctcgtccagcgagtcatcatactcgtcctcgtactcccactgcacagtgaaggtttttttgggggggggaaaaggggtgattttagcagctcgagaaaacgcatcgacagtgcnnnnnnnnnnggttttttgttattttttgggggggaggggtgattctagcagctcgagaaaacgcatcgacagtgctgccgagtccagtacaggcatagagaactgtaaccggcggcctcgtggaagacacatgagcagcccccctcccttagccccccatctcaccgactccgagaaagaccccctcccacctgggactccatcgctgccgtctgcagctgcttgtggtaccgctcctcccgcacattcaggtaccgcgccacgaccgcttgtggaggccgccctttggccgcgcctgaagaggatgaagtggatgccggcgcgggggtcgcggcgccacccctctctactgttgccgccaccgcttccggccgcgcgggctggctccgggccttccaggcggcataggcggcccagtccgctcctcggtccagtcccgccactccttcactgccgtccagcagnnnnnnnnnnttcgcggcgccacccctccctactgctgccgccaccgcttccggccgcgcgggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccgcgacggcggcctcggcgctgccccccgcccgcttgatgcaggcggccaggtagcccggcccatannnnnnnnnncgccgcgacggccgcctcggcgctgccccccgcccgctcgatgcaggcggccaggtagcccggcccatactctggcagcatctcgaagacggagcagaccgcggccgtcagtgcagcggagagatcgggtggtgccgccgtgctctccgacgcgccgcctccatcccctggcgccttgctctccaccacccaggcgcgcggcaggagcgcggcgacgtagtccgcctgcgcgtcgtccagcgtcaggcgcccggcgctgcgggcggcctgcagtgcggcgggcagcccgtgccgccccgccagcgcctccagcagcgtcggcgcgcggccgccgggcg

SEQ ID NO: 45971 - DNA, 78 bp, Chlorella protothecoides
accaagtgcatgaaccgctacttcacgcaggtacggtgtttgtgggggactggggggtcctgtggtgggtgccgggga

SEQ ID NO: 45972 - DNA, 71 bp, Chlorella protothecoides
tggccgccgcggcacccacccccgcacctacccccccccaggccgccccgctcgtcccacctccccaggcc

SEQ ID NO: 45973 - DNA, 69 bp, Chlorella protothecoides
ccaatcgcgttgttgcaccgcagattggtgcccttgttgttgtaaccccagttgaggtctcccatgttg

SEQ ID NO: 45974 - DNA, 61 bp, Chlorella protothecoides
cgcacctccgatggtcggggaacccatggtatgagcctggtcgcctggctgcagcggtgag

SEQ ID NO: 45975 - DNA, 19265 bp, Chlorella protothecoides
  modified_base (104)..(254): a, c, t, g, unknown or other
  modified_base (2312)..(2321): a, c, t, g, unknown or other
  modified_base (4426)..(4435): a, c, t, g, unknown or other
  modified_base (4523)..(4532): a, c, t, g, unknown or other
  modified_base (5503)..(5512): a, c, t, g, unknown or other
  modified_base (6177)..(6186): a, c, t, g, unknown or other
  modified_base (8952)..(9014): a, c, t, g, unknown or other
  modified_base (9313)..(9322): a, c, t, g, unknown or other
  modified_base (10631)..(10640): a, c, t, g, unknown or other
  modified_base (11196)..(11205): a, c, t, g, unknown or other
  modified_base (11605)..(11614): a, c, t, g, unknown or other
  modified_base (11893)..(11902): a, c, t, g, unknown or other
  modified_base (12167)..(12176): a, c, t, g, unknown or other
  modified_base (13473)..(13482): a, c, t, g, unknown or other
  modified_base (13606)..(13615): a, c, t, g, unknown or other
  modified_base (14881)..(14890): a, c, t, g, unknown or other
  modified_base (17116)..(17125): a, c, t, g, unknown or other
  modified_base (17374)..(17383): a, c, t, g, unknown or other
  modified_base (17818)..(17827): a, c, t, g, unknown or other
  modified_base (18242)..(18251): a, c, t, g, unknown or other
  modified_base (18929)..(18938): a, c, t, g, unknown or other
tcttcagatattgcaaagggattcttcgacacttggcaccatttcttcagagtcagagtaccattcactagtttacagacctccacctttacatccaacacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggaagtcgtatcgcctcgtccccatcaggaaattatagtaacagagtcgattgaccaacattcggcctcgccagttgtgctccaccttttggggtgcacgctggtcttccacagaatcatatccagtgctctccagtatcctgctctcccaagcctcgctcctgctcttatggcgcctctcgagagtgtaccagggtctgccacagctcccatcagtacgtcgcattcttcctcttggatttgtagtcctcccagttgaacggtcccttgctggcatcccccccgaccaggaagttgtaggctgccaccacaccattgtagaacagcacgtacttccccacggggctgacatcaaaattgagggccgagattccaccgctgtacacactggcagagagaaggttgtattcctgccatgtggtgggtggacttggggtgggagatcggacagggtttgcatccccatgtgctgtgcaaacccatggccaagcccaccgtgcaacggggcggatccacccttccccctttcccccggggtcccaccttgttcttggcgacaaactcgaagtcgcgcgtttgggtacctgtagagaggagcgcagaggccgtctcgatgaggttcctggtgcgaagtgccttgcgtggcggcgacaggttgacacagaaggtggggcaccaaacggccttctcgcgtgggacgtggaagaggtcgactgggtggttggacaggaagccgccatccacgagcgtgacctgtgcggcggaggggagaaggtggtcctggaaatggctcgctgggggagcagggagcgggtactgtgctgaggggaacaggaagacgcacaggcactgtccttgctggagtcagccgaccagtcggtaggcacacttcccacgagcatgcaggtgcgtgccaacaggttgcgtatccgcctgggtcttgtgggggcaggcactgtgagtgccccctcaactcccccccccttcactcccctgcacagtgccccaggatgcacctcacaatcccagcacctcccgacattcacctggtccgggatgtagtcctcaaacccaatctccttccactttgtgtccggcaggctgacagcccgctgcccggcatagggaatcttctctcccggctgtacagggaatttcttggggaagaagaagaatgggacggccatgctggcgcggacgcagtgccccgggttttctccatctgcgtggagggattgccaggggcgtcagcacctttcagaagagagggagagatgcagggggagtgaacgagcagcactggggatgcatgggtgcgtcccatgctccctgagcttccccatagattgctgccccccggcccgcaggtcacgccggcccccacttcgtcgcaccagggtttgccatgtacagctcggagtgcgtcacggggggttggtcaaagttcacgggcctctcccagctcagcacggccttggtggaggtggtgatgtcggcggccacacagcacaccaagccctccacatcctgtggctgccttccgtcctcgacctgatatggtggtgagaaatcacggtgcaggctcggaggcagaggtaatgggggatgctcagttgcaggcgcacactcagacaggcagcaggtcctgccagctgacagcagagtcaggaactcagtccctgcatggagtctgaacacatcgagtaccttgagccactcaatcttgctgaggtcgcacttggccttgagatcgctcagggtgccggctccatatgtgttcatcaggttcttcagccagtcctcgaaagttttgccgggatgcaggccgctgtttttcaaggcggtgccctgcgtggagttggatatgaggcaagccttggtctaagctttctccttgggtcctcaagcttcaagggtgcgcaggacctaacaatgcctatgggcgcgcatggcccgtcccctcgcataccatgctgcagagtattgatgacagccaagaatagcactcttaccagagcaaatgggaacagagggaggctgaagaaatcaagggtcnnnnnnnnnncctcttctcgagtatgcctgtgatcgcggacaaaagggcccgctccgccttacccccatcgtcaaaggtggaggtgggcatctccaccatcagacgtagcaggtcgtctgccactggggcgtctggactcttgcgcacagcgcccatgatgaatgctgcgacggcaccggcggaagcacccccaatggccctgtgatgcaagggttggggtgattcaggatgattgacctaggcctgcaagcttctccttggttacttacaggacaatagggtgcggggttcgcggccatggcatcatgccgacgccgggtaccatcaaccgcacacctgaaccggagacctgcatcctcaagggccaatacatagcccacatgagcatagcccaggacgcctccacctatgaggagcgtataagattccaagtgtaatgagaggctgtcgtcggtgttaggacgctggatttgtcaactgcaatggaagtcgtcgttcatgcgtcgcgcccctgctgggagctgcgggaagtcgtatctgtcgactcggcaattcccgggacaaatccatcatacccaccgcaacaccctccaaccccgtaccggaaaggacgagatcgacccagttgatggtgtcagtggttgggccagctgacttcggcaggggtcctttgttgagggaccggagatcgctcacgggcttgctcactcggatttcgtcgagaacgggtttgaccagcactcggaactctttggtgacctcatcccacttgtcctgctcggcgaggcgctcccatttctcttgccgatccctccactcaggcatttccatgagttcactgaactcaaggggcttgaacctggcattattctgccaagggttggaattccggagggtagcagtactctctcccgccatgtctcaatgctgccgaccgaagttgcgtatgcgctgcagtaatgagagggctttagagtgattatggaatgtgtgatgggatatgcgcaccttgcgctgcttttatcctatgttgccgcaaccttcctgcgcgttctgcggaggcacctgaagccgggcaaaaatcgtatctgtatcccagtatgagggcaagggaggaacagcgtacgtacacggatgatgacgtcctgcgaaaccctcaacaaagtatggagagcgggcatgagtgctatgactgggaccatgcccgatgggcatccggtcaagagtattcgacagaacctagccgtgagcagggtctcccgacacgcccgtactcggttccatgagtgcgttatcgaatactgagagctccaaaatgagcatgcaacgcttcgatactcaatagatcgactgttaatctgccgcaccccagcctgttaaatctttcacggactcggccctgatgagacctccacacacaccatcgccgaagatttcaacatcgcgacatcgctccatcttattcttgtcataaaccacttgttactaagcttgcaaattacatgtgaactcgtcgcacctgcgcttgcttgcctttcgctcaatagccactgtgatccagtccaacgcggggaatcaagcagcgggggcaatggcagaagacagcgaagaggatgatctagaggctttgctgaggcaagagctggagcgtccagcatccagtcttagcgaggaggaggcagggtgcgtcggggcgggtggctcgttccatgggcgctcggctggcgtatgcgcttgccggcatggatattcagcatgcctccccagcctcccgatccaggtcgccgcccgccaagcggcaattcacgggccagtccccgcgcgccggtgcgatggtggaccgtggtcctcggattcatggctgctgctgctaccaggctcctccgcctacacacccctcttcccatgcccctccacctcaatcgcagatgcccaggccccgtcgcccatctgccccccgcaccccggctacatgggcggcctgtgcatccgctgcggcgggctacgccccgagggcgaggagggggcgggcgtggcgctgcgctacatccatgccggcctggaggtcagccagcgcgaggcagcgcgcctgcgccgtggcgcggccgagcacnnnnnnnnnnacgctcgccggcatggatattgagcatgcctctccagtctcccgatccaggtcgccacccgccaagcggcaattcacgggccagtccnnnnnnnnnngcgccccgagggcgaggagggggccggtgtggcgctgcgctacatccatgccgggctggaggtcagccagcgcgaggcggcgcgcctgcgccgtggcgcggccgagcacgcagccgcgcagcgcaaactcaccctggtcctggacctggaccacacgctgctcaactccacgcgcttcatcgacctcaccgagggcggtgagtagggaggggaggggaccacaaggtgtgtgtttgggggggaggagcgcaactctgcttggcgcgattgcaggtggggccgggctggagaagatgggcgctgtgtaccctacttctctggcgccagtggcgcaactgcagtgctgcgctgcgtatgcgccgggctgcgcctggtcttggatggccgcgccaccacggtgcctggcatgctccgctcactcttcgtgttttaggagaagggtcaccttgttgcctccctcctaccaccatttcctggaccggtgcctgcagaggcagcggccctgcagcgcgaggcggccgccggggacgcgggggccccgcccaacctcgtcgccctgcccgcgctgcagacctggacccggctgcgccccggcgtgcgcgctttcctggagcaggcacacaccatctgcgagctgcacgtctacaccatgggcgaccgcgcgtacgcgcgggccatggcggccgtgcttgacccggagggacggctgttctccggccgcgtcatctccgccgtgaggcagcgcaaagggggagggggggagagctgtggggggagtgtatgtcttttcagcgtcttgcccacacctccacagagtatgtttgtttatgttgtgactcggacaggggactgtgcttgccgtagggctcaggccctcctcaaaccgctagccacgccgctccctgactcagcgcatggactcccaccaccacacactcccgcctcgcttcccacctgtcacagccagacannnnnnnnnnggggggaggggggagagctgtggggggaagtgtatgtcttttcagtgtcttgcccacacctccacagagtatggttgtttagattgtgactcggacaggggactgtgcttgccgtagggctcagaccctcctcatatcaccagccacgccgctccctgactcacgcatgaactcccagccccacacactcctgcctcgcttcccacctgtcacagccagacagcacgcagcgcatggtcaaggacctggacgtcgtgctgggctcccccgagcacgtcctgatcctggacgacaccgaggctgtctggccgcgccacggcggcaacctgctgcccatcgcccgctacatctacttccgcgcctgcgccgagcgcttcggcatgccgtgagtctggggtgtggaggaggaggttggggtttcaagtggcggggtcggcggtgtcgcagggtagggacaggatggctgtggcgcaaagggaccagcgggccatgggttcgatgcagcacccaagccgacgggctctctgtacgagcccctgccaggggtccctgctttccttggaaagagcgccggggcgctgccatgcgtggtggcatccggaccacacacctgtcgactcacctcgcgactcccggtgcccaccaggcgcacttcctggatggannnnnnnnnnacaagccgacgggctctctgcacgagcccctgccaggggtccctgctttttctttggaaacagcgccggggctctgccatgcgtggtggcatccggaccatacctgtcgacccacctcgcgaccactggtgcccaccaggcgcacttcctggatggagagaggaggggatgaggaccctgaagcgggtccgttcccggccctgctgcgcacgcttcgatccatccatgccacattctttgacgatctggctggtaggtgccgtggtgcaacatgttgggctggaggggagggcagggcggtgaatgcgcaaggacggtcgaaaagcccgagtgtgggaagccctgtgggacggacccctccccccccccctccttcaacccaccggcagctgggaggagcgcagacgtgcgcccacttgtggccgcccgccggcgcggggtgctcgcaggcgtgggcctcctgctcagccgcatcgtccccttgaccagccccgccccggatgcgcaccccctgtggcgcctggcgacggcctgcggcgcgacctgcacgctgagccccgggccacaggtgacccatgtgatggccccggactggacacagaaggcagtgtggggccgggacagggggctgcaggtggtcaccccgcagtggctcgccgagtcaggtgtgtgcgtgcgtgtgtgtgtggttggggcgggcgggggggaagcatcgactgaaacggaggtcaccaacgcagggatcgcagcctgatgctcatgcaaccccctggccctgatcagggcaccgctgccaggtcgctccccactgcacagccatgaatgcacgagtggcaacagcatttgcggcccccccacccccctctgccccctgcatcgatgcagcggggctgtgggcgcgcgccgacgagtcacggttccagatccccatgcccggggcaggggccggcggggtggtggccccggtgccccctccccgcagcgccgaggaggagctggccgtcgtggccgcggcggccggcggcggccagaccccggaccggtcctgatgtcgtgggcgtctgacgcccggccatgctgccgcattgaagccttgattctcccctgcgtcaacacacacccccacctcgtgcccctgctcataccctggtgccgcctttcccccccttgtacgctgtatggccctctgcgccctcacctcccccgcgcacatgtacctacccctgccccggacaaggtaacacctgccctccttcctcaacactgcggcacatgcatttggtgctccacacccttcaggatgcgggcggctgggcgtcccgcgccgcgccgccccgcgccgccgcggcggccgccttctccgcctccagctccgccaccagctcgtccagctcggcgtcggcgaggaagcggaggcccgcccccgcctccaccaccgccatctccacgttcttagagctggcgtccacgacctcggtcagcgcgcgcagcgcgagcttgagcgtgtcgcgcgggccccccgcctcgtagttcttctccaggtactcacgcacggtcttggagttgcggccaatggcgttggccttccaggcggagtaggtgcccgaggggtcggtctggtacagcgcggggcgccccgcgccatcaaaccccacgatcagggtgctgatgccgaaggggcgtacgcccccgctctgcgtgtacttttgctgggtggccgcaatgtgccgtgtcatgtgctccacgctggccggctcgtccagggtcagcctgtgtgtgtgtgtgtgtgtgatgggggggtggggtgaagggggttgaatggggtggggatccaggtgacatggagtgaggagtgcgatgggaagcggagagaaagcaacgcgatcgtgggttgttcgccctcggggaacacagtcgacggggcccggtcctcttggactcgaccatgaccatccccccactccgccctatcccatccttggacccctccaacttcccaccacacaagtaaccgcggcacctgtgactctgggcctcggtgcgggccttgttgatgagcacgcgcgcgtcggcggtcagccccgcaaaagccaggcagatgtggtcgtcgatctgtgcgatcttgcgcaccgtctgcgacacctgcagcttggccaccgccttcttctccacgcccagcacgatggtgtccgtgccgcgcacgcccacggccagggcccccttcctcacggcctccagggcatactccacctgtgatgttggtttggggtggggaaaggttggacgccactcggccaaggcactgtcaaggcactgtcgtatcttggccaaggcggctacatcacacagcccctctgcctgcgtagccccgcaccctcgggacacatacgaaatgcttgcagcaggtcaataaatacaacatctccctggctcccttacttggaaaaggtgcccatcggggctgaagacggtgatcgcacggtcgtagcgcgccattccggcgtcctgctacccagcgctgaacgcgatgctggatctggatcaagggattgtatgctggatgctgaatcgcaatgtgccgcagcgctccggatgggcatgggcagggtgcgggctacacaaataaggcggtgcgttccacactctcagtccaagcaggtgacagcacagagcacatctgattaccaggtactccgctcctgcaatattacacccacaagcgcaccggctggggctgatcacacggcttgcagcagtgatgaaggnnnnnnnnnnnnnnnnnnnnnnnnnnnnnnnnnnnnnnnnnnnnnnnnnnnnnnnnnnnnnnntcagcaccctggcgactgttcagcagcctcttatcgcacacagagcaaacgccgtggttcaattgagcagagttgcggacaccccttcgtgagattagatcgtctcgattgtaggtcacccatacctcgaatgcgcgcgaggcgcgatctgcagcactcctcctcagtgccacatctgccatgcatgtttgatcgcaattcatgggaaccaactccaaagcgtgagccgcaggtcccactcttcatccaatgatccccacgcatacaatccagtaagcaaggaatatgtgatactccannnnnnnnnngtccaaagcgcgagccgccggtcccactcttcatccaatgacccccacacatacactccagtaagcaaggaatatgtgatactccagtgtccgagcatgtccagccagtcggatgcaggccggggtttggggcgcctgctccgggcccccgccacagtcaccacccggctctgccaggcgggcatcttgatcctcgcggtgtggtgggtctttggccccctgggaggtgtgggcacgaccccgcgggacctgggtgagggcgcgaatgacacgggtcccatcttcaactggcaccccctgctcatgctgctggccttcccggtgctcatgggcgaggccctgctggcgtaccgctcccctgcccccacactggactccaggccggccaggaaggtctaccacatcagcctgcagatctgcgcgctggcgctggcgctgctcggcctgacggcggccgtcaggtcccacaccctcaagctgccgcagcccatccccaacttttactctgcccactccttcctgggaggcttggtgctcgccctcttcgcattccaggtgagaggttgtgtgtgatgagggggcgttcctgctggctggggtcatgtgcgtggcgtggaagggctgatgttaccatcccctgtccttcatgtattcccattcttgggaggggagccggcagcccattggacatgcgtgtggtacgcagtggcattcctgctcgcgagaggctctcccctccaccataccatccgacctctgcccctccccaaactcaatccaaggtggcgctgggcctgtgggcatacgcctggcccaagctctcccaccccgcgcgggtgatattgggcccgatacacaccttcctcggccgcgccatcctcggcctgggcctggcggcggcggcggtggggctgcaggagaaggccaccttcctgcagctgggcgcgggcgcggggccagcctccgccgccctgcgcctgcctgcgctcctgcagctgctgctggccgccgtcgcgctgggcgtgctgtggcaccacgtggagccggcgcggccggggcccggcgtggtgagcctggcgggggacggcatcccgctcttcgagcagcgcacgccgcgcaacagcgccgaccactgaaggaggggggaggatgtatcaatgtccctgcgatgtttcatgtgcacatgcaacattgctgtgtggcccacacctctttgtgagaccaccctgtgtatttcccaacactccgccggggctgcattcattaaataagtggccgagggccccaggcgcacagggtaaagtgccannnnnnnnnncgatgtatcgatgtccctgcgatgttgcatgtgcacatgcaacatcgctgtgtgccccacacctctttgtgagaccaccctgtgtatttcccaacactctgcgggggctgcattcgttaaacaagtggccaagggccccaggcgcacagggtaaagtgccagtggtggggtgtcacaggaggagggaatgcaaggtgccgtcgggcgcagcgagcacacccctccgccgtcccatcactcctcgtcgtagtcgtcctcatcgtagtcatcctccgttggctccgggtcctgcagggccgtcccagcgggccccgccagggactctgcagccgcagaggctggccccgggtcagcccctgtcccttgcgccgggtgggagctccctcgctccgtaccctctcctacgaccaaaggggcctgctccactgtatccccgccgtcgtgagctggcaaggatgcagcctcctgctccggcccagcggcggctgcctgttgcagcccgggcgcctcatcccctccgccagcggtgcccggggcaccagcctcgccggccagnnnnnnnnnntggcacctcgtcccctcctccagtggtgcccggggcaccagcctcgccggccaggacggcggcctgccccgcgcctgatgcaggcttcttctgtcgtggggcgcgaggctttgccgggccggcggtgcggccctcctccttcgctgcaggcctggggagggggagatacggggggtctggtgggagcgctgcctgtacagtgttgaaatccattccagagaaaccccgaccatgccccatcaccccatacgtccgcactttgctcgcttcttggcgcgcggcgtcgctgcctccacctcgtcggtgacgggcgggaggtctgggacctcggtcacggcctctcggcaaaagtccagcaaaggatctgactggacgtgggccttgctgcaggcaatggtgnnnnnnnnnnagccacggcctctcggcaaaagtccagcaagggatccgattggacgtgggccttgctgcaggcaatggtgggagaactttggtggtgactgtgctggaaactcagggtggattgtgcagaggtggaggttgtggaaatggtgcgggaacgactgggcgggagttagtcagaagaggctcccagggcctcgtgagatgaggtaccagagcagtggtctccccttgacaagcatggggggagggtgacacagctcccaccactcacatgtgggagctattnnnnnnnnnntgtgagatgaggtaccagagcagtgatctcccccagacaaggatggggggagggtgacatagctcccaccactcacatgtgggagctattgaggatcttggcattgtgctgctgtgctatggcaatggacccctccagcaacttgctcagaaaatcgtccagggccttggctgcatgggggtgtgcattcggcttgctgtgagcgcctcttcgtcaaatccttgtgcgctaactttcgacacccaaacttccctcctcaggccannnnnnnnnngttgtgctgctgtgctacggcaatggacccctccagtaacttgctcaggaaatcgtccagggccttggctgcatggggttgtgcattcggcttgctgtgagcgcctcatcgtcaaatccttgtgcgctaacttcgacacccaaacttccctcctcaggccaatacccatcgccctcgctcacagatgaggatggggctggccttggtaaccttgcccacgtcctcgtccgactgcatcattttcttgatgcgggctgtgaagggcgcatggtttcgaaaaaacttggagttcgaggacaaggggccctcatcccccgtcccggcgtcatccggcattgacatagaggcagcggatgggcaagggcaacaggtacaggctcgtatgggggcccctcttgtggttctgaaaatagcagcggcctctatgtgctctcctaggcccttttgtaaccggttcaagcgtacgcatgtattgctatctggtcaatcccactagcaccccgaggagcgggtaacatcggccatgccgggtggtgtgtgggttcggaggaagttgaacacagcgcgcgctcgaccatgtcgaccatgtcgcgaacgatggcatcggctcggaacgcaccaatcgcacgtatcctccatgagagatcccacagaaattttgcgggtaacaaataatacactgagatactcctcacgtgtatttgttgccgatgtgggtcctctccaggcagccctccctctgagtgaccacagccctcaaacacacgttcttcgctcagttcacgcttccagatcgcggtagggatatgtagacagacactgaccactattataagatgggccaggctgtctctggcctctggaggcagcttttcgggtcaggagactacaagatcgtcatggtgcgtggatactgtgtgcaggggggttttcccctcaaggtcgcatgccagcaggccgttacgctcccagtccctggcagatccgtcccaccatgatcctcggcaggtggggctggacaatgcaggaaaaacgaccaccctgtaccacctgcacatgggcgagacggtgaaaacccagccaaccatagggagcaacgtgagtgccaggggggggcacatgcggagcgcgaatgaccagtcgcggcatgccagggctttgaggagtggtccaagctacatgtacactgtgcgtctgccgtatctgatgcgaggtgatcgcgctcagtggatgcctgccatggtacacttcaccctctttccaacccaaatcacaggtggagcaggtcaaggtcgannnnnnnnnnggctacatgtgcactgagcgtctgccccatctgatgcgaaatgattgcgctcagtggatgcctgctatggtacatttcaccctctttccaactcaaatcacaggtggagcaggtcaaggtcgannnnnnnnnncagtttgggatttttttacaatgtgagactgcattccagacatgtacctgcatgatgtggcaacgatgagcagtcgagcatgtgtggatgtctgcaaggaaaggccagctcaacttcccgcggcgcccgcccctgacacgccaccctcgtcaccacatcatccttgcccctaaaaaaccctccactacaccctcaacctccaggtgtgggatctgggcggccaggtctcgctgcgcctcagctgggcggcttactacgccagcacggacgccgtgatcgtcgtgattgactccactgaccgcgcccgcatgggcatcgcccgccaggagctggcaaacatcctggccagcccccagctggcaggggcatgcatcctggtctttgccaacaagcaggcgaggggcggcggggggatgagaagatggttgtcgccgggtggggacgacccatgcgccgccgtcctgccacattttgtggtctgagtgcaaagaattgactttacacccccctcaccacctcacacagacactaacatgaacatgcaccccaccgcaaaccctaccatgtacaggacttgccggaggctatgtcggttcaggagctgagtgagacgctggacctcgtgagcatcaaggaccacaactggcatgtgcaggtgggcagctgcagagaaggtgggctggtggccgtggagggccccgtctcctgctctcacccccccttcccccccctttttcatccctcacgcccaggccagctgcgcggtgtccggtgagggcctcaaggaggggctgcagtggattgcgcggcatgtcaaggcccagaacgcctccatcttcccctccctcccgtccttgacatgatgcaggggttccagggtcgtgcccctggccccccgccgtcccacccctgtgcttgcggccctatgtggcaggttcaaaacactacacgacagttaggggttcctttgcaggacaccaagtatgttgatggtccagcgaaacaccggccctaggcatggttgtcagaaaggggaaggtgaggtgtgggggaggggggagcacgagaagtatacggtggcgtggccgagtcaggcatgtccaagcacaagtaggggggccgtgtgggctataacaccccaggcacgcgcatgaggacgaagctgagcaccgcgacgagcatcgcgacgatccagcccagcgccgccttggtgctgctgggatggagggtgtggatggggaaggcacagtgagtgagagattgcgnnnnnnnnnnggaagctgagcaccgccacgagcaccgcgacgatccagcccagcgccgtcttggtgctgctgggatggaaggtgtggttggggaaggcacagtgagtgagagattgcgcgacgccgctgtgatcgctgggtggagcgaggatgcgaggagcactggtccattgccgtttgtcgcaccatcatctgttcttggcacccacggcccctgactgggcagcgcccaacacacctgggggcagctttgagctcctcggtcagcttcacatactgctgagccgcgcggatgcgatctgctgcggcctgggcctggtcgtgatgaaagggaagacgacttatcatcctgatccagaatgaagctgacccatgtacacatccacaccgtcgtgcaacagaagggaagcctccatgccaaccacagacctggacattgaccagcagctcggcaaccatctgcagggcctgggtgtgctgcatcagcaccgtttccagggagtccacctgctccttcagcgactggccgccggtggaggcctcgactgcagggctgacgtccacagccgggtcctcctgcatggtgggaggggtagcggttgaggcggggggcccggaaccggggaaagcgatgcacagatgtccatgaggcgctgtcgacaggatttggcatccacggcacaccttggcaggctcccctggcactcccgccttgatctacggtagtggtggtcggtgagggggtgagcggttgggcgccaggcggtctccatgccccacgcagtggtctcatcgcccctgccactcctgtttttgaggctcagaggggctggtcttctgcacagaccccaaagccaggtcagcggacgtcttgtggagcagcatctcctcagttccgctaaccgcgtcatgtcgctcagtgctcgtaatctgttccgtcattgtgataagtaagcgtgtttggcttccaatcaaatgcgtaaagggggcagcaaaacgtcaggatggatcgcggctgtacgagagtgtccatgtctccaacagctttcaggtttcaacatccgggcccccgtcatgttcatgctgcgcctgctcccccagctcctcgacaccccccctctcgacagcatcatcagcagatgcacctgaggaggcatctagatcccacacaacgcaagcaatccggtgggagctcgtctatgtgctctagtaacgactcttagtccgtttatatgctgtcggctgcggcctgcttgatgcaccatagccaggatcacttccgtcgcctgcctgctgagccggagacgggccatcgccgagagcaaggactcgtgcttactatgttgaattaaaaagaagagatgggaaattcccagagcggcgcgacggcccgttttagtcaggcagaggctctgggagagttgccaggagtcacctacaaggacaccctaggtgggatgtggctgtgctcgccgggggccccaggcgacgcaggccaagtcagcgcatgtttgatttaaccgattttgtttccaaaactaaatctcacagggggagggcgcttcttgaaaagctctctgtgtctcacagatgatggccagtcggtggttgcaaaggtgaggatggtacggcacgggaagcccactcatcggctggagaaagggaggcgttgccccccacctctccttgcccccacccctcccaggtgtaccccaaagagtctgaggcgacgctggtgcgcatgtacgaggagcgacttgcgagcatccggtgcgcaggctgctgccctgcgcccggcaggctcttgggagggggcactgagctactggtgcaggacagggctctgggcatgcagtgccgggtcaggggtgctgccgtgcatgcggcagcttcaaccaccctccccacatccctcgctcctgccccagtaccgccttcctgagcatcgactacccgcatgtgctgccgatgcagcgcatctacgagtccgacaggtccgtcttcctcgtccgccagtacctctttgccaacctggcacagcgcatctccacccgccccttcctcacggccatcgagaaggtgcgaggcacagccaggggccatggcctgcaggattaggtgttatctgctgaaccctccttcagctgaaacacatggatgcaggaacccctggcagcaccttatttcccccagtgcctatacattgcagctctggatagctcgccagctgatccannnnnnnnnntcccagccaggggccatggcctgcaggattgggtgtcatcagctgaaccccccttcagctgaacacatggatgcaggaacccctggcaccaccttatttcccccagtgcctatacatcgcagctctggatagctcgccagctgatccaggccgtggcccagtcccacgccgcgggtgtgtgccacggcgacatcaaatcctccaacttcctgctgacctcctggcactgggtgttcctggcagaccacnnnnnnnnnnagcgggcgtgtgccacggcgacatcaaatccgccaacttcctgctgacttcctggcactgggtgttcctggcagaccacgcgccctataagccggtctacctcccggctgacgaccctgtgcgcgccgggggagtgaaaggggtgattggtgggcctgcatcgacaactcctgagcagcgagggcgaggggaaaacagcgcgggtgcacatgctgagcatccgtcctcctttctgcgaggtctcctctcgcccgaccgcaacattccaccccctcaccctttcactcctctgcacaggccgactactccctcttcttcgacacggacggcaggcgcacagcgtgcatcgcacccgagcgctttgtggacgtgggtcacggcaggccgctgccgcctgccccccacgcctgcacccctgccatggacgtcttctcnnnnnnnnnnatttgtggacgtgggccacggcaggccgctgccgcccaccccgcccgcctgcacccctgccatggacgtcttctccctgggctgcacgctggccgagctctttctggacggccaggccctcttcacatactccagggtgggccggtgtggggagggcgatgtggaggctggggtgtgttctacaggaggaacagggccctgttcccgctgctcaggagatccagccggcatcttacgggccatctttttagatcgaaccttcctggccctcatgactcgtccctattcagtggctggtctcatctccatatccactgggctccttgttcctctttcaccgccgaatacactcacgacgacatccccacccccccccacacacacaaaacgcagctgctggcgtaccgggcggggnnnnnnnnnntcacggtatccccccccccacacacacacaaaaaaaacgcagctgctggcgtaccgggcggggtcgttcgaccccgggcccagcctggacaggatgccgcccggggtccaggacctggtggcccacatgctgcagcgggacccgtccgccagggccggggcacaggcctacctggacggcgagctgggccggcgcgccttccccgcctggatgggcgacgtcgtgcaccctttcttcgcgtccatgctgcgtgcgccgccggatgagcgcgtggccttggcctgcgccgagctgccggcggtccatgcccagctggcaggtggggttggtgggaaagaggtgggattgtggttgtgtgtagggtgcattggggtgtcggtggcaatgctttgggtgtccaggtaccatcgccagggccatggccgccgcggggaggggcttttctttgggcaattcgcacatggaaagcatcacgagtgcgagctgggcctgtgcctctccacacaccctgttctacaggcagcgacctgcccgaccagactcggggcggcctgaagccctcccgcagcaacccaaacgaccctgcgccggtgcctgcgccggcccagcccggacatgcagggagtcggggtccctttccccccgatcccgactttggctcggagggagaaggagagnnnnnnnnnncaccgaccctgagccgatgcctgcgccgccccagcccggaaatgcagggagtcggggtccccttccccccgagcccgactttggctcggagggagaaggagagaggccgggccgtggcgcactccccggccccaaggccctgctggaggaggtgcagagggtggcggggcggctggagcacggcggcagcgcaggaaatactgagggcagacaaggaggcgatgtggcggctgccgcggcaagcagcgaggcgcggggcccggggcccggagcctcccagggcgccagcgcgagccatcgccgcccgggccccggcgacgcgccgag

SEQ ID NO: 45976 - DNA, 106 bp, Chlorella protothecoides
ggtcgacaactggcactccccggagctgaactacctcacgcgtcgatagacgcccctccctcctcctccttctatttccgagtttcgtaattaccttgaaacgacc

SEQ ID NO: 45977 - DNA, 73 bp, Chlorella protothecoides
tcgcttttatgttattcatgacaatgagatccagatttgggcctacggaggggttgcacgcatcgatgctggt

SEQ ID NO: 45978 - DNA, 61 bp, Chlorella protothecoides
atgttgtcttcagttgagggggccggcgggttccccttcctggtggcatcgtatacagtgt

SEQ ID NO: 45979 - DNA, 61 bp, Chlorella protothecoides
gaggtgggacgagcaccttctccgcgagctggacaccgtgctggaggccaggggggagctg

SEQ ID NO: 45980 - DNA, 76 bp, Chlorella protothecoides
ccgccgccatctccaccccccagccctccagcatccctatctgacgattgctcgagtgcacccgtgatgaccctga

SEQ ID NO: 45981 - DNA, 64 bp, Chlorella protothecoides
aactttggactccatcctttcaatgtgcaagggaacatcattcctcatcaacccccttcccctc

SEQ ID NO: 45982 - DNA, 138 bp, Chlorella protothecoides
tgatatcagttgtgcagcactccatcatgcacgcaagtcgcgtgggatcgcgtgcatttgtcgagttgcaaccctgccagcagcaccgggcaacggtactccgggcaaccccgctcggattcagtaggcactggacct

SEQ ID NO: 45983 - DNA, 61 bp, Chlorella protothecoides
tgcacagggccagggcacccccagggcccgcagctcgccgcaactgggcgcgctcaagcac

SEQ ID NO: 45984 - DNA, 63 bp, Chlorella protothecoides
gtggcaatgacttgccatggaatcgacgtgagcaccggcaacctcaggagaatgtcagagggg

SEQ ID NO: 45985 - DNA, 62 bp, Chlorella protothecoides
cagctctgggccgaggcggaccacccggctcattcctcgttcggtgacctgggactgcacga

SEQ ID NO: 45986 - DNA, 61 bp, Chlorella protothecoides
gttcaatttttggatagaaaggggggggggaggtcctgaggcccctgtgccggcatgaaga

SEQ ID NO: 45987 - DNA, 61 bp, Chlorella protothecoides
gtgacagcacaaccaccactttcatgagcttcaggaaatctcatgggcatgatggaatagt

SEQ ID NO: 45988 - DNA, 69 bp, Chlorella protothecoides
aaggggcatgggccaagttttgttgccgacattgcctggctcatcctaaaatgtcccttcccttccctc

SEQ ID NO: 45989 - DNA, 65 bp, Chlorella protothecoides
aaagtatccgtaagtgctgacaacatgctccatccatcaaagtgcctgaggtgtcctgtggacct

SEQ ID NO: 45990 - DNA, 72 bp, Chlorella protothecoides
cccagcccccgcgattggatgagcatcacttcctccccccccccattgagaaattgcctctccacacagcga

SEQ ID NO: 45991 - DNA, 61 bp, Chlorella protothecoides
gaacgggtgatgttcttcatgagcatagccaccccaccggtgcacctcggccagaacgagg

SEQ ID NO: 45992 - DNA, 77 bp, Chlorella protothecoides
gcaggaggagttttatggccgtccagtgataatcgcagacagggagatggtggagatggtgagcagggccttggatg

SEQ ID NO: 45993 - DNA, 79 bp, Chlorella protothecoides
cccgccacagaatatttcgtattttatagagacttgggcatgtctcaggtcctcgatacgaggcatctatgacgcccaa

SEQ ID NO: 45994 - DNA, 617 bp, Chlorella protothecoides
cctttactcaagggtgaggcaaggtggcatagcgatacattttcacaacttcaatgtctggtttgcacattctctcaagatcggaggactacttacagggaagcgcattatagaagaaggtattttttaatggcctcaagtaatccaggtgcctccagctccttcagtttgtccgccgcaagaccgctgatcatggcaaattgcgtgttgtactccctgaggagtgctacgagacaattgtactggaacacgatatgagcatcctcgtcactgtccgtgtactttgccacatgctcctccacagatgtgtacgacggactccactcgacagcgaaggatgtgaggagcaagacaaaagcggcctgcaggttgggatgtgcctcgggtgaaagcatgcccggagcggacagagactgctcccaaacagatgctggagcctcgagagtcttccccctgggaacatttgcatacctcctgatgtgccaaggtttccttcacgtaagccaggaggtcctccggcacgtccttgatgtttgacagattcttttcctcgagcaagctgagaccttcaatgtctagattgtggcctactagatcctccttggcatcctgcaaga

SEQ ID NO: 45995 - DNA, 92945 bp, Chlorella protothecoides
  modified_base (171)..(180): a, c, t, g, unknown or other
  modified_base (795)..(804): a, c, t, g, unknown or other
  modified_base (1026)..(1206): a, c, t, g, unknown or other
  modified_base (1281)..(1290): a, c, t, g, unknown or other
  modified_base (1945)..(1954): a, c, t, g, unknown or other
  modified_base (2653)..(2662): a, c, t, g, unknown or other
  modified_base (3173)..(3182): a, c, t, g, unknown or other
  modified_base (3526)..(3535): a, c, t, g, unknown or other
  modified_base (3922)..(3931): a, c, t, g, unknown or other
  modified_base (4090)..(4099): a, c, t, g, unknown or other
  modified_base (4461)..(4470): a, c, t, g, unknown or other
  modified_base (4615)..(4714): a, c, t, g, unknown or other
  modified_base (4890)..(4899): a, c, t, g, unknown or other
  modified_base (5306)..(5315): a, c, t, g, unknown or other
  modified_base (6427)..(6436): a, c, t, g, unknown or other
  modified_base (6802)..(6811): a, c, t, g, unknown or other
  modified_base (7070)..(7118): a, c, t, g, unknown or other
  modified_base (7261)..(7270): a, c, t, g, unknown or other
  modified_base (7355)..(7364): a, c, t, g, unknown or other
  modified_base (7449)..(7563): a, c, t, g, unknown or other
  modified_base (8536)..(8545): a, c, t, g, unknown or other
  modified_base (9011)..(9020): a, c, t, g, unknown or other
  modified_base (9391)..(9400): a, c, t, g, unknown or other
  modified_base (9567)..(9576): a, c, t, g, unknown or other
  modified_base (9869)..(9878): a, c, t, g, unknown or other
  modified_base (10183)..(10192): a, c, t, g, unknown or other
  modified_base (10752)..(10761): a, c, t, g, unknown or other
  modified_base (10824)..(10833): a, c, t, g, unknown or other
  modified_base (11606)..(11615): a, c, t, g, unknown or other
  modified_base (11893)..(11966): a, c, t, g, unknown or other
  modified_base (13256)..(13265): a, c, t, g, unknown or other
  modified_base (13689)..(13698): a, c, t, g, unknown or other
  modified_base (14338)..(14347): a, c, t, g, unknown or other
  modified_base (15294)..(15329): a, c, t, g, unknown or other
  modified_base (15596)..(15605): a, c, t, g, unknown or other
  modified_base (18571)..(18580): a, c, t, g, unknown or other
  modified_base (19280)..(19289): a, c, t, g, unknown or other
  modified_base (20133)..(20142): a, c, t, g, unknown or other
  modified_base (22067)..(22076): a, c, t, g, unknown or other
  modified_base (22129)..(22138): a, c, t, g, unknown or other
  modified_base (22756)..(22765): a, c, t, g, unknown or other
  modified_base (23099)..(23108): a, c, t, g, unknown or other
  modified_base (23291)..(23300): a, c, t, g, unknown or other
  modified_base (24266)..(24275): a, c, t, g, unknown or other
  modified_base (24760)..(24769): a, c, t, g, unknown or other
  modified_base (26616)..(26625): a, c, t, g, unknown or other
  modified_base (27258)..(27267): a, c, t, g, unknown or other
  modified_base (28400)..(28409): a, c, t, g, unknown or other
  modified_base (29405)..(29414): a, c, t, g, unknown or other
  modified_base (29480)..(29489): a, c, t, g, unknown or other
  modified_base (29685)..(29698): a, c, t, g, unknown or other
  modified_base (30683)..(30692): a, c, t, g, unknown or other
  modified_base (30768)..(30777): a, c, t, g, unknown or other
  modified_base (31336)..(31345): a, c, t, g, unknown or other
  modified_base (32351)..(32360): a, c, t, g, unknown or other
  modified_base (32926)..(32935): a, c, t, g, unknown or other
  modified_base (33214)..(33223): a, c, t, g, unknown or other
  modified_base (33590)..(33599): a, c, t, g, unknown or other
  modified_base (33898)..(33907): a, c, t, g, unknown or other
  modified_base (34404)..(34505): a, c, t, g, unknown or other
  modified_base (34913)..(34922): a, c, t, g, unknown or other
  modified_base (35572)..(35581): a, c, t, g, unknown or other
  modified_base (35635)..(35644): a, c, t, g, unknown or other
  modified_base (35903)..(35912): a, c, t, g, unknown or other
  modified_base (37231)..(37240): a, c, t, g, unknown or other
  modified_base (38691)..(38700): a, c, t, g, unknown or other
  modified_base (38838)..(38847): a, c, t, g, unknown or other
  modified_base (39289)..(39298): a, c, t, g, unknown or other
  modified_base (40565)..(40574): a, c, t, g, unknown or other
  modified_base (41313)..(41322): a, c, t, g, unknown or other
  modified_base (41503)..(41512): a, c, t, g, unknown or other
  modified_base (41902)..(41911): a, c, t, g, unknown or other
  modified_base (42159)..(42168): a, c, t, g, unknown or other
  modified_base (42644)..(42701): a, c, t, g, unknown or other
  modified_base (42829)..(42838): a, c, t, g, unknown or other
  modified_base (43004)..(43013): a, c, t, g, unknown or other
  modified_base (43247)..(43256): a, c, t, g, unknown or other
  modified_base (43320)..(43329): a, c, t, g, unknown or other
  modified_base (43830)..(43839): a, c, t, g, unknown or other
  modified_base (44043)..(44224): a, c, t, g, unknown or other
  modified_base (44331)..(44505): a, c, t, g, unknown or other
  modified_base (44635)..(44644): a, c, t, g, unknown or other
  modified_base (46126)..(46135): a, c, t, g, unknown or other
  modified_base (46934)..(46943): a, c, t, g, unknown or other
  modified_base (47055)..(47064): a, c, t, g, unknown or other
  modified_base (49547)..(49556): a, c, t, g, unknown or other
  modified_base (50036)..(50045): a, c, t, g, unknown or other
  modified_base (50113)..(50216): a, c, t, g, unknown or other
  modified_base (50426)..(50435): a, c, t, g, unknown or other
  modified_base (50555)..(50564): a, c, t, g, unknown or other
  modified_base (50812)..(50979): a, c, t, g, unknown or other
  modified_base (51468)..(51477): a, c, t, g, unknown or other
  modified_base (52643)..(52652): a, c, t, g, unknown or other
  modified_base (53160)..(53169): a, c, t, g, unknown or other
  modified_base (53643)..(53704): a, c, t, g, unknown or other
  modified_base (54308)..(54317): a, c, t, g, unknown or other
  modified_base (55007)..(55016): a, c, t, g, unknown or other
  modified_base (55393)..(55402): a, c, t, g, unknown or other
  modified_base (55812)..(55821): a, c, t, g, unknown or other
  modified_base (59758)..(59767): a, c, t, g, unknown or other
  modified_base (63616)..(63625): a, c, t, g, unknown or other
  modified_base (63689)..(63818): a, c, t, g, unknown or other
  modified_base (63923)..(63932): a, c, t, g, unknown or other
  modified_base (64630)..(64639): a, c, t, g, unknown or other
  modified_base (68049)..(68058): a, c, t, g, unknown or other
  modified_base (68496)..(68505): a, c, t, g, unknown or other
  modified_base (68906)..(68963): a, c, t, g, unknown or other
  modified_base (69842)..(69851): a, c, t, g, unknown or other
  modified_base (70518)..(70527): a, c, t, g, unknown or other
  modified_base (71058)..(71067): a, c, t, g, unknown or other
  modified_base (71356)..(71365): a, c, t, g, unknown or other
  modified_base (71662)..(71671): a, c, t, g, unknown or other
  modified_base (72268)..(72277): a, c, t, g, unknown or other
  modified_base (73420)..(73429): a, c, t, g, unknown or other
  modified_base (73533)..(73740): a, c, t, g, unknown or other
  modified_base (73902)..(74027): a, c, t, g, unknown or other
  modified_base (74328)..(74337): a, c, t, g, unknown or other
  modified_base (74844)..(74853): a, c, t, g, unknown or other
  modified_base (75591)..(75600): a, c, t, g, unknown or other
  modified_base (76002)..(76011): a, c, t, g, unknown or other
  modified_base (76431)..(76440): a, c, t, g, unknown or other
  modified_base (76713)..(76722): a, c, t, g, unknown or other
  modified_base (76997)..(77006): a, c, t, g, unknown or other
  modified_base (77218)..(77227): a, c, t, g, unknown or other
  modified_base (77348)..(77597): a, c, t, g, unknown or other
  modified_base (77725)..(77734): a, c, t, g, unknown or other
  modified_base (78015)..(78024): a, c, t, g, unknown or other
  modified_base (78188)..(78197): a, c, t, g, unknown or other
  modified_base (78394)..(78403): a, c, t, g, unknown or other
  modified_base (78677)..(78686): a, c, t, g, unknown or other
  modified_base (79076)..(79085): a, c, t, g, unknown or other
  modified_base (80082)..(80091): a, c, t, g, unknown or other
  modified_base (81100)..(81109): a, c, t, g, unknown or other
  modified_base (81366)..(81375): a, c, t, g, unknown or other
  modified_base (82202)..(82211): a, c, t, g, unknown or other
  modified_base (82288)..(82297): a, c, t, g, unknown or other
  modified_base (82375)..(82384): a, c, t, g, unknown or other
  modified_base (82764)..(82773): a, c, t, g, unknown or other
  modified_base (84986)..(84995): a, c, t, g, unknown or other
  modified_base (85082)..(85322): a, c, t, g, unknown or other
  modified_base (85394)..(85421): a, c, t, g, unknown or other
  modified_base (86001)..(86078): a, c, t, g, unknown or other
  modified_base (86279)..(86440): a, c, t, g, unknown or other
  modified_base (86791)..(86800): a, c, t, g, unknown or other
  modified_base (86859)..(86868): a, c, t, g, unknown or other
  modified_base (87266)..(87275): a, c, t, g, unknown or other
  modified_base (88223)..(88275): a, c, t, g, unknown or other
  modified_base (88643)..(88652): a, c, t, g, unknown or other
  modified_base (89285)..(89294): a, c, t, g, unknown or other
  modified_base (89361)..(89389): a, c, t, g, unknown or other
  modified_base (89598)..(89607): a, c, t, g, unknown or other
  modified_base (90744)..(90753): a, c, t, g, unknown or other
  modified_base (91198)..(91207): a, c, t, g, unknown or other
  modified_base (91811)..(91820): a, c, t, g, unknown or other
  modified_base (92084)..(92093): a, c, t, g, unknown or other
tgttttggggtggggggggagggggggaggaggggggtcagcagttgaatatgtggggtgggtggggggtagcaaaggcgcaggtgcaaggtgtcagaaggctggagagaactggaggttattataaagcggcaggggggatgcctgccgccagccctccggtgcagtacnnnnnnnnnntggggtggggtgggggtagcaaaggcgcaggtgcaaggcgtcagaaggccggagaaaactggaggttctcagaaagcggcagggggcatgcctgccgccagccctccggtgcagtacaaagaggtggtgtggccgtggccctccacagagtccgggtcacgccccaccaacacagcacccctcgcctcgctcatctgcctccagcgcacccctggagagtcggcgtccatgagcagggtgatggtgccgttgggcgccggggtggggatggcgacgttggggagggagaggagcgctgcgcggaagctggcggcgtgctggggcgcagtgaaggccccgagggactggtgcgaggcgtttgccggcggcctgtggagggtggtggtgggaaggggggggggtggtgaactgaagcattggctgtcgatgaacttggggcttggccagggccggctgaaccgggatcgcctgccgccgcccgcggctgagggccaagctgtgattggcacacgcgctctccccgcagccccccatgccgcggcgtgctggatcagggccctgccgcccaaacaaccacccacgccgccggcgctgtagcacaaccgctcacctgannnnnnnnnntgggatggtgaactaacgcattggctgtcgatgaagttggggctcggccagggccggctgaatcgcgaccgcctgccgccgctccccgcagctgagggccaagttgtgatcggcacacgcgctctccccgcagccccccatgccgtggcgtgctggatcagggaactcccgcccaaacaaccacccacgctgccggcgctgtagcacaaccgctcacctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctatcccggcccatcaccatgctgagcagcgcccacacgcccggcgtgtgggcggcggcccctcgctccagcnnnnnnnnnngtgccactacatgctccaggcccagccagaggccggggggaaggcgggccaggtcgtcgaagaagagcagcgtgggcaggggcccggccctgtcccggcccatgaccatgctgagcagcgcccacacgccgggcgtgtgggcggcggcccctcgctccagccccgggatcaacaccgtggcgggcgcggcggcggggccctccgacaggtgggaccaggcggcggccagggcctctacccacgtgcccagcttctcggcggttgccggggtggggtggtccagcaccagggtcaggccggggagccatgcggtggccaggttgcccaccgcgcgcgccaccgaggcgacgggcagcttgatcagggggagcgagggggagaaggggaagtcggtccgcgtcgaggcaaggcacgtggcatcgctggggtcgtggatggcgtagaagcgactgtggtggaacctgcaagaaggaaggaacagggatgccttgaaacaggtaccagcggtccacagccaccgtggcccgagagtgggtgccttcaggatggggggatgtcaagggggtggtcacggcatccttacaagaggtacgaactcacggccccccatccttcaaagcagcgtgggcataggaggccagagcccaatccaccnnnnnnnnnngtcaggatggggggatatcgagggggtggtcacgacatccttacaagaggtacgaagtcacggcccccatccttcaaagcagcatgggcataggaggccagagcccaatccaccaaccatatgctgaacgcatgcgcggcgttctggcgctcctccaccctggtcccaagcactacagacgagggggtgcaggtgatggtctaaaggcaggtacagcggcctctcgtcaccctccatgagctacttatcgctccaattcgggcaaagacggtgcctacatttgtctggcagctcttgttggtaccagggcagggagtctccgctctcgggggtgccctgagcttgtgttgcgacgaggaggaagaaggcggcgagcagtgcccggctccggccactgctcgatcccgccgtcatgatcggttcagaatgtggggtagctgcttatagcaggagaatatgtccctggccaagttgaggaagcctggccattttgttggcgtccaacagggtttcggagggaatgacagttcaagctcgtcgacgtaccgcgctcctcatgaatacatcagctgtagaattcacattctttgcgatacaattgcgcgcacttggtgtcgatcaccctcaacccggagcgcgggtgggtctcagctgctgtcagacaattgaactcccatcagattgcagggaaaaccatannnnnnnnnngcttggtgtcgatcaccctcaaccccgagcgcgggtgggtctcagctgctgtctgacaatttaactcccatcagattgcagggaaaaccatacctcgcaaagcatcaccacatgtatgcgggcatgactgcatgtatcgtttacattccaacgtgtccttcaactttggacaatgtacagctacactgtgttcagtatgcacgaggggaatacacgccaatgctaacctcctggatgccgtggccaccgtgccacgacgagacgttgccgtgcagattcgaagccctacacgtctggtggacattgacgttcatggtgtaggctgcatgatcaggacgttgcttaagaaatacatgtaccctgcagtcacgctttttaattgcattgtgcgcatgttggtagccctgcagaatgacgtgtgggctgcagcaaacagaatagagctgcacagaggggcccgctccggaggcaagcagcccatggtgcctccaaatctgtacaacgcagtcannnnnnnnnntgttgccgtgcagattcgaaaccgtacacgtctggtggacagtgacgttcatggtataggctgcatgatcaggacgttgcttaaggaatacatgtaccctgcagtcacgctttttgattgcattgtgcgcatgttggcagccctgcagaatgacgtgtgggctgcagcaaacggaaaagagctgcacaggagggcccgctccagaggcaagcagcccttggtgcctccaaatctgtacaacgcagtcaacccatcaccaatcatccacaccaatatgtttgtggcatcgagcatgcacgtgttgacagtgactgaattgcagctcaaatgtgagtgtgattgannnnnnnnnngatatctttgtggcatcaagcatgcacgtgttcacagtgaccgaattgcagctcaaatgtgagtgtgattgagaagcgtggccaggggccagagccaggatcagagctggcccttctggaggaggggagcacgcctcatccgatccccgttgcggaaggcaccgagatgatcccctttgcagcaacagggagccacattttggctcgcatggtacctggccttgggttacaatcattcgtctcaccgacaggccaccatttaggcaagcttgcttcggcgttcttgcacctgagggccacgttgtgtgtgaagattcacccacaccccgacgggaatcttgttacaaaaacaaaccccgaccaagcattgcaagcttatttcgaagnnnnnnnnnntcccacaccccgacggcaatgttgttacaaaaacaaactccgaccaagcattgcaagcttatttcgaagcgctatacttcgacggaatttactccttcattgtcccaaggcatccggaggattggcatgagagagcgcccctcccatgcggaccgtcgnnnnnnnnnnattcgacggaatttactatttcattgtcccaaggcatccggaggattggttcgagagagcgcccctcccatgcggaccgtcgccagcacggttcgtccttgtcacaaaggaccatcctctgtgatcgatgtacagcgagttccccagcagcttgtcgcgagataagaccacaatgctgcccttgcactgccacataccttgggaaaagctgtaggtgcccattttgaggaggatgtatggccggcattcgatgttggtggagccacgcaaaagtgctgagacatgcatgaagtgcattcaaggtaacagtatagaggactttaaaatgcatggcattagccctctgagctgtagtgcacacnnnnnnnnnntggggccagggtcaggatcagacctggcccttctggaggaggagagcacgcctcatccgatcccctttgaggaaggcaccgagatgaacccctttgcagcaacagggagccaagttttggctcgcatggtacctgcccttgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtcaaatgtcgtggaccccgcccaggaggtgctttgccacgatgcgggactcgattccatccgggaactcattcaagtcacaccggcatgggacatcagccaagcttcctgatactagatagttcatatcggcaaattgattttctttcttgcatctaagccagcggcccatgnnnnnnnnnncttacagcgaattaccaagcagcttatcgcgagataagaccacaacgctgcccttgcagtgtcacatacctcgggaaaagctgtaggtgcccagtttgaggaggctgtatgaccggcattcgattttggtggagccacgcaaaagggctgagacatgcatgaagtgcatccaaggtaacagtaaagagggatttaaaatgcatgggcattagccctctgagctgtagtgcacactgcgcaggagtctcattctcgtgtacagggcttggttatcagacaacacaacaaggtgtgtgaaagttcctatcgatggcccgaaaccagttctcgctatggaggaacccatatgctatcctgaaaattacaacatgcaaataggatctcccaaacaaagtctggaggtgccnnnnnnnnnnattaccagacaacactaccaaggtgtatgaaagttcctattgatgccccgaaacgagttctcgctatggaggaacccatgtgctatcctgaaaactgcgtcatgcaaacaggatctcccaaacaaagtctggaggtgcctagagactcaggatgtccacggagaaccaaacatcaaagtttgaagaggcgtgtgctatgtcatccaagtatgtgctgttgagtcctcatcagtcaaaaatgtcgtggaccccgcccagggggggctttgccacgatgcgggactcgattccatctgggaactcattctagtcacaccggcatgggacatcagcctagcttcctgatactagataattcgtatcggcaatttgattgtctttcttgcatctaagccagcggcccatgaagtagccagccgagggtccgtaccacacgtcatcgaccctcgacagcaactttagcgcgacagagccctcatgcatcgctggagatgtctggcggtctcagccttggcctgtgttgcagtgctacaggtccaagcgcaggccgcagagcaccagagcttcttgcctctgaggcgactggctgcgacacctgttgaggctggtgacccggctgcagccaaggcgctcgagacggtgcccgcggagtggatcatcaccaacgagtctgccccgggaatcctggcccggaccgccactccccagcgagagatactgttcaccaccatcaggctggcgcccgtgaagtttgaagagccgctggacatgattgcgaacttctgctactttgtcaaaaagtccggggcattgccccacctcctcatcttcacaacggacatcctcacctggcaccggctgcacaagctggggttccctgcctacctggatcgcgccttccctgccaggcccgagtacatctttggggaagcaagcaggccggctggcacctacaatcgcgtgtttgatgtggagaagcactggtggggctggaaaatcctggagcaggacttcttcgccgtctgtgagttgatgcggggtcgaagggagagaagcgggggggcgcatgggtgcttgtggcatcgctgctatgcatgctgaggcatgtacannnnnnnnnncgatgcggggtcgaagggagagaagtggggggggggcgcgtgggtggttgtgggatcgctgctatgcatgctgaggcatgtacacgctggcggatggctgtgtgtgatcctgcatctgccttacttggcgcccgtgtcttacccagtccatgccctgcacagacatggatgcggatgcggtgccactgaaggacccgttccttgctttccaggacaacctgtacgatgtccaggtgagatgaatggcgggggactgctgggatgtggacaggtgatcgccgagcacgagcgtggcggctggaccgctcgggaccccctcacacccatgccatgtccctgcagggtctctctgactgggatgtgccnnnnnnnnnncgactgctgggatgtggacaggtgatcgtcgagcacgagcgtggcggctggacccgctcggaaccccctcacacccatgccatgttcctgcagggtctctctgactgggatgtgccacgaatccccatccaagaggacgcccttgtccagagctgcgagctgtactacctcgtcccagacaaggcagtggcgtcaggtgagcactgcagatcgtgtgggggcctggcttgtcgattggggacccctgctccccggtctnnnnnnnnnnnnnnnnnnnnnnnnnnnnnnnnnnnnnnnnnnnnnnnnntgcacaccctgccccatgctttcaccccccggggaccgcccctgcgccggggctccggacagcacctcaaaccccaatccccttgctgagctctcccccccccccaacaggtaccatgctgcgggagcactggcacatccccnnnnnnnnnngtgttgccggcaccccaggacgcaggggcacggcacctttagcagcctgccacttttggtgccctgccgtgcacatgggctcagnnnnnnnnnnatgttgccggcaccccagaacgcaggggcacggcaccttcagcagcctgccacctttggtgccctgccgtgcacatgggctcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaccctcaaaccccgatccccttgctgagccccccccacccacacacaggcaccatgctgcgggagcactggcacatccccgataagaaggtccagctcttctccatcaatccttgccagagcacggggctgtggtacctgcgccccaccccccccgccaaggccttcatgctggccatggtgcaccgcctgatccaccccgccacctggcaccagtgggaccagacggcctggaacgaggtcatcctgcccttcctctggggcacgggcgactcggagcagctggcctaccgcatcctccccaacgagaactacatcaacgtgcgcgccatccccgaccgcgagaaggcgggcctcccgctggacatcgtcatcctgcactccggcggcacccacggccggaacaaggccctggcctacgcggcgcgcggcttctggcacccggagctgggcaaggcgctggccgacgtgccgggcgggaagctggcgcacacccacgcggcgcggcccggctggtctcacacgcgcccgaagccgcccggcgcggaggttcccgccctccagcacctcaccgacttccagttcacggctgtggtggccgtcacctccgccctcctcaccgccggcctcatgctcgccgtgttcagggtggcggggcggggcagggccggccgcgcagcgcgtgccggcggcgccgcgccctggggtctcaaggccggcggcgaggccctgagcccccacccccggtcaggcaagggcgcggcagacccgtagcggggtggctggtgcccctggcgagagccatgaggggcatggtgtcccggacggatgtccggggggacccaggtccacaccccaggacattagccgactgcagtgtgtcggaggtctcgacccggtcatgccgccttgaacccatgggctctcgtattctatgaccaacaagctggtacaggcactctgtgaagccnnnnnnnnnnaagagccatgagaggcatggtgtcatggacggatgtccgggggggcccaggtccacacccccaggacctccgccgactgcagtctgtcggtgggtctcgatgtggtccagccgccctgaaaccatgggctctcgtatttcatgactaacaagctggtacaggcactctgtgaagcccctgtgcaatcgctcctccaccatagaccccgccaatctcagggaagcagccatgcgaccgactcgtgcccctgaccagccccacccctgctgcggtgtgccttgctgtcagctgtacgtgcaaggtgaacatgatgcttttgatccagtttgactgcaaaacacaatcgatctgtcaggccgacacctagagtagagaattgccaggcaaggtggggcgtgatgcacacgccagtccttgccgcgctgcgaggctgcactccccttggcgctcgcctgacgacagggcnnnnnnnnnnggaccccgccaatctcagggaagtagccatgcgaccggctcgtgcctctgaccagccccacccctgctgcgatgtgccttgctgtcagccgtatgtgcaaggtgaacatgatgcttctgatccacttcaactgcaaaatgcaatcgatctgtcaggctgacacctagagttgaaaattgccagtcaaggtggggcgtgatgcacgcgccagtctttgccgcgcggcgaggctgcgctccccttggcgctcgcctgacgacagggcgcatgcagatgtgggatccactgccctacttgggagcctctccctgatgagcctcacatacttgctcagagtcagagtgtctgaaagatgatacttcacaaccttnnnnnnnnnncccaatcccctgcttgggagcctcgcttgatgagcctcacatacttgctcagagtcaaagtgtctgaaagatgatacttcacaaccttgatgtcgagtttcacattgtgaggagcccggcgttctgaggggggttaagaccaagtgccctgtcaggtgtaggggacnnnnnnnnnngttatgaggcgcccggcgtttaaagggggggtgagaccaagtgccctgtcaggtgtaggggacttggggccacttgagcaaaataccgttgcagacgatcgaggcaccacggtccccgccgtgtgtccataaacagaccctcgtccatgcacccaccagcaataaatgtaacaaatcatccgattccttgcttctgcgtggatgggatgctccgatgccgcctcttgcatgcaccagtgcccgagtgctcagcgactacccgccggatccgtcctgtaatcggcgcttcccannnnnnnnnngtccgattccttgcttccacgtggatgggatgctccgatgacgcctcttcaatgcaccagcgcccgagtgctcggcgactaccccccggatccgtcctgtaatcggcgcttcccaggtaaaggcgcgcatcctgacattacagggtcaacgtctctccattgaccttttgcaaatcttacctcgaatcgatgcttcattacagctgcatgtggtcgagctagcctcagatcatctgcactcgaatacccttgcctagagttcctacaccggcgccacgggcgtcctgacctcgccaacagcgcgnnnnnnnnnntatacccttgccttgagtccctacaccggcgtcacgggcgtcctgacctcgccaacagcgcgacgtccccagcctcctctgggagaccatgcgctcccgtgcatgtcatctcctgctactcggttgtgcaggcatcctgtggcaggtggcgcggtgtgcggacgacacagagaacagccccgagccaacgcggaagacagggccggggcttggcaccgcccagctcctggcccaggaggggcccacccccgtggacgagaactgggtgatcagtaatgccaccgtgggatccatcctgaaacagagggccactccgaggcgggaggtgctgtttaccaccatccggctccccgccaccaagtatgccgctgagctggagatggtgatgaacttctgccactttgtgcaagaagcgggcgcactcagtcacctgatgattctcaccaccgacaacatgtcagttgggggatggggggtagagtccacaggagttcctgtttttgaacgccgccagctggagcttgttggacggcgcccacctgctatgtaccggtagccannnnnnnnnncaccaccatccggctccccgccactaagtacaccgctgagctggagatggtgatgaacttctnnnnnnnnnntagagtccacaggagtgcctgtttttgaacgccgtcagctggagcttgttgggcggcgcccacctgctatgtaccggtagccagtttgcggcataccagtcttcgaggcctgcctttcccgatgccatcgcaggacttggacgcgactccatgatcggggcctgcccgtgtatttagacaaggccttcccagagaggccagagtatgcctatggcggcggcaaggcacacgactccccaaaccgcgtgtttgatgtccagaagcattggtggggctggaagatcctggagcaggactacctggctgcctgtgagttggtggggtggaggggcacggggtgtgcacaggctgctttccaatacctgtatgtctcgacccagtgccaaggctgaaaagtgcatggctggcgggtgactgacagcatgctttccgcagccccacatcggcagatcattgccttccctctgtggtaagccccatcgttcaccattccccgaatttgcagacatggacgcggatgcgattcctctgcaggatcctttccttccttttcagaacaccacctacgatgttcaggttggctggggtgttcaggttgctgacaagaagctggattccttttgctttggacacccagatcggtgaccctgttttctttttatccaaagtgttcagagtatgacgatgaccagttatgcctaagccgtttcacctctagctggccatccatcctgcaccccatcccaaaacagggcctgtcagactgggacgannnnnnnnnnctgctgacaagatgctggattcgttttgctttggacacgaagattagtgatcctgttttctttttatccaaagcgttcagaatatgacaatgaccagttatgccaaagccgtttcacctctagctggccatccgtcctgcaccccaccccaaaacagggcctgtcagactgggacgaggtgacaccccaggacccagcagcgtcgctctccgggggctgcaagctgtactactggatcgaggacccagccgcccccactggtgggtcagccagggctnnnnnnnnnnnnnnnnnnnnnnnnnnnnnnnnnnnnnnnnnnnnnnnnnnnnnnnnnnnnnnnnnnnnnnnnnnatcaacgattcactctctcgccttccctcctttcctcacacgcaggcaccatcctgcgggagtactggaacttcccggacccggtggtgaagacacacgcgcacaacccctgccagagcaccggggtctggtacctgcgccccacccctccggccaaggccttcatgctggcgatgacgcagcgcctctccgcgccggccacccgccatcagtgggaccagacggcctggaatgaggtcatcctgcccttcctgtggggcaacggggaggtggaacccctggcctaccgcctgctgccccacgcccactacgccaacgtgggggtggtggacaagcgccgtgcagcgggtctgcccgtggacctggtcgtcctgcacagcggctacctccacggcaaagagaaggcaaggaaaggaggggggggggggtatttgatgttgttgagagggtaattttggggaggggtggtgatggaccgtgacattaggcgtctgccggtttggatactgtgtgggccactttcccccaggagcattcactctcggctgtggatactggggggatcatccacttccctgctccccgcaccacccctgcaccgaggatcccaccaccaccaccttctcttcctctcaccctcgctcgcgcagaaggaggcgtacgagaggatgggcttctggtcgccatccaatgcgaccaggagcaagggcacgaggctgacgcatggccaggagggcggcggcggggccaagggcggcgcggccgacctcccccgcgccgcggacccgctgggcctggcggcagcctctacggttaacaacgggccccgcccagacctggcgcacggcgcagcggcgctgggcctgctgaccgtgctgggcgtggtggtcacgctggccttcacacggcgccgacgcagcgctgcgctgcgctcctcgctgctgcccaccaagaccgggtacggcgccgcgacgccgagcaacttgggcagcccctctcgctccaaccacatcaacaggtcgccacacatcgcggcgtactgagcgatctggagtgcgggcggtaccaccccgtactgctctgcacccgcccccctacgaagaaaccatgtcctgccatgtataccttctcttttgcacccagcgccgtacttgctcttcctgctgtcgccagccgtgctgctctctgtacccccctccagggtctgcttccatcaagttttacacgataggagggcactcagagaaggggccgctgggaggggttccttcgccccgcccctcaccctgnnnnnnnnnngacacgacaggagggcactcagagaggaggccgctggcaggggttccttcgccccgcccctcaccctgcaggcaggcggggttcaggcgcccttgctcttgcccagctgtgccagcagctggaccacgttctggctggtgatgaacaccatgagcgcggagcccagacccagcagcgccagcagggcccctcgccgtgcggcgcccagctccgcccacgccagcttcacgtagaacagggctgtggcggttgagcgtggcgggggggaagcgtgagtctcctatccgccgcttggcgccgtgtgggatggtctggagggagcctgggcacatgaaaaatccatggcatgcccaactccagcctcggattccccctctctgtcgaggtcgggacccccccccaaaaaacccactgggcatgaggnnnnnnnnnncggtagggggagcgtgagtctcctgtccggcgcttggcgccgtgtgggatggtctggaggcagcctgggcacatgaaaaaaccatggcatgcccaactccagcctcggattctcccccactgtcgaggccgggaccccccccaaaaaacccactgggcatgaggagggagcaggagagggaggccaccccgccgaccagcgacatcacgcaggcaatggagtccagggccgcgaagctgagccccaccgacgcggcgcagagcagcatgcgcagcgtggccagcaccgcaggccggagctggccctgggtggccaccttggaggggaacatgccgatgatcaggtcctgggaggggtgaggaaggtggggaggggtcttacccagtactggatgtcgtggggagtgtgtttgtgctgacatctgccagcacccgctcccagaccagcaggcgtggagctggggcttcctggcggcttctgatgcagccgccagggagctcgtcccatctcatcatgatctggggagatgctccccccttggtcgacgactcgctcgacgcacaggcgtgcagcaccaaagggagcgtggcagcaccggggtcaaacccctttccacacttgccatctcctcgtggcacannnnnnnnnncagatgctccccccttggttgacgactcgctcgacgcccaggcgtgcagcaccaaagcgagcgtggcagcaccggggtcaaacctcttttccacacttgccatctcctcgtggcacaatcaaacaaccccccgccctcacacaaaccacacttgcctgtagcaccaggacgagggccgggtacttggtgctgcagttgaccagcaggaggcaggccaggagcttgtccatggcggtgtcggtccagggccccgcccgcgagatgtcggtggtgatgagggcggaggtggtgctgccgtagtaccagtaccccatcgccccgaccgtgccgtacagcagtgccatgacgcagaaggcggcggtgagcagggccgggaagcgggagggggcggccatgccggcgcgcagcgcgggcagcgtgctgtgcccggacagggaaaccgcgaagatgccgacagcctggggcagcgtccagcgcgccagtgcgtgcccggggggcggctgagagggggggggatccattgggggggtgggttagggcctggggtgctggagcgggaagggcgtttggtgcgccaggttggaaaaggggggaggggaggggaaacacaacagggaaagagacgcatgcgcaaaggacatgcaagtcatacggccccacgccagcgcgtgacccccccgcaagccccggtctcgaccctccagccaaccacctgcggcagatcctctcgggaggggtccaggaccaggagggagtagaccaccgtcaccacgatgcacacgctcagcatgcccagcttggaaaggatggccagccggctgaagccccccacgctcagcatgggcaccagccagaggaggctgagcgcgacggcggtgtggacagggctcagggccaggaggcctgggtggggccaaagaggctaggggtagggctcacgtatgctnnnnnnnnnnnnnnnnnnnnnnnnnnnnnnnnnnnngaagaatcggcgccatgcatggccgggccgactcgccctgatccgcacgcaccatggttgtccaggaggatgaggagctgctgccaggtcaccaggagggccatgcacgcccctgcacaacaatcggactggcggaggtgtaagaaagcgaggcagaaaggtcatgaggtttaggcgtgtgtaatttaagtcaccccacacaattggaatggaggggttccatcgggacttgacagtcttcctcggacccattcatgcaggagtacnnnnnnnnnntagaaagcggggtagaaaggtcatgaggtttaggcgtgtgttgcttaagtcacccatcacaattggaatggagagattccatggggacttgacattcttcctcggacccattcatgcaggagtacaccagaccaagcagcacaagggatgccatgtagagaactcacctccaaaaagctccaggaaagccacgaccgccaccaccttgcggccatggatccccagagcatgttttccttcatggtgaagggtgatggggggtgatcacattgcagggtcaggcacagaatcctggagctgtacgttgagacgagggcactgccagaccgttcctggctacagatgcaccacctggatgcgtcctttgatccctcccaggcaacacgcaggaatgcgcaggggtgttcttctgcctccctggtgaacaatgccgctcacaccctcgtccctcacattatcccctcaccaagctgcggaaaggaccgcggagcatcaacaggcagatactggaatgcagcaactatcaggtgccctgatagacagaagagggaggagagcaggagcaaggccacaccagcaatgtagccgccagcccggtaagcgtagggcgtggagaggaggcccagccccacgaaaatgttgatctggttgcagggtacaggagtcttgtcagtatctgccccacgatccgtcactgcaccagacgcgcgtaaccctccaggcttctcaccacattgaaaagggtctgagtaaaggtcgcgccctccctcactggctccaggtccgggatgctgccgctcacggaggccagcaagggaatggtgacctcatccatccttcagagaatgtgtttctatactccagggagggtcacgcccttctgcacagctagagctgcactttgctcgccgtggtgttcggcactgcaacgcccccgcgggcacccgctctcattcagctcggtgtaacatgaagggaggttcttttgctttctccaacgaagcaaaaggaatgaggcggaattggatgtttgctcagggcactgcggatgtcgtcgtaaccggggattcgtcgcatgccgccgatccgacaccctgctaactggggcatggatagtttctcctcctgcctaatatatgggacgggaagccctagagcgcagcgattaattgttgtatgtttcccataacaaaatcatccttcctccttctcttttccagcattataccattcacaatccgtctcaacccagcaagattcatattgaggctttgatgacgtgaaggcctcagcatggcacccgtgaacacgcctaatgcacagacgctcaagctaagaccctcgactttatatccatattcttcttgaaccaagcaaacattatgataatgcttcgcaagtagggcaggcaaatagtcagtgtccactcctcagcaaggcggaaccagcaaaaggtgtcctcgcgtctcgccatgctgtccaccgtgaggtcgtcactgaaggagacgtttcatgattcgttggcctcgcattccccgaccccttccgcgggtgagcacgatatgtgggctggtgggtgggctgcacggtgacagtttctgctgaaccatgggtcctcggaccctcccgcaattggccagctggcatgccgctccacggctcccttccccttgcagaaaggctggtgcacacgctgggagtgaaccacgagtatccactgcacaagtgggtagggtcgccggtgctggcgtcgcggcagtgtggcctgtgaccgccattttggtcctaccagcactggagccatgcagctgccacatgcagcaacccctgctcaccctccctcaaacccaacgacgacacagggctgtatttgatggggacttgcacgccgtgcgccgcctcttgaaaggagtcaacccacccttggtccagtcattggatgcccatggcaacactgtgtgtggcgcagagaagaacgggaggggggggatagagggtgctgtgcgcccagaaagcacccgacggatccctgcctgtggtcctgcacccgtacccgccaaatcaccgcattcgctcctctccccttggctcgctcagcccctgcacctggccgtcatccggggaaagcgcgagattgtggaggccttgctggaggctggggcctcggtgggcgccaagaacatagcgcgctggaatgctctggatgaggccattgccttgggcaatggggagctggtgcacctgctcttcctgcagctgcggaaggagtggaagcaagagaaagcccagaagaaggagcggctcctggaggtcttgaaggagctccccgatttcagcatgaaggtggttggctggagggagtttgacatattggagcccggaagagccctggctcagatgagcaggatagtgtttggcggggctaggagttgcgggcgaaggtgcccttgtccttgtagcatgcatggctgcttggcgtgggctgcagtcccggacagtgagcctcagcttcccaaggctccacatccgggatcaccccaggacccagcttgcacctcacaccctcgcctcctgcgcactgtcggagtgctgccctccttgcacccgtgcttggcacggagtccttcaagattcacacacacacaagtacccccctccctcgcagctgaaatgggacctgggttctggcatgtttggcgtcatcctgcgccagtttgcgccggacgacacctacaccatcaccaagctgggcagccggctgcgcatcgatggcagcctgatggggctggaccgtggggccgggggcgtgctgccgcgctggagacggggcgccttctccctcctcatcgacgcggagcccagcccggcgccggtgagtccccagcggtgatggggtggtgttcacgcgcacgtgcattgacatgcgtgtgggggtcgaaactgagggctggtgtgccctgtccgannnnnnnnnnaaggccccagcggtgatggggtggtgtgcacgcgcacgtgcattgacatgcgcgtggggtccgaaactgagggctggtgtgccctgtccgaggtcagctcagtgccgcgcatgcaggggcctccagcgtcagtgcaggcacaggcacagggcctgtgggatctccccccctctccatacacccagccgcccgcgcccgtgcagaccttcttcgccaaccacgagaaggcgcggtacgtggacctctacaaggagcgcaaggaaaggaggaagaacgtggaccgcgaggtggcgctgctcatggaccacggtggtgaaaaggtgaagatgaggacgacggcgtccgacttcaggccggtcaagacctggctgcagcggcctgccactgccgtggtggatgggtgggacacgcaggtcaggggcttggatggggaacaggaggggttggggatggaggatggaggggctgtgtgtgtgtgtgtgtgaggggggggaattgcacgtgacgtgcaaaggcaagcctgcgccagctgcgccatggtgccttgagtcagagtcggcgtcgccctgcacttttgaggaaagaacagatccagacatccaaggatgcagctgctctggcactcaatccctgcaacagtccacagctgggggccgacatgctgttaattttctggcttgcatccatactcatcgacgtnnnnnnnnnntgcgtcgccctgcacttgtggggaaagaaaacagacccagacacccaaggatccagctgctctggcactcaatccctgcaacaatccacagctgggggccgacatgctgtttgatttctggcttgcatccatactcatcgacgtgcccccctgtatgaccagtatagctcttgcgcctcttcaccagccgcacacgcgcttcgcgggccctccactcgcaagcactcgcacactcctgcgcaggtgtttgagtggacggggaagatggcggcggtgtcgcggcaaaaggctgccgtcgagatacccggggccagcacctttgaggcctacctggcaatggccatgccagacgatgtcgttgccgagacagagctggaccccagctccaagccggagaagtctcgggtctggttcaaacgagctgcgagggtgaggtactgggacggccgcatgggggtatgctgggacatgcttccgagattgcaggggggcatgctgtttgccagccacaggagccctctgggtatgtttccgttagcgctcgtgggtgcgtgcactgccgcagtgacttgccgatgccttccagaacagaacctccctccggctgccgctccccaggctcgtggcgaggaggccggctcactgccggctggagaggcgaagctgcgcgagatcaccacccagtgttggatggcaaaggtatgtctttagaacgaagtgggagttggacatcatgatgcaggggcggcccggcagcctgtcatcactgtggatggcctgcgaacaatgcagcacccggtatcttgaccgcacggcgctctcttatgcacaccaatcatcgctnnnnnnnnnnacgaacaatgcagcacctggtattttgacgtcatggcgctctcttatgcacaccaatcatcgctaacaggacttcccgctgacgctgcggcaactgctgccgctgctggaggcgctgggcgaggccaaccagcacgtggagagggctgcagagttcatgcaccactggtcggaccaaaacttgttcccggtcaaggtccaggtagggccgagggtgagccagagggaagggactcttcatctcccaactaaagtgacctgcaccccttgcggggttcactctgcagtctgtcatcactgcagcaggagcagcactgactgtacctttggcaaggagaccatcgcgcacgactcgcgcagattcggttggtgcgggccttctcagcccgtcccccattctcaaaatctgcttcacagatcccgctcatgtggactgtgtacctcagcatgcgcttcaagcaatttgagctgctgggagccgaccatccagcccggaatgcgagctattttcaggtgagaagccaggcggaatgtgctgaatgtgacgttgaccccgagcaaccctgtggtacttcacgaattccaagcatgcgggcatgtctgcgcacaggtgccggcagggtacaaggaagtgactgtggccgagattaaggaggcgcgagagagtgagaacctggaggtgtgatttggagaggactactccaagaaatccctcggatacgcagacgtgggggacctcgacatgtgctgcctcagtgtgaccgttgtcattgcaactaacagtctcgatggcacgagctgtgatcagattgtagagataaattaatacgattgagcaacgtttcttgaatgccgaaggcccctggtcgaacgttggtccgcaggcgcggccccgtgtgcagcaacccccggggtccgacgcttccggggggagattgcttttgcggcagcagcgtgtctcgacccccacataccgccgacagccagggtgcactgcacttcaatgtcggataatggatgtatagtagattgcgctcaatatggcttttatgcggtccggggaatcggtaattacgcacggtaactccgcacccctcgccttctccttgccttccccgtcggggttggaccttccctaccccatgtcctttcccttcaacgcaatgcctccctatcctgtcaatgatataacggagtatggaatggcggggtaccaccccgatctccaagccgtgctggcgatgcagggggctgcggcaatggctaattggcccgccccaaccggcgaccaactgctggccatgagccagttcctcgcgggtcccaggctgcccaacgctggctcgagtcgatcgaagaaaaacggtcacgtgccggggccggcgagcaacccactgtacaaggtgcgggtctgatggtttggggttcgggcagcgcccgcggacccggtagcgtgacgcacctcaacgccgacatcttttctccccgcccctccacctccccgcctttaccctatcatcccacagactgagctttgtagaagctgggaggagactggctcgtgtcggtacggtttcaaatgtcaggtgacattcctcggccgtactgcatccctgggtctgaacacgccggggcataagggacccttgagatcgcgacacctcgatgtcctcataacatgcccgttccaccctcaccgcagtttgcccatggtcgcggcgagctccgtacggtgcagcgccatcgcaagtacaaggtggggccctaggggtgtggcaggccacgtcgctgatgaaggcccctgcctcctgtctgtgacacacattccctcccactatgctgctgaccccttgtatggagggtcatcgcctgagaggcacatgtctggaccattccgagcatcctcggcgcccacattgatgtctnnnnnnnnnncgacggcccccccagcaccgccggggcagggaccatgtctgccgccgtggcgnnnnnnnnnntccttgtatggacgctcatcgcctgagaggcatatgtctggaccatttcgagcatcctcggcgcccacattgatgtcttcccacaaacccctttccccccacctctccccgtcagactgaggcatgccgcagctatgccgccaccggccactgcccctacggctcacgctgccgcttcatccacaagtatgacggcccccccaccaccgtgggggcagggaccatgtctgccgccgtggcgacggccgccgcggccgccgccgccgcggccgagaagggcggcccccccgcccgccgctcgccgccctcctcgcccaacgcgcccgcggccctggcctccctcctgaactcgctgaccctgacggatctgggcggcggcggcgcgagtgtgctgggcagcgggcccctgccctccctgtcctccccctccatgagcccccgcggcagcctgagcttcggggagccgggcctccgctcgctccccccagacgccccggagctgggcctggggacgggcccgaggtatgccgccgccgcggcgcccttcccccccgccccggccccggcgccggcgcccatccttcgctccagcggccagccgcagaccgcccgctcgtnnnnnnnnnnccccccccgccccggccccggccccggcgcccgtccaccgccccagcggccagccgcagaccgcccgctcgtccctgcccattctgggccaggaacccaccggggggccccagcccccccacgccctggggctggcctcggcgccaggcacccccacgggcgcgcacctggccacgcgcgccgtgcgcaggcaggggtccgagtgcgacgaggccagccgcaggctgcccatctttgcgcgcctggccaaggagcaatgagggctgacggccggacgtgtcgacaggccgaggcatgcgggccgggccgccgctcgttcgtgcctgacgggaannnnnnnnnncgatggccggacgtgtcgatgggccgaggcatgcgggcggggccgccgctcgttcgtgcctgacgggaaggaacggagcgtgcgcgggggggggaggagggggaggggggagccttttgctcccgagatccgaccgtcagttgacccagcggtcgccttctcattgtgcccctccctggtcgnnnnnnnnnnagggagagccttttgctcccgagaaccgaccgtcagttgacccagcgatcgccttctcattgtgcccctccctggtcgccccctcctgtgttgtcgggagccactcagcccgcccccacccctatgatctctccctgatactcccatttttcttgccagatgtgcagccatgagtcagtggcgccatccctgcatgaaccctaaccccctgcacaaggccccaacccccctcacagcaatccccggtcgttcagagtgtcgcgtcaggtcttggtgcctgagccccctgatgccctgttctgagatgctcagtttccagaaggaatcgatcgcccttcattgcaaccccacttccctcgaaaaccctgcacatgggcagatgcgcttgacgccccacttcccacaaaagttactgcctccattcttgcagcctcctattttcgaggatctgccctcttcgtagggtccctgatttttcaatcccataaaagggagccttgaatgtcccaaccgaccccgggcatcgaacagtgtccaaggctgtccccactctctgcctttgccaagactcgagtatgctccatgaactccaagaaaccctcctctaccctgtctttcttacaacacactccctagccgccctctccgtactgtgcatctctgtggttcccatgcgtggcagggcctggcttgcctcagatgaggctgcaggcccccatgaacagccaaggccgctggggtcccttcatctacccttgtaaacagatatgtcgagcacaccggtggctatggcaatgcccaggatgaggaagggggccacgatgacgaggccaaagatgagggcaaggggatcctggaaggagggtggaggggctagcgcagccttggttggtctgtacgagagccccatgcatcgcagaggtggctggacgggatggagggatgctcaccttggcaggattctgnnnnnnnnnngggggaggggggggacctagcgcaaccttggttggtctgtacaagagctccatgcatcgcagtactggctggacggggtggagggatgctcaccttggcaggattctggcccttggactcggcagcgctcttccagtacctgaaagggatggagcatggtagtccaggatcagcacttccggctcatgcctcggcactgagtgctcctcccctgcacacctcaactcagcacaactcctcagcgcatgcaacaacattggttgtctgagagcacagcagtgaccctggcacaccaacgtactcatccggctcgttgtcacgcgtgatggccttgccttcatcatctggacctacagcaagtgaacggcttgattggagatcatcatgaaagggaagatcgcatgaccacctgtcattgctccgaaggtcccccctcatgcgcatgcgcaggttggtcgcacctcccagagccgcggggcgcgttnnnnnnnnnntagatcgtcacgaaagggaagatctcattaccacctgtcattgctccgaaggtcctccatcatgcgcatgcgcaggttgtcgcacctcccagagccgcggggcgcgttgccggccttctgcatgtcctgtgcacgctggaagactgaatgcctaagggtcgacatggggaggggggagggcacggcaggcagcagccacctgtcctaacgccaaggcctccaagtctcggggagtgtatgctcatcattttacaggatgcctgagtgtcacaggggactggcatgagacactgcttagaacaggacgacatggaatccccgcagtatcgagtgcggtaccccacagggtgtcaactcgacgggagcctcgcatcgatacgaacagcttgacaccgcaccactaacattgttactccggatactcgtacatgctgtagttcaagtattcgaaagagctacctggtcgaggggctgcacctcttctcgttgtgggcgccatggcgactccagtggtggaatcgctgttcatcaccttgaagcgcggcatggcaggcgtgcggcatcaacacgtgagaattgtgaaggctatcggcctgacatatcggcagcagactgtggagaggacaaacacgccagccatgcgaggggccgtcgccaaggtgtgagatggaaggggttgcgtgcacatactatttgtccagcggtatgaaacctattcgggaattatgtcactcagacaaccacctagccctatgttgttcagatcccccacctcctgactctggagaccaacctacaacgagctgcgcggcttgctgctcaggcagaggcgagaaaacttagacctcctgtcattgttaggcatgcttaaatacttgcgaggcactatccttgatcgtattctccttcccagtggctagtcaaacgaaccgcgtacttttttggaacttgatgaacaaggggaccagaggcaagcaggggcttcataactgctaaggtgtatgcacaccgatgtcacagggatggaatgcacgggcagtcacgagcccctccaggctaagcttgcgcctacttgacttcactatattgggcgagctcggcaatgattcgctggatgtcgttgccggagaaccgtgactcatcctgcacatggaaaattcatggcaagaactgggatgactgccaggaaggggcagtcctggcattaaatggactccctaggaaggactcttttggccatgcagaacctctcaacacagccgcgcataatatctggatccatcccaattgctcagccaactggatgtcagcagcacacaattacgtacatccagggaggggatgagcttgaatacctcatcgggggtcatgggttgtaggttggtcatcaggcccagctcctgctcagtgaagtgatgctgtgctagcagcctgtacatcgtggcaaagttcagaagatgggtgagtaatcctctggagcaagactctgtaggcaaaggacctgaagagagtggcaagattgtataggaaaagcttgctctagtctcccttcaccccactcccgcaacccctcactcactctctcatcttctggagagcatccttgtttcgactcgtacagaagtgtttcgcatactccatggacttctccatgagagcattggtctggtattccgggtctctttgccgcatgtgctctaggtactttgcaaacaccaggttcacttccgagatgttcaggatcttggcatccttgaacactgcagcaattgaattgaggggagtgagattatatgcagcattgcttcatgggaagcaaagtgtacgcgccgtgcagcgctgctcannnnnnnnnncgaagggagtgagattgtatgcagcattgcttcacgagaaacaaagtgtacgcgccgtgcagcgctgctcaccagcactgtcggtcgagttgtcgtccgccatcccgtgcgtggtagcctggcagtttccaaaaaggacctccactgaagatttacaatatctaacttcttatcagattgaataggaaatcggtaccaacgggacgactgaccgcgaaatttgagattggtttcaacaaactctgctacttgtttgtcacagcacggggagcacaagtggccctacgtgtgagtagccacgagtccctcctctaatacgtcaaaatccaggacaagagaaagagttcagtttgttggtgcaaggtctgttgatctgcactcaaagctactcccttcttcttcatgttgtgtataattcccaccagcccccgcagagcctccatgcacaccagcgcagccgtctcacctgccaagctcccacctccaatacctgcgcattgatcattccctgctagagatcacaaatgtcaagtgtatgatcccggcagtcctcagggtggagtcaacgaccatggtagacagcatttcagtgcaagcatcaaggcccatgtgcgtcacgtgtcccaacatctnnnnnnnnnngtgagactggtttcaacaaactctgcttgttgtttgccacagcacggggagcacccatggccccacgtgtgacgagccacgagtccctcctctactacgtcaaaatccaggacaggagaaagagtgcactttgttggtgcaaggtctgatgatgtgcactcaaagctactcccttgttcttcatgttgtgtattactcccaccagctcccgcagagcctccatgcacaccagcgcagccgtctcacctgccaagctcccacctccaatacttgcgcattgatcgttccttgctagagatcacaaatgccaagtgtatgatcccggtaatcctcagggtggagtcaacgaccaaggtagacagcatttcagtgcaagcatctgggcccatgtgcgtcacgtgtcccaacatctccgaaaaccaatgcccttcacagccgacgacaaagtgccgcggaatactatcgcatgcaagacaaacgaaattgatccacgggatgtccaggcggctcatctctccatgctagctcggttactccacgtctgccggccagcactgatcagatcgccacttccttggaatcctagccatccatcaccaatgtacgatgcagcgggtgggttcgttatgaatttgtctccaaaggacatcccgctgcacctcactactgtcaccactggacttcaccccaggccgccccgacggggcaggaaagccacagcttcagcagatgccaagaatgcgccgcacaacatggccacatccgacacaccgaaacgcccggagcccgagccggaagaggcaccggtgagaaccaccaccaagaaggctcgcaagccacgctccccctctccccctcccccacctttgtacgacgtctccatgcgcgcacccgccctgccctccacggctgctgccgccacgatcctgtgctggaacgtcgcaggcctgcgtggcctcctcaagaaggtgggattgggaggagggtcgggagaggaggacctacacccatgtgtttggccagctgccgggcctgctgggcgcacccggtgacaaccaaagaaagccacgcccaccccccccaggaccccacggccatcgcgtcgctgatcgcccgggagcagccgcacgtcnnnnnnnnnngacctacactcatgtgtttggccagctgcctggcctgctgggcgcacccggcgacaaccaaagaaagccacgcccaccccctccaggaccccacggccatcgcatcgctgatcgcccgggagcagccgcacgtcctgtgcctgcaggagatcaagctgcagaccagtcactgcgacgaggagctgcacgacctcctggccctcggtcccgagtggcagatcacttggaactgcagcactgccaagaaggggtactccggcaccgccatcctcaccaggtcttctgggaggctgttggtagagtgcacagccatggtggggtgaagcagagaacggccagctgcccatcgcctcccattgcacgttgggagcagggcgggcgtcgggcctcacatgctgcactgtgtccgaccctcacacaaaccctggattcttcagcgcgcctgcttgacgccatgaatgcactgctctgcatccgctacgccacaggatcccccccctcagcacggtgtgtggcatgggctcgcccggccatgacgaagagggtcgggtgctggcggccgagtttgacaccttctaccttgtcaccgtctatgtccccaacaggttgagcggtgcctggggtggcacggggtctgtctgtggcacctgtcaggccccgacacacgtgtgtgcagggtctgtgtggcagtggcaggggatgtatggccttcctctgtgcaccctgacatgctgccagggattgggttgaagaccgagcgctcacctcccagccccactcccccctccctcggcagcggggagggactgaagcgactggagtaccgagtgggcagctgggatgaaggtggggcccgatacactcaggcgtgtgatcgcatgcccacgactccctatgtgaggggttgacctcgcagtgtctgccataccgatcaatgatatggcgctcacaatcctaaagccctccctgacaattcattcctcgcactgtcctcannnnnnnnnngttcacccaggtagggacccctccgtcgacgctcagcacttgctcatcaggacccaatatggagtnnnnnnnnnngtgatatgacgctcacaatcctatagcccttcctgacaattcattcctcgcactgtcctcacaatctggtgcagccttctcgtccttcatcaagaaacttgaagcacggaaaccggtggtcgtgtgtggggacctgaactgtgccaggcagagcattgacatccattcgcccaagaccaatctgaggagcgcgggnnnnnnnnnnnnnnacaggcctggccaccatgtaaatacgcccttcacacctcacattcacgacaaaacacacaactccaatcattcacaatgtctgcaggaagagagagactccttccagcagcgatacatggatgctggctgggtggatgccttccggaccagatatccagagcacaccggatacacctactggtcctacaggttcaacctgcgagcccggaacaaggggtggagactggactacttcctggtgagtggcaggagagtagtgaagggtggggtgggtgtgagggtgctggtctgtgtccacgatgatgttcacagatggctgtgcctcatgctgtgatcgcatccttgccctgaaggtcagtggcagcctgtggccgtctgtctacgatgttttccatctgcacgatgttatgggttcagaccattgccccctcggtctgaccgtccgtctcgacgaggaaaagggaggatgatagccatacgggtccggtctgctcggaattccctccatataataaggtattgtcctttcaaatcagaccatcgctggggccatcatcgggccgacatggggctgggtttagggcatggtggaatcctcgtgcttttccatcttaaccagcttcgtggcgtctacctgaacgcgaggcgcacacagcagcactgcacattccccgggaaagtctccggaaccattttctgacctgccacctcagtctcaaaggaagaaatttcgtgcagcaagatattcaggtgccatggtgacaactcgtgctcgtgccaaacgcgtgaggaaaggtgatgacactggtcagtcagatccagcagccaaggccatcgccgagagatcgggtgggtctcatgactatcttgaaatgtcgtgagggctccttggaggatcacatgacctgacgatggcgagctggtagagccgagccgatgtcgacctgtccaattgtgcatctacctgctatagggtccagtgcnnnnnnnnnntcacctcagtctcaaaagaagaaatttcgtgtagcaagatattcgggtgccatggtgacaactcgtgctcgtgccnnnnnnnnnnagtgagggctccctggaggatcacatgacctgacgatggcaagctggtagacccgagccaatgtcgacctgcccaactgtgcatctacctgctatagggtccagtgcaaactcagaggggaacgatgctggtagcggagatcaggggcttaccaaggcatccagccttgatgaagcaggtaaatcttgtcagtaggatattggcaatgcggtgtaaagtgggtggctggcggctagggttttacaagttgtgatcatgccccaacctgttgtccatccgtgggatgacaggcccccagcatcccagtataccaccggcaggaggcagccctgatgcagacctccaggaaaaggtgggcactgatgtggctagcgaagagcctgccgcaaagcaggcaaagaccagccatcaaggggatgcatcggagtcgcgctcctcaccagagcacaccagccccactggaggggaccagagccaggctgagagtccgaaaggcacaacaaacaacagcagttctggggacgtgccagctgacagcaaagatcctgtagagtctggnnnnnnnnnntcagccccactggagaggaccagagccaggctgaaagtccgaaaggcacaacaaacaacagcgtttctggggacgtgctagctgacagcaaagatcctgtagagtctgggaaagtgttcttcttctatcgcccaagggtgagactttcgcggatgagatcctgcttctgaccggcaacgtaattctggaaacctgctgctttgcaacaccaccccatgcaataaaatcaaacccgttctatactcactgccccgcaggttggtctagaccatgttgggaaacttgaggatgtgcagaggttctacctcctcctggagcctagccagcctgggtcaaagtcgaggctcatcgtgattggcaagaaacgtctgccagccatctccaatcacgaggtacctcgtttaccaatatgctaccaggcccctgggagctagaagtttgtcttgatgatcaatgtgcttggataccgggcctgcatgagattgcttcgcattgggtagtgagccttgtagactgtgcatgtcctgcacagctggcctggccgccaccactccgctccctgacaccccagaggtattttgcatttgtcgaggcggtggccgaagacaaggggacactgcttcaggtactgcatggtgtgggagcagaggcaggatgcttggtcggcagagtctcccgcgctgatcaccacgattgccctccttgttgccgcacagggcatgggggtccagcggtaccagactacgacgatgggggagagggtggtgggtgcctgccgggctgcaggggagggggcctactccattctggagcatggctcgggcaccaactttgtgtacaggtgagctgagcaggcctgggggtgcatgccagctcgtgacgctcgtgtgggattgagggaggtcatttcttgtcctttgtgtgagaggactggatgcctgtggcatcggtcgtgatcattgagacagccagcattcctgctcaaactcccgaccaggctggagcnnnnnnnnnngttgggggaggtcatttcttgtcctttgtgtgagaaaactggatgcctgtggcatcggtcgtgattgttgagacagccagcactcctgctcaaactcccgaccaggctggagctgcctactgagcccggcgaagcccagagaatgtgtggcatcgagctggaggggtcctttgggctcagcgtcaaggtgaagcctggtcaggcatgctgtgagcattcctggtgcgagcttgtgttggaccagatgattgctggcaggagcatgacagggagcacagccgggctcggtgcgaattcccagttctcttccctaaatgcctcagaaccccaacaagaccagcactccagcggtgggcctgaaggagaaggctgatctcccagaggcactggaagacgagttccaggggtatgcctggattgctgccagggaccccaaggtgaggatccatctgcagagggctgtgggtccatggctcctatcgttggtcgcacgcatcgctttcagaagctccatgtggcaccaaacaccagtcactggcccccattattgcagcttctggattatnnnnnnnnnnattggtggcacgcagcgctttcagatgctccatgtggcaccaaacaccagtcattggcccccattattgcagcttctggattatgagcgggtcgaactcttgttcgtgggggcgtcaaaggacttggctgcagagctgggtgagtgtgtagggcagtttttgctgtacagtcgaggggtgatgggtccactcggcataccctgtgtgtaaatgatatcgccctgctgtgtgatcctccgacctaatcttcccgtctatcctgtggcctggctaggctcnnnnnnnnnncgccccgtgtgtaaatgaattcgccctgctgtgtgatcctccgacctgatcctcccgtctatcctgtggcctggctaggctctgcgggggctcaggttgtggaagtggccaaggcagacgagggcaacccagaggagctgaagcgtgagatacatgccgaggcaagcaggggctgatggtgaaaggcagatcctcgtggcactcggcaatgtcaggcaaaggttatgccatccgaacacgtccacgtcattccactgtgcaggagattggactgcagattgagcctgcagagacaggggaagtggtgtgagtgcagtctggcttcagcacaccccccatgaggcttcacgtgcacgtgcatggcatnnnnnnnnnncagtggtgtgagtgtgcagtccggcttcagcactaccccacatgaggcttcacgtgcacgtgcatggcatgaggtgtaagagctacgacggatgatgaccaagtatatgtacgtctggtcggaaagttcgcacgttacaaggacatcatgcccgtgtcgcggcaggccttcgcgatgtgggcgttcgccctgcagctcctcatgagcgtctcggcagatctcgagggatcactggcttacacatcctccagacatgacagctatgtggaagagctcaaggagattgtctccattccctnnnnnnnnnnagtgtaagagctacgacggatgatgaccaaatatatgtacgtttggtcggaaaatttgcatgttacaaggacatcatgcacgtgtcgcggcaggccttcgcgatatgggcgttcgccctgcagctccttgtgagcgtctcggcagatctcgagggatccctggcttacacatcctctagacatgacagctatgtgaaagagctcaaggagattgtctccattccctcagtgtctgcccaatccgctcaccttcccgatctattggaggcagccgattgggtgaaggagcgtctgctgtctgctggcctgcaggtgggcgatgccatgcagccattcccccctccccccgttcccagctgatcggcaagcacgacacattgcatgacccaaccccttccctgacacgcactgagcgctctggctttgctggcacacttccccccctcccacagaatgtggagatcctgcccactaagggacctcgccctgtggtattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggaaccaggatggaaacctcgtgatccctctggctcagttgtgcacctgtttggaggggaggggggccaaatatgggggtacacgccgcgggccccccccccaaggcgaggcttcaacctctgcgctacgacccctcttggcccccgccgtcctgcagatgacgtccagcccccggaacccctcgacaagtggacctccgggccattcgaccccgaggagcgggacggcttcctgtacggccgcggcgcgtccgacgacaagggaggcttcctggccgccgtgcaggcgagcggccgggtggcgaccacacaggatgcggcgtgccgggggccagtgcggtgcatgctgctgtgatgtgcgttgcgccgagccatcacgacgtgggcactgcgacgcgccgcaggnnnnnnnnnngcagtgcagtgcatgttgctgtgatgtgcgttgcgccgagccaccacgacgtgggcactgcgacgcgccgcaggcggtggaggccgtgctgcgcggcggcggcgggctgcgggccctgaatgtcaaggtgctgatcgagggggaggaggaggtcctcagcccgcacctggaggacttcctggccgcccacgcctcgctcctggccgccgactttgcgctgtcggccgacggcggccaggtgggggagggccgcccctccctgaccctgggctaccgcggcgcggcggggatcgaggtccaggtcgacgcgctggcgcgcgacgtgcactccggcatgtacggcggcgcagtgcagaaccccgtgcgcgcgctggcccagctcctgggctccatgttcaacgccgacggctcggtggccgtgcgcggcttctatgacaggtgagcggcggcgggtggggcggggcacgctcgtggcagtgcacctcggggaatacacacacacacacacagagatctacgcgcagctgccacccttgcttccaccccgatgcaacccctccgttccacagggtgaggcccattacacaggctgacagggacgacatcctggcctacaactacgacgaggacgaggagctgaagggcggggnnnnnnnnnngcagctgccacccttgcttcctgccccgatgcaacccctccgttccacagggtnnnnnnnnnncttctcctcgctggagcgcctctggctgcggcccacgctggagatcgtcggctttacgggtgggtaagggcatggggggttgagcgcagggttgagggtggagaggtgaacgggatcaaagaatgctggtggtcgttacgcaaggctagggtggtagagtggaatgtgtaccacatgcatgtgaggacgtgcatgtggaggtatgcttttgtggtctacgcagacccaccccacagcctggatcatccagaacagcagnnnnnnnnnnagggtgggtaagggcatggggggttgaacgcagggttgagggtggagaggtgatcgggatcaaagaatgctggtggtcattacgcaaggctagagtggtggagtggaatgtgtaccgcatgcatgtgtggacatgcatgtggaggtatggttttgtggtctacgcagaccacccccacagcctggatcatccagaacagcagtccggtgtatgtacacggcgttgcatgaggtcaagggggccgttcgatcttgtatgccctgcagccacatctgctttcattttcacccctccttctctacagcccgggcttgcttgcaactccatacttcatgcccccccccttccccccttcccctcctcctccttcctctcctcctctggtagcgctcaatccccttcgcttctctgaatcccctccccctcccccccaaaaataaaaccaaaatgaacaggtgggcacactggggagggcatgaagaccatcgtccccgccaccgccgtagccaagctagccgcccgcctggtggccgaccagcgcccgggggaggtggtggccctgctggaggcccacatcgcggcgcaccacccgcccgcctgcaacgtgacggtgcgcgaaatgggcttcgcggccaacccctactccctggaccgcgcctcgcccgtgctggccaccgcagcggaggtgctgcgggaggtgctgggcgcggcgcccgtgcacgaccggtgcggggccaccatccccgccctcgccgcgttccagacgctgctgggaatcgacaccgtgccctttgcttttgcgctgccgggggacgggccccacgcgccggacgagcgggtgaagctgtccatgttccacaaggggcgggaggcctacgtgcgcctgctgcaccggctggatgggtggggggagagcggcccgggggggccggcggaggacaggagcgagctctgacgcaacgcccgcaccatccacatgcgacctcgcgcccatgcccagtcccggccccaaccctctgtatggtctctgggtacacaagactggtatccatgctatgcaaactatgctagtcgttccagccgggagaggcggcgtgtcgggggaaacagtatgacggtgcgttcattggcgctggcataaatgtacaatggtctgggaaaacgtgcgtcgacacgacgatcctggcggccgtcaggacgattggaatcgaaacagcgaaggctgcgtgttcacaacaagctcatgccaggtgcttcctctgttgcggacgacaaccgccgtcgtttcggggagtgggcgaggtcctgcgcctctgccnnnnnnnnnngggcgttggcgtaaatgtacagtggtctgggaaaacgtgtgtcgacacgacgatcctggcggccgtcgggaccattggaatcggaacagcgaaggctgcatgttcacaacaagctcatgccaggtgcgtcctctgttgcagacgacaaccgccgtcgttttggggagtgggcgaggtcctgcgcctctgccggacgctgcagggcatccaccttccgcacgtgctggatgtctgctgtgtccaagctgtcctcgtacacaggcaacttcacttgcagcctgctgccccgccttcgggccctgaggccagacgtctgtggactggagctgggggttcgccacgtgctctcggacctgcagtccacaaaggggagacgttgagaattgggcgacgggtcgcaattcctgagttgggtcacaagatccgaaaaataacactagcaaatttgactccctgtctgcgcacccttcgcgtgccgcaatgtcgtgccgaaggcgggcagcgtgaagggcgaagtagacacgcggattggtcagtccagcgggccaccacgcggagacgctggagagcatcccaactcccatcgctctgcagtatgtgaaacgataagatgtctcaagcgcatgtgtgatgcttgacggggccggcagcacgtttcctccgctcggggaggccaagggtgtcggagcagtactgacagagacagcaagcccccaccacgcgcggcgcgagcgccgagcgattgctcacctctctgagcaggctttgttgtaggaggaaactcctccgcaggtgagacagtgcatgcagccgggctgttgaggggtgttctggctaaagctcacggacataagctggtcggtggaggaaggtgcagaggctcccggctaggatgccgtgaagctcttgagctcaagcaaatcaatcgagatgcaaagatgccgggtcagggcaaccaggtgtgtctaagctgaaacgcgggctgaaccttgaatcgtgtagggctttgccagaacaatagaggttcatgtcattttgacccaggaggtgcaacaggcccccctctgcatggcgttctttcgtgttgaatgaggtctgtcgatacgagttgttcgtccgagtgtcaacttggtcatgtcccttttgggggacaaatcctgcatcattaaagccagaatgtcaagtcgcgtgtcgctgcaaatcgacaacgaaggcaaaacgctgtcgcaatggtattgttaaatgcagcatacagcgcgcggacgtgcagacctgcttgtgctatgtgagccacaccagagcttgggactataaacgggacatcagtgggagtttgcgggtgccggtgtccactgcagcatgtggaacacccccgccttgatgaattacggaagagtgttgctgccaggcggtgcagtggctatggatggacatcgcaaactgctcatcannnnnnnnnnattctacatgagattgcggttaccaacagcaaccttggcatgtcgggcgttccccatacgctcggtcatgaccttcagttgtaagcgggagaggccacttatctgctatgctgagagtccgcaaatgctgagagtccnnnnnnnnnngtgtggaacacccccgccttgatgaattgcggaagagtattgctgccaggcagtgcagtgactatggatggacatcgcaaactgctcatcatgagaagtgaatcatcaacagtgaaacgagtgatgttgtcgactgtccatgctttgtgtccttcaacttctacatgagattgcggttaccaaaagcaatctgggcatgtcgggcgttccccacacactcggtcatgaccttcagttgtaagcaggagaggccacttatctgctatgctggctggtccgcaaatgctgagagtccgccaatgctgagagtcagccgaggggaagggcaagccaggtcaattgtatcatgtgtttacagaccagtcgatagcaagctaccggggttaagatgcgatatcccgaggccaacctcattcttagttggggagtacaattgtggtcnnnnnnnnnntctcagccgaggggatgagcaagccaggttaactgtatcatgtgtctacagaccagtcgatagcaagctaacggggttaagatgtgatttcccgaggccagccacattcttagttggggagtacaattgtggtctgctctgtgattgattttctccaaggccaatggcacccaggatgtgttctcataggtttgactcgcccaggtacactgaggcactgcatcgtctgcaccttcgcagcatgcaaagtatccacagtacgataatatcatcatgccgacaccaagtctgggatcagaggatgcctcatgagatgcagatcctccacctgtggtgagggagaatctgacttgatcggagaaaaaccgattcgaggatcatgagtgcggcgtcggtccaggggccaccggcacgacacagcccgtcaaacggcaccacgaatcacctccgctacgcaacgatgtcaagtgacgcccaaggactagaaggggagccgcgtcagctttccatcgctaggtcaacttcgcgaggaaaggtagaacagaatctgaatttccgtcacgtgtcagttcggtcaattctcgggaggcgtccggcaggaattttgtgtggttggcgtggtggagcaactatgtaatgtgtattagcgaaagtccgtgcaaacatttgagtgattataaacctgttagcgctctttagtactctaccagtctcgttcgctgccaccatactttcccgcgtgctctctagaacctgcgtgtgcgccgcacacccgtctcggacaacctcgatctcggcgctttagagctggagaagctggtagacggcgttacgggaccaacagcggacgtccgcctcgagggtaagcgtgctgacggtgcaagcttcggtgggggtggtgcgcagccgttcgtgcgacgcgtcccatgccctccaacgggctggcgggcggggcccctggcgtgcggccagtgatctgccctgtctcgcgtgacttgaacaaggcggtcatgctgggctgggcgtccgcccccgggaagtcgagtgtcacgaggacgtgccccagcttccccctccttccccattcctcaccccccgcccaatctcccttccacaggctcaggccccctccccagcgccaggatggtgcgtcaagtgatccgcgtgccctactctgaggaccgaccccgcctgaccaaggcggcccccagtctggtgggcacccttccctgccccatcccccgctctgccatgcaccgggtgcccnnnnnnnnnncctccctccccagcgccaggatggtgcgccaagtgatccgcgtgccctactccgaggaccggccccgcctgaccaaggcggcccccagcctggcgggcaccctcccctgccctatcccccgctctgccatgcaccgggtgccctccctcctcttcgacatggacctagacctggagcacagccacctggcccgagtggccaccctggacgagacggatctggcatccacacgcgccgccatcctggcagcgctggagcccaccagcgatgccgagtacatggtgctgctgcacgtccgcttcgcgcgcgaggacgcgctgcgccgcggtagggccctcaccctggcctccctggccgaggttctgcaccggctggggtacggggtgcgcatccgcaccgccaacggcggcgggcgctgcggcgcctgcctgcgcaacctgcgccactccttcctggccgtgtcgctggcagggccggggacgccctgtgacctcatcgtcgaccccgcctttcgcgaacagttccagattgcgcacatgatggagcgatacaggagggtcatggccatggtgcccgaggaggtggtgctcccccccgctcgtctcgagaaggtgagtggtggcagtgtgtgtgtgtgtggtggtgtgggggggtggggattgtgtaagtgccgttcagggtggacaatggcatctctgggtgacctggacagctccctatcggcgcaagatggcgtgannnnnnnnnngtgctgttcagggtggacaatggcatctcagggtgacttccacagctccctatcggcgcaagatggcgtgaattcttatgtattcccatggcaaattccccgggacatgatcagatccttggcaacaaactcctgccccccctttatcccccgcagctggtggaggtgctgtgcggcgagnnnnnnnnnnctcttatgtattactatggcaaggtccctgggatatgatctgatccttggcaccaaatcccccccccaccccttcatcctccgcagctggtggaggtgctgtgcggcgagatgcagcgcgccttcagcgagaaggacctctccctgcccccctggcgcgccctgggcgccatgctctccaagtggcaccccggccagggcaagtccaaggacgtggcagtgcagccgcggagcaggggcgggggggggagcgccgcgtctgacgcccagcgccgtctgatccagtcgctgcagccccaggcagacgcgcaggacgcggctgccgcgattgacacgccggatgcgggggccgtcccgccgtccacccgcgcagacggctgccccgagtgcnnnnnnnnnncgggagtgccgcgtctgacgcccagcgccgtctgctccagtcgctgcagccccaggcagacgcgcaggacgcggccgccgcgatcgacacgcccgatgcgggggccgccccgccctccacccgcgcagacggctgccccgagtgcggctcccgcgcctgtgccacacacgcctgcccgccctcgttcctgggcccgcgtggcgacgtggctgccggggaggaggaggagcacctgctggacgacctgnnnnnnnnnncgccacgcacgcctgcccgcctttgttcctgggcccgcgtggcaacgtggctgccgaggaggaggagcacctgctggacgacctggaggccgacggggaggcagaggcgctcctgggttcgtccccgggggccatcgccacgccctcctcggccagcgacagcgagggcgactccccgctggtgcgcgcccgcacggcgcggcccaccccctccctccacgtcagctggggcctgggcctgggcctggcctcctcctgcagcggcagcgccctgggcgacggctcccaggcctcccgcagcgccctccaggcgcgctaggtgcctggagggcagctgcgagcccggcggcgacccgaaggcgatggcaagcccctgcctcgtcgccaggcgggtccctcctcccccaccacccaaagacccagtccatctcggacccccaccccccccctccatcccgccgccgcctggtcccacnnnnnnnnnnnnnnnnnnnnnnnnnnnnnnnnnnnnnnnnnnnnnnnnnnnnnnnnnnccaccacttgcctcatgccagggaccatgcccccgacaatgttcccatctttttccaagcttgcctatttacccccctggctctatctatcgtttgttcctgacccggcgccgttgggccccatggtnnnnnnnnnntcccactcattcccaccacttgccttatgccaagggccatgcccccgacaatgttccatctttttccaagcttgcctattaacccccttggctctatctatcgttccttcctgacccggcgccactgggccccatggtcgttgatcccaccccattctgccgtcannnnnnnnnncccccctcccccttcgggccttaccacccctcccaaggcgactcttgccgtgcccggggggtgagtgcgatggacggcggtccccaccccattctgccgtcagattccaggtccagcttgggaccgtctatatgctcgggccaccggggtggccgggaggctggggaggtgcatgcccccctccccctgcccccaaccaccggctgccccagtctgcccccccaaaaatactcnnnnnnnnnncgcggcggcaggtccctcattcttcatgctgcccgctgtgtccttctccccagagtgtccatgnnnnnnnnnntcttgggaccgtctaatgctcggggcactggggtggccgggaggctggggaggtgcatcgccccctccccctgccccaaccaccgcctgccccagtctgcccccccaaaaatactcgtctacacctcatgatccctgtgtatgccgcccatcgctcctcgcatgggtctcaggctgtctatccatcccatcaaagttttggtgagtgttctaaccctgttttgtgcatgtggacaatgcacccgccttgccctgcccttctccccacgatcgcctgtgtttgcgttgcggcggcaggtccctcattcttcacgcctcacgctgtgtccttctccccagagtgtccatggggctgccattcgcacctcttcaaagtggtcaaagagtgtctcgttgtggaagagagagcgtgctacattcagggtgccacaccacaatagagcggggttgaggtctgttgagggtcccatggctctggcttgacggtgttacatgagagaannnnnnnnnntgtgctacattcagggtgccacactacaatagagcagggttgaggtctgttgagggtcccatagctctggcttgacggtgttacatgagagaaacggggagaccagagcaaaagagcctagggaatatcagatatcatacatcgagggaggggagtagcacaggcctggccgaagtcgccaggcgcctcacagccgggacaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtggccgttaccaggccccgctcgtccggcgcagagagctccaggatcgccgggtcggcatccagcacgccggcggacatgcccacgtccacgcgccagacgcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtggattgaggaggggagtggggcggggtggggggggagggagcaggcggtggaccaacatgagggagaagggaggtgtcaacaccctttctaaaccagtctggcgctcgccaggattagcacggcnnnnnnnnnngagggaatatcaggtatcatacatcgagggaggggggtagcacaggcctggccggagtcgccaggcgcctcacagccgggacaggggtgcgtcgggcgcgggctcgtcggcgccgccgccgcccacgcccgccccctcctcctgctgcgccaggggcccgatgctccagcgccgcacctgcacgccgtcatccagccccgccccgcgcatggcggctgccgaccacctccccggcgccttcttggccgtggccgtcaccaggccccgctcgtccggcgcggagagctccaagatcgccgggtcggcgtccagcacgccggccgacatgcccacgtccacgcgccagacgcgcccgccgcactcgcagttcagcccgcgcgtctggggcgtgtggccgaccaccatggcgcgtgcgcgcagcgcgcgcagcgtgctcagcagctgctcctccatcgcctggcggtcgcctgcatgtggatggaggaggggaggggaggggagtggggcggggtggggagggaccaggcggtgcaccaacatgagggagaagggaggtgtcaaaaccctttctaaatcagtctggcgctcgccaggattagcacggcacacgaccacaacatgcgaccgagacaacctgcatgccgccaatacccttcttgctcctggccgcggcagcgagctgctcataacaagcagctcagacgacgcttaagcccactccgctgcatcctctcttcaccaacccctcttcttcacacacacacacacccgaaacaaaagaacttcctccacgccgctcaccgtggccaaactgctcccggccgtaggtcctgttccacatgatggaggagccgtcgcccatggcgaggaagggcggcagcggcgcggccgctcccggctcgccgcccttcgccccactcatccaggccgccacctcggcgttgatgcgttccaggccgtagaccaggtggtgggggagcagaccgccgtgcgcaaacacaatgtcgttcaccaccagcacggtggggttggccgccaggtccaccgccatgcggccgccggggcggtacagctcccagcgcgcgcgcagcgcggcgcgcgggtcgcgctccagctccgcgtcggagatgccggcagccacggcgcactcccagaaggcgccaggggtcacgtacctgtgtttgtgtgtgtgggggggggttgagtgagtgtgtgtgttacggggcaggagggagggggcgcagaggatctgcagggtgttcggggtgccagggctggtgggtgacatacaaagagacggggcaccagagggggactgcagcgcaggagggggaatagcaggtcgggaatcggagccatgaagttgggagttcaaggtatcagtctgatgtgcggctcccgagaagggcaagcggcccccagagttgagcatcccaccaccggctcatgcgccgcacctaccataccattgctcacacagcnnnnnnnnnnggcaccagaggggggactgcagcgcagaaggggaaatagcaggtcgggaatcggagccatcaagtctggaattcaaggtatcagtctgatgtgcggctgccgagaagggcaagcggcctctagagttgagcgtcccaccaccggctcatgcgccgcacccaccatactgttgctcacccagccataacctctttttcttcctttccccgaccctccttgtcgcccccccccgggccaacctgaagtcgccggcaacgttcaggctctcgtggttaccattcagcatccacaccgcgccctgctccagccgggcctgccggtccagctcccggagcagcagcaggacgccgatctcgcagtcgccgcggtccaggacgtcgcccagctggaccagcgtcgtgtcagcccctgtccacagcgcgcggccctcctcgtcccggcccagcacccctgccagctgcaggctggacaccgccttgtttaggtcgccgtggatgtcgcccactgcgcggatatgggggggagggggggggcgcgcattgtgggtgtgcgagggggaattattgttgtgattgctcattgaggggcttggtggagagggggcacgcagcagcgatggttggaggcgcagatcacgctggccactggcctgatatgccatgatttctgtcccttgcatgggtaagcccgccccaccccccaacctggtgatgctagcgaggcccagccatgccctggctcaccctttccaacggaatgcaagcaaggcattgacccaaatcccccagccagctcaccnnnnnnnnnntgggtgtgcgtggaagaattattgttgtgattgctcattgagggtcttggtggagaggggccacgcagcagcgatggttgaaggcgcagatcacgctggccactggcctgannnnnnnnnncgcttgcgaggtccagccatgccctggctccccgtttccaaagggaatgcaagcaagacattgacccaaatcccccagccagctcaccggcgacgatgcgcccaggggctttgacgtaaacaggcggccctgcaaagggtgctgcgctctccttggtgtcagggtcactccccccgttactggagaagccgtgcgaagggggggcgctgctgggggaggacgtgttccatcctgacaccgcctcgcatgaggccgaggcgtggagtctggggcgtgcgggtgtggggaatgcggtgaagggcgctatggtccggaacctccttgcagtccatgcgagcaggggctgcggcctgtgcttcacggcgtgcaggctggcacggtagacacatgcactcggcatgccgccgcagcactcgctggtggggtaagggctcctcgacagacggcggtggtcggcgcctggcgcagcgcggctacaggtctgaggcccagagtccttccctgccttaacgccttccgctcttgggcatacacgagggttaaagtcggattggctgatgaatgcaaaagtggatggagcgacgcacaaggaacattctcgcgatagactgctgtggaggaggaagatatggagcgcgcgcgaatcggaatcgcctgccggagaccttcgaatcaacgatattgagctgatggcaatgcatgcggtatatgtgcgcatttcctccgtatggcgtttcaaatctgtacatatcgacaacatcacaccgatcctgcttgacgagtagggcgaaacaggggatcagcagtgacccttgtgcccgaacccacatgcatatgagtgcgtgatctcgtgccatgtccaaccttcgtgtggtcaaaggaccccatggggtgaacaaggtgcattgcgtcaaccgtcccgacagtaaggtgctgatcacgcccgcgcggcatgcatgtctggatggtggtctgctccaatagtgcataggtgaaggcctgccattctccacactgcagaagacgatcgtgtactttggaggggaccagatacatcagcatggagtggatgaggtcatcatagacctgcaaagcccaaccaaggttgccaaactcctgtgtagcagcagtggcggagccgcagtgtataggtgaatgggcaagcggagaggagcacaagagaagctgggatgtcagcttgcacaaggcaaatagacttgccatgctgtgatgagcgtggatgataggtagaaaaagtgctgctggctgcctgcccgtgttggcgtgctgcttgcagcctggctctccctgcacaatacactactctctcagcattgaatcacacttcagtaaaggtccccatcctcccccccgcagcatcgagccttcacggcgtgaggcaggcagcgcttgctacgacaacttcctgcacggctgcacgctgagcggggagcccctgggctataaggccgggcctctgaaggcgctgccacagctgctggccctcctcattggggcaggctgggagcacagggggggggtgggcgttgacctcatagccttcagcaagggcggcgttgtgctaaaccaggtctgggctgtgtggatgtgggaccgtgtgcccatgggcctgaaggagagctatatggttgttggccttaaattgtttgttgtggggatgccttaactgatccataccccatgatgctgaggcaatcattgagcaaacctggactttcggtgatcatttccacaccaaccttgcttctttttgtcccagatactgacggagctggcggagcttgcttcacatggctcctcaacaccactggacgagccagggacctcgaacgctgcagagaacgtgcatcagctgacctctgccctacaaacagtccagtacctggacgtggggctcaactgccgcggcgccttcctcacagacccccaggtctttgtcgcgctgggtacattcgcggccgggcacccctgcttccggctggagctgtacaccacaccctggaccagggaaggcagcaggaggccctggctggtcagggagcgggaggctatgctgagactggcgacgcagcgtggcgtgccctgcctccactcgcccctgtttgccgacgtggttgcaaaacaatcgccacgggacctcctgatgctgcacttcaaggcccatcttgtcttcttgacgaatgagagtgcggccgaccctgtcatacttgcttgagcgaacggggaagacggcgcaggtcctgtccaggatgcagagcatattgagatgcttcttctgggaaggatgaatggagcacaagacggccctgtcatcgtcccaggccctctcctccgcattgcaccacccatgccagggagcactgaccactggatccgccccaccgaaggccctcatgaattccctccccctgtcgctgcgtcatcacgcgccgtcttacagcgcacgaaacagccaggggcgnnnnnnnnnncgcaccacccatgacagggagcactgaacactggatccgccccaccgatggccctcataaattccctcccactgtcgctgcgtcatcacgcgcagtcttacagcgcacgaaacagccaggggcgcgctgccctagtcaacgtacattcgcatgccgttgacggggcccacagggatgacggtggggtgcgtcaccccctggtgttccgggtgcaccggccggaagttgaattcccggcaaagggctcccaggatcacccgcgcctccaggagcgcgaagaactggcccaggcagttgcggggcccttggatgaagggcatgaactgcatgtgagggaggtgagggtgaggggatgggggaggacacggcatagttcgcacagaagacgggtggctgtttttgttggggcaagcaggggattggtcttgcaccgtggactagccacctctgcgcaggcccctcatgcatgcaccccagcannnnnnnnnncgagggtgagggcataggggaggacacggcatagtttgcacagaagacgggtggctgtttttgttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgcacgagttgtcgctgcatgagtagccttcgatagaaaacgggtctgtggcctccccccttctccacaaatagaaagccgaccggcgcaccagcaatgaccatggtgggggtcaccaagaacgtcacatccaagcccccagattacacactacatccagcccacccccctggagcccaccatatagggccggatgtcctcgtcaaannnnnnnnnncatgcacgagttgtcgctgcatgagcagccttcgacgaaatacaattctgtggcctcccccctcctccacaaatagaaagccgaccggagcaccagcaatgaccatggtgggggtcaccnnnnnnnnnngccggcttccaggccagggggtccttgtagaggtggtgcacgcgctggacgtgcagcacgatccagctgccggcggggaggtcgtagccgcacagcgtgtcgggggccaccaggttgcgcgtcagcaccggcaccacgctgtacttgcgcaggctctccttcagcgcggccagggtcagggtcatgccctccaccgcggcgcgcgcaggcggcgtcgcgcgcgccggcagcgcctcgcgcgcctcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagctcgtagcatagctgggtggcggaggcgcgggtccagggccggccccgcgcctccagcgccgccaggacccggtccaggatgtcgacgtcgggcggggcgccgccggcggcgcgggccgcggcgcgcgcttcccgccgccgctcaatcacgcccccgaggtatgcattcagcgcgcggatgttggcgtcgtagcgccgcaccagcggcggccagagcaggcgccatggctgcagcacgcgcttgttgctctcctccatcaccgacaggtagaggggggggaacacgcggtcgcactcctcgggagggaggctcaggatggcctccccgatcacctgcagcgtcagcagcctgaactcctcctccatgtccactggagagtggtgtatacgagggtgggggggagggaggttgcgccatgggcaaaactccaaaagacagtgcataggtgccgcaccggagtcgtgcgccggcctggcccagcgcnnnnnnnnnnttatgagggtgggggggagggaggttgcgtcatgggcaaaactccaaaagacagtgcagaggtgccgccccggagtcgtgcgccggcctggcccagcgctgcctcgagttgccccattcgtgtccccctgtcctcctcctggtcctcgtgtcacggtccccccccccctcccctttcccctccacaaaaagctccaaaacaaaccatccacacctggctgcccggtgcccttgtgcttgcgcagcttggtggccaggcgctccacggcccgggcggcgatgggcaggatggtgtccagcatgtcaatccggaaggctggggccatgagcagccgctggcgctgccagtggtcgccgttggaggtgaccaggcccgtgcccaggatgggcaggaactcgcggtaggagaagtcggtgtccttggcgtagatgcgctgccgcgtctgcacgatgcgcttgaaggcggcggggtcggccacgatgacgcccgtgcgcgtgcccacccggaagcgcaccacgggcatggcggcgctgacccagtcgtacatctggccccaggagcagccccgggccagggtcagggcgtggccaaacagggggaggttgccgggggcggaggggatggcgcgggtggcccaccacacccgggcccagcggtcggcctccagccagcgcaggaggaggagggtgcaggtgctggccagcagggcataggccacgctgagggcggttgggatactgaacgaatcccagacctccatgggtgcccgggggaggccagggcagggtgggaaggggggggctggtgcgggggtggtggtgttgaggctacgtggcctcgctccggctttcaaagctacaatgtaggaagcagggacctcgcgtgtggcacgagcctcggataaataaagccacttattttcaaatccatgcacctctgcttcaggtgggaagacaacatgcaatgtggtgcaaactactcctatgcgccagtatttgatgatcgacgtcgaatgcgccacgcagggacagcatgcgggcagcaggcccttcctcacttggaaatacgagccagagcagagtccgatccaccatgtgagagagcgtgctgatgttgagaatcaaacgcgcccattgccgatgctgattatgaaaggggctccacannnnnnnnnnggggacagcatgcgggcagcaggcccttgctcacttggaatacgagccggagcagagttcgatccaccatgtgagagaccgtgctgatgttgagaatcagacgcgcccatcgccgatgctgattatgaaaggggctccacagcgcggccagactaccccagagtgatccccctgagagtcgagtttgggaatttagcggatctcatagcagaatactgagcgaaacaaatccattcctctgaaggagatcctcgcaacccatctgaggaggggctcgcggctcctgctctcacacgagggacagtgcccatgttcagcagcaggacccaagggggtgtggttgatcggtccctggtgcgaccccgcgttgaggtacgatgcgacagggcaccctgtatgcgtcggattacatcgatgagacgcttgatttgagacggctcagctctggtctccacagatgatcatgcctccctatcaacaagcccacaggtcaacctgagcacctttnnnnnnnnnntgatgagacgctttatttgagacggctcaggtctggtctccacagacgattatgcctccccatcgacaagcccacaggtcaacctgagcaccttttcctacctgttcagcgagctcatccagtactgtcaagcgcgcgtatcaaacatcggggagcttgagcggaggtgggtgcactttttgtggggaagctcctctgatgtctgtgcagtacctcgcctttgcactgagtcggctgcccgccctgggcgacgtctcctgctgtggcagcacatggagcttccccatcacactccgcatgcacaggctggacattgtgggatttggcgtgggcgtgcgcctgctggagctgctgagctatcgcgagcgcagtagccgccgcgacctgaagctgctggatgcgttgcgattcgtgcacaccacgctttggcggtacctctttggccgccccgccaaggacctggagcagagcaannnnnnnnnnnnnnnnnnnnnnnnnnnnnnnnnnnnnnnnnnnnnnnnnnnnnnnnnnnnnngcccagttgccgcgatgccttctgagccagagatgggcagatgcgcaggaatccaaccgccaccttaccccatggacccttccccccttccctctcaggctgaggacgagtacatgatctccgacgtcgacctctttatcaccaagtacatcagcgtgcccaaggagatggggcacctgaactgcgcagcgttcgtggcggggatcgtgaggggcgccctggatggcgctggcttcccatccaggtgggtgggcgaggtgtgcagggtaggagcttactgagggaacgcgagtgcaagggcttcagtcttggcatcctctgtccctgacatgctgaattgagttggcattgtcagcatgttactgaggacccaccacttctactcacgattgcagggttacagcccacaatgtggccgtgccggggcagtcgcaggccaagaccacgctgctgataaaattcgatgccttggtgctgcagagggagcagcggctgccctccagctgaggagaacagggcaggacggagcgcaaaccctcacaactctccaacaaaagggggtggaatctcccaatgcaccccgcgcgcgcgcgcccgaaggcgnnnnnnnnnntagaacagggcaggacggagcgcaaaccttcacaactctccaacaaaggggggtggaatctccctatgcaccccgcgcgcgcgcgcccgaaggcgcctagctcgagcactgatgcaatgcatgcatgttgcgcagccctcgatacgcattgtaatattaaactagtatcatgcatcgcatggagatccagaggagatggccgacaggctccgatagcggaggggagtcctccccggttgatactcctgccgtcgaggccacgacaacaggggctgcagagcaagctacatacccagagacgcacatcacatcagcacccgagatgtacgatgtgaccaagctcgtgcatggactgaggcgcatggggttcacgacggacatcgaggccctgccagcaggagacccagcactccaaaactccgtcgtcccggagatagcggagagtgccgcttccagcatcgctcagcaggctgctgccgcggccaagcatgcttcagaggccctggaggcgctgctcgccctgcatcccacccacccagcgggcgccatgctggcgtcggcggcccaggctgctgccgctgcggctgtcaggctgctgacaggggaagacgtgggcgaggaggaggaggaggaggaggaagaggccaatgaaacgactgctcatcaccaccatcatgaggggtgcagagnnnnnnnnnntggaggaggtggaggaggaggaggaagaggccgatgaaacgactactcatcaccaccatcatgaggggtgcagaggtcatgactgtgaggaggagcatgttcacacagggcaggaactccctgagctcgtcctgtcctcaatcggaaggctgcggctgcggatcaatggtgctgaggtggcgtgtacctgggaccagcctcctggatcaggtgctgggggctggtgaacgctgaagcagggttgcatgtgcatttgggagcttcacattgcgggaggcaatgtgctccccatgcagttgcatggtactgaatcagtggactgagagtcatgctcgttcaaagatgcccacctgccctgcaccacttaggatgcctgnnnnnnnnnncgcatgatactgaatcggtggactgagagttgtgctcgttcaaagatgccacctgccctgcaccacttaggatgcctgctgcgcacttcatcaggcaagaacccatctgagggaagctgcctgccccccaccacagacaaatgattgacatgctcactccttctattgccacacagatacaattacactggctccatgcgctgaaggggctggcggtccagcctcaaacaactccatccgttggaacgtcaggcaggcgtcagatggcctcaaagaggccttggagaagctgctgaacggcgcggtctcagtgcaaactgccccaggagagaggtctctgcccaccgaactgtgcaccctgtcccttccagcccctgacggcgacggaccatcaacctcgaagacctccnnnnnnnnnnacgcggtcgcagtgcaaactgccccaggaaagaggtctctgcccaccgagctgtgcaccctgtcccttccagcccctgatggcgacggaccatcaacctcgaagacctccatgagcgaccccgcaacccaagcgcccagcgcacccaaagctgtcccagggccggccggcccctctgtacccccctcgctgcaggcgcaggcgctgacctggcgcgacatcacggggggcgcccccgagctgcagggcatcctggacggcatgcccgagggcgacctggccctggtcagctggcaggccgactgggtgcccgccagcctggcggccgaggcggcgctggccctgcgcccgccgcgcggtgtggcggcgctcctgcgcgtgcgcatcgaggccacgcccgccaaccgcgcgctggctgtgcggcgcgtggccgcgctgccgcaggccaagcgcaagagtgcgcggctggtgctgcgctccggcgcgcacttccccgcgctgggcctctgcgtcgccccatccatgcagcaggagctggcggagggggagggcgcgctgcgcgccaccgtcgccgccgtggagcgcgcggtggaggtgcgcctggcggacctggtgcgctgcgcgctcgacgccggcacagggggggtgaccgggggcctggcgacgctggactctgtggcgcccgccccgcagctcctgggcttggtgaaggcgcgggacgaggtcccgctgctcttcgtctggacggagggcggcgcggccgagcgcgacaccatggagggcatcgcaacggaggtccagggtgcgtgggcgcggaccctggccggtcctgagagcaagggtgcaggggcgggtgatgtgcgagggggggtgaccagatgaggagggtgggtgaggacccaggggaggagcagcgcatctatctcactccatgagcgcctgccgtgcggccgagggacgggcaggctcatggaccccagctgtgtgacaggctgcagcccacgccctgcgcggtgcacggaatgacacgccacatcggtttgtgcacacctggcacttcaatgacattccatggctccacatcatcaacccccacgcctctcaccctctcccctctgtgcaggcacggtgcgcgtcgtgcatgcagacacctctgcctcgccccagctccacaaactggccgcctccctgggtctgaagcgcttccctgccctcctggcttttgccgagggaaaggaggtgctgcggcgacagggcgagaggctcatcccagcctctttgcggcacacgtgcgtcacgctcctgctctctcggccccctgcggcggggaccgtcccgcacacaccggcgaaacaggctgaggaggacggcatagccttgtctctggcgccggcctcggcaagcaaggcgatcgagcaatccgccggggtcagcgtcccaggcgagacgctcccagcagcggcagcagcagctggcggcggttcatcctccccttacccagaagcgtcctcgcctgcttccgtgtacgaccctcccgaggctcgtctcgcaaagccggggttcactcgccgcatgccagacggcgagacggtgcactacttccccaagatgccctgcctcaggtatgtttgggggcctcagggtctccacctggcgtgacccagggtggaataagacggtggcatcgacggtgggccttccaacatgccgtgtcccctcgcccatccccaccaggtgtggctgcccatggtggacgtcagatgaatggaatgccaggtgcatccgctgcagctgggactgcgaatcaacggggtacgacgacgactcccagcctttgccaaagtacaaagccaagtgggcagcatttgtggcccagatcaacgcgggcaaaacagcgccgtggagtggcaagcgatgaagtgggggaacacacatgaaaagcgcatgccctgaccctcctgtgctgcaatggcagggctctcgacctcttcaatggcatcataaaagctatgaatgcttgtaatcattcttttagcttcggtggcaaagagaatgcccgatgtggaaggcatcatgaaaagggtgccatatcacgtgggtgtgcaagtttttggcgggaaagacttacagagctaccgccgtccccccggcgcgaggtcctcttgctgcccggccgagtacacatccggcctctttcggaacgtgagggagcaggcagtctatcgcaatggctccaggtgcggggaccaggcatggcgccctggtgccccttgccggcgggacatggccgggctttgcttgggcctggcaagggtgctggtcaggcgtggcgacaggctcgccatccccgaggactgcaaacatccacagtctattcttgaagcgcaacggtgaagcgatgcgaagccccaccgatccacacttcctccccgcaggcgacaagtccaaggccgtgaaggccctgaaggcggtgaagaagagccagtggaagaagacgaggaagcctcggtactccactagcttccaccgccccaagaccctggtccgcacccgggaccccaagtacccgcgcgtcaggtgcggcctggtgtgggctggggatgcggtggtgcaggcctggatggctcgcgtgtgcatgcttctgtaagcctccggaggagcagccgaagggtcgatgtggttgttcttgtcaatgactggcaggcgctggggtgataagctgctgtatggacaagcagtcccacctgaatggacttgcacccagctttggagacacttgcagtacatagcaagagtgtcaccgctgactctcactctgcacttcattgcatccactccttgcagtgctcctggccagcagaagctcgactctttcgcggtcatcaagtacccgctgaccaccgagtccgccatgaagaagattgaggacaacaacaccctggtcttcatcgtggacatccgctccaacaagcgccagatccgcgacgccgtggcgcgcctgtacgacatccagacccgcaagatcaacaccttgatccgccccgatggcgagaagaaggcgtacgtgcggttgacgcccgactttgatgcgctggatgttgccaacaagattggtatcatctgaggaggcgcggcgctggatgtggctgctgctgtaaggaacatagcaaagctgaaatcggctgaatgggtgtgtgggtttgggtccaggaggagaaacgaacggcagctcaagtagtgcaggggatgttcgcgccaacccaggtgttaggtttcccgccaggccagtatcgcgaacagtcgagagctgtcgcagagctgtccacgctggcatccaacagcgaccaaatcaaagggcattataccatccctgtaagcgaagtatatgcacagggcgtggcagggaagaaccccgacgagcagtatccgagagccctcgttcaattcgaatatcgactcgcacagggatgtttccgttgctcaaggatacccaggtttccacatcgccgcgcacacctccaccggtctgtaaagacggcctgggaaaccatgcaggttcatgcaagcggctgagcggcttcacagacgctgcgcagaccgtcagtcgtgcgtcggtgcgccggctggctcgcagggcaggggtgaagcgcatcggttccgagttctactccgatgcggaggggagcctgaggcgctttttgggcaccctcgtcgaggacatcggcgtcgtgacggagcatgctcgtcgacgcacggtcacagtgggcgacgtgctcctggtcctcaagaggaatggcaggtagtgcgggttgcaggcataccgtgctgaggcttgtagctacagaggtattggagacagttccttcacgacacccagagcgactgagaagcaatcgacatccaaaagaatatgcttccactgcaggaccttgtatggnnnnnnnnnnaactgagaagcaaccgacattcaaaataatatgcttccactgcaggaccttgtatggcttcgaggagaagcagcgcaagaggcggctcgtccagcggttgcctccccactccctggcggagtcgatggcccgcgtctgcagtacaagttctgaggcacagggcgaggcgacgagcaagtcagcctcgatggagcgtggtgcaccgactcagcatgtcacaaggcctcccgcagaggtggccgtggtagccatggccgggagcaagcccacgtccaacggctcggagccaggagtgccacagacacagctgggtccccgcacccctggccccatgacaccacaccgcgctcaagacatccagatcgggctcagcaccttcagggacagcgtgctcgagcgccaggcgcgcagctgcgcccccgtctcgcaggccctggagtgggtctcggccgagctggcgcggacagggaagggaccctgctcgcggacggagtttgaggtagggaaaggggtttggcttgaagggtgcgagattgatccatgagtgcactgtgtcaagtccagcatcctcattccatcacttgaacaggtggtgctggacgctctggaccggcggaatgccatcatgctagatggcgacgcagaggcgccatccaggaccctgtacttcctgtgacgaccaagtgccgctcctgtctcctgttgtgacgacgccatcgtttctcctggcgtggcctctcctggtgtgtaagacaccacattgtatgctgctgacctacctcacgtccggtgtgatgcatgactcccgtgtttcctctcctgtggcgccccttcacttgatgccgccgaggtcgccccctcaggctctgctgctgcaccctttctccctacctcctcttggggagccagacagagtaacaagggtgtgattgtaacaaccaacagtaccaaaaggaaaaggttgacaagggattaaggcaattctggatggggaaggtttgcatgacatggggtggtgtcagcgaggctcctggagagatggagaggaagggaagagcagtcgaaatcagtgccctctgcggggctgggatctatcaacacgggcagagcaactatcaaagagcaatgcggggcagcgggtgattgtgtctaaaggaaagtcgatgccccttcgtgattggagggtggaagtgatgaatgtgaactagattgtctaaagctaatagtgactagggaacagcagcaaccgccggccatgtgatatgggagcgcgcatgctgcactcatgagtccatgcaacttggcggctcacattgaaagcgttggcctgtgtagtttcgcagcccgggtgcccacctgcatcccctggttcccacctcagcgccgctgcacatactggcaccgacccccagcgtccacggcgcagcagggtggcggcaccgggtacctcatgcgcgggatgctggcctgcctgctctgctccagcacccactcgaagccgtgcctgagcaggtcgcctgccctcgccgccagctggtgcgcagtcggagcgctgaaccccatcgcctcggcccaggcggcgccctgcggcgccgccagccggcgcatgcacgcggccaggggccccgggaagtccgtgcccagaccctggcgccccggcgccagatggcagcggtaatcaaaggccaggagtgggttgagcgggtaagggcccggcgccccctccgttgctggggcctcgggtccccagtcgtccacggcgcgttcatgcttggcaaacttctgggtgccgggcaggaacatggagctggcggcgcagcctgtgccctgccaccacacgccaagcatctggtcgttgtcgatcagcgccagccggccgcgctcatccacaaacacgttgcctgcatggcggtcgcactgccccgtcagcaggtccagtgtagcggcctgggtggcggaggggggtgcaaggggtgtcagcaggcagcgattcgtatatggatgctgttgggggatgggcatggggacgtctcagtgccggggggggtcggggcaggccggatggtggggtgcgattccttcacacaacgccacgcctctgccgagggcctctgcatgatctggagacccaagggtgaggcagcccgctcattcccaacccctccacacacacgctcacatacacactttcacaccttgatgacctggtccgaggggatcctggcccactcctgctgggccgcggggccgcggctagtcaccaggctcagcagcgacacccccctggccaccggagtcatgacggccttgtgcccctgcaccacatagccgctgccaggcaggatggaggtcacctcctccgtccacacgcgcggcagcatgtcctgcgtggcgcaggccttgctcagccggcccagggccacaagctgccccggggagccggaggagtaggcgtcatcgcagccccagggcgaccaggtgcctgaccggtccagggggacgcagtgcagctgcaggtgtgcatgggaaaggggagggtgaaggggtcgatgggtcatctgcctcgcgctgcggagcggaatgggatcgcaaggcgtgctcggccaccaggccccttgagtgcatccagcggcttcattgcaatagacattgtgagggtggagggacccaggatacctccttcagaagcctctgcccccacccactgttccccgtaagcaccttggcgacatctgcacgagtttgcccaatctgtgtggcagccatggtgtaggcctgcgagatgccctccggcccggactccacctcgccgccaccaaacttcaccttgccgtccagccttcgtagcaggtggctgcagccggcacagcgggggcagagcgcgaggtgcatgcgcgccgacccccgcatggggaagctggcgttggcggccgtcaggggccccgccgcatccaacatctctgcccacgtcagaccggagcccagcatggcgctgccgtcttccagctcgcactctgcgcagaattggcactgggagacgtggatggggccggaggacggtactttggagtccgcagccggcccaggagatccagcatcctcacagtctggcaactgggactggtcaatcccaacagtctcatttctctggggtgcagggggatcagatggtggatgagtatcatcattgtaatgcctgacaacaaatccgagtttggtcgttcaacgcatggcattcatattcagcccggcatgactgtgtgccccccgacccctgctttccagtctgaccgagggagcaagtgggtcctctgccacccggacctgcagagtgaggccgcgccgactcgcctctcgagttgccagcactcctccatgacgaacctctgtatatattatgtgtgttggtgcttgttggcccgattggttcccaccgaggagaggcctgggatgctaagagaagtaaaccctaactcgggatgccagacgtagtcagaacacgccatgctgacctgggatccgatgcagcgccgggtcggaccattgaaagctcaacagcagtaactgtgacacgaaggaatgaaacgagtttgaaagggtcggtgatccctgtcgtattccccgcgcaactcccgctcacgcacgatgaaggccaacacaaacgccgagccgatggtagcagggacacatcggggtcgcccgcgccttacgaatgacatggtgtatcagtagcggtcgctacatggtcactggatgtcttaaatgagctgaagcacgattgaagctcagcggtggggttcgaccatgtatgagatactcctcgaccccttggaaggtgagacttggggnnnnnnnnnnggcggtcgctacatggtcactggatgtctttggtgagctgaagcacgattgaagctcagcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaccagccttccaatcattgcccatccattgtgtacagcgtggtccccaccaccccatgcctgccggggcattttttagtcatacaaaagagatccgggggcnnnnnnnnnnactgcggattaaaccagcttagtgttgcgaggtccacaaaaaaaccctttccggaacaacttcgaccgtccgtgactggtatcaatcgcgtccgcaccgggaatattcttgtcgaggcgtccaactcccggaggcagggcggacgagtctccgtcgacagtactttccgctcgacacatagtcacaagtgtgctgtctagtttggctgttcaagcccccctagggatgccacagtcggcgtgctggatgtcacgccgggtttccagaccagccttccgatcatttgtccatccattgtgtacagcgtggtccccaccccatgatgcctgccagggcactttttagtcatacaaaagagatccgggggctgctatggtatgaggcgctgacgacttgcatttgcaaggctggctgtaaacttcataatggaaaaaggggaaatgggggcagtgggtggcacagctgatgtccaccccgcccctgcagggttgtggagggaagggctctcgacacccctccccgctcagcacagaaacatgggtgcatgccgcatcgtcatggtactcttctctcggcaggctctgtccaggcctgccgtgcacaccccccggcgagtgagggccatgtggcccaccaaggcctcgccgacgcacgctggggccctcccgctcaggccttcttggggaagtagtcctggnnnnnnnnnnggggccatgtggcccccaaggcctcgcccatgcacgctggggccctcctgctcaggccttcttggggaagtagtcctggagcgggacctgctccagggccccctccttgagggcttgcagcgcgcccaccgtcgccttggcgccggcgatggtggtgatgatgggcaccttgtgcgccagcgccagcctgcgcaggtccctgccgtcgcgcacgtcggcctcgtcgcccgtggaggtgatgatcatcatggcgatgtcgtcgttgcgcaggaggtcagccgcggagggcctgccctcctggatcttgagcacgctggtgacgccgggcacgcccgcggcggtcaggtgctccgcggtgtgcttggtggccaggatgccgtagcccatgtcggccagcaggcgcgcgctgggcacgatggcgtccttgtacttgtcctccatggtgatgaagacgttgcccgaggcgggcaggcgctggcccgccgcgatggccgccttggcgaacgccttggcgaagctgacgtcgatgcccatgacctcgcccgtgctgcgcatctccgggcccagcagcgtgtcggcccccgggaacttgtcgaagggcagcactgcctccttcaccgccacgtggcccaggacgggctcggcggtgaagccgatgtcggagagcagcgcgcccgacatgaggagcgacgcgtacttggccagcgggtgccccacggccttggccacaaagggcactgtgcgcgaggcgcgcgggttggcctcgatgatgaacaccttcccgtcctgcaccgcgtactggatgttgaggaagcccaccaccttgagcgccttggccagcttgggggtccagtcgcggatgacgtccaggcactcctgagggatggtctggggcgggatggtgcaggcggagtcgccggagtgcacccccgcctgctcgatgtgctgcaggatgccgcagatgacgacgttgccctcgcggtcggccagcgcgtccacgtccagctcgtcggcgcggtccaggtacttgtccaccagcaccggccgcgcggggtccacctccacggcggtggtgatgtagcggtggatgtcagcggcggagtgcacgatctccatggcgcgcccgcccaggacgaaggaggggcgcaccatgaccgggtaggtcagccgctccgcgatggccagcgcctgctcctcgttggtcgccacgccgccgggcggctggcggatggacagccgatccagcagcgccatccagcggtcgcggtcctctgcctcgtcgatggcgtcgggggaggtgccccagatggacacgttgccgcgcccgctggcggcggggatggggtgcgcctccagccaggccgccactccggcggccagcttcagcggggtctgcccgccaaactgcacgatgatgccctcgggacgctccttctcgatcacgttcagcacatcctccacctaatgagtgggggttggggaagtgggttgggtggtgaggagggacacacatgttgggatccgagagcgggcgtgagctgcagtctgagaaaccggtccgtgccccaaccctcccctcccagacatcccaccgtgaggggctcgaagtagaggcgggaggaggtgtcgtagtcggtggacacggtctccgggttggagttcatcatgatggtctcgtaccccgcgtcgcgcagtgcgtagctggcgtggcagcagcagtagtcgaactcgatgccctggccgatgcggttgggcccgccccccaggatgagcaccttgggctgggtggtggcctcgcactcgcactcgccgtcgtaggaggagtacatgtagggcgtggcggcctcgaactcggccgcgcaggtgtccacgcgcttcatggagggcaccacgcccgcggccacgcgcgcggcgcgcacgtccaggtcgctggctcccgtgcagcgtccgatctgggggtcggagaagccgcggcgcttcagctccagcagctccgtgggggagagctgggccagggtgcgcgtcttgagccaggtctcggcctcgtgcagctcctggagctgggccaggaaccaggggtcgatggaggtgtactcgtgcacctcctcgatgctcagcccgtcctccagcgcctgcttgatcaccaccatgcgctccgggttgggcacgcgcatgttgtactgcagcttgtccggggtctggcgcttccagttggggggaaggctccagccgtccagccccgtctccagcgagcgcagcgccttctggaaggactcctggaaggtgcggccgatggccatggcctcgcccaccgacttcatctgggtggtcagcacgggggcggcgcccgggaacttctcgaaggcgaagcgcgggatcttggtgaccacgtagtcaatggagggctcgaaggacgcgggcgtcttgcgtgtgatgtcgttgggaatctggtcaagggtgttgccgcaagccagccgcgctgccattttggcgatggggaaccccgtggccttggaggccagggcggaggagcgagacacgcgcgggttcatctcgatgatcaccatgtcgccgttggccgggttgatggccatctgcacgttggacccgccgcactccacccccatctcgcggatgatggccaccgaggcgtcgcgcagtcgctggtactccttgtccgtcagcgtctgggagggggccacggtgatggagtccccagtgtgcacgcccatggggtccacgttctcgatggagcagatgatgaccacgttgtctgccaggtcgcgcatcacctccagctcaaactccttccaacccagcagggactgctcgatctggacctgcaagcaggtggggtggggggggagagtgtgtgtagggatacgagcaaggagagatggagcccaccatgcgaggaacgagtctgcactgtcgcccggcatggagaccagactgacaacagagggcaatgcctggccccctccctggaacacgcgcacacacacaagcgcacaacgtgcctgggtggtcatggaggcggtgagcccggcgttcacaatctccttgaactcgtccatgttgtaggcgatgccgccgccggtgccgcccagggtgaaggcggggcggatgatgagggggaaggccccgatcttgtcggccgccaccatggcctcgtccatgttggtggcgatggccgaggcggccatcttcaggttcagcttctccatcgcctgcggggtggggagggcagggggggctggggtgagaagggggggcgatggaagcggcgcgtcgccgtcagacggttgtgttgtgtaaggccagcgcagggtgggcggagcaacgtagggcgacgtcgatgtcgggcggcgatggatttggcaaccgtgcagcacaccaggagccctacnnnnnnnnnngtgggagggcagggtgggcttgggtgagaagggggggcgatggaaggggcgcgtcgccgtcagacggttgtgcaaggccagcgcagggtgggcggggcatcgtcaggcgacgggcggcgatggattcggcaaccgtgcagcacaccaggagccctaccttggagaagaggtcgcggtcctcggccttgttgatggactccagctttgcgccaatcagctccacattgtacttggccagcacaccgttctcagacaggttcttggtcaggttgagcgccgtctggccacccatggtgggcaggatggcgtcggggcgctcctgcagggttggatcatggcaggagtggggcgttgggggccttgcaaggggtcggatgacttgtgaaggcctgtgcaagccatgcacggtcccagaaaacaagagctgccagggtgttnnnnnnnnnncaggggttggatgacttgtgaaggtctgtgcaagccatgcacagtcccagaaaacaagagctgccagggtgtttggtttgcagagtcatgagttggcaaggctcccatcccgatggtgcaatgtcatggcactcagagaccctctggtgcgacttcaacatctgaaaacctcaccctggccaggatgggctccaccagctcgggggtcatggggccgacgtaggtcgcatctgcagtctcggggtcagtcatgatggtggcagggttggagttgagcaggatgaccctgtatccctcggccctgcggtttgatacgggtgtaagacatgagaatgaacatgaagagagtgagagaggtctacggcagcatgcagaaggccagatcctgtgcccctcccctnnnnnnnnnnnnnnnnnnnnnnnnnnnnnnnnnnnnnnnnnnnnnnnnnnnnnnnnnnggcgcaagatggcctgccagaccccaagcaaacgccccctcacaccaggcctacttgagagccttgcacgcctgggtcccagagtagtcgaactcgcaggcctgttgcgtgccagggaggcacggcatggtgagcactgggcttcgagggtttgggccccaaatatcctgcccaaagcacccacccccgcgaacccttgcccgggtcgtacctgcccaattacgatgggtccggcgcccaagaccagcacgctcttgatgtcggtacgcttggcgacgcgctgcacagccgtgtcccaggcggtgaacggcggcttggtggtctccgcagcgggcgtggtggagttggccttctcgggagccgacactgaggttactaccaggcgggttcccctgaatggagcaggccgactgaggcccgcatgcggcctggccagggcaggacgcggagcgagagagaagcctgctccggcctcccgaccgcacagcggctgtgccgccttgggcgctgtgctcatcattgaatgcatggatctacactgtgagatgcgttgggatgcagcttggggagtggtgcagggatgtaagcctaggtcaagcattggagggttaggtgctggaggtccacgtgctcgcctcacgtggtgagttggcagcgcgcgtgatgagtatcgggccgaggcgtgctcgaccctcgcggccccaattggccatcacatggcatactgcgcgttgggggacatcgtggaggtgcttcccaatcagtgctggaaggcagtaccgtgcacggacacgtcacctggtcagcatggtgctgtattttgtaggccttggcctagcggacgaaaaggatatcacagtcaagtgagaaaaggcgatnnnnnnnnnnccacatggcatactgcgcgttgggggaaatcgtggaggtgcttctcaatcagtgctggaggtcagtaccgtgcacggacccgtcacctggtcaggatggtgctgtactttgtgggccttggcctagcggacgaaagggatatcacagtcaagtgagaaaaggcgattgggagtgtgataatacagatacatagagtgctccaatcctcccgcaaaagattaccgcaatttgcctctcatcaggggcctggaggctgtgaggaagtctgagagggtctacctggaggcctatacctctgtgctcctagtacccaaggagcagctggtaagaccctggtgacagcttctgatccagatgggcagcatatcacgccacgagtgcatcaagagctgctccctccccgtttgcatgcaggaggagttttatggccgtccagtgatgatcgcggacagggagggggtggagatggtgagcagggcctcggatgtgaagatgtccagtgcacacatgcatgcatgcatgctgttttaggcttgtttggtagctgcaatgcatgcatgcttatatgcccagacctgcacctttgctgacctgcaggaagccgacaccattctccaaggggcacaaaccagcgacgtgtccttccttgttgtaggggacccctacnnnnnnnnnngtatgcccagacctgcaccttcgctgacatgcaggaagccgacactattctccaaggggcacagaccagcgatgtgtccttccttgttgtaggggacccctacgggtgagacacagtactggaagagctccaggcatcttctgtttggcactctgggggcatggacgtacgcatcgcgtggcaacacccaacctttcgcgtcctctccccccaaacccacactggggtgccctgcagtgccaccacacacacagatttggagctcagggcgcgcgcagccggaatcacagtgaaaacaattcacaatgcttccatcatgaatgccattggggcggcggggctgcagctctaccgctatggcgaggccatcagcatagtattctttacaggtgggcggcggggggcgggaaacctggagccgcatcagggcatgatgcttccagatagccgtcgcctttcgctcgtcagtaattcccagtaaaatgcgttcttgtacatgccgagcagagacctggagacccgacagtttcnnnnnnnnnntactcgtcaagaatgcctaataaaatgcattcttgtacatgtcgagcagagacctggagacccgacagtttctatgaccgcattgccgccaacaagaagcttgggctacataccctgtgcctcctggacatcaaggtcagtgcgtttgtttgggtggggggggaggagagggatcctggcacctgtgccaatgttgtatgacctcacatgtaccacatcagagacacttcagcacatgtgggcatggtggtgaggcagttggggttgagcacagtgatggcatgacctnnnnnnnnnnaaagctggggctacataccctgtgcctcctagacatcaaggttagttcgtttgtttgggtgggggggagaagagggatcctggcacctgttccaatgttgtatgccctcacatgtaccacgtcagagacacttcagtgcgtgtgggcatggtggcgaggcgattggggttgagcacagtgatggcatgacctgcatgcacaataacagcagcagggcaaatgtcgctcaacgccttgccagtccatacacctagactttgaccattgcatgcaagctgcctctccaccacaggtgannnnnnnnnnttgttgctcaacgccttgccagtccatacacctagtgtttgatcatggcatgcaagctgcctctccaccacaggtgaaggagccatccctggaagccttgtgtcgaggcaagaagatctatgagccaccacgtttcatgaccatcaacaccgccgtcgagcagctgctggagattgaggcgaacaggggcgagggcgcctgcaccccggaaagcaaggcagtgggagtggcacgcattggggccgactcccagcagattgtcgccggcacgctggcggagctagtggaggtggactttggggcgcccttgcactcccttatcctggcaggggagatgcaccatatagagttggaggcatgggagcggcaccggttgtgattttgacgaaacacgaaacgaactaccggttttcaagtagtggaacgtgggcttgcgacggatgtcgttagttggtgacctgcatgctgagctctcccgacattcgggcgcctgcgcaacgctcctgacaggctgggtctaatggcatgcagcatcgccgagactaacctacacacaatcaaagaccggtgatctcattccgcgctcggaagggtggnnnnnnnnnnccccaatggcatgcagcatcgccgagaccgacctacacacaatcatagactggtgatctcattccgcgctcggaagggtgggaagagtggggagcacatcggcggacctccttccctcacaatcgctggccgggcctcggctctgacctgcccaggctcgcgacacagctggttgggtgcaccatggcttctgcggggggaaagatgttgagtgcagaggaaagacgtcgtcagaaggagctggaagaggctcggaaagctggactagcagcgcccgaggtgacgatgctgggcagtgctatggtcctcacgtggagggatgcacacagacgtgggcactcttcatccacatgcactctatcattcagatttcctttagccattacctccatcatgcccaataccgaccataggtggatgaggagggaaatgccatcaatccccatatcccacaatttatggccagcgctccctggtacctcaacaacgatcgcccttctctgaagcatcagaagaactggaaggagggggtcacagacaccaaggtctggtacgaccgcggcgccaaggtgttccaagccaccaagtatcgcaagggcgcatgcgaaaagtgagcgcagggatggatgaattatgcttcctctctgtgcgctggtgctgacctgtccattttcattgtttggcgttgggtgcagcctgatgaattgtcattccgtgccagacaaggcgctcactgccattccatggagaacctgttggcgaggatgtccaccatctcctctccctcactccaacactcagctgtggctccatggcccacaagaccaaggactgcctggagaggccgcgtaccaagggagcacgctggacggggaagaacattgctgccgacgagaaggtgcaggacatccagctggcgggctttgatgcgaagcgtgatcgatggaatgggtacagcaatgatgagtgggtgaaggaagctgaaaggtgcgattgatgaggtgggaggtctggcacgggatgcagagcatatctagctgcgatgtgtaagccactcaggaggtcccatgaggggcattttctatgctgtggtcctcctcccttgttctggaggagagggtctaggcctcccccccccccccnnnnnnnnnntgttgggtgcagcctgatgaatttttattccgtgcctgacatggcgctcactgccattccatggagaacctgctggcgaggatgtccaccatctcctctccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaggtgggaggtctggcacgggatgcggagcatatctagctgcaatgtgcaagctaccgaggaggtcccataagggacgtttcctatgctgtggtcctcctcccttcctctggagaagagggtccagccccccaccccccaccccctccccaatcccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagcagagattcgtcgtaaggagctcatcgaccagacggacggggatgaggagctggctgttgatgctgacctggaagaggaggaggataaggtggatgagacggacaatgcaggtagcttggtggagatggtatatttggaggagccaaggaggtctgggattcagtctctacatgcagtgctcgctaaagctggcactgacctgctttgggccgacaaaggtggacgcctgggggcgtggaggcatcgatcctttgcgtgccctctaatagcttcctaatggtctccgcacctgcccnnnnnnnnnngttttgaaggagccaaggaggtctggtatttggtctctacatgcagtggtcgtcaaagctggcactgacctgctttgcaccgacaaaggtggacgtctgggggcgtggagtcgtcgatcctttgcgtgccctctgatagcttcctaatggtctccgcacctgccccattatgcaggctttgccaaggtggagaaggctgtgcggacagtgggtggcgggtccaccgggaccgtacggaatctacgcatccgcgaggacacagccaagtacctgctgaacctggacctcgactcaggtgagctggggctttgaacggcagcagcagggcaggcgtggatgctgtgtgtcctgaactgcaggacccttgagttgcctgggcccctcttttgatcaagtggtgtgcagggcctgttggcaggaaacatcagggtggctgaccacccatgggttcggccattgtcatccatcgactcctgtccacgaagtccattcctcctcaccgacacnnnnnnnnnnttctcttgatcgggtggtgtgcagggcctgttggcaggaaacgtcagggtggctgaccacccttggtttcggccattgtcatccattgactcctctccacgaagtccattcctcctcaccgacactcaatcgagcatcgtctcaacatgagtcccatcaacctgtccctgttgcagcctactacgaccccaagtcccggtcgatgcggcaagaccccaaccccgacaaggatccctcccagaaaacgtttgcgggggacaactttgtgcgccagtccggcgccgtggcgggcttctcctcgctaaacgccttctcggtcaccgcctacgagcgcgggcaggacgtgcacctgcaagccaccccctcccaggccgaggccgccttccagcagttcaggacgcggaaggaggcgctggggcagagcagcaaggccgacatgctggccaagtatggcaacgctgcagccccgctgacggaggacgtcgcagcactgcgtggcagcgaggcctacgttgagtacgacgcctcaggtgaggaaagggaggaggaaggggagggggtgcatttgcgggtaggcctgcggcgagtgcgggggtctccacggaatttggcagcaaggggtgttgaagggggcatttccactcccctgcaaatatagatgcatgtacttgttcatcgacccgttctggaactcccccgtgcctcatccccccaaccctattctctcctctgcaggcnnnnnnnnnngatagatgcatgtgtttgttcatcgacccgttctggaactcccccctgcctcaaccccccaaccctattctctcctctgcaggccggctgctgaggggccacgaggtggtggccctgagcaagtacgaggaggacatccacccgggaaaccacacgtcagtgtggggctcctactggaaggatggacagtggggctacgcctgctgccaccagtttgtaaagaactcgtactgcacgggcaaggtgcgtgggagggtcacagggttttcagagggggaagaagaggctgccctgtccatggcagtctggcttttggtgtgagcagtggaacgtggggtgcctgcatcgtgtgctgtcctcagcgcagtcggttggtcggtgctcacatggtctgctccatgnnnnnnnnnntgcttgttgtgtgagcagtggattgtggggtgcctgcatcgtgtgcagtcctcagcgctggcgattggtcggtgctcacatggtctgctccatggccactcgtgcaggtgggggagacggcggccatggaagccgccgagcagctgcatcgcaacatgcagaacaaggtgcaggacctcgaggcgcgggaacccacctcgagaccccagggcacccagccaaatgtgaggagtgggggaagagtgtgtgctggagtccatgctggtgtagtatcttaggaattctggggttgaagggcagtggaggccgcctcacgatgcaacaaatgggttaaaggaaactcgggccccagctcaccgccgtccacccaccacccctcgctctgctcgcagcaaatggcgctgtggggcacggagaccnnnnnnnnnncatgggtaaaagggaacttgggccccagctcaccgccggccacccaccacccctcgctctgctcacagcaaatggcgctgtggggcacggagaccgaggagggcgtgcagctagacgatgccaagctgaaggcagccatccagaagcaggagcggctggagcgggaggcgctggagcaggacggcaaaaagcgtgggtacaattcgctctccgcggacgggctggaggtcacggcagaggacatggaggcgtaccgcctgaaaagggcgcggnnnnnnnnnncgcaagcgtgggtacaattcgctctccgcgggcgggctggaggtcacggcagaggatatggaggcgtaccgcctgaaaagggcgcgggacgacgacccgctcgccgccatcacgaaggcaaaagcggggccggcggcggatgggtatgacctggtgtagcgcccaccgaggctgcgctggcagggcagctttccgcaggcggtcctggggagaagtcagggacatggcgtgagagaccctgtcagggccatcagcttccgggggtcccacactcnnnnnnnnnnattccgcaagcggtcctggggaggagtcggggacatggcgtgagagaccccgacggggccatcagcttccgggggtcccacactctatcccgggagtcagacctgcacttgttgtgccttgggatcatgctggcgtgtacatgggaacagaggaccagtgtcacttctgtctaggctgacagggcgcaatcgaggggtctacaagaaggcannnnnnnnnncagtcagacctgcacttgttgtgctttttgggatcatgccggcgtgtacatgggaacagtggaccggggtcagttctgtctaggctgacggggcgcaatcgaggggtctacaagaaggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcctattcggcaatcttaaaacctacacgccgtctcggctgcagaaatgcctgcctggagtcccaccctcaaccctcttttccccattcgccatccggaaccccaactgcagcccacctgttgctannnnnnnnnnaagccagccactgcagttgggccataccctgtggccacatcagtttcttagaacatgagcgtccagcaaggacatgacatatgtgcactggtctcgcaggcaccatgctgtggagccacgatggcacttacttggccacgcgctgcgacagcacgcccaacacggttcgcgtgtgggactctggcaagctggcactcgcctccctggtgtgcctcaagaagccggtccgcagcgtcgcgtgggaccttgatagcaacaggtgggctgcagttggggttccnnnnnnnnnnttgttctagggaaatgatgtggccacagggtatggccccactgcagtggctggctcggagtgaggagtccagccacagtcacagtggcaaataggtggagcatctcaccccaccttcacacacactcaccaatgcccatcctaaggggaggcctgtcagctgcnnnnnnnnnnagatggttatggggaatagagggttgagggtgggactccgggcaggcattcctgcagcctggacggcatgtaggtttaaagttgccgaatgggcacattggtgtggcaaatggcgctgcacatcgctctgtagggtttgccaagcatcatcccggcacacagggtaaaaggtactggcgccactctctcaccaagcnnnnnnnnnngagcaccatcccagcacacagggtgaaaggtactggcgccactctctcaccaagcttccccctttctctgctcttcatgcatcacaggctgatgatgtgctctgggtacggtaagctgtacctctggacggcagatggcgcctcgtgcgtgcacatccccctgcctgggatgaaggctggcacgctgagctggcacccgacccagcccagcctcctgctggcatcccgcgactcgttcgcctgtgccttcttgtagacccctcgattgcgcccnnnnnnnnnncggcctatggggttggagggacatgggcagcgccgatacaaggaagcgggacctcgtctggccctggtcatctggctcagcccctgcacagggaggtttgtgaagggcatgcaggacatgcttttgattccggaggtggggtaacatttgccctggggagttgagagggcaatgacatgctgcctgtgccggggccattggcatgctgcccatgtgaatttttgagccaggcacatcaatgtgcataccaggggatgatattgctcattccgccagcgctctcagggggcaaggcatgtgccatgggatggacgcaccagccaccatgcatcgccaaagtcctcccccctggcccctctcaagcaagcctcgcctgtcgactgagggcannnnnnnnnntggcctctggggttggagggacatgggaagcgccgatacaagaaagcgggacctcgtctggccttggtcatctggctcagcccctgcacagggaggtttgtgaagggcatgcaggacatgctttcgattccggaggtgggggtacatttgccctggggagttgacagggcaatgccatgctgcgtgtgccggggccattggcattctgtccatgtgaatttttagagccaggcacatcgatgtgcataccgggggatgatattgctcattccgccaccgatctcagggggccaggcatgtgccatgggatggacgcaccacccaccatgcaacgccaaagtcctcccccctggcccctcccaagcaagcctcgcctgtcgactgagggcagcacgcgctcgtcatcggttcctcctccctccacccgccctccccgtccttggacggcggggagcgtgggatgcgagatgccgggccactgactccggccacaccattccgtggccccaggacggtcctctcctcctccacttccgagtatgccaccaggccaactggcccctgcactgccccggggtgaggaaaggacgccagccgctgccaggtgtagctgctcaggagctgcacctccccgtcgtagctcccaatggccagcagctgcccggagggtgaccaggccaccgtccggatgcccagccccgcgcccggcgaggtgctccgtgccaggacctcgcccaccgggctgagcaccagcaggccgtggcccgcggtgggcgcctcccagaccgccaggcagctcccgtccgggttccacgccatgtctgcgaggtcctgcgtgccggggctccacctcccctccagctgccaggtcctggtgtcgtagacggcgacggagtccttgcacgcgctcctctgcgccggcagggaagagagcagggcttgttgggcgggggtgtgggggcccgtggtgacctgttgcacatgccaaccgggtcgnnnnnnnnnnggggaagagagcggggcttgttggacggggtcatggggggcggggtgacctgttgcacatgccaaccgggtcgcaccgcacccatatccgtgagagaggttgcagtcctgcggccctggtcccgtcgattctgtacctgtgcgattgccagctggagcccatccgggctgaaggccagcccagcatgcgcgtgcttgggaccctggagctgcaggcaggtctgccccaccaggctccacacggacaggcggatgcagaagtcggcgacgagcaggacatgggcccccgaggggctccagcaggcgcgcacgcaccccgccgatccctcctcgatgcagcagctccaggcagagtcctccacgctgaacaccagcacggacccggtgcggaggggccccgccaggatgtggacagagtcgggggaccatgccaaggcctccacctgttccggcaccgagaacagggccaccaccgccagggagcttgcctcccgaaccaccaggcgacaggcctgggcatgggcaatgtactgtccatcgggagagaactgcggcaccgagccggtgtatggtgtcccctcgctgaaatccatgatggcgggggcgggggggtgttgcggagggtcaaattgcggccgcgacgcttgcgaatggagaggccggggaagtggtgacttcgcgcacaagcattcggccgacttgattgtccaatgtctccttcagcgcccggagtatctcagcgagggcatttccagcccatggttcaaggctgtcggtcacgaaatacagatgttccaactttcttggtcaccgtgagattggcgacgaggtgctggccatctgtacggggttcctgcgcgacaggtttgcgatcagactctcatgctgagtgcatgacaatgggcgatccctctgtacgcgtcacacgatggacgaggagtgtgtcagctagattgaccctcgtcaggacaggtgcaagtgaaccttcctcaacatgatcaccgacatgnnnnnnnnnnttctgtacggggttcctgcgagacatgtttgcgatcagaccctcatgctgagtgcatgacaatgggcaatccctctgtacgcgtcacacgttgggcgaggagtgtgtcagcttgattaaccctcgtcaggacaggtgcaactgaaccttcctcaacatgatcaccgacatggaggcaggggcaccagagcaatgagcaggtgaccatatagaatatgaaatgtcttcgttatggatgtgactctggctgcgagcttnnnnnnnnnngcgggcaccagagcaatgagcaggtgaccagatagaacatgaaatatctccgttatggatgtgactctggctgcgagcttgtgtggaacctggggtcgcacgaggctcctgcgaagagtggtgggaatggattctcacgagaccttgaacttcatacgttcccctcctgcaccggtgggcaaagatggacgctgacgacgccactgtcgatttctatgccaagttgagcgcccgactggacgctgatcttcagcatgaagatggcgccctgtggctttgctcccccgtccgccatgtgccctccactcatgaggatgtggggtggggctgtggatggcgcaactgtcagatgctcctctcgagtaccctgaccagcgactgtcaggtgtggggaacatcctggcattcacaggggtgggccccagttgttcagcatgtccacaagacttggcatttgtgcttgctcacacccttgccgctctggtgcaaacattcccagcgctctcgttccctccctccacagagcaccgtttgcaaccaagtcctgtgccaagatgacggctccgcggcactccctgacatccccacgctgcaatgcctcttggaggctgcctgggcagccgggtttgacccggatggagctgcacagctgggtcacaaggtgcagggcgccaagacctggatcggcacaaccgagattgccgtcatcctgcgtttcctcggagttggtgcccgcatcatcgactttggtgtccgggcccattcaagggctggggcccctcctcatgccagtttttcctgcgatgcctgtggcatggccatcatcnnnnnnnnnncgtccgagcccattcgagtgctggggcccctcctcatgccagtttctcctgcgatgcctgtggcatggccatcatcnnnnnnnnnnccgggccgtttgagtgtgttcagtccccaccaggtagggggttggcgcagcatggagcctggccatggcaggggactnnnnnnnnnncagggcacctggtaccacagcttggtgctggacgactacgacctctgtgcgcggtgccaccgccagcatggaggggggccagttgggccgtttgagtgtgttcagcccccaccaggtaggggggtggcccagcatggagcctggccatggcaggggactggaccaagtgctgcgaaaccttgtcagctacttcattggcgcgcaacacacacttgctaagtgtgtgtaccacacgaccacagcttgcgtagagggagacgcacgctgatctgcccatggagctctcagcccggtccccacctgcaggttcagctgacaggactgccgtgcaactgctcaactgggcgcacacctacttcaccgagggagggcccaaggannnnnnnnnngctgccgtgcaactgctcgactgggcgcgcacctacttcaccgagggagggcccaaggaaggtcaagccaggggactcttgcgcaccagcaggccgccactgtaccttcagcaccagggccattccaggacagtcattggcctcttggagaatgctcaaggtaacaaggaaggggaccagggaggtgctgtgatggcgatttcatgtagcgactcaattcctaggacgtgaatggctctacttgttcaaccaggggctgctgtagctgtctggccggtgagccttgcccgtgaccgcgccctcgtgaccccggcaggagcgcaggctctcctagtgctcgatccagccgtgacatcctccgcgatgcacaaagcgctgaccgtcccaaagtattggcgtagcggcatgctcttgcagccacgatcgttgggtcaccctcaataccaggtgctacgattcgatagtacaggagctggtgtcccggaaagcgacctttccaaagtcatacttgcggcggaggcatttccctgacatacccattgaaggactatgggtaacatatcaccttcatttctgcatctcgtaatactaccatgatttgtgagtgatatcatgtgagcagcccgggcttccgctgtcctcggacccggcgccatgggaggggggtgggaggggattgaccgataccacgatccaacctctgtccgaccagaaccagttcgtacgaaccgctaccttggaaatgacaacctcaacccgcatgtactctgtatgtttcaggacagcagattcatactccaggagtcgccgcaaatcatccgagcaacggtcgtgacaatgggccataccctggcttgaagtcgagcaagaagtaagttcgtcgcgctcgcccgacctatgacatgcctgccactctgtgacgccgatctgaaacaccggttgttacagattgcgggagtgtcctgggaccactatcacagcttgtagatccctgctggtgaatggaacaggccatgagcagatgctggctcgggatccaaacactgccatgcatgggcgtttgatcgatgagagtccctcggtgtccgcaatcctacaagataggctctcgcgtttccttggagatctgtccgcataccttccgactcgccgtgcccgcgatgttcgacgcggtcagcttcatggcttctcccacacgatctgcccacgagttacgttattaagctgccaaaggcaaaaacatggtggatgaatcacactaccgccctgaggatcgtgcgctcagtttaaactgacggaaagccaggttctcgtgctgtgatgatgtcagtgagcacgtctaggggtacaaaattcgggaactccaattgcacatggagggtagcacctgttcgacccggggagcaccggagtcccgcactcgcaccctccagtcgatcaggttctaccagggattgagcgtgggacgtgtacgagataacgccgtgtgtcgcgggtggacctgtcctggccccggtcccaggtttcaacgcgcttcggctgaaggccaacgaggccatttcattttgagtcggggtcgtcccccgtcattctgagccctgtccttttccaactccttgaaagcacatctaggttacattataagctggtgcagggtgagcaggttcgcagtgaggaccagcgaggctctgcagatggtgggtaccttcctgcgtcgcaggtctcgttttcaaccccccggtcgcacgcccacctcataggaaggggcaacagggcggcatgcccggcgcgtaccatcccggagggacccatgggtttcctcataaacgtaaacggagtggacccaagagcaagagcagtccgtacctgggcgtgacgcagtataagaggtgggttgtcgacacgggcggcatgctggtccgctccccaacagacccccttgcaagcagtacttacgcactgcgccttacatttacaatccacgcagaacgggtcgtttcgaagcccacatatggtgagtctggtgccggactccagagttgtgtgcgttctggtggctataagttgggggtgttctgccaagatgggaagaggtaacccgctcctggctcccctgcactgtgatccaggcaggtctcggccttggggctggggaagatcctgccacgcatgcattcgcctggctcgcagcctgcccatgtcactccggggcnnnnnnnnnncaccttcctgcgtcgcaggtctcggttccaaccccccggtcgcacgcccacctcacaggaaggggcaacagggcggcatgcccggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccataagtggggggtgatctgccaagatggggagaggtatcccgctcctggctcccctgcactgtgatccnnnnnnnnnnnnnnnnnnnnnnnnnnnngccaaggggcaccagcggcacctgggctcctacgacagcgccgaggcggcggcccgctgctacgaccgcgccgcgctgcacctgcgcggcccctccgccgagcttaacttcccgctgcgcgagtacgaggaggaccccttcatgctcgcccacggcaaggccgaccgcgcgcgcttcctggacctgctgcgcgccgagttcgccatccagccggagcgtgcggcggcggcgcgggcgaggaccaaggcgggcaccccgccccgccgggcgcccctccacggcccgcacagccctgtctgcgccgatgacggcgtgcgggcgggcagtggccccctgtccctggcgctcggcgcggaggcgcgcgccacggcgccgggcgcccacgcgccgcgccggcgcgtcgaggaggagagcgcgcaccagcaaatgctctcgctgctggcgctgggccccgacggcctgttcgatgcctcccccggccgcccgctcagcgtggagcccctggcgccacgccccctccgcgggcacggctgggaggcgtccgccctcgacccgcgcgccgcctcgccctgccactccnnnnnnnnnnnnnnnnnnnnnnnnnnnnnnnnnnnnnnnnnnnnnnnnnnnnnnnnnnnnnnnnnnnnnnnnnnnnnncctcggacctgtacgcctgtcacgccgaggcctcctcccagcttcgcctccaagacgcatacggcgaggaggcgtatgcgcacgccggcgaggtcggcgggtgggccgcgcaggcccatcccgccgccgcggcgtgcgacccatggcacgcgcgggcggtggggctgcgtgccgccgctgccccgcgcctgagccccatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggggcgctgtgctggtgggcacccccctccaggacctggcctggtcggcggcggacgcggaggaggtgggcagccccctcatcatgctggacgacggcggggtgggcgctggctgggacctgggggtgtactgaccgtggaagccaggccgcgcagcgcgctgcaaccgcctcacgaggtgcgggggtgccgcccggcagggtgggtggatgctggtgcccgggggattgaacgcagcatggccagcctcaatcccttggtcgaacctgcctgccgattcccctgcaggtgagctcccaggccctagcttcagactgcacagctgtgaattcaggtgcagggaccattnnnnnnnnnngtcgccagcctcaatcccttgaccgaaactgcctgccgattcccctgcaggtgagctcnnnnnnnnnncggacagctcgtctgactccgtagcggcgcgcacatgtggcgtctgcgccaggtccactctgacgctcttggtaatccttggatcccctgaggaacattgctgcagtgtgaaactacagtctactttgcgtacactagacaggagggagtcccaacattgctcgtatgacccctggcatgcaggggctgaaattttaatcatatcgggcagcaagttgccctggtcatcatgtctcgccttccttcacattaatgttgatcgcccttcccaagtccccataaagacctttgtgtgcgaggctctttcattccccaacgggaataaaacttatcagttgattatattcttggcacattgctgtattgtaccctgcaccatgctgtgtggagctgctgtnnnnnnnnnntggacagctcatctgactccgcagcggcgcgcacatgtggtgtctgcgccaggtccactccgacgcacttggcaatccttggatcccctgaggaacattgctgcagtgtgaaactacagtctatcctgcgtacactagacaggagggagtcccatcattgctcgtatgacgcctggcttgcaggggctgaaatttgaatcataccgggcagcaagtcgccccggtcctcatgtctcgccttccttcacactaacgttgatcgcccttccaagtccccagaaagacctttgtgtgcgaggctctttcatttcacaacgggaattgaacttatcagttgtttatatcattggcacattgctgtattgcaccctgcaccatgctgtgtggagctgctgtaagacagggaacaggctagactgtggaagtaccctggaccacagtggcagaggccgagcaggcttctactcgtgccacatagaatttcatgcaagcgtcacgtagccctggagtcagtcttgccgcggctctgaaaactggcgcatgagacgatcgaccgtctgtgaccgactgagcgccgtctccagggtgcgaacgcgagcatgcagctttgcgcaaactgcgagcatcgcatgccatgggagggagcaggctggtttgggtccccgcactacattaccgggcacgtgccacagtgctgcgcagctgatctggtagcacacaccagccaccatgaccttgagccatggcccgtacaaactccaaccacagcacagggtcgcacctcgagcttgctcggcaaaagttgtggcatttgggacagagtgcgactgtcgtgccagagcaacctgcaccatctcctgacagcgtcttgcctgggcggtggctgccctcaagctatcctccacttgcttaaggtcttccacaccgggcgctctgccaggcatctannnnnnnnnnnnnnnnnnnnnnnnnnnnnnnnnnnnnnnnnnnnnnnnnnnnngaggtaggcaacacttcaaagggatcgcaccctcccaccagccacccctactgcctgtgtcaatcacctcgagaggacctgtgattgttgttgcaggaggacttttacagtctgcgccaggctctcagattgctcttgatctgctctggctgctgtcctcaaggccacgacctgtgggttcaagaaaagtcgatggcctcctctgaaaagcaacacctcgctcattgtgactcaggttcgccatccaccagatactgtattacgtaatctggccattccaacctcctagcccctgtgtgaatccagccccccatcatgcctgcgctttgagcctgcgccgctcatccagccaagcctttctgtcgcgnnnnnnnnnngtcaagaagagtcgatggcctcctctgataagcaacacctcgctcattgtgactgaggttcgccatccaccggatactgtattgcttaatctggccattccaacctccttgcccctgtgtgaatccagcccccaatcatgcctgcgctttgagcctgccccgctcatccagccaagcctttctgtcgcggtgcagctggcgcacttctgtcaatagagcagcctcccttccggcaagctccttcatttggtgaagtgacagcacacagggtgaataggtccagtacattatcaattttatgcggggagtgagcgcagggcggccattctccttaccatgtaatggcccacctgcaactgttttagcattctctcagcctttgaggctatcttttgacggactccctcgcgtgtcatgtttccaatggtgcccatgaggctggccagatcccgtgcgagggagaggggaacgtctctggcggctgggtcaaaggaagcgtcccgggcgtcatcgacgggtcgatgggtggtctcgccatcagagttgtcgttcagctcctcagcttcgggctgggtgctgattgaatgatcgggccttaggagatgcgagggctctcgggaaacagccggggtnnnnnnnnnnaggctgggtgccgattgaatgatcgggccttagaacatgcgagggctctcgggaaacagccggggtnnnnnnnnnnnnnnnnnnnnnnnnnnnnngcacatgtcaacgccgttcagaccatcatcaagcgccgtcgggtttcggcaccacatgggagatgtcatgtcagatttttccagtttgtgatggaaaagttcggcaatcaaaagaatacaaactcttgccatccaccatttacaaagcgtctcaagatagttagccattctgtcattttttcttacaatacagcaacgcatcaaaaccnnnnnnnnnnttcatattgctatcgcacgcaatgggcaagctaaaaaaggatgactagcgccacgtacttcgctgtctcctcacatgtcaacgccgttcagaccatcatcgagcgccgtcgagtttcggcaccacatgggagatctcctgccagattcgtctagtttgtgatggagaagttcggcaatcagaagactacaaactcttgccatccaccatttacaacgtgtctcgggatagttagccattctgtcggatttcttacaatacagcaacgcatcaaaaccacatttcaagatgcggtatattatgagaataaaattggtcgttgggaggtgaggcccagactggaacgacacactcataccatatgggtggatgcagatacttgttacctcctacagcgcagatgtgagccgcgtggacgggggaacgtgcacagaggctccgggagcatcgtagaacgcgctcagcatcagagctgcagccaccgaatccttcatctgagcatggatacaggtggcttatgagtgtgtgtgcagcatttgctcatcccaaacacatgccagctcccatcactgccatcacctgcaaggccttctttttcttcattcccgaggccttcatgtcgttcaaagcaaagagcgttgtgtttcgctcatctgcagcatgtagacgtcatggggaagtatgacattctggaaggccacaggcagccgttttgacagcaacgtgctgtatgtgactttgttactcacatagagctgcgctgatagcagcgtgccaagcaggctttcctgagagggagatgcggttccacatgagaaagccaagggccagaggtccacccacctatgagaaacacacggatgtcccaggggaaagcgccatcggcgatctgctctgcgaagcgacggcatcttcggccctgctgagagtcggaggagggccgtgccaggttcccgctgctgatgactggcagtccaaccactatgccctcacaacctgcagaagcaggaatcagtagcaaaaatcgtgagagggaacctggtgtgatatgctggccgctggaaaaccactgacgacgcagtgtataccctgaccaaggatctccaatcattgcagcctgtaatagtcactcgccttnnnnnnnnnngtcgtgagagggaacctggtgtgatacgctggccgctggaaaagcactgacgacgcaatgtataccctgaccagggatctccactcattgcagcctgtaatagtcactcgccttccttcctagcaacagcaatgacgtctgtggcatcctgcttgataaatgccaggcccctggcagatagtggcggcagggggcgtggggctagaccgtgagtggacaccgccaagccaagattgcgccgtccatagtctacgcccagactcctcgttggaagagagttcatgcgcggcgcaaggtgtgggtcatcgcgctcgtgtccgcgggtctgtaagtatcgtgggacctccgctcccaactttgagcagtatgcttgatttcccgtgttggacagtggacaatgatgtccagtcttcgtataactcagtttacatgtatctttagctcnnnnnnnnnnaggtctgtaagtatcgtgggacctccgcctccaattttgagcagtatgcttgagttcccgtgttggaaagtggacaatgatgtcaagtcttcttataactcagtttacatgtatctttagctcgctgcggccggtcttatgccagtgggtgaccttcgctgctggatagcgctcagccagggtttcgtcgcgcgccctcagggctggactgttccgatatacatgtcgcgccatccagtgaagcgcgctgtgctgcaggaggatgcaggttgtttccccacccagcccccagattccagtgatagagtctctcgagtcgctgtgcccattatggggtcgtagtctgtgaaagaggtcgcctctgcgatggggttggagtggagcctgccttcgcgtcggtttaggaaggctatcgaggcggacgatattccaggacttcgtacagtgcgtgggtattgtaaaccgattgtggtgttgggaagagccctgcacgcgccacgccgcacgcggagtgtagccgtcgacgtgaccccgtgaaaactgtcctgtgcagctctgccaggagaatcccggcgccttgctagccatccgtgcgtcccgtctnnnnnnnnnnactggtgggcgggattcgggggttgggggagtatttgggcagctgcccgggcggtgaatcattggcagcagctgcctggaggtacctgcccatccgtacgtgtctctgtctgatcaggatttgcagtgcatcgatccagggtgcaccagccgggtgggaacctgcctggccataactcttcccccaccccaccccaacaatcacctcaagccccaaccccaagtccgcaacccctcccctccccaatgcagcaagcccgccaannnnnnnnnnatcaccccgtgaaaaccgtcctgtgcagctctgccaggagcatcccgccgccttgctagccatccgtgcgtcccgtctgcgcaccctcgtcctcctggcctctgacaaggggtccgccctgaccctggaggtggtgctggatgcctgccgggtggctgccgggggtccccgggagctccgggcgcttatcgacgtgcctgacagcaagggaaacagtgccctggccctggctgcgaagagctggtgggcgggattggggggttggggggggatttgggcagctgcctgggcggtgaatcgttggcagcagctgcctggaggtatctgaccatccgtatgtgtctctttctgatctggacttgcagtgcaccgatgcagggtgcaccagccgggtgggaacctgcctggccataagccttcccccaccccaccccaataatcacctcaagcctcaaccccaagtccacacccactcccctccccaatgcagcaagcccgccaacgtggcactgctgctgatgcgcggcgccgacccgctgacggtcaaccgatgcgaggacaccgcggtgcacgcagccgcgctttccggctgctcccacagcctgtccctgctgctgacggcgcgcagcccctcgggccgcggcctggtggcggacgcgcagctggtgggccgccacgccgctgagcgctgcatcgacgcgcccaacgccgcggggtacgcgcccctccatctggcctgcctgcacggcaacctggaggcggtgaacgtgctgatcgcacagggcgcggcactggccacgccgctggccggcggcgcgcgccgtgcgccgcactgccgccgctgcgccgccg

SEQ ID NO: 45996 - DNA, 68 bp, Chlorella protothecoides
acgagcctccgcaccaagaagaccggctgccagcaaaaatttacgatcaagcagctgaggcaagactc

SEQ ID NO: 45997 - DNA, 61 bp, Chlorella protothecoides
cgtggctgtgctctccattggcagatgaagctggtcagctgtgcgcagatcgtgtatactg

SEQ ID NO: 45998 - DNA, 63 bp, Chlorella protothecoides
aacccatcgtcgtccttgtgatcagcatacacatcggccatgagggcggctgcatggaaatcc

SEQ ID NO: 45999 - DNA, 69 bp, Chlorella protothecoides
ggactgctgtatatcacctaaacgaggaggtatgttccaggacaagaccccgagtacggtgaggggctt

SEQ ID NO: 46000 - DNA, 120 bp, Chlorella protothecoides
tatgtgaggcctgcgcttgaagtttcagctatagcacctgcgattgtgcttgcctgaaaaatcatttctgaagacttggaaggctgcacactccaatcgcttcctctgggtagcttctga

SEQ ID NO: 46001 - DNA, 61 bp, Chlorella protothecoides
ccgcagtgatgatcttgcgtggatgttctcgtcatgtgtctattggaccatagttcctgtc

SEQ ID NO: 46002 - DNA, 462 bp, Chlorella protothecoides
  modified_base (135)..(259): a, c, t, g, unknown or other
gagtcggcatgcaggtgaggtgcactgacggatcaatctacgtgcagtgaaggcacaagcatttgccgaggaggatggacccgactgcctgagctggcccaatttggggcagaattcggacagggccaaggtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagcatcagatggtaatttgtccgggataaattcatgcaacaaagtgaattccctgtgtaggcctgtaggaaagcgcgagggtcctccaaacaggcccatcggacacagcggtctagcatttttgtgctcgctcacgaccgtcaccgcgctggggagttgtttgagcaatgtcttccaaagcttctggatggatccacatgc

SEQ ID NO: 46003 - DNA, 73 bp, Chlorella protothecoides
cgagccgcggtggcctggcccggcccggccaagaccgacaccggcatgcaccagcccatggggcctgcagcag

SEQ ID NO: 46004 - DNA, 61 bp, Chlorella protothecoides
tggttggcgccgcttggccgatcgtggccccgagcgatcctgatcgctgcgcggtgtggcg

SEQ ID NO: 46005 - DNA, 373 bp, Chlorella protothecoides
  modified_base (110)..(321): a, c, t, g, unknown or other
aagggctgtcgcttgggatgcggctccgcgtaggcgacatgcctaggaacgaacccccaacgtctttgccttgcgagcactcctcagacttcacgccagcaggtggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgagatgggcggccaccatcaaccactctgacccaccggtgcacctcttg

SEQ ID NO: 46006 - DNA, 61 bp, Chlorella protothecoides
accacgttggaggcgttgcggctggccagggacccgtccatccccgacctgtgtcgtgtgc

SEQ ID NO: 46007 - DNA, 61 bp, Chlorella protothecoides
ccatacgtgtcgaaatttaaacgctcaccatctccagccaagaagaaacaattagcccctc

SEQ ID NO: 46008 - DNA, 72 bp, Chlorella protothecoides
cccatgcctgggcccgatggagggccctggcatggaacatggcatgtaaaccctgagcatgatgggagcgcg

SEQ ID NO: 46009 - DNA, 76 bp, Chlorella protothecoides
accaagcacccacgcagcgagcaatgcccctcgcagtgggcaatgccccacgcagcgagcaatgccccaccccact

SEQ ID NO: 46010 - DNA, 99 bp, Chlorella protothecoides
accacgaccgacattgcaatctggtgtgacaaggggaaaggagggggccaagtatgggtgagccttgcaagggacatggagttcacccaggctcattgc

SEQ ID NO: 46011 - DNA, 419 bp, Chlorella protothecoides
  modified_base (97)..(337): a, c, t, g, unknown or other
tgtggggacgggtggtacgcgtcagcccactgttctgtcagcccattgtcttggatgctgcagagggcatatcgcagcgaatgagaccacgcgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactgtccgccctttcctcaccgcacctgctgcccctccccaggcaggggtggaccatgatgccctgccgctcgtccttttc

SEQ ID NO: 46012 - DNA, 103 bp, Chlorella protothecoides
ggcatctgtgcatgcagatgccaagcgatgtcttctgtcaatctgtagggaagggttggagtgatgatcgcatcgccaccaccagccctgcacatcaggatgc

SEQ ID NO: 46013 - DNA, 61 bp, Chlorella protothecoides
ggacattgcgatgccctactcgccaggatacagataccctccacatgacactgtaatggcc

SEQ ID NO: 46014 - DNA, 61 bp, Chlorella protothecoides
tgctccgctggcatacacaccccgcctgtgacccctgggccctgtctgttaccgcgagtgc

SEQ ID NO: 46015 - DNA, 61 bp, Chlorella protothecoides
ccgaacaacctccagggatctccgtgccacaccctccacccaccatgtccaagatcatcga

SEQ ID NO: 46016 - DNA, 143 bp, Chlorella protothecoides
gagtcagggagtacctttccctggtcccaataaatcctttttacgatgagtgctccaacctttcattcccttcaagttttccatgtgtctgcttttttcgaggttccttgtagactgtctccataccttcgaaaatgtcatgc

SEQ ID NO: 46017 - DNA, 73 bp, Chlorella protothecoides
gtgggtgtaggaactggatgctgcaaagcacttggggccaaggtgaccatctgacaggggagacccaggaagg

SEQ ID NO: 46018 - DNA, 75 bp, Chlorella protothecoides
agggacaggaacaacataggctccggtgccatggtcacgctgggcagcagcaaggtaggcacgcatgccgatcac

SEQ ID NO: 46019 - DNA, 67 bp, Chlorella protothecoides
tcctttgcaggtggatcgccatgcgttcaagtaggctagatagacaaggccaccaggcaatccacac

SEQ ID NO: 46020 - DNA, 72 bp, Chlorella protothecoides
cactggcaagtgtgcggacgtggggaggtggcagtaagggcagcatggctgctagaatcaagagaacggcgc

SEQ ID NO: 46021 - DNA, 112 bp, Chlorella protothecoides
agtggtaggtactgtaaagcaaggttgtatatgcgtggaaagtttatcgctgcttactccgagccttcttaccatgcaaatacccctgcttcttcggaccgacgatctcgcg

SEQ ID NO: 46022 - DNA, 70 bp, Chlorella protothecoides
gatcttccctgcactgctgcatgccgggccccctccatgcaacagccccatcatctcagaggctcagcga

SEQ ID NO: 46023 - DNA, 61 bp, Chlorella protothecoides
gcagagaggatcaggggacgggcagggtttaggtcgtccagatggtcgcagatggcgtcgg

SEQ ID NO: 46024 - DNA, 61 bp, Chlorella protothecoides
ctgccaagagagtgtgtatggaggggggggtctttgaggggagttgaagcagtcattggcc

SEQ ID NO: 46025 - DNA, 61 bp, Chlorella protothecoides
actcgctccaccctcctcgctcctcaccatgcagccgggcatggtggcggcgaagaagggc

SEQ ID NO: 46026 - DNA, 61 bp, Chlorella protothecoides
atgtaggactgccggggctggagcagcaggtgcagcaggtgctcctgtgcgcgggtttggg

SEQ ID NO: 46027 - DNA, 69 bp, Chlorella protothecoides
gccacttgcctgcggcacagggtctctgcgtgtggaaaagcctccgcagaccctctgcagcgcacagct

SEQ ID NO: 46028 - DNA, 74 bp, Chlorella protothecoides
ctcctcatgtctggtgccagcttcattgggcaagcgggtgtagaccaggtcggcgcattcgcagcgcccctcgc

SEQ ID NO: 46029 - DNA, 66 bp, Chlorella protothecoides
gctttggtggggacccacctcaatgcaagaatgcccgcagaaactgacgggcgatctgtccacggc

SEQ ID NO: 46030 - DNA, 107 bp, Chlorella protothecoides
atccctgtgtcttcatgtgtgtctgctcatcaatagcaattgtaatgtgtctgaagaatacatagatacgtccctggatcggcttttgcccactgttaccttcctgt

SEQ ID NO: 46031 - DNA, 87 bp, Chlorella protothecoides
gggggaatgccccgccggaccacggcaatgccctcatccttgagtaataggtccctttggggtatgcacaggtatttgaggagcacc

SEQ ID NO: 46032 - DNA, 61 bp, Chlorella protothecoides
ccaacgcgtttgtgctgcagcagtttgagaaccccgccaaccccaagatccactacgagac

SEQ ID NO: 46033 - DNA, 61 bp, Chlorella protothecoides
cggagcgtcgccgtcttcccctccagccccaccagccagctccaggaccaccgacacgtag

SEQ ID NO: 46034 - DNA, 61 bp, Chlorella protothecoides
agtaccctccttcaacctaggagggcgggatggcgacgagcccctgaagatccagatcggg

SEQ ID NO: 46035 - DNA, 64 bp, Chlorella protothecoides
cctgccctcccccgaaacctgctattctgctatacctgccctcccccgaaacctgctattctgc

SEQ ID NO: 46036 - DNA, 70 bp, Chlorella protothecoides
gagggcctcagagcggtgcagtagctgcatgttcatccagtcatcctgggcagcaggcttgtctgacgag

SEQ ID NO: 46037 - DNA, 61 bp, Chlorella protothecoides
cggcggagttgaaggggtctcgccgcccagacccgccgaggccgaatggctggtactctgt

SEQ ID NO: 46038 - DNA, 64 bp, Chlorella protothecoides
ggacgaagtgcattcgcaaaaaagcacttgagcaacatcaggatgttgaccgccccgttgacgt

SEQ ID NO: 46039 - DNA, 61 bp, Chlorella protothecoides
ggctcagattccccaccgatttctggatcctccgccgtcagccatgagcatgaggtgagct

SEQ ID NO: 46040 - DNA, 66 bp, Chlorella protothecoides
caaccgttgaacatagaccatcaagctcctataccatccacaccatacggggaccttctccccgaa

SEQ ID NO: 46041 - DNA, 68 bp, Chlorella protothecoides
ggaagcgggggaagaagaagacgggcgagatggaggaggagaagaagaccgactggttcgtgcatgtt

SEQ ID NO: 46042 - DNA, 66 bp, Chlorella protothecoides
gtgtagagattcgataacagagcaagtacagcataatttgttgatcgtcactctagagtaggctgc

SEQ ID NO: 46043 - DNA, 64 bp, Chlorella protothecoides
agcgcgagagttctggtcccatacaatacagtttgcctattcacgctgcaccccggctgaacct

SEQ ID NO: 46044 - DNA, 71 bp, Chlorella protothecoides
cagccgcaggggtcccgagacgccagcggtggagccgccaggacgccagaccctagcaggaggaatcccac

SEQ ID NO: 46045 - DNA, 61 bp, Chlorella protothecoides
gtaacgtcgcatgatgggtggcgtgatggggtagccacagaatccagaccatgtgctggta

SEQ ID NO: 46046 - DNA, 7127 bp, Chlorella protothecoides
  modified_base (177)..(186): a, c, t, g, unknown or other
  modified_base (564)..(573): a, c, t, g, unknown or other
  modified_base (1057)..(1066): a, c, t, g, unknown or other
  modified_base (3599)..(3608): a, c, t, g, unknown or other
  modified_base (4585)..(4594): a, c, t, g, unknown or other
  modified_base (5011)..(5020): a, c, t, g, unknown or other
  modified_base (6670)..(6716): a, c, t, g, unknown or other
ccggaggccaccgcgacgccggaggccaccccgccgccctccccgccagcgtcgtccacgccagcgccgtcgctgccgccgtcgtccctgccggcactgccgggggggggacttctgactgcggcgcgagccccctcgaccggccagtgcagcgtgaccctgtcggatgtgctggannnnnnnnnnctcagggggggggcttctgactgcggcgcgagtcccctcgaccggcctgtgcagcgtgaccctgtcggatgtgctggacggcctggctcccctggacgtgccgggcatcctcgtcctgtccgccagctgcgacgcggccgcgcgcccggcggcgctggcctacctgctgagggaggtgcggcgcgggctgtcttccggcggggaggtcaagtatgtcctggggtgcggggtgactggcggcctggaaggcagtctcacagggctcctgccggccatcggcaagcacatgcgcggcgcgcagaccatcctcgacgcgagcgaggagccagcgtgagtcgggtgccttggggcggtgtgggtgtcatggcgggcttcggnnnnnnnnnnaaggaggtgaacggagtgagaaggtgtgttttacgagagcaagtttgcagtgctcatggtgtgggtggggatgcacaccctgccacggtgcactgctccgtttcatctacatggcctgctctcctgcaggtgcacgagtccagatgaagccgtggcggaggaggacgccgtggcatgcatgacgccgcatgccctggacaggcgctgcgccgcccagcggtgtgtgacagtgtggagtgggacggagcctgaatgctccgagtcgactgatgagctgcatgcaggggtgaccggctctctgcccggcagaggggtatcgcgtcgagcctgacgtcgcagcaggccctcccctccaccgtcccaagcccacctcccggcccttccccgcagcgtgctgatggagtgcgtggagatcattctccaggtgctgcgtggcactcagcgcggagccaagggatcaccgtcgccgggcgtcgccgtcacnnnnnnnnnnatggagatcattctccaagtgctgcgtggcgctcagcgcggagccaggggatcaccgtcgccgggcgtcgccgtcacagggctgagcgacgtgctgtctgccctcgacctgggaggtgcggggatggggcggaggtgggggggcgggcgaggggtgaaggaggggtgtgtctggctggctggctgctcataccctggggcacgccgctcagctcagcttcatgtcctcgtgaccttgctctgagctcgggactggcgcccatgtgctctcgcgtgcctgcctgcggcctggactttcacattcacacgaatgcctcttgaaatgggtccccccacttcacacacaggcacgggagactgcgctgcagaggccgcatcccgctccttcacacgactcctggagacggcctcgtcgcttgcagaatctgagcaaggcacggcacccacgcccggtgctgcatcgggcagccaggccctggtcttcctctggcatgtgctggagatcctgcagatcctggccggtgaggctggcgtgcaatgatccatgaaggcgtgcatggactgcttgctgggggagcgaggttgagggtggcctcagcagctttcggcagggcggggggcaccatgtgtgatgtgttcagcatccccacctcggcatgtgctcgaccccacgtcgtgtcaggaggcggcccggaaggagctgcaggatgcaaggtcatggcagggtcagacctggggcagatcatccacgacggagcacgggaggggctgacccgcgacctctggacagcggcccaggtgcaggggggtggaggcatgagtgctgggaggggaagaggtactggtgcggtgggatacaaacatgtgataggcctgctgtacgacgctgagcatgggattgcgaatcacagaacctcccattcaccctacctctcatgtcctcacgctccccctcacccctgtcactacccaaacaggccctgcagagtccatgcatcccagtggcaaagtcccacccgctcctcctgcccggcctgctcagcatgtatctgtcccatgcgaccccccgcatggacgccatccaggagatcgcacgggatctcctcccccaggtgccaggcgtggtctccggcaagctggcgcaccagccggtgtccggctggccctccctctgcggccacaccctggtgcactggtaccgcgcggccctggagcacctccaggtgggcgggggcgggtgggagacaatgaggctttcatcggaggggttcttgagatcggtctcgacctgcggatctttcggccggcacctgccaagattttagaaaccttctggggtattttgctgttccagaagcccgcagcctcgtccaactcaccgccggacccaccttgttcatccagaacaagcatacccctttggtcatcgctccctcacctcacaggcggagtgggacgcggcagtctgctcggcacaggcagaggagaagagggtgaagacaagtcctggacgtggagattgggaggacactattgcccaccaccggcggtgtgccaccctgtttgccagcctcatgtccctcgtcagggtccaggatcggcggccccaggtggggtggggcaggtgggggttgtaacttggtctcatcttgctgtgcatgcggcaggcttgcctgtatcgcccaggcgcaccttggtccaccctggaggggtagaaactaccagagtgaggacatggtgtgtcgcatcctccacaccagccctgccacaccccaacagactctcaatccagcgccttccattccctccccccatcccctgcagatcatggctctggctctgcgatggggtggcaagtttgtcgaggccttcctcaagatgcttcccttttggcggcacctcctccagaacggccatcagccagagttccacctcctggtgagattgaagtgtgtacagggctctgggccattcaaatctgggaccaaggaaggcactggtcctgtccaggaacctgatctcatctaatcaacctacacaaatcctcctgttccccacttcccccacaggtcaaggacatccagaagggcaccaggatactgcagatcctgtgcgccgagagcaagatccagaagaacctccccgtcacatctcaggccagtcatgcgcgaatggcattgatagggctttgtggtgacatcctctttgtagtgccatggacaaccgctgcgtatccgaccagaccatggtctcccacctccacactccactgcaggtgccggccatgaagcggacggtggagcgctttgtgttccgcatcaagctgctgctcgccgagacggatcaggccgacgccttctggctgggggcgctgaagcacaagaacctgcagggccaggaagcgtccagccaggtggattgcaggcctggcgtgccgttgctgagttgggttccagcgtggtgaccaggctggggtttccaaggaccaatggggaattagttttacgtgagggcctctggggatggtggatgtnnnnnnnnnngttgcaggcctggcgtgccgttgctgagctgggttccagcgcggtgaccaggctggggtttccaagcaccaatggggaattggttctacgtgagggcctctggggatggtggatgtgatggaagcattcgatctatggtcgatgctgatcacccaagcatcatcaccccgcaacagttgtacccagaggaggaggaggaggaagaccccccggaggaggaagaagcagaggaagagcctgctgcaggagtagagcccgctgagggagttgagggcgaggaaagcatggaccaggatgagtgaaagacagtcctgatgtgtctgctgcctcttgaatctcgatcccaacgagctgtacattcccattgcacactggcagcagcttgcatggctgatctgggcggccccagaccaacacgtgccaagtcagggggcgtccgcaacggactgcatgggccaggcacagggcatgtcggcacgtccaggtggcccctcctgtgaagaggcacgcttcacccaggcgaagctgtgactgcagtccttgctcaggcgtagtactgcagggacgtcttcttctttgcctgcacctctatgatggcgtcgttgaagtcctcatgcttgatctccgtggcgtcccgccgcagcgccagcatgcccgcctccacgcacaccgccttgagctgcgcggcgttgaagtcgtcggtggagcggcccagctcgtcgaagttgacgtccggggagacattcatcttgcgcgagtggatgcgcaggatcttggaccgtgcctcctcgttggggtgggggaactcgatcttgcggtccagccggcctgcaggcggtgtggggagggggtgagcgtcacatgccggacacagcggtaaatgcagcgctcagagacattgtgtgctcatgacctcgctcccgcacgatgcacaggctttgtgacccatgggctgaaggctgcatgccctcaaaccnnnnnnnnnncgtgtgctcatgacctcgctcccgcaagatgcacaggctttgtgaatcatgggctgaaggctgcatgccctcaaacccacgacccttgaaaactacacccagggctgcggtacacaaacatggcggccctcacctgatcgcatgagggcggggtccaggatgtctggccggttggtcgcggcgatgatcttgacgtcgtcctgggaggagaatccgtccagctggttgagcagctccagcatggtgcgctggacctccctgtccccagacagctccgaatcccgccgcgtcgtccctgggggttgcggggagggggcgtgggtcgaggaacgcagaggccatcacgggaaacggccggcgccctgccgcgccacctggtgggcgtgtcaagacgacactcagcacccaccaccccannnnnnnnnntggggagggggcgtgggttgaggaacgcagaggccatcatgggaaacggcaggtgccctgccgcgccacctggtgggcgcctcaagacgacactcagcacccaccaccccagggagacggacaccagcggcgcgcacctatcgcgtcaatctcgtcgatgaagatgatggcgggcgacttctcacgcgccagggcaaaggcgtcgcgcacgatcttggccccgtccccgatgaacatctggaccagggccggccccgcaagcttcaggaaggtggcgttggtctgcgccgcgcacgctcgcgcgatcagcgtcttacccgtgccaggagggccgtgcaggagcacgcccttgggcggcctgatgcccagcgacttgaagcggtccttgtgcgtgatgggcaggacaatggcctcccgcagctcctggatctgcgagtgttgagcggggagtgtgcaaggggaatgggatgccagtggacaacaccgagcgctacatccactcagggcaatgcagacaccagggaggaggagcctgcaagcggggcactggaggcgctgcctcaaacacacaaacacacacacgcacgcacgcacactccctctccccctctgactctccaacctgcttatccaggcccccgatgtcggtgtagtcctcgctgggcttctcatccacctccatggccttgaccctggagtcgtactccgccggcagcgtgtccaggatgaggtaggagtccttgttcacccccaccaggtccccgggcttgagggtggcagggtccaccagccccgccacgggcaggaacactgtctggcgtgtgctggtcttcagcaccacgcacttgcccttcttggaggcgtcctggtacgcattagcacctacgaatttgtgtatgtgcggtggtggtggcggcttgaaagaacgcatggaatgggagcgggcgccacacacacacacacagatccccagttccatccccgggcgcccagtgctcgccagggttaccctcctccgtgctcccacgcctcaccatcctcctcctcctcctcgtcagggtccacgtccaggacctcgacgatgttgcccaccaggtagggaagctggttgttcagcttgatcttctcgtgattgtccttgatgcgctcagccaggcctgccttgtcgtggttcagccggttgttctcctcccgcagcacccgcagctcggtctcgaggagccgcgttctgtgttggaaactgatctgaatcaatcacccggtatcgagcgcgcaagccacccgtccaggcgtccacgatccgcgctctcacctccgctgaatgtcgtctgcagacatggtcttgaactcctcgggcagaccatcgtcctgcgcctgttcctccccgaatatctcgtccaatgtggccatcacgtggccccttcaatggggtccctgttcaagaggccctcctgccgacgaaggatcgctgggagcgagagtgatcggcggggcaacgatgacgttcacagacgctctctgactctatatctatccaggggggtaattgcatgcgatataaagacactttgcgctggcgaggcgatccgcaaactctcattgagactaggctcacccagcggtggtactgcccccccccccccccccccnnnnnnnnnnnnnnnnnnnnnnnnnnnnnnnnnnnnnnnnnnnnnnntggctgacctctgcatcaaattgccctcaagtttctcacgaaacgccttccattgaagaatattagcctgaagaggtagtactagagctgtttatgatgagaaacgtattacaattggtttgagatcactcgctacagacaagaatgccacggctgctgtcaggatacaccatggaagcgcatcctggcgtctttgtttcccatcccccagcgtacatgatatgaagagattgggtgccatcacaattgtcccctaagcctgtcagggagcatcgctgccggtccagtctgtcaaactgaagtcatcattgagggcatcggggcttgtccaatcaagtctcagcgtatgaaactgtttcatacagccatagatcttgcttgtgacctgcgtgagtaccccacctttgtgga

SEQ ID NO: 46047 - DNA, 61 bp, Chlorella protothecoides
cactgatcccaagcaagggaccagcgttccgtgctgctaacgaccagcgcagaattgcagc

SEQ ID NO: 46048 - DNA, 61 bp, Chlorella protothecoides
cccaatatcctgctgctgtgtaccccttcctcctgccacattattgggggtgggggttggg

SEQ ID NO: 46049 - DNA, 76 bp, Chlorella protothecoides
ctcgccctgcgggatgcattcgagccgcgctccgacctcctcggcggggccactgacggtccatgcaggcgttgta

SEQ ID NO: 46050 - DNA, 75 bp, Chlorella protothecoides
caggtgcgccacggtgaggatgtggccacgctgcgagaccagcatgccgctggcccagcctcccctggccttcac

SEQ ID NO: 46051 - DNA, 374 bp, Chlorella protothecoides
  modified_base (93)..(321): a, c, t, g, unknown or other
gcataccctgcccaacttggaacagctggatgattccgtactgcggggtacgtgatgaggggccctgatgtagaataggggagctccaggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttgcacctcgcgagaagctctcgtggttgtgcctcggaacccttttgtga

SEQ ID NO: 46052 - DNA, 61 bp, Chlorella protothecoides
accaccaccaccctgcacacccgccgcaggtgccgcaagaagcgtatccaaggccccggcg

SEQ ID NO: 46053 - DNA, 3023 bp, Chlorella protothecoides
  modified_base (639)..(648): a, c, t, g, unknown or other
  modified_base (1249)..(1258): a, c, t, g, unknown or other
  modified_base (1559)..(1587): a, c, t, g, unknown or other
  modified_base (1900)..(1909): a, c, t, g, unknown or other
  modified_base (2164)..(2173): a, c, t, g, unknown or other
  modified_base (2502)..(2511): a, c, t, g, unknown or other
ggggggggcaggaggggccgggaccccaccgatacagactttcacactcaaaatgggaagtacagggggctgtctgatcctgagcactcaacaggggtgactggcatttgcgcctctgatatggagaaaaggggactgggtgcttgggggatccattttcggcaggctatccctacaaagccttcaggccgtgcgaagggaggacaaataccagagaggaatggaaaatcttcatgtgggagttggggaaatgatggaagatagagagtcaaaaggtcagacctctcgggaaggtgccgccatgggatgtcacggcactccccggtgggtctgaagcaaggcgcctctgtctgtggagctaagcactgttctcgctgggagcattgtgcagatccctgtttccgccaagcacggtcgtggactctgcagccaatggaaacacagagaatgggtgagacacattctcgtcgatttgtgtggagaaggccaaaccatgcttgactgtgcaatggagaaggccaactgtcattgcctgtacaatatgtagctggtcctgaatcatatctctgaacttacccttggtagagtgggcgaagctggagttggcgttgttggaagtggaggagctcttcggcgccnnnnnnnnnnctacccttagtagaatgggcgaagctggagttggttttgttggaagtggaggagctcttcggcgcctgacgcaagctgttagggaagtgggaaaggagagcatcagtctcgagaattgcgaggcgagggcttctcttcgacaacctggtggcccaagggggtcttacatcgcagcccctgccgcaatttcctcaaacttcatccatcacacaacgtcgatgcagcagatatgaggggagctgctcgaagatgcgtcaaacaggaaacccccactcggcatactcccaacctaccgtcggaacagatccctggcgttctcgctggcagtgcgcgcatccgctggcacatatgctgccttgggcccctttgcagggttgtatttgatggtgctggcggcaccctcggaggctgaagcgaaggccctgccaacggccccgacagcgaccgtcagctgcttcatcgccagtgcttgctgcatggttacgatattggtcaaagtgtgcaagaagtgcaatgcaataatatttggtggcgatgccgcttccgaacgattgatttataccttccaaagacccacgcgctcccggacgcttcctcgacnnnnnnnnnnttttggtggcaatgccacttccgaacgattgatttataccttcccatccaatgacccacgcgctcccggacgcttcctcgacccaggtcctgtggccgcggctcctctcccatcgtgagccacgtcgaagtggggggaccgacccccggaagcagacctcgcaactacctcgtgcttgatacccctatagatacaggatcagatgccggaatcgggttcttctagaatatgatccaccatccgtggctcataaccgcggtctgctacgaggggggggccaggcagtgccccagggtcgtgnnnnnnnnnnnnnnnnnnnnnnnnnnnnngctggcgggggcggagggcggcgcgggcgtgccgccccccaggccgacctgaggtggtgtgtgtgtgtgttaggagggagggacgtgtgccgccgccccgggatcgcgagggggcaaggggcacggcgcggtgtggtcgtaccggcagcaggggaccccggacggcggtgctgcactgccagcaggcattctggctgtgtccctcatcagatacaccgaccgagatccccctccggtcagggcttcaccacctttccccaacggatgctgcgcctcggcggggagggccgatgccacagcagctggaccccgnnnnnnnnnntgctgtgtccatggtggtgaggaggtgtatggcatcatgcaacctgggtggttggcgcacacaccggcaaatgtggcagtgtccatgcatagctgcggccaatcacagcgcgaagcacggttggctgcgccgtgcctcgctgcgatactcctctcccgccacctcggggtccagctgctgtggcatcggccctcaccgtcaaggcgcaggagccgtcgggaaagggtggtgaagccctgaccggagggggatctnnnnnnnnnnagaggcacggcgcagcctaccgtgcttcgcgctgtgattggccacggtgtgtgcgccaaccgcccaggttgcatgatgccatacacccgcgcaccaccatggacactgcatacaactcaaccgacgttatttttacatgccgtgaaggccaaggaatcacagatctcacccacaagcaaggctggtgcgggcaggcacgctaggccacgaccctggggcactgcctggccccccctcgtagcagaccgcgtttatgagccacggatggtggatcatattctggaagaatccgattcctgcatctgatcctgtatctataggggtatcannnnnnnnnngcgtccctcccacaccacacacacacaccgcctcaggccggcctgaggggcggcgcgcccgcgccgccctccgcccccgccagtccgaagctggggaggaagaggaggccgttgcggcgcgcgtagcgtcccaccaatgcggtgagcagggcgcccgccccggcgccgagcgccacgatgccccagagggagtagggctgcagcggctccaggcccgaggtcaggttcatgccgaaaatggaggtgagggccatgtggcactcgaaggccatgagcaggaggtcgatggccaggcccagcgacaccagctggttgcgccgcgcgtccaggtccagattgaccaggtgctccgtggcggcgatgcgctcctgcagcagggccaggcgggagagcagggcgtccacttgcagccagtaggcctccaccagatcctcgcactcctccatctcccccgggtcgggcgcctcgctcggtggcgccgccggcggcgcgggccaggccccgccgccgcc

SEQ ID NO: 46054 - DNA, 163 bp, Chlorella protothecoides
gggatcagacagaccatacatgttctctgcttctgaggtgaaatttaaggctagaccagaatgtgccctgtgggtattgagcagacagacaggggcgcaatttggaatgtggagtagctgcgtgactcatctaggacttgacataacagaccagtgttggccc

SEQ ID NO: 46055 - DNA, 82 bp, Chlorella protothecoides
ttcgaggtgaccgccccagcgcctggcaaacagtcggtatgctgtgctctcttgcacccacagcccatccatattgaggagc

SEQ ID NO: 46056 - DNA, 61 bp, Chlorella protothecoides
ggatctggactgggtggggcctggcgagggatgcgaggtgctatgggcatctgcgcgcaca

SEQ ID NO: 46057 - DNA, 103 bp, Chlorella protothecoides
ttcttgatgttggaactcagtggactcgacgactcccagcaagaatatgccagcatcaatccatgttccctaatccacacatctgcagcctttccacagctgt

SEQ ID NO: 46058 - DNA, 78 bp, Chlorella protothecoides
cccgggaaatcacgaatgtcgatgcgggagcatcgtcatagagtgcagctcgggctgggactcgagacctaacgatgc

SEQ ID NO: 46059 - DNA, 96 bp, Chlorella protothecoides
cctgagcggcgggtctgcatgtcttgtgccgtcgactgcctgttctacctcgggcgtggcctggcctgtggtctgccgagggggaacatctcaaca

SEQ ID NO: 46060 - DNA, 61 bp, Chlorella protothecoides
gcgtgggatgacttgcaccgatcaagccactcgtccgaggctcgctgggtgcacgcgcggc

SEQ ID NO: 46061 - DNA, 71 bp, Chlorella protothecoides
gacgagatcgtgcagcccggcaggtgatggggcatggggaactgcaggtgaggccgccatccccccgcctc

SEQ ID NO: 46062 - DNA, 168 bp, Chlorella protothecoides
ggaggctgacgccctgcgatgcattcaattgagattacaggtcatgcgtgcacccagaatcgaaaagggttgttagacaatactcagtgttgcatgaacatgggaacagcgaaagcttgctccccatctcttccaatctgtcttgcaatcattccaaccctcctgccc

SEQ ID NO: 46063 - DNA, 79 bp, Chlorella protothecoides
gagcaaaaacccttgcctgccccgctctcaagttctttcccccacaccaagacattccaagatacccttgctggctcag

SEQ ID NO: 46064 - DNA, 76 bp, Chlorella protothecoides
gtacagcgccggcaagctgaagatcatcctggatttgcccgagcacgtgggcatcgaggctgtgcccgctgccgtc

SEQ ID NO: 46065 - DNA, 61 bp, Chlorella protothecoides
catttaccccgcccacccacggcgcagatgtctgacgctcatttggcgacctcgcgaggca

SEQ ID NO: 46066 - DNA, 63 bp, Chlorella protothecoides
cctacctgcacaggtgctgggaagcaggaatcgttggatttgtgtgattgagtcagggggggg

SEQ ID NO: 46067 - DNA, 76 bp, Chlorella protothecoides
cgcgctcacccgacccctcctccacagaactaaaccccctcggaaacccccccaccagagcagtgggcgaggatgg

SEQ ID NO: 46068 - DNA, 61 bp, Chlorella protothecoides
tgtgtgtgtgtgtgaggcggtggggggggttgtcgcacatgtgtgtgaaaggagggtccta

SEQ ID NO: 46069 - DNA, 72 bp, Chlorella protothecoides
gtggtcggacacgcctgggtagaatggggagaaccaataagacagggggctcctccagggtccggcacgccg

SEQ ID NO: 46070 - DNA, 73 bp, Chlorella protothecoides
ggcaaagacgcgggcaaagaagaggatcttggggggggggggggagggggcttgcttgcacgcatccaggaat

SEQ ID NO: 46071 - DNA, 71 bp, Chlorella protothecoides
cctgccccgcctgcaccggcagttgaccctatggcggcaggagccccgccgccgccgccgccgccgcccag

SEQ ID NO: 46072 - DNA, 61 bp, Chlorella protothecoides
agtccctcatcttccaccacaccattccgtactccagccacgacaatgacaccctgcagtg

SEQ ID NO: 46073 - DNA, 201 bp, Chlorella protothecoides
ataggcacccatgtcccagcccacccctgcagaaattaccagcatatttggccctgcccacatctgatgtatatatttggcctcagctgcacgtcacagtgcattacatggaagaacgcactgcctgtagggcaaggggcatctggagaggtatgcaagcactaaatagttccttgagcctactgctacacgatacccggc

SEQ ID NO: 46074 - DNA, 61 bp, Chlorella protothecoides
caagagtgagacactggccatgacttcatcacccgcctcaagcctgtgcgtccgagctgtc

SEQ ID NO: 46075 - DNA, 61 bp, Chlorella protothecoides
cagagaggggccggggctcaggctgtcccgtagctgctgaaagtaggcgcctcggtctctc

SEQ ID NO: 46076 - DNA, 61 bp, Chlorella protothecoides
gcctgcagagcgcgcagcgcactcatcgccatggcagtaggcccacgcgcagcaagctctg

SEQ ID NO: 46077 - DNA, 61 bp, Chlorella protothecoides
agaagctggaagacgaggactggcaggaggggtatgcagaggattatacgtcgcccatgcc

SEQ ID NO: 46078 - DNA, 74 bp, Chlorella protothecoides
agcgcagcatgatgcgccatggagcagagaccccacgcgtaacagctgcaggccctgcagactggaaagtgcaa

SEQ ID NO: 46079 - DNA, 61 bp, Chlorella protothecoides
ccagacaaaggcggcgtgcgtgtcggtcacgccccccgtgttcacgtccagcccgatgcgc

SEQ ID NO: 46080 - DNA, 11059 bp, Chlorella protothecoides
  modified_base (1736)..(1745): a, c, t, g, unknown or other
  modified_base (2488)..(2497): a, c, t, g, unknown or other
  modified_base (2589)..(2787): a, c, t, g, unknown or other
  modified_base (3379)..(3388): a, c, t, g, unknown or other
  modified_base (5147)..(5156): a, c, t, g, unknown or other
  modified_base (5634)..(5643): a, c, t, g, unknown or other
  modified_base (6120)..(6129): a, c, t, g, unknown or other
  modified_base (6199)..(6208): a, c, t, g, unknown or other
  modified_base (6279)..(6288): a, c, t, g, unknown or other
  modified_base (6490)..(6502): a, c, t, g, unknown or other
  modified_base (8818)..(8827): a, c, t, g, unknown or other
  modified_base (9324)..(9333): a, c, t, g, unknown or other
  modified_base (9897)..(9906): a, c, t, g, unknown or other
  modified_base (10525)..(10534): a, c, t, g, unknown or other
  modified_base (10930)..(10939): a, c, t, g, unknown or other
ggcgcggcggccgcgggcgcggccgccgccaccgccgagctggccgagctgcgcgagctgcgcgccgacgtggagcgccgcgagcgccagcaggccgaggtggtggccagccaggccaagcgcctggaggagctggaccggctgtaccgcgaggagagcctggcgcgcaagaaggcgcacaacgcgctggaggacgccaagggcaagatccgggtgtactgtcgcgtgcgcccgctgctgcccttcgagcgcgagcgcgggcaggagatggctgtgcagctccccgacgagctcaccatctcgctgacctacctggagaagaagcgggagtacgccttcgacgccgtgttcccgggggggacgccccaggagcgcgtgtttgaagacacacgccacctcatccagtccgcggtggacgggtacaacgtctgcatcttcgcctacggccagacagggtcggggaagaccttcaccatctacggcaacgaggagctgccagggctgaccccgcgcggcgtcaccgagctcttcgacatcatcgaccgcgacgcgggcaagttctccttccgcgtcgaggtctccctcctcgagctctactgcgacgacctccaggacctgctggccgagaacaaggccggcgagaagcgggtgggtgggttgtgggtatgaggtttttttttttgggtgtgtgtgtgtgtgaggggacctggtggtggcgaggaggcatggccgggagatgagcgggaccactccacccttgcacttcccatgcatcacttcccgggaacccggcccccccacctcctctcaccccccttccccaattcaaatcccccaacagttcaagcagcccaagctggacatcaagaaggaccccaagggcgtggtgacggtgcccggggccacgattgtggaggccacctccgcgcgcggcctgctggccacgatcgaggcgggactggcgaggcgccacgtcagcagcacggccatgaaccgggagtcgtcgcggtcgcacctcatcatcaccatcggcgtggaggccaccaacctgcagacgcagtccgtgtcgcgcggcaagctgtcctttgtggacctggccggcagcgagcgcgtgaagaagtccaagtcggagggcgcgcagctgaaggaggcccaggccatcaacaagtcgctgtcggcgctgggcaacgtcatcgccgcgctggccaccgagcaggggcacgtaccctatcgcgaccacaagctgaccatgctcatgtccgactccatcggcgggaccgccaagacgctcatgttcgtcaacgtgtcgcccgtggacgccaacctggacgagaccaacaactcgctgcagtacgccacgcgcgtgtccaccatccgcaacgaggtgggcaagaacgaggccaacaaggacgtgctgcgcctgcagcgccaggtcgcgcactggaaggagcaggcggggctggcgccccacctccgggactacgtggacctggtggagatcaaggatgccgtccagaacggggaggagtgaggaggggacaggcgtgtgtggagggctgggatgagagagtcgcgcacagggggggggaggagggcagtcgcttctgcggcccaggtccgcgccccgtgccaggggcccccgcgcctggcagcccctcccacccctgtgttgggtcccagcccccttgccttcccccccccgtatcccccaactcctccagatcctacagccctgnnnnnnnnnncggaggactggggcgagagagacgcgcacaggtgggggcggaggagggcagtcgcttctgcggcccaggcccgcgccccgtgccaggggcccccgcgcctggcagcccctcccacccccgtgttgggtcccagccccttgcctttccccccgaccccccccaactcctccagatcctacagccctgcgccgtgggcatgcctgattcgtgatgcgagagacccttaatgccctgaacccccaccctgcatgtgtgcaccacacctgtaatgataccgcttttcaatcttcctgggggtggaggtcaggccgcaggccctgccggttgttgcccaggggagacatcccacctcctgatctctcgcgccctgatgacggccatgtcacgcgggtcaggcgggacagcacggcgagatagctccacccgggcacgaggctgggacggggaggagtcggtgcgcccttatttatgcgggaaaaggaggggggcaagtgtttgcggacctgcagagggcaagagctggggaaggcaggctccaccggtcccggaaagggtcacagagagatgtcccccgatcccagccttcatggctcagagggcgaggcgccatacatccacagcgtgggaaatggtctgaggtccgtggggatgcgtggagagaggactctgccgctggcgtgcgcgcactcggaggccgagcaccggagtgcctgacccatcccaacaatcccattcccaggatnnnnnnnnnntccgggcacgaggctgggacggggaagagtcggtgcgcccttatttatgagggaaaaggagggggggcaagtgtttgcggacctgcagaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcggaggccgagcaccgtagggccagacccatcccaacaatcccattcccaggatcgatcgatccaggctgcacagcgtgctccgggagctcttcatgcaccgattcaggagtctgagtcgcgtgcatgtggatgatacgggggtggtgctcctgcaggtataaggctgcgctggcagggtggcttaattcatggacagacccggttgaaccctccaacgctctctgcctcgccgtgccatgtgcccagcaacacttgtgtgtgtcttgcagggaggtacagtgaagcacatgtacagcaccgacaccgagcacctgttcaggtgggtgcaccaggttgggagcgggcgctggcctgtactgcttgcctgatctgcccccggcatggggcaggcgccagggtgggtggacatgcatcgtgctcatgagacccctgcagcagactctccgcctcatccaaagtgctgaaccccccccccccatcccccccttgcccaaccgagcaggcaggagccctacttccattacctgtttggagtggatgagccgggttgctatggtgcccacgacatccgcacctgccaggccttcnnnnnnnnnntttccactacctgttcggggttgatgagccgggttgctatggcgcccacgacatccgcacctgccaggccttcctcttcgtccctcgacccagcccagaccaggaggtctggatgggcccggtccgaaacctgacctactacctccaaaagtatggcgtagacgaagtgcactatgtggacgagatggcgatggtgctgaagcagatggcgccgccggcgctgcacatgctgcacggccgtgactcggacaggtgttggggtggggttttttgttgcttgggggggcgctgggtggtctctgtgagggggatatcacctgcgcggtcctgctgtgtggccttgggagtgtgcgccctctcgacagtgaaggagggataagcatgctgagccacatctggaggcctgcccttgtgcagaggaagacccttgcacgccgctgtcctgccctgcccttccaccaccacgccaccaaccaccccccttctgccacaatattcccagcggccggggcatgccgctcgcccacttccacggcatcagcgacttccagctggagaggagcggcctcttcgttgcgctgaccgagatgcgcgtcttcaagctggacatggaggtggagatcatgcgctactgcgcacgcgtggctgcaagtgcccacatcagggtcatgcaagcggtcaggtatgtgggtttcttttgtgtgtgtgtgtgcgggggtagctggaagggtaatcgtgaaagttgggagctttgaagggcgattgcatggcatgcgctcgctctcaaaggggagctggatactgtccggctggccgctgctcttgtggccccaccttgcctcggtgtaggagagtgcgacttccctgcatccccgcaccccactacttcccccttccgaaatccaaacaccccaggcccggcatgtacgagtaccagctggagtcccttttcctgcacgacatctacagcgagggcgggtgccgcttctcgccctacacccccatcttcgggtcgggccccaacagcgcggtcctgcactacggccactccggcgcgccccacgaccgccgcatcgcggacggcgacctggtgctggccgacgccggcgccgagtactaccgctatggctccgacctcacggtcaccttccccgccaacgggcggttctcccctcgccagcgggtggtgtatgaagcggtgctggatgcgcggcgcgcggtgctggcggccatgcgccccgaggtctgctggaccgacctgcacctggtggcggaggagcggatcctggcggcgctgacgcgcgcgggcctgctggtgggcgacccagcggagcaggtcgcggcgcgcctgggcgcactcttcatgccccatggtctgggccacttcctgggcaagcagacgcacgatgtcggcgggtacgtggccggccgcttccgcgagcgccctacgcagccggggctggaccgcctgcgcaccgcgcgcatcctggagccgcacatggtgctgaccgtggagccagggtgctacttcatcccggccctgctggagccggcgctggagggggggcccctgcaccgcttcctggtgccggaggagatccggtgctacatggtgggcggggggggcaggatttgggtggctgctggtcgatgagagggagggggtgcagggagcggcgggaaggtgagatatccagggaggagggcatcgctcgagagacggggacaggctccctgcacctcctcccgcccaggctcnnnnnnnnnnggaggtgagatatccagggaggagggcattgctcgagagacggggatgggctccctgcacctcctcccgcccaggctccagccgtccacacaccagccaccgtcatgcccctcccccccacacgcagggcatggggggggtgagactcgaggacgacgtgctggtgaccaatgagggatgcgaggtgctggcctccctcccgcgcgccgtcgaggaggtggaggcggtcatggcgggcgcggactggatggtagtatgagcgccggccgcgaacagatcggacggcagtatgagcgccggccgcaaacagatttgacggtagtaggagcgctggccgcaagcgcctcccccacccaacccccaaaccccaacgaaagatttttccttggcggggtaggtcctgccagcatggctgggggcctcatctgctcgtgccatttttcgttggttctaaagttctaaacaatatgcctgggcnnnnnnnnnncccccccaccccccaacaaaagatttttccttggctgggcaggtcctgccagcaaggctgggggactcatctgctcgtgccatttttcatttgttctaaagttctaaacaatatgcctgggcacacggcagcctcccctcggcaagcggccaccgctggtcgctccgcctctgcgagagcggcgtcgtctgcacagaaagcgtgccgcaggcgcgctgcaaccctttccagccccgagctgctcttccacccctgagcggtgggcggtgggcggtggaccctcccggggctacatgccccgatctacctgggctcccgccctgcccgcccctcccaggactttctcttttcgcgccggcccccgcgtcacctgcttctctcccctctcgcccagccacatgcagccgactgcctgtggctgggcctgccctgccgccacccctcacgtggttctctccgccactgcaaactgctacnnnnnnnnnnaccgtggagctagtgacgctgctccccttttcccttgttggcaatatgccaccaagcctccgccatgaannnnnnnnnngccgtggagcgagtgacgctgctccccttttccccttgtcggcaatatgccaccaagcctccgccatgaannnnnnnnnnaagatgcagccgactgcctgtggctgagcctgccctgccgccacccctcaggtggttctctccgccactgcaaactgctacttgccccctaattcgtgccgcccttcacctctcccttgtcctctccttcctgctctagcaatgcgataccccaggctggggcccctcattttttcacgacatacggagttcctcggacacnnnnnnnnnnnnngctcgcgatgcagccacggcgcaaggctcaggacatgctgtaagcgccgggatggcaagaaagaatctggggccatgctggcgtaggctggcaagatgcactgaggaggtcaagggtggagagccctggcgctccatgcatgattgggaagggtgggttctgtggcaagtgacattcaacgctgcacagcaacatatcagcagggcctggctggtgtcgaagaacccatctcgtacaagcagaggcatctccatctgtcccaccgccacgtcaagccgttgggcgccccaccagcctcgctcccgttgcgaggaaggccaggcagccccgctccaggcccaccgtcagcacacagaagagggcggtgaaggccagagcgcccagggagcgcagcatggtggagcggagggtgggtctgtgcactcgcgccagcaggcccacggtgtcagtcaggtagcggacacatgccaggaccaggtcgacggccctggcggggggtggcggaaggaggtgggatgcaggatggggcccaggcggcagcggatcgctccctctgtcctgtgagtgcaagagtaagccaagggcagcctgcgccagcttggacaaaatacacatgccatcgaggtggctacctgtctcccaggcctggctgagggtcaaaggactggtccacactgtggaggttgccatcagcagcagaagccccttttatcaaaagcggtagacttgtacctggcgctctatacgccaagctagctccgcgcagcttccagaggctctttggagcagtcagcgagcgtgctgtccgcagaccactgcgtaatgggtagcgactgctacttgactggcagctcggaggggtggcaggtgcccgagagacacgagatgcacccgatggcaaggggactggcattgagcgaaggtatatcgagacccatccccgagtatgattaaaggagtgcaggcagacgaagcattagggtagccttgtgtcaaagcatcggctcatgttccgcgcgcgctctgctccggagagaaaaattcccatccctttgactacccaagcgcacacagacccatccgtgggaaactgtacatcgagcatttcccattttcagtctggtatttcgtcgagaagccccggcggatgcgcctgtcccaggcgtaccgtgcctcctgcctggccccgaagccatacccagctccgaaaccccgactgctgcacacggctgcctggattcgtgccgctgcagtgcgccctgatactctggatccggaggttgatgaggtgatcaaggccatccatgccacacccaccaggcttgccctcaccgtgacggggggcggggtgcaggtgggtcctgcttggcgaggaagggcgttcgcttgcacctcaacctcacagcaacccccagcttttaccctcaccattccacatgcccacaccgacacaggcaatttcgtggctgctgggggtcccaggtgcctcccggacagtcctggatgtgcaggtgccatactcccccaccgccctgaagtccctgctgggcggccaggccttcgcctctgcctccagcccggacagcgtcgccgccctgtcccaggcggcattccagagggcagccagcctgacggccctcggcacacccgtggcagggttggcgtgcagcgccgccctcggcaccgaccgcgtgaggcgcggggaggaccgggtgcgtcggttgggtttgggggggagctcctgcccagagcgtgccggggcgcgcgatccgatgcccgcatgcccagcctccccgtccacgctgccgccaggtgtacatcgccgcgcatggcaccggcggccgcgccagcttcagcctggttctggacaaggccgcgccccgcccacgctgggctcaggatgcggtggcctcccgcctgctcatccacgccgcggctctttcctgcggcctgcccgtccccgagggcgacctggcgcggcgctggctccggctggaaccgggggatgtgctcgagagcgggcggccgcagccgcccccgaccctgcggcaggcacttcagagcctgggccgcggtgaaatcacatctgtagaggcgggtctgggaccggtcactgccggggctccgagggggggcaggctgtaccttcctggcagcttcaatccgctgcatgcggggcacacggccatgctccaggtggggtgcgatacttataatgaagcagaggagtgtgtgtgcaagtgggctgggtggggagaggccatctcttgcagttcctcagagggatctgccagcgatggtaaggttgcaccggcnnnnnnnnnngcaggtggggtgcgatacctataatgaagcagaggagtgtgtgtgcaaaagtgggctgggtggggagaggccatctctggcagtttcccagaggaatctgccagcgatggtaaggttgcaccggcaatgataggcagctcccacccacccccgctcccttcgtcatcaggcggcgcagagcctctgccctgagctggaggggtgctacgagctgtcgacggggaacgccgacaagggcctcctgctcgtggaggaggtggaacgccgcgtgaggcactttgaggaggcacgcctgccagtggtcctgacccaggtcggcttggtggcttgcgggggcagcttgccgcggggattagggggtaggcaggggctgcatgcagcaggggtcttgtgggcaccattcctaccgtatgctgatcctcgcatcatgccccaaaatatgtatgtttgtcccccattctccgtacctgccccaggcgcccctctacgcccaaaannnnnnnnnncccaaaagtatgtttgtcccccattctccgtccctgccccaggcgcccctctacgcccaaaaggcccggctcttccccggcagcgtctttgtcatcggctacgacactgcaatccgtctgctggaccccaagtattatggctctcgcgaggacatgctgctccaggtgcgaagggtagggaccggtggcgcacgatcctctggcgtcgtcaccactcccagctagaggtagtgtgcactcacatctccaacgcagctcgaccgcctgggcaccagcggctgctcgttcctcgtggcaggccggctggacacccagacccagcagttcatgcggccggaggacctggccgtcccgtcccagctcaaggtgtggcgtcggtggtgggaccgcccgcctgggcatgaggctggcgtggaccggcatgcatgccctgggacagaggactggggacccagcagcaagagtggcgtgggcgtggatgatgggcggctcgaggcacagcgtcctggtccagacgctgccgtcacgaccgcgcatgccagccacccttcccacccacccaannnnnnnnnntgtcctggtccagacgctgtcgtcatgaccgagcatgccagccacccttcccacccacccaagcgccctttcctcaccctcccatgccacccacagcccctcttccgaagcataccagagagcctgttccgtgcagacatctcctccacccaacttcgagcccagggggcatgctaatatcatcgttcgtacagggaagatgttactcggccgacgccccaaaggcgcagtgctaggaccagggcgtcgctcaaagaattatgggggcacagaaagaatagcaagggtgtcgggtagagtgcccacgtatgtgcagatacagctgcccgttcctcttggaagggggtggaattgccatgtggatgaccgtgcaaggacgcggcaggaccggggcacgagctcgtcggtctgaaaacagtgcgtatgtgctgtcccagagactccgggggcgggtgggagcatgcggggtggagagggtcagctgtgtatcgtgcgacgccatgccatgcaggggtccgtgagcgtgaaacccgagggtggcagagccgactgtaaaaaaagggtgggctccgggtgcatagctgtaagccctcggccactggccccttgggaggggtcnnnnnnnnnnggcatgcggggtggagagggtcagcgctgtatcgtgcgacgccgtgccatgcaggggtccgtgagcgtggaacccgagggtggcagagccgactgtataaaaaagggtgggctctgggcgcatagctgcaacccctcggccactggccccttgggaggggtcctgtctcctgacgggcaaggggaggggaaaggcgtcgccttccccacgctcatctgccagcgctcaggccggccggctgcccccgctgaagttgagaagcaggttggcggcctgcgtgtcgcgctcgctcgtcccgcgccgcagcgactcccccgccgcctcctcgcgccgctcgcccgtggcctcgtgcaacgcggcgccggcctcctgcgctgcctcggcggtggagccgcnnnnnnnnnncgacgggcaaggggagggggaaaggcgtcgccttccccacgctcgtcagccggcgctcaggccggccggctacccccgctgaagttgaggagcaggttggcggcctgcgtgtcgcgctcg

SEQ ID NO: 46081 - DNA, 72 bp, Chlorella protothecoides
ccaccaggaaccctctattcctgattggcctcgtgctactggtgaccagatgtgcctttgcggtgagttgga

SEQ ID NO: 46082 - DNA, 75 bp, Chlorella protothecoides
taccttgctccagtactgggtcttcagatctcccacacgatagaagtaggtggtgttggggcggaggtcctcggc

SEQ ID NO: 46083 - DNA, 70 bp, Chlorella protothecoides
gcacacgctgagcatagttcagctgacaggaattcgggaacaccaccacccgcacatgacttgcggcacc

SEQ ID NO: 46084 - DNA, 61 bp, Chlorella protothecoides
ctgcaggacgagacgcctgcgacggccgggtgagggtcgtgggcggtgcatgccgatgttg

SEQ ID NO: 46085 - DNA, 4931 bp, Chlorella protothecoides
  modified_base (1764)..(1773): a, c, t, g, unknown or other
  modified_base (2230)..(2239): a, c, t, g, unknown or other
  modified_base (2655)..(2664): a, c, t, g, unknown or other
  modified_base (2877)..(2886): a, c, t, g, unknown or other
  modified_base (3188)..(3197): a, c, t, g, unknown or other
  modified_base (3332)..(3341): a, c, t, g, unknown or other
  modified_base (4760)..(4769): a, c, t, g, unknown or other
  modified_base (4832)..(4841): a, c, t, g, unknown or other
ttgacagtgcagatgccatttgcaagtgagtcaccaaggatgagtgtgtgttacagagcatctgcttgcacatcagtggaccgacccaagaaacattagcagggcatttcatttgacgtagaccaaggtatgcacacctgagcctatgcgcgtccactacccactgcaagcaggcatgaaggcttcagcaaggcgggtccatccgcacctccacccttgatgccatggggctgtccatgccagccatccgtgtgcgcaacttggagatcctgaagtctggcgccacgaagatcctggtggccgtggagtgcctgaagccgggccagaaggcgtggcggcagacagcaatggcaacattggctccggcaacaagggcaagaacaaccttggcacgaagaatgttgggaatggtattatcgggtgagctctgaatggagtcttgatggcatgcaagatgtgcacagcccctgcaaccgtcgggtgaaacagactcattgatatgacggtgctccctttgcaggcaactccaatgtgggcactgccaactgggggaacaataacgatggtgcaggcaatcgctgctttgacaaggcaggaaatcacaaggtcctcaatgactgcagcctgctcgaattccggaagcatgcatgggtacttgtcttcccgctgccgcccaccaggtaatcgccacctccacccgccaagaggtcaccacccccacctgccaagagatcaccacccccacctgccaagaagcctccgccaccacccacccggaagtcgccaccgcctcctgccaagaggtctcctcccccacccgccaaggtgttaccgcccccacccgccaagatgccaccgcccccacctgccaagaggttaccaccccctcctgccaaatcatctccgccgtccccagtcaaaatatatccgccggcaaccctagattcacctccccacacacccgtgatatctccacccccacacaccaaaaacatccccaaccccctccctcaagatttagccctcctccgtcaccacctttacctccacccagtcctcctccatcaccaccaccacctccggcccccccccctctatcaccacctccacctcgtcctccatcacgacctccaccatctccacccagccccttccctccccctaaacccccaccttcacccagcccaccaccttcaccgcctctaccacccccctctcccccaaccccaccaccagggcaactgccacagttgagttcagtgctccaaaggatggtcgggtggacattacctttatcgctaccacagtggggtatacctcctcttatgtgagaccccgcgtctactcgtccaacctctcccttcttgccggaggtatcatcaacagtcctacttctactgtcacctctgctacccttcttggcgagaaactggatatagcagcagcatattcctttggtacagcagtgatctttccaggtgacagtattataaaagaagctgtactgctgagtttgctgaattccgcgccccctcctgttggaccagccccgcctcccccactctatgggtccatcgctggaagtatcacccaggacggaaacgatttctcactctccttgaatttggggcctaccaaccagacggcgtaatctatgccttctacactgcagctggcggcctgatcggcattggctctgaggacaacagtagcactcccatgacttggacaagaacgctgctcgaaagccagacagctctcgcnnnnnnnnnncctatgggtccatcgctggaagtatcactcaggacggaaacgatttctcattctccttgaatttcggggcctaccaaccagacggcgtaaactatgccttcttcactgcagctggcggcctgatcggcgttggctctgaggactacagtagcactcccatgacttggacaacaacgctgctcgaaagccagacagctctcgccacctacgctcaggttgtggcgtacaagaccgggagcgggaccgcaaatgccctgaccctgacctgatagtgtcattgggtcgctggaccacacctgggttgctcatcctggccccgcatattgtgatcctacggcatcacgacacttgaaatgtgtgagcgtcagattgcgccaagcgatgcaaaagagtggttatgcagttggaagacagagccttgtaaccatgctcctccttgttggtccaatgcattcgnnnnnnnnnncgtgtcattggatcgctggaccacacctgggttgctcatgctggccccgcacactgtgatcctacggcgtcacgacacatgaaatgtgtgagcgtcagattgcgccaagcgatgcaaagagtggttattcagctggtagacagagccttgtaactatgctcctccttgttggtccaatgcattcgctcatgtagtgatgcctgggcacggagccagctgtgcctgcatgtcaccccagctcctgagccaggtctgtcaggcactcctgatcaaagacgcaaacatctaggtggtgaacgatgaagttggtcacgctctgtactctgtgcaaggcaatgagcaatccgggggcgtagagaaatcatggcgatggatgttacgaccctgccttgaaaattcattctttcttagtccannnnnnnnnnagtagagaaatcatggcgatgtatgatatgaccttgccttgaaaattcattctttcttagtccaccgggacctgaaaactgagcgatggaccttttcgagacatggcgcagagaagcgtagctgcactgaacccaccgttcggaaagcacctatttgtacatgataagaattcttcagatcctatgcgcccaagtagtggatcgcaggtttannnnnnnnnnaggacctggagaatgagcgatggacctttttgagacatggcgcagagaagcgtagctgcactggacccaccgttcggaaagcacctatttgtagatgataagaatttttcagatcttatgcgcccaagtagtggatcgcaggtttaggtaggccgggtgggcccggtgggactggacagccaagctcatggcgatggtctccccgatgtcatcatcgctcctccaactgaatggcatcgatcttatcaatgtaaaatccgcggttctaattgctgatacaatctgcacatgcagcgggtgcnnnnnnnnnntcccctccccctctgcgacctgccgcccggggtgggcgatgcagagggttttgcatggcctccgcccacgccacagtattcagcatggcgtggacccttccccgcagggcggtcctgttctacgagtcgctgccnnnnnnnnnngcatcatcgctcctccaactgaattgcatcgatcttatcaatgtgaactccgcggttcaaatcgctgatacaatctgcacatgcagcgggtgccctgcccccaacacccgaaccagcatggggctccgggcctgcatgctccttgccatcgtgacggccctgctggcacgcagtcatgccgccagggtcctcgccgatggcttcttcgagcacaagacccaggccgcaactgggcagacaacaggcacatggtgggttcatgctcgggcaatctggtctgtcactgccggctggcaggggagggcaccttgcctccttggtggcctgtggcaacccctccccctctgcgacctgccgccaggggtgggcgatgcagagggtttcacatggcctctgcccatgccacagtgctcagcatggcgtggacccttccccacagggcggtcctgttctacgagtcgctgcccgaggagccggctgcgctgggcgagtttgaggccctgacgcagcccgcccttgagcaccagattttcctggcacgggtgagatcctgcgccgggggaggggcccttgcaggccagcggggcggcaggcttccccggccccgctcacacggggcacatggccaaggggtgcggccaggctgggtccgggagaaggggccctcacccagagtcgggtccctgcatgctagccagaccacctgacgtcttgcacgcacgcgcccctactccccgcacccagtgcccctctggagcctcccctccccctcccttccggccctctgcaggtggacatctccaccaatccccagctgcgccacaggttcagggcggtgggttccccagcggtggtcctgttccggcaccagaaggcaagagtgtgggggaccctggggacgtgggcgggcgtttgaatgtggcgtgcgtgcattggcctgcagcgcaaggggctcaagcaggcaccgaccccttggcaaagggcccgcgcctcgcccgctgcacccgcctctttcccccctttcccccgctcgtctgtgctcggaatcctacctcccctccgccccctccctgccccatcacacacaaaaaacatgcgcagatgtataggtacgaagggactctgagccgggactccttcctgcattgggccacggaagcctacgaagcatcacccggagccaaggtgccccagccgccgcctgcattcaggctgctgatggagcccctgtacagctacgtggatggcagggtgcgcacccccagggatgtcgtttgccttttccgcagtcagggtgccaggtctgaatggcaggatcgcgggaggatgaggggcacaacctgcattcaacccacagccctggtgagggggtggccggtgagcagcctcaggcagagggcaccaactgcaacccacccnnnnnnnnnnacaccaaaaaacatgcgcagatgtataggtatgaagggactctgagccgggactccttcctgnnnnnnnnnncgccctgcgtaggtgggcgcggcggtgggagtgctcgtgggggctgcgatcctagtcaccctactggcggcgaggcacgaacgggatcgc

SEQ ID NO: 46086 - DNA, 67 bp, Chlorella protothecoides
gatgtctgacggcaacaccagtcccctctcttgtcttgctaccatcaaaactttggactccatcctt

SEQ ID NO: 46087 - DNA, 12629 bp, Chlorella protothecoides
  modified_base (469)..(478): a, c, t, g, unknown or other
  modified_base (1284)..(1293): a, c, t, g, unknown or other
  modified_base (1624)..(1633): a, c, t, g, unknown or other
  modified_base (1692)..(1701): a, c, t, g, unknown or other
  modified_base (2764)..(2773): a, c, t, g, unknown or other
  modified_base (3387)..(3396): a, c, t, g, unknown or other
  modified_base (4319)..(4328): a, c, t, g, unknown or other
  modified_base (5202)..(5211): a, c, t, g, unknown or other
  modified_base (5751)..(5760): a, c, t, g, unknown or other
  modified_base (6245)..(6254): a, c, t, g, unknown or other
  modified_base (7598)..(7607): a, c, t, g, unknown or other
  modified_base (8123)..(8132): a, c, t, g, unknown or other
  modified_base (8241)..(8250): a, c, t, g, unknown or other
  modified_base (8559)..(8568): a, c, t, g, unknown or other
  modified_base (8908)..(8917): a, c, t, g, unknown or other
  modified_base (9981)..(10024): a, c, t, g, unknown or other
  modified_base (10087)..(10096): a, c, t, g, unknown or other
  modified_base (10509)..(10518): a, c, t, g, unknown or other
  modified_base (10713)..(10722): a, c, t, g, unknown or other
  modified_base (10900)..(10909): a, c, t, g, unknown or other
  modified_base (11499)..(11508): a, c, t, g, unknown or other
  modified_base (11691)..(11700): a, c, t, g, unknown or other
  modified_base (11968)..(11977): a, c, t, g, unknown or other
  modified_base (12199)..(12208): a, c, t, g, unknown or other
tcctcctccccctcctgggcggcgccgtcccagcccatggccgcggggacgtccacctccgccagcatggcggcggtgctgcgccgcaccttttcggcgtggaactcgcgcaggaaggcgcgggcgcgctccacgctcagccgcgtcagcacggcctgccagtactccgggtcggcagcctcgcccgagtccagctgctcaccgatgcgggcctccaggtcccccagctcctgcagcgtcttgcctgccgagatcgtgtttgggagcggcgtcaggcatgcgcatgcgtgtaggctgggtggggtggcacttccaagggtgatgagcgacgcaggccgggcgtggcaaggaggggagtgcgcgtcgagtccccatcagaccccatcatgattgcacctgtgagcgcatcaacccatcagcgcctgtgccatgacaagactgccccctcacctgcgagcatggccctgannnnnnnnnnctcagcgcctgcgccatgtcaaaacctgccccctcacctgcgagcatggccctgacgtcggcctcgatggacccgtgccagccggcttcgcgcaccgcatactgcgcgggggtgggctccccccgcgccttggcccggtcgacctcctcctcccgctgcgcctcggccagccccgcccccaccaccgtctccagcgccgcccagaaggccgcccggcccgcgtccatgcggtccagctcctggaaggcggccgcgtcggcgcgcagctcgcgcagcaggcccagcgtggcgccggggccgtacagcagcgaccccgggtccagctcggcggggtcgacgccgggcaggtcgtacaccagggcggcaagggcatccacggcgcgtggccgcccctccgccagccgggcctgggaccgcatcttggactgctccagcaggaagtcctcctgcttccgctccagctccaccgcctccgcggcggctcgctcgcgctggatcatctccagctccgcctgcatcgcctcgcgctccgcctcgcgctgctcctgccgcttcttcaccttctccgcctcctcctgtcgggtgggccagggagaggagtgggggcaggggagggggggcaatgtcccgcgaaagtgcagagcttatccgcatgggcgggatgcagctgcatatccggttgctttgtgcaaggcaatgaaattgtgaggcagggacaaccagcatccaatccacatcttgtgaacagtgacaatgcgccccttgcattgggacagctacactattcgggcactgcggcccccgannnnnnnnnnaggtgaggcaatgccctgcgaaagtgcagagcttatccgtatgggcgggatgcagctgcatatccggttgcttcgtgcaaggcaatgaaactgagaggcagggacaaccagcatccaatccgcatcttgtaaacagtgaagatgcgccccttgcattgggaccgctacactattcgggcactgcggcccccgacggagcctcccacacgcccctctgcctccgcactggtggagtaggtgccaatgccccaaccaaaacccatactcggtcctcaacccaccagccggctctgatgcctcttggcctcggccttggccgacatttcccggnnnnnnnnnngtgagtaactgctgcatctccacaccaggcagcaggcctggactccaccacggaagcgnnnnnnnnnntcgcccctctgcctccgcactggtaaaataggtgccaatgccccaaaccaaaatccatactcggtccccaacccaccagcctgctctgatgccttttggcctcggccttggccgacatttcccggacatccacgccctcagcaatctgcttctcgatcttcttgccccacacaaagggcttggagaagtttgggtcgccgaagggattggcctcatccgtgtactccgagtccaccttcttgtgcttcttctgatgctccacaattctctggatctgttggcgcgagaagggggacagactggcaagatgagaaactgctgcatctccacactaagcagcaggcctggactccaccacggaagcgctgctccccacaaccaaacaagtgcaggcgaccctgcgcctgacaccataacacgcaatataatgcccgcacccaccagcttctcgttcttgttctgcttgcgtgcatcctcgtcggaactcgagtcgtcactagagtcacgacgcctgcgtttctccttcttctccttggatcgtttggactttttcgacttcttggcgtccttccccatcgtatagatttatcacaggatgcgtgcatgcttgtggtgcgagaagtaaggagctccgctccccgatcagtatgcccgtgggagatgtttcgagccgcagcacgcacatcacataattgcatgcctttcacacatgcggttgcccttctgcccactgccagctcctgtggacagacttacaggcccacgccgttcagtggtgcggcccccttccatggccagaagagggaagccgacgcctgcaccaccgtcacatgtcctcccagtcaaagtcggcctgcactgcagcggcagcctcctccgcatcgttggcctccgcttctgcctttgccaccgcttcgcctttcacatcttccagcttcacccgctttgcatctgtcggtatgactgggggtggagcttggggggaggacccctgcatccctgtgttaggcatgttggggatgtgcgacccaggaatgcagcaacactggccgccaccatgtgnnnnnnnnnnaggggagggcccctgcatccctgtgccaggcatgttggggatgtgcgacccaagaatgcagcaacactggccgccaccatgtgtcacctggagagtctcctgcggccaaggcgccgacgtcctccccacccgccagtccggccagcctgacagactccatgtactgagcgacgtaggccgcctcgatctggcgcctgcgcgcctcgtcctccgcagcggccgacgtcgtggcggcgccggcgccggcgccctcctgctcgggcctgcggaaccatgccggcagctccttgcctgggaggagcgcctggcccggcccggttgcggtgctgccctggccgattttcacctggaggggatggagggcaggggttcaggttgttccttggtagacgtgctgagccagggtaaaagatctccggcagggccacggcaggaggagccatcgaggtacagccccgatggatcccgagcccatgcaggtatgggtattgcggctttgtggaagcgtagccgaggaagacttgcgccggaccaggaccgggattcaatcgatgccgacacccacccaggggcccgcccctgaacagctcgattgctccggcaccccccccccnnnnnnnnnngcttgcgccggatcaggaccgggattcaatcgatgccaacacccacccaggggcccgtccctaaacagctcgattgctccggcaccaccccccaagcagcctgccgtcggtctatcactgtaaaggaaatacccacctccacgctggccacatccaccaggtccatgaattggtcgacggagaggtcgccggcgccgtcctcgcccccgcccgcgccgcccgcccccgccgcgcggcgccgcgccccctccaggctggccttgcgccgctgggctgcgtcgcgctgggccaggaaccagtcctggtataccattggggaggggcggtgtgtgtgtgtgtgtgtccaaagtggcgaggagagcatgcagacagagtgcacggtcaggaacctgatgaaacagctgggacggggaggaaggaggggaagacaaggcagtgcgcctccgcagtggcatgtggtgccggtccttgggggccaaagatcctctcgtacccgcctcctgcacccctgtttgaaagaatgctggccgcctccacacccctgcccttcaacatccgatcgccccgccgcgtgctcacctgcagactgccggggtccggggggtccgcgtcctttatcctctccagctgctctatgagcggggccagctgccgctcgaacgccgcctgcagcgccttggccgccgcctgccgcgctttgttcccggctgcagatcccccagggccgccggcctgagagtcgccggccgcccgctgctccagctcggcgccacactcctcgcacaagaacgtgccctgcaggattggtagaggggtggggtggggtgggagctttgggtgtggccgggttcggcttgcgccatcatatcagggctgccctgactgctggtatttccctgaaacgacctggcttgccccgatgnnnnnnnnnntgggctcccctgtctgctggtccttccctgaaacgacctggcttgccccgatgcgcacagacgctccattccctgggcatgtcaaggcggactcctccactcgaacatcgcttcgatacaccattgccccctccccaacccccttccccccattcctcgcgctcaccgttctcgggtccagcagccgcacggcgtccagcgaggaggcctgcgcgccgcagcgcggacagatgtactgctgtagtacgtctgtgtcttcggcctgcagtggcacggcgaggggggctttgcagaggggacgccgaggcggcaaggccagcccaacagcgggtcacacaggagggtatcacgctgccgccggccctcatccttgggtagggactgcaactgcagccaggcctccgattcacctcttcctccacgcagcgtgcccgcccgacccacgcaggcgcctgcccaacccggcgcacacacacctgcttgcgcagtgcctcgcgcatgagggcgaggcgcaggcgcagcgcatccttcacgcgcgggtagtccaccgcccagaaggcgtgggtctccacgcgccgccgcgcggcgacctctgggtcgtcggacggctccttgtccctggccaggctgtacttgaccacgtcgcagcgcaccaggcccgcatcctccaggtacttgagggcgcggcggacctgcttctgggacagacgcgtgtcctcgcacaccgtgacctcgtcgcagtacccgtccgcgcgcgtggccaggtagtccagcagcagcacccccagccccgcgaaggagaactggagcgggggggggaatcccatggcgttcaccttggcgagaggcaggtaggagggcaagggggcagtgnnnnnnnnnnaatctcatggagttcaccttggcaagaggcagggaggagggcaagggggcagtggggcagggaggcgagggggtcaagtccctcacccacccaccttgctgaagcgggacacggtggggggcaggagggcatctgggtcgatggcgacgggggggggacactcccccgcatagaaggcgcggcctaccaggcggatcaggcgctggtacccggcttcgccggccagtgctcggcctatgccgtcacccatggcacaggcagtcagcagccaacgtggcggcaggtcggcacgggacgctgcatcagagggtgtgtttccccatcgagtcgatgaactgcgcgatggacatcatgcctagatggggagcggctgcatgagcctcaacttgagcagcgcagtctggtgagctcccagcccatgcgtgtctcagagacacacaaaatcgtgtctaggtatgtgtgctcattgtgcaatgctgcagaaatatgtgtcctgcgcaagcctcccagcgatcctgcagcgaagaatccctcgagccnnnnnnnnnngaaatcgtgtctaggtatgtgtgctcatggtgcaatgctgcagaaatatgggtcctgcgcaagcttcccggcgatcctgcagcgaagaatccctcgagcctgctttgactccgtcgaccaagacactcagatcggtcacgacgaaggattccagctcaacatgtgaaggcacgctggtggggtgatcacaaacagcaacgacctccgtaaggtatcattagaatacatcctgtcaatttcattccgtaaggggggtcgtgagctggtactcgtgtcttagggcgtgggccctggcggcaaaccacacccattcctcgacatggctgaggatgatctgaccgtctcgctgctggccagctgacgccagatggagacgacagtcgttccctccgacgaagcctcgcgtcagaacgacgtcagcaccagccggactgggggctccgccttgaggtcgctgctcagcagggcatggccgcaggaagacnnnnnnnnnntcggactgggggctccgccttgaggtctctgctcagcagggcatggccgcaggaagacacgggctatgcccccagacgcctgtcgtctccaagcttcaagtgagcgctggtgctggcatccggggggcgagtgggaggcaggggtggtagaggcagcagcagggagacaggccaggccagcgtccggtgcagccctgtgctggccctccaaacccccaacctggggtatacatgctcttcccaggaacgcccatgcactcacgggacattgaatcgcgaccttgcatcacagggacagattgttagcgctccgcgacatcctgctctgcaagggtctgcgtcgcaatgtagccaacaacaatgggaccggacaggagcagatcgagagggatcgcaggcagctgccctccctggtggaggccgggaggtgagaagttcagggtggtgctgtgtagtggggtttcatgggtactcaccccgcgcccagggtccttacatgacgggcgcagtggcgaagcccggtcaggttttccgaggcactgtcctgggaggtggcgacctctccgggactcctggtcacctgaagcacagctgcacctcatctccatctccctgctgcaggcacgccggtcgttcacgggttgtattcagtggcagcaacatcaacctacacctctggatccgaggtgagcacctgaggcgcgcacagctgcagcatgggttgtctcctacgtactgcttgctccttttccctcatagccacagggatgctcaaggaattcctacaaagcaaggagcttgtcgttcgctctgagaagaaatggagctctcagcgcccctgagttctatgcctcgctccctcgacgcagactcgttcatctccatcgtccaaaacaagacgcgggtgttgatcctcgccttcttcatcatctaccagctcttcttctggagctggggttccctctactacctgctggtccgattcaagccgggctgcatctacggcgccgacagcttcgtggaggcctgggtgtttgccgtggtgacgcagatgactataggtgcgcgggtgcatggatcttgctgtggtataggagtctttcccaccgggggggagggggggcagtcaagacagcctgctgggggacgtacagagcctggtggcttatggaacgaggcacgggcgctaccagcgctcaggaagctcacagagacgtttacacataggagccatcaccgagcccctttccctgcctggcaccctccatcttttcctgatgccttcccaattttacctcagtccatctccccacctcgtcgattcccgcctgtgtgtcgctcgcnnnnnnnnnnctttcctgatgccttcccaactttacctcagtccgtctccccaactcgtcgattcccgcctgtgtgtcgctcgcccagccattcactcatgcccaacctccacccacctgaccgcccattccccccctcgcgcaggatatggcaatacgggtcctcagaactgctggcccgtctccgtcatgattgtggtccagggcatcctctcggtcctcctcggcgccatggtcgttggcatcatgtttgcgcgcatctcgcacccgcactaccgcggccgctccatctacatgagcgaccgcgcgtccatagccaggcgggacggcaccctgaagctcatgttccgcatcgccgacatccgacgcacacaggtctgtgggtgtggcgacgaggggttgctggggcatcgggttgggtgtggcgcccctccatgcggggctgggcttgattgggcgcgcatgcttggcctacgatgccgtcagcccttgtgggcacctagcttgcatcctggcagtaccctcnnnnnnnnnnccgggggaagggatctttctccaagatcggtgtcttcagggttgctgcaagtcatggggccaggcgctctcagccgccgttgtccctggagcgctctcgagcgggcgcnnnnnnnnnnttatacacctggggctccggccgggtgacagccgagggcgagaagattccaggtgggggccgggacgtgcgcagtcgggggaagggatccttcgctgagattggtgtcttcagggttgctgcaagtcgattctgcatggggccaggtgctctcagccgctgttgtccctggagcgctctcgagcgggcgcacggctgctgcttggggcggcgtgctcacctgaacccagatggttccccatcccatgcaatacacacccaaacgcccccatgcctccgtgcagtacgttgcgaggcgctggacatcggnnnnnnnnnnacggcgtgctcacctgaacctagatggttccccatcccatacaatacacacccaaacgtacccatgcctccatgcagtacgttgcgaggcgctggacatcggatatatcgacggcatgctgctgctgcccctcatcattgagcacaccatcgacgagcggtcacccctctgcggccacacccacgacagcctgaccagcctgaatgcggagatcgtggtgacttttgagggaaccacagaggtgagctggcgggtcgaatggtcgggcagactggaaaggggcagggaatggcacagcgtttgaagggatgggtcccggcgggtgggatcagatcatgcnnnnnnnnnntgaatgggcgggcggactgggaaggggcagggaatagcacagcgtttgaaggggtgggtcccggcgggtgggatcagatcatgccgaattgggacctggcgaggccttcagctgggagcacccttcaccatatggtggacagccagtgtggcggctggaggctatgtacaccggcctacaggcatcggaccccgtgctccgtgccaagagcagcaggacccgccatgcttgcgccaactcgtttgctgctgcagcctgtgcgtccctgtgcctttgcgctccgactgtgtcctagatccctctcacctcaccactctccccccctcaaacccttcagtttggcaaccccttcatggctcgccgctcctacctgccgcacgagctacactggggcgagcagttcctgcccatcatcatgcggcccgagggctcggaaaccaacaagcactatggtgtcgacctcacgcagtgagctggtgtgggatgccgggtcgtcagactctgggggtccgatagcatgtgtgggtcatgctgcttcggcacctgcgatcctctggattgcagagacctgcaagagttccctgtccatgcagccacagtgcagattcagtccattgctcctgctgcacaccatcatgtccctgttcgggggcgcaccctgaaccccctctttacaaggcgaggacgctcccgtccatcttccccaacccacccaccccctccaaacaacctcgcacagcttccacgacctgcggcggcagaaggacgtgccgtccgcgccggcctcggaggtctcgcacgccgtggtcagccgtgcgctgaagaccgtgccctacccgctgctgggcgagaacacgctggtcgtgtcggacagcctctgcgtgagctggacgtggggaggcgcgctggagctggtggcgcgcgtgggcgacacctaccccaatcagatggtggaggtggtggtgcacttcatcctctaccgctggtgcagactggaggaccagcagcgcgacccgctgctgcccaccttcacgcagcaccgcctggatgtgagttatgttggnnnnnnnnnnnnnnnnnnnnnnnnnnnnnnnnnnnnnnnnnnnnatacattgccaactccaccaaaatgacaggtcgggtacaacaccggcgcggaccgcctgaacnnnnnnnnnnctggggaccagggctggaaggaggttgtgaggtgcagtcggggcaggcccttgtcgcccgtgctgtgctgagtacactgccaacaccaccaaaatgacaggtggggtacaacaccggcgcggaccgcctgaacctgcggctgcccgtggatgtgcgccacgtcatcgacgccaggtcgccgctggccaactggttggagccggggggcgtggactcggaccttggctccgagatcgtggtcatagtgagggagcgcggggaggggcattctttggggtgggtgggggaggtatcagaggggcctgcccccacagcgtggggtggcttgcccaggctgctgttggggtgccctggcgacggagcaagggggggagaggccttaggcctgccggccttctcctcgtgaagcatgnnnnnnnnnnaatcagaggggcctgcccccgcagcgtggggtggcttgcccaggctgctgctggggtgccctggcgagggagcaagggggaaaggcctttggcctgccggccttctcctcgtgaagcatgcatgccgagagtgcctatgcttctggctgagccgcggttcgatgctcgccgtggcctcacggccacaccacatgnnnnnnnnnngtaccgagagtgcctatgcttctggctgagctgcgattcgatactcgccgtggcctcacggccacaccacatgccaggctctggccggcaccacccgctctcaaccgcttcaaccccatcacgccacccttacaccagatgaacggctaccgcacgcgctccacagacaacgtcctgnnnnnnnnnngaccgcttcaaccccatcacgtcacccttccaccagatgaacgggtaccgcacgcgctccacagacaacgtcctgcgccagcgcacctacaatgtggggcagcacgtgcgatggggtcaccgcttcgtgcccatcgtgcggccgcccggcttctccgggtgggtggcagggtcaggacgggaagcctgccgggaggcggctctgggattcgcaaggctctcgctcgcctgtcagccggcaagcctgtcagcctgcccgtaatggtcttcgtgcactgccccaatccccacccgcagcgacggcaaggccagggtgcggtggggtaagttccacgccgtcgttccggacacacgcaaggaggtggacgggcacgcggtcagcgtccccgggggcccccgcatgcgcttggccaaggccacccccgcgtcccttgcagggacctccagtgagtttggaggggggacctgggtggggggcaggctgacggcaggagacgatgctgcagcggcgatcattgacatgcacatgggctccccatgcggcggcggcccgcttgcatcagaggcagccggcggttcaaggcctgcttnnnnnnnnnnagatgatgctgcagcggcgatcgttgacatgcacatgggctccccatgcggcagtccgcttgcaccagaggcagccggcggttcaaggcctgcttgttctggcgcacagggcctgcaacaaacctcattctcacatcacccaccccgcccatccgcacacgagcagccgcgacggtgagggcnnnnnnnnnncctggcgcacagggcctgcaacaaccctcattctcacatcaccacccccgcccacccgcacacgagcagccgcgacggtgagggcgcccgagtcgcacgcgccccggcgggcgcaggcggcgcacgcggcggggggcgaggaggagcgacgcatcgccgccgacgtctcggagatggtgcgctgggaccgaggggggtcacctccctttcggtgggggaggttgaggggagcggggcagaatctgaccaaacttggcagatgccgctnnnnnnnnnnaacgtctcggagatggtgcgctgggatcgagggggggtcacctccctttcggcgggggaggtgaaggggagcggggtagaatctgaccaaacttggcagatgccgctgggccagtcaggcagcgtcccccccgggcggcgtcgtgtgcgtcctgcgctcacatatgcacaggcacccctgttgcccggggaccagctctctccttgggcattcgctgtgccnnnnnnnnnnatgggaggcgtcgtgtgcttcctgcgctcacacatgcacaggctcctctgttgcccggggggccagctctctccttgggcattcgctgtgccctgcgctgcccggctcaaactcccatcccgccccccctgtgtccctgctctccacgcagctgtcacgcatgcccagccggctggggcctggcgccgtggaggccagcgactacaccatcctgcccatggacctgcaccgctacgccgccgagatcgcgagcatgtcgctgctgccggcgcgcagcctgcgcccgggcctgccgcgcttcttcggcgccgacggcggcgggcaggacccggaggccgacccgctggcgtccccggggcggggcccggggcccctgagccccggcgcgcatgggcccccgctgcgcacgcgcttcggcacg

SEQ ID NO: 46088 - DNA, 61 bp, Chlorella protothecoides
gggcgtgtcgcagctgaaggaggcacctgccgactggcgggcgtacgtggaggagcggcag

SEQ ID NO: 46089 - DNA, 77 bp, Chlorella protothecoides
tgtcaaggtttgagtcctgctgacaaaggtctgggatgttgtggggattccccttgaccgggccctttccccacttt

SEQ ID NO: 46090 - DNA, 67 bp, Chlorella protothecoides
gtcgaacagaatgttctccagcttcacgtcacgatgcacgatgcccgcgccatggcagtgacccagc

SEQ ID NO: 46091 - DNA, 80 bp, Chlorella protothecoides
tctgcaccaggcagtggcgcgccgtcaggacgtagatcttgtcacctggacccttgatgagggtgcctgcagcaagcatg

SEQ ID NO: 46092 - DNA, 166 bp, Chlorella protothecoides
catacgctaccccgcctgctcagtgacaggtgagcgtgtgtggcagggtttttgggggggtgggaatgggggagggggggttgaggaaacagctgcatgcctggcacacgtgcggcatgcgatgcctcggggcgcgatgacaagcacggacaccacagctcaatac

SEQ ID NO: 46093 - DNA, 61 bp, Chlorella protothecoides
aatccggtcttcctgggatggctcacagttcaatgccaccattcaaagcctcatttcgacg

SEQ ID NO: 46094 - DNA, 22203 bp, Chlorella protothecoides
  modified_base (106)..(115): a, c, t, g, unknown or other
  modified_base (1515)..(1524): a, c, t, g, unknown or other
  modified_base (2798)..(2807): a, c, t, g, unknown or other
  modified_base (2875)..(2884): a, c, t, g, unknown or other
  modified_base (3991)..(4000): a, c, t, g, unknown or other
  modified_base (6049)..(6058): a, c, t, g, unknown or other
  modified_base (6478)..(6487): a, c, t, g, unknown or other
  modified_base (7235)..(7244): a, c, t, g, unknown or other
  modified_base (7676)..(7685): a, c, t, g, unknown or other
  modified_base (7881)..(7995): a, c, t, g, unknown or other
  modified_base (8113)..(8122): a, c, t, g, unknown or other
  modified_base (8701)..(8710): a, c, t, g, unknown or other
  modified_base (9091)..(9200): a, c, t, g, unknown or other
  modified_base (9976)..(9985): a, c, t, g, unknown or other
  modified_base (10566)..(10575): a, c, t, g, unknown or other
  modified_base (10828)..(10837): a, c, t, g, unknown or other
  modified_base (10897)..(10906): a, c, t, g, unknown or other
  modified_base (11070)..(11079): a, c, t, g, unknown or other
  modified_base (12245)..(12254): a, c, t, g, unknown or other
  modified_base (12523)..(12580): a, c, t, g, unknown or other
  modified_base (15091)..(15100): a, c, t, g, unknown or other
  modified_base (16866)..(16875): a, c, t, g, unknown or other
  modified_base (17047)..(17056): a, c, t, g, unknown or other
  modified_base (18049)..(18058): a, c, t, g, unknown or other
  modified_base (18520)..(18529): a, c, t, g, unknown or other
  modified_base (19495)..(19504): a, c, t, g, unknown or other
  modified_base (21064)..(21073): a, c, t, g, unknown or other
  modified_base (21676)..(21685): a, c, t, g, unknown or other
ggcggtgccgctggcaagggcagggcggatatgggaggggaggctgacacgcaccgaccggcatggggctgggcggacagggtggagctagccgtggtgttccccnnnnnnnnnnggcctttgcggcctccgcgcaggcggccggctgggacctgcaccacagcacgctcaactccctcgacaacagggtgcagatgacgacgcatgtgcgcccactctgaccgagcacagtgcccggagcgtgttacaaggggggcggtgccgctggcaagggcagggcggatgtgggaggggaggctgacacgcgccgacccgcatggggctgggcagacagggtggagctagccgtggtgttcccctggccgtgctgctcccattctccggggggaaagagggatgagggggcagcaccaggcacaggtgcacatgatacgaaagctgcacagacggcagccctctcccggcctctgcatgctcctgcctgcgccagccatccaaggggcagtcacgtccgcccctggctcatgagtatcgccagcctcattgagtgcctgccggggatgcatcccccatgccctccacgccctccacgtccaggatgcgcagcatggtcaggggctgcggggcgggttggcagaggcgtgagtgccggtggctggtcggccaagccagagccatgcgggcgagcctggcgaggcccgagctccacaaacatgcctgccgggatggagcccaacccccacaccggtcccaagccccgacgccacacctggcggtgacccttggttcgccgcgagttcttccgtcgccgcttgtggaagatgagcaccttgccatccaggaattgctcctgcacgagttggttgcaggggcggtggtcgagaccacggcatggcgtgggctcgaacggaggcagacgaggtgaacaggctctcacgatccgcgcttcacctccactgccgcggtgacggtgatgcccggcaccaccggccggccgatgatggtggcgtctgccgtgcctgccagcagcacccggtcaagggagatgcggtcgttcacgtccacgccaggaatacgctcggtgacgatggtgtcgttgggggtgaccttgtactgtgtgccggccagctccacgacagcgaacaccgggcggggggggacggtgtatgcctcctgcacccgctccctgagcagggtgtaggcgctgggcacggcctcagcagcgggggtgatgacggtgttcagggcggtgtggacagacatcccggcgacgcctctgctgaggctactgcgtgacgctacgagctgtgtgaacagggccgtggcgcgccgcgccgacatggtgcggcgcagctgctgcagcaggtgcctgggcccctggcggtgggacggtgaacagggtgaaagtacaaccaggtctgtttacgggcccccggggcggccggtagcgatagtttcagcctggatgtacctgtgtcgttcgagaagtcaaagcggtcggatgcacgatgtctnnnnnnnnnntcaggttttttttgcggggccccggggcggccggtagcgatactttcagcctggatatacctgtgtcctttgggaagtcaaagcggtcggatgcacgatgtctggatgggcgggtggtgtgtcgcgtcagtggcagcaagtttcaccatttggcgcgaaatgggcctcactcatgaatttcacagtgcactcgctcgtctccctcgacacctccatgcgcgcaaagaatggtgaacaactgatctgtacatcaatctcagcacggtgaatgtggatggagcaaggatctatgccactgccccaccaccacccggcagccgtattaacaggttagcgtacgcggaagcgccaaggtctctcgcgcatggtccataggtcctcgtcataggcagataataatccagtactgaatggatcgagtaagatgacggcccaaggccgccgctggtagggacccgggtccgacatctggagctgggcgtcgctgcgtggaggcctgccccctccctcctcacccgccatgctgcccctcacctccagcggcccctcacgccgcggcagcctgctgcacctgaccaacagtcctggcgggaccccctccctgggcctgcaaccgatccgcgaccccagcaacctccgcttcctggccgggctcctggcggtcacgacctgcctcctgttcctgggcctgcaccccgacacctaccccctgagcggcgccttcccgcgccggcgcggcctgtcgggcctggtggcggacagcaggctgctggctcgccatgcggaggcggctgcgggggccgaccagggccccacaccacggcccctccccgcctcgcccgcgccctcgccccccgccctccccgccggcctgcccgaggactttgatgccgaggcgtaccgcgcctaccacccccacctggacctgcccagcgcccgcgccgccgccgagcactacctggcgcacgggcgggaggagggcctggtcgcgcaccgcctgcgtgtcctcctgcgctacacggcctgcacggggctgatcaaccagcactactcccacatcgccgccttctccctggcctccgtgctgggcgcggaggtggtgctgccccccgccgtctgccgcgactccttcgcacactacttctctgtgttcaaggagaagaacgaggtgcagtgggctcccgtccccctggactccctcctggacgtccctgccctgatcgcctggtggaaggccaggggcatccacgtgcacgaaacgccggcgctgacgnnnnnnnnnngtgtgaggggtggcgaggaggatggggtcacgctgggcgggagcggcatcgccgtggtctgtggggannnnnnnnnnacccgtccccctggattccctcctggacgtccctgccctcatcgcctggtggaaggccaggggtatccacgtgcacgaaacgccggcgctgacgcccttccccgacctcacccagcccggcgtcgcctttcccctctacgcccagcccggcgtggacccggacctggtggtcaggtgggtgaacttgcctatgtcatgtatggactcttcctcaggacagggacgggggggatcgtctcggctgtgaggtgtggcgaggaggatggggtcacactggacgggagcggcatcgccgtggtctgtggggaggttctttcggtcggtggcagtggcgccagctgcggactcggcgcctcggcgcctgtggcgctcgaggctcttgccgacacgatggcccccggctgggcgccgacacgccacaggtacacatgtctgcacacacggtcgctccaccctttgtttgacctagggtggagggcgtgtacctgaagaacatggagctgggggagctggtggacctggcgcgggaggcggtggtgggcagggcgcgggagcgcctgctggcggctcgcggctcctcgggcccgccctcggccgcggtgccctacgtggtgctggacctgccctgctccttcttcatgctgcgcacgctgagcgacctgggcctggtgtccggcgtggcgcgcagcctggccttcgccccagccctgcacgcgctggcggaccgcgtggtggacgagatgacgcgcggcggcgtgctgcccttcaacggcgtgcacctgcgcatcgagaaagacgcccgcgactgggccatgatcatgggaggagagcaggtgggtgatctgggggccttgggggggtgggggagatgatgcggagggccagctgggcggagatgtgaggggagggtggatgactgggacggatgtggagtgtctcggtggtcccgcctggtggtcggtgcttcggctgtcaggcttgtgcgtggacgagcccaccacgtgcacggagcggcgcacgacgtcgacgcatgcatgccccgacccgggagccatggcccagccgccccactgccggcgccccacccaaccccccacacccgccacnnnnnnnnnnatcgacgcatgcatgccccaacccaggagccatggcccagccgcaccactgccagcgccccacccaaccccccacacccgccacgctcccggtccgtcgacccttgcaggtggtgtggcagagctacgtgaagacgatgcgcggcgtgggccagaacgagagcgtgccgctgtatgccgccagcggcatgctgacctacggcgcctccaccgacatgctgcgcaccgtggccttcctcaagcacatgcgcgtctgctccgagatccatcacaaggagatgtacatccccaaggccgagctggagcgtgagtcctggcgtggggggtgaaggggttgtcattcgtcctttcttggcgtctgcggagggggaaggggaagagtgtgagaggggggatgcatgcgaggggaggatgtgatgggggccggagtgccgccacagcaggctggctgtggagggcaagcgctgtcctggccgcgcgctggcgcggtgcggggccaggtacacttggagggggcgccgtacggcggcgatggcggccagcctggcctgcatcgtgttcgggggagccccctccgctccccctctcacgccccttgcctccatcccctcttgcccccccccccctttccaacaacagtgctgaacagcgagcaggaggcgctcctggacttcatcgtcctgtccaaaagccgcctgtttgtgggctttggctcctccaccttctctttttacctgcgagagtaccgctcgctccaggtgggcacgcctggcccggagggcggctgcagggcgggagggcgagcgcctgtgtcaggccacgccggtgcatacactcgggggttgagcagcaagccctcggcatgctgcacccgctgagcactgggcttccaggcctttgagtctcctcccccattcccacccaccatgcacagggcatgtcacgctcgacctcgtccctggtggatgcctccatcatcggcaccgatgcgctcttcgcctcggctggcaccgtggtctgaggccggcacgcccagatccccgacgtcgtgaccgcatgagagcccgagcctcgccccgcgcccccccacctccccttcgtatcatacctgtcctctgtgccctacgcagcgtgagcccggcactgcacgttttcttgcccatgagtggacgacgctctacacctggaggcgagagactcgcgtcctccacttcccaggagtgcgcctcctcgagtgcctttggcaaacacatggatccttctcttcctcccgtctttcagtgctccccgtccctccccttcttccccttgcccctgtagcggaatctgcaccctcccgcttgtaaaacgctcgcatggcaagcagcaccctcacggtggcatctgtgaatgcacatggattaaaaggagcgggatcacgggcgagtccgccgcgtccagccggcagtcgccatctacgggccctggccggcggccctctgctgcgcctgccaggcctcaatggccgcctgggcggcggcgcgcttggcggcccgcctctccgcctcggcacccccgtctgcgggtgcaggagcggctgccgccgcctgcgcctgcgccggcgcgggcgccgcccctggcgcaaacccccaggtggggaaggccaacggcgccacgatggccgggacgccgcccacgacgaccctgaggcccagcggcccacccgcgtccgtccccgccccgacgccctgctccagcgccgcggcctgggcggcgcgggttcgcaggaaggccagcgccaggtgccgccccgccggcgtggtgcccgcgctggtgacggtgcccagccgcgcgggcggagcgggggtgtcggatgacgtgatcgagacggcaggtgacgtcatcggggcggcggtggattgtgagacggcgtcgcctgacgcccctgcgccaccaagggaagccgtctcgccgcccgccgccgccaccaccacggcgtcccccgcgcgcacaggcccgcgcgcctccagccccaccagccgctgcttgaccaggcccttgctgtgcaccnnnnnnnnnnatcccccgcgcgcacaggcccgcgcgcctcgagccccaccaatcgctgcttgaccaggcccttgctgtgcaccttactcagcgtctcctggcccatgtagcagcccttgcccagactgacggcgtggtacagccccgcctccagcgcgttagcctccggggtcagctccgcgccggggaggggccgacctgccacgagcagcgcggcgcgcagcaggccctcgcccgcgggcaggcagcgctgttggttggtgggtggacgttaaaggggatgggtctgggcgtgtcgcactccttccgcacggctgccgtggatcccagggtttggcagggggcgacgatccagcccgggaggtccccaccgctggcaaccagatgaagtcctgacccaaagtcccttcagtccatgccctgcctcagnnnnnnnnnnttcccagggtttggcagggggcaatgatccagcccgggaggtccccacccctggcaaccagatgaagtcctgaccaaaagtcccttcagtccatgccctgcctcagaccagcagcccccgctcacttggtcgccgctgagcagggccatggcgtcgccgagggggccgacgcagaccagcgtgacgacgggcgtggccctgcccagaagggggtcccgcacaacacgcacgctgcggtcccctgcccagcgcgacgcgtggctggacccgggctcaaaatcagggccggtcacgaggccctgggatcgcgcaatccccagggccccgggccccagcaggctcagcatggaggtggccgacgtgacgtcctccacgctgacctggcatggggccaggcgccggggtcaagggccggcccatgccagggccacaccataatgaaattactgcaggcctgcacagcatcccccccatgacatcccccaaccgccacgtccaggcatgccttgtctgaggggaagatgtggcggtccaggcggtcgtacaccgggccctgcatgccgggggatagcaggaggagcacgctctcctcactctccaccacgaccagggccaggtccacggtgcgcccagtcgccgtcacaaacacctggggggatgtgagaaagaaagtggggccggaggggaaggcagggacgcaagcgccgcataccatgcacacgcgctgtgttcctgtttgaggtgcctnnnnnnnnnnggtggggctggatgggaaggtagggatgcaagcgccgcatatccatgtacacgcgctgtgttcctgtttgaggtgcctcctcataaaacgctgcctccatcttcaagcgccatgcatccattgaattccccaacatgcaaacaccgcaccgtttcgcagcactggccaggtctcaggttgatcacgtccgcagtggactgaccctgtagaaggggcaaggctcctggccccaccagccgcagcctgccccactgggacctgtccaccaccacacactgggagtcagcttcactacacccgctcaaggcatcccatgcctgctggtcattgctggttgccttgagtccctgggagcaccacacggataggacatgaacattttacgactgcatttgggagactattcccaccatctcgcttacatttggccannnnnnnnnnaccttgagtccctgggagcaccatacggataggacatgaaaattttacgactgcattcgggagattattcccaccatctcgcttacatttggccataaatgcctgtgcacatatcccccaaaacctattctgcatcatggctgttgccaacatacctcatgcccaggtaattggcttgatgacgcttgatggtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcagacacaacagcaagcgatccctcgatcctaattgaatgctgattttggtattcgattttttgtttaaagcggatggtgcatgtgagcctgtgcatccaccgcatgatgcgcgnnnnnnnnnngaatgcctgtgcacatatcccccaaaactattctgcatcatggctgttgccaacgtacctcatgccctggtaattggcttgatgacgcttgatggtcggggctgcttaggcaagcaccaacatgacggaggcctttctcatgatattgcagaggtagtagcttgaacggaataccattataatagcgtgatcgacggtgttggatcaacgaaggatgagccagagaggagcttataattgacaacaagctgcgattcgtgcaacctggactgcaagacattctacagcctcagatacatcagcaagcgatccctcgatcctaatcgaatgctgattttggtattcggttttctgtttagagcggatgatgcatatgagcctgtgcatccaccgcatgatgcgcgcacatgggccggattgagatcaccatgacccgtcagcacaggttgggtcatgtcctgcaatggaggcccatggggcgcaacaggtatgtccatgcgtgcggttcgtcaataaatttggtataggctagcctgtatctcgacattagggacgatgctgggcgggatgacgagcaannnnnnnnnncccatccgtgcgggtcgtcaatacatttggtataggttagcctgtatctcgacatcagggacgatgctgggcgggatgacgagcaatcgcaccttatcgggacagcccctccatgcacccaccaggacccgcagggcggcgctggcgcggcgcgcggcgcccagggccgagcatgtcctgatctccaacaccaagagcgggggccatgccttcctgggcctgcacctggctcaaaagctcctggaacaggggcatgaggtcaccattctgaatgctggatccaaggtgccgaggcacgtggtggtggagatgcgggtgtgctgatggctttagcggctccatacgtggaccacatcttccaggcggatcgagaccagtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctggaggttgtgtggggggatgcgaccgacagcagtttcctggagtccctcaagccctatgatgtcgtcgtcgagaataacgggaaggacctggatacctgcaagcccttgatcgacgccttcaaggtgatgcggcatgggatttggctggcggtgcggtgtcttcctgattctctgggcgaggtagtggttaccatgcctgacgcacctcctccaatgccatgccgggacatggcagggctccccctgcatgcatcgatgagtccgtgacgcccgcaagttggacgctgcaggggcgcaagggcacccagtacatcttcatcgcctctgccggggcgtacaagcccgaccccaaccagcccccgcttgtggagggggacccccgcaaggagtctgctggtgggcccgggtgatgtgtggggggggatcgctttacactgggagcctccatttgacctgggactccatctccggccctgctctctatccctctatcagggcatgtggccgtggagaagtacatcgagcaggagcatctgccttacaccgtgttccagccgctgtacatctatgggccgcacacctccaaggactgcgagcagtggttcctggaccgcatccttcggtgagggagggaggggaggggagggagggtgtgcggattgcggccccgagtgcacggccacccccctccagcccacgccctggcgttcacggcacccccctcccacgtgcgctccggctcccagggacgagccggtgcccgtccccgnnnnnnnnnnggggagggaggggagggagggtgcgcggattgcggccccgagtgcacggccaaccccctccagcccacgccctggcgttcatggcacccccctcccacatgcgctccgcctcccagggacgagccggtgcccgtccccggtaacgggctgggcctggtcacgctgagtcacgtcgccgacgtggcggccatggtggccgcggcggtgccgggcaagccggccgccctgggccagcacttcaacgtgtgctccgaccgcgcggtgacccatgcaggtgagtggggcgaggggggcgcggcagcgacggggggcttggaggtggccctggcgctgtggcgtggactcaaggggtgctgtctagtccccagccaaggtggtctgcatgcccggtcctgcaggcatcgtgcacatcctggcagaggcggcgggacgggaggcacgcctcgcgccctttgacgccgaggagaccgggaagctgaaggccacggggtttcccttcaggtgagggatgccgggaatggtgtggagagccgcatgactgagggtaagcaggtcccctgcctctgctgggcagtgctgcnnnnnnnnnncgtgtggagccgcatgaccgagggtgagtaggtcccctgcctctgctgggcagtgctgccgctgcaatgtgtctcatgcggtggggtttgaggcctctctcgaacatctgcaaaatcacagatgctcgatcccaagcagcatcgttgcgcttgttgccgaaatcaatggctcactctccggtgcaggcctgggcacttctttgcctcgtcggacaaggccaagcgtgagctgggctggaagccagagcacacnnnnnnnnnnttccaacatctgcagaatcacagatgcttgatcccaagcagcatcgttgcgcttgttgcnnnnnnnnnngttcacccaggatgcagccgaggtgaggacgagcgagtgcctgcgccagggtgcagcaggcagcagtgcgtggaaggtacccctgtgcggctttcagctcttgtgcaggcactcagtgccgggttgctccgcacacgcagctggtggaggcctacaaggcctcnnnnnnnnnnctttacccaggatgcagccgaggtgaggacgggcgagtgcctgcgccagggtgcagcacgcagcagtgcatggaaggtacccctgtgcggctttcagcgcctgtgcaggcactcagcgccggttgctcctcgcacgcagctggtggaggcctacaaggcctctggacggcgggaccaggagatggatttcagcggaggctcggtgtgacggaggcccgcaggctgaggagcatgcatggcacactggatcaggaccatacttcaggcttgcatgcatgctgagggatctcctggaatgccgatatgtaataaagcagaagccacggacgtgggtgtgggtgttgggcaaacccccgttttggcgccagccgcgaggcgaacggataacccacgaaaggcacccgcagttcccatctcgccggcaccctccgagcgaactccgtggcaaccaaacatttgactagatcattcccgttggtgcttcgggagagcgagtggttaacaggcatcgactccgcctcctaccactggggtcgccatggccatgcttgcacctgtgcaggcatccctcagcagcctgagcctgcatggggccggcacggcgctgaggcccttcacgacgtcttcatccatgcgtcagaggaaatgcacgatcagctgccgcagcatggaggccggtaaggactgtgggtaggcctttgcgaggcggacagacgacgcacggtggcccatcctgtcccacccatgttgccacctccacagccaaacatccacccttgcgccaggtgtgggaatcttcggcaccaaggctggcatgacgtccatctacaaggatggcaacatgctccccgtgacggtggtggccctcgagcccggcaacatcgtgacccagctcaagtcggagggccgggaggggtacaactccgtgcaggtggggtaccgcgtcgtccccgaccgtaagatcaccaagccagagcgcaaccacctggccaaggcgggcgcgccgcccatgaagttcctgagggagttcaaggtgagagaactgggggaggtggtgccagcccccaaggggtactctacttgtgcacaccgcacctggcccagttccttcaactccttgaagccatgcatccccccctctcttcccccacaggtaaaggacaccnnnnnnnnnnacttcgactccttaaagccatgcatcccaccctctcttcccccacaggtaaaggacacccaaggacttgagcctggtcaggccttgaacattgcctcgatgtttaaggagggcgactttgtggacgttgccggcacgagcatcggcaagggattccagggtgaggatcgcgtcttgttgagccgtgcgcgcatgggagctgcaactcaagatgtgggaggagagggcctctctatgagttgggctacggcctcacgcaggtgcttcacnnnnnnnnnnnnnnnnnnnnnnnnnnnnnnnnnnnnnnnnnnnnnnnnnnnnnnnnnnaaggctgcatcaagaagtacaacttccaccggggagcgatgacgcacgggtccaagtccaagcgcgagcatggcagcatcggtcccggcacgaccccgggtcgcgtcttcaagggcgtgaagatgccgggacagatggggaatgagcgtgtcaagatccgcaaagtggaggtgaggcgggagtgtgctggggcgccagtgtctgcagacgccctgccctgtgaagagcagcgcttgcacctcgtctggaatgccttgccccagagcagagagacacccttacctccccccccaaacaacctcaggtgcttctggtggatgaggagaacggtgcgctggtgctcaagggaggactaccgggcaaggctggcaacgtgctggagatctgtccggccaaaatcgttggtgtgaatgtctgatgtaagtcggttacaggaaaggaatgctgaagtccgaggtgggagcaggtgcgcgcgtacggacacattcggtccgaaatacagcttccgagggcgccgcagatgccgtgaagattcgatcagatcggggcgagcggtgtgaccggatgtgtcacctttgagttgtttcgttccctgtcttggagttgagagtcatactggtgattcgcagaggatgcggcgatggctcacctaggtagcacgacccctattcgacgagtggggcagttgctgacgcaaagcatgaaaacgccaggggagtcgtcgtgtacggacctgaaagtacaaaatccaaattatacgaggctgagtggatggtaacgtcccaatgaaggcactcttccagttcggaaggtgcctgagctggttgtgagttggggagggacagggtcgcggtgcgagcacccgtactattccaagccttccaggcattagcctttcagaatgaacaagagtatgacagcacgcctttaatgctcaatcgcgacgatattgagttgcatagaggaatcgtgcatgattcttgccacgtcggctgggggcggggtttaggtccaggaaacggactctcttgaaaacgaccccgcctccagggacaacacacctcgatcgcataacacaacaagcgcctctgtcgacgtctaggtcctcttgcacttgcattttcgctacactattcattgcagagctcctcacgcttggaaatagggaagccaacatcagcgcacagaccctttgcacgggccgtgcggccctcttcgagctctccgggccatccatggatggtcgaaaccctggtgcctgaatcgatctagagtccgggctccgatagagacgtccccgtccgtgctggtggcccgcgggcgatacggatcaggaggacaggtttaggtgcctagggcgtgcaggcacagactgagaggcatcgatggtgggtaggcggtgctcctgcaatgctcgagttgctgcacatgtgcagtatttgcggtttatagctattctggattgccgggagagcaaatgccgggattctgcgacgctgcgcgcccgagcccgccaggcaaggtccaaactcaaacacatcaatttccccgccatctcgcagcaaatcgacaccgctgctcatcagaaggcatcatgtcagatcaagagtctggaggcaagtgcagggtgcgtgccgagggagtgtgctcggcgatccgaggccgggcttcgcagtcgagcgaccgaatcatccccacacacatcccaggtgccattctctgagtcttggaacagcctgcatcagagtgagaccgcgtccggcagcctgggccccctcctagcgagcagcgatggcagcagcctaaccatcgcggcttgggggggccttagcgtggacggacatccgggtgctggtacatcgtggcgggacagctccatttcacccatgtctcgacccccacttggcctggaacagcaccccgcaccctccatcgaccaggacatcatcggcatgctcaggtgtggtggccatgctgtacagtgcttcgtctgcaaggtccttgagagtcacctgcaacagggtgccccccactcaaaaaaaaaaacatgccacccgctcctcactacctccccctgagcatcctcaacccgtgcccgccccgctcaacccccactctgcaccccgggcatgtgttcgcagcgtggcgtaccagcaggaggcggagctgcgccccgacgccgagtacctgcaccgccactccccgacctcggcacggcacggcccgcgcctgtccgccggcatgcgccgcatgggcctgggctggatggtggaggtggcgctggaccagggcctgacccaggaggcgctgtcgctggcagtcagtctgttggaccgctacatgagcgcggcccaggtgagggtgccggcaagagaggcagccgtcgtgagcatggtccgtaccctgccagcctgatgccctcgggggcaaggctcacggtgaatgtggatcatccgaaaactgaccccaccaccgctcttcctccccccccccccccccccccccaaaaannnnnnnnnntagaactgaccccacacccgctcttcctctcccccccaccccacacacacaccagaacatccccgtcgcaaagtttcagctggtgtgcacagcctgcctcctcatcgcggccaagcacgaagaggtggggcccctgcttgtggggtgcagcaatggtggcgggcggtggacccctgcatgggcacatgcccttcacctctgggcgggatccctcagggcacgagacgctcgggtgaccgccgcggtctgggatgtgtcgatgccgcccaggatgcccctccgagctgctcccccccgcccgcctgggacgcaggaggtgcaccccgcagtgagcgagctgacgggcctgagcgacggctccttctccgaggccgatctgcgctgcgcggagctggcggtgctgcagacgctgtcctaccgcgtcaactgcccgaccctctacaccttcctcctgctgctgaaccgcgctttaggcctcaacccccgctccagcgcgctggcctgctacctcacggtgtgctggcgcggatgttgtgcagtatgatttgggttgcagtgtgtgggggctgggtggttggccttgaggagagtgtgagggattgggcggttccctgtgacgaagctgctggctgtgatggtgggttgggtgagcccctgggtactggacatctctgattcctcctccttcccacccacctgatgtctgctgggcctctgaccccacttcctccccccctctctgccgcaggagctgtccatgctggagtacggcatgctcgcctttgcgccctcgcacgtggcctgctccgccgtggccctggccaacctctacttcaatgagcccctgcccatgaggtaagccagctggtggtcattccaagaaaggagggatggtgaaggggctgggcgccagggagcgcatgcgcgccacgctctgcgtgacccctccccgccagatggtgttcgtggtcacgactcccccgtccccaaccctccccaatccccttcgtttgatcccctcccccgcccaaaatctctactccctgttgcagcgcgatgctggccaccatgccctacacccctgcctcgctgctgcccggcatgcaagccctgctgcacctgcatcaggcggcccacggcgcgcccaccggcaccgaggcggcggtggtgcgcgacaagttccgcgcctacgagtggcagggcgcgggcaccgtgcaccctttccagagcctgcccggcagcctgaccgcggggccctgggcgctgatgggtgcggggccgccgggcaagtcctaacgcgacgcgggggtgggtgggggtgggccaccggcccccgcccggtttccccgcgccccccacccccccttcgccgcagacacggagcgacgcccggtctctgcccccccctcacaccgcactgcatcgccagaccctcctccccgcacacacggggaacccctcatcctcctcgcccctgttcccgcactttgttttccacggcgccctcggtccggcccctggctcgccacgcagtacgcgtcttccggctctacctcccttcctggctcccaaccctgcacacctgacgcgtgatcttgccccgccccccgcccagagtgagggcggggggtggggcacccccgacggcccctgcgcgagtgggcgcaggtcccctcagcaccgccccacccctccaaaccagaccgagccctgcagctggtttttcaggcacccgcgcggcacccgctgcgccgggcgcagctgcnnnnnnnnnngcacggcagccccccctccggctcttggccaggaacctcacgggtcggcgccgggcccgggcccccctatcaccctcaacagctgtcttccggcgcacgagcggactccaacaccccaccacccaccatccacccgtgcttgaccacggctgtgcggcgccggcacgatgcnnnnnnnnnngttcccctcgacagctgtcttccggcgcacgagcggacttcaacaccccaccccccaccccccacccgtgctcgaccacggctgtgcggcgccggcacgatgcacgccggctgcccattgacccggggaccgagactggccaggcccgatcaccctgccccaagccgaggggggctttgcctgatgtgagcagaatttccgtaccaaatccttttgaaagagcaccgaaggaccccccacacgatgccgacggtgttgccccaaacctttcctacccctggccctcccgtgtagctctagatttgctgcgcccagcaacacaacagcgcgggtttgggggggttgtcaaggtcaggggaaggggggtggagctgcggcgcatcccaggcaccaccccggggtccctgctcgttcagaagccgtcgctggcgaggagggagtgcagggcctccaccaccgggctccccgccaggctcagccccggatcggcgatcttggcggcgaggagggaggcgaccgcggcgcgcaggtcgcgcacgagcacgccgatcctggcgggggccttgaaccgcgcccagccgccggcggtgagggtccccgccacgtgatccacgctgagctcgcccgcgaagagcaggatggcgtaggccggcacggcgctgctggcccggacgaagaccttgctggtgcgcacgatgtcggagtagaccagccagccggaggggaagcgccccgccccaaagttgcaggaggaggggtgcaggaacacgcggccgcggctgcggtcatggaagcgcagctcggccgggtctgcgtcgatctgcgcggtgcccccgtgcactctttggaacttgggcggcggtgcgtccacgcgcagcaggttggggtacagccccgccgccagcgcggccttgaccacgcgcgccgaggcggccgccgcgtccaacgcgtgtggcgggtccctggagggcggcgcatccaggcgcgccaggnnnnnnnnnntgtccagcgcgtgtggcggatcgctggagggcggcgcatccaggcgcgccaggtagccgccgtccacaaagcccagggcctgcaggatgccggccagctggcgccggcccgccagcacgccctccatgccctgctgcgacaggaagttgtcacgcgcaaaggcgcctcgcgcgccggggccgcccgccgcgcgccaggcgttgtacgccgcgatcagcgccaggtggtccgactgcgaccccgccaccgaggccgtgagccggcgtcgggccgcgtcggcctgtgtggggaggggggaggggggaggagggcagcatttctgtcatttgtgtgggggatgcgcggcgggggagccatcaggtgggcggaggtctggggggcgcagctgtgtgtgcatgcagcccgggcgcgggccgtcgcccacgcatcccctccaaacaccacctcccacctcctcgcggnnnnnnnnnnccgggccgcgtcggcctgtgtgggtggaggggggggaggagggcagcatttctgtcatttttgcggggcatgcgcggcgtgggagccatcgggtgggcggaggtctggggggtgcagctgtgtgtgtgcatgcagccagggcccgggccgtcgcccatgcatcctctccaaacaccacctcccacctcctcgcggatggcgtgggcggagaggaacatgggccggccgtgtgctagggcggctgccatggtcagcaccgggtccaggcagcagagcagggcgccgaagatgagcagctttccgatggccgggtcgcagggcatggcggtcaggtggcgacccagcggggtcaggaccaggggcgcggcatggtcgtcgcgcccgtcggggcccgccacggtttccagcgcgccgatgtccagcagcatgtccatggctgggcggcggagaagtggagggtgtgtgtgtggtagggaggtggaaattcagggggggccgagcacagaggtcaagagtggggcagggagaggcgctcagcagggaagcagtggtagcgcgacgaaggcatcacgcgtcatgcaggcgggccacgtgagcagggaacgcacgctgcgccgccccgttcctccccccggctcgacaactcaccatgctcgagggcggcggggcggggtggcgtgagcatggcgcgcgcggcggcctccacgtcggcggagctgcctaggatgcccttgatgtctagcacaaagcccttcagtcggaggaggggcggggggagaggagggacggaggccaggtgagtcaacgacgcccatgtgctgacaatgcaaggagggcagccgccgccctgtgccgtggcagggtggggtgcgggcctgcgccagcacctcccaaaggcatcattcctcctggcccctccactctccacctttgtgtcagtcccagggcgcgccaaacccacctctnnnnnnnnnnagcatcattcctcctggcctctccattctccacctttgtatcagtcccagggcgcgccaaacccacctctcccacgtgtatctacctgcagcgagacgcggtggatctccggcgcggtgttcttctccagcttgcgccacgtggcgcggctgaacaggcgccagcaggtcccaggccgtacgcgccccgcccgcccacgccgctgctgcgccgaggcctgcgacacccaggtctccgccaggcggttgaggccctggtcggggtcaaacgccatctccttcacccgccccgtgtcgatgacgcacaccacatcgtcgatggtgatggaggtctcagccacattggtggccaccaccaccttgatgcagcctgcagggcgggggcaggaggtcagcaggggaggcatgtaccaggggccaggaggggcacagaggggcgaggaaagtggagtgacgcccccggcgggcacgcgccggtgtccctctgcccagcaccgctcgatgcttgactgcactctgcgccgtcgcacctttgggcgggcgctggaagacggccgactgctgggcggggggcaggccaccgtggaggggcagcacgtgcagcggttggcgcgaggagcgcagctggcgcaccaccttgtcgatctcctcggcgcccgaggcgaagatgaggatggcctgggccgggcccttggagaacttggtggcgatgacgtgctccaccaccgagccgatgagctcgtagttgatcgtggcctcgtcgatggccgccagccccgcccgcgtctgctcgctgtactcctccagcccacgcgggatgggtgccgccttgtccttgacctccttctttccacccgggccgtcgcggctgcttccgcgggagggcggccgggtgaccctgaaacgcgtctgctccagggcatcctccaggtagtactctgtgtgagggaagggtgggctggggggtgtggacggaggtgaggagtgtggcggggtgatgggcagccttgcagtcaagactgctgggctccatggaagtccccattccatgtgccccacgggcaggtttggggcagggaccggtgccagcctccgccagaccggggccacacgcccatgtgatttttggcacaggcgccaggaaatcccgggctccccgcgtgcaggcagggccccctgtggctggcacggtcccacccagcgactcaccggtgacgggatgggtgaaccccgggatgaccacccgcgcggtgggctgccccagggcctcctcaaagtatgccgcaaacaggtcggcatccgctgtggcagacatgagcaccaccttgaggtccgggttcctgcctgcaggattggggggtgggtgcaaggaggccgcaaggcatggtgtggaggggccagaccagcgtttcgagcggcatcgctggtgcaggccggtgcacccccagcgtcgctgacggctgcgcagtcgcgagtatcgacggcgcctggccagcatgctcgcactgcgcggtcgccaccagtccaacacccaccagtctcaacccacccgactggagcnnnnnnnnnngccgcaaggcatggtgtggagggggcagaccagcgtttcgagcggcctcgctggtgcaggccggtgcacccccagcctcgctgacggctgcgcagtcgcgagtgtcgacggcgcctggccagcatgctcgcaatgcacaggcgccaccagtccaatgcccaccagtctcaacccacccgactggagcagcttcttgaggaggagcagcagcaggtcggactccaggcttcgctcgtgcacctcgtccaggatcacatgggtcgtgccctccaggccggggtcgttgagcagccggcgcagcaaaatgcctggggcgggccgggcgagggtgggaagtgggggggtgaggttgggtgggcgaggccgggcggtgggcggggcaggtagggtgcctgctgcgacgtgggtgcctcgccacggcgcaacgtgccttgaggtgccgcaggccgaagattggaacgagctggaaagacccatgggcgcatgatcggcctggcttgacgacaatggagggcggcgagcgcgccccacgggaaccccccccctggaccttcccaaggaacccacacatgcacccacccgtggtgcagaagaggaggcggnnnnnnnnnntatgggtgcctcgacacggcgcagcgtgccttgaggtgccgcaggccaaagattggagcgagctggaaagacccgtggatgcatgatcggcctggcctgacgacaatggagggcagtgagcgcgccccacgacccccccccccttgaccttcccgaggaacccacaaatccacccacccgtggtgcagaagaggaggcgggtgcgggcgctgcgcttggagtcgagcttgaccgcgtggcccacgacctcgcccgccgcctcgccccgctctgccgccacgcgtgccgccaggcccacggcggagatgcggcggggctgggtgaccacgacgtcgagcgcgccgcccgccccgcgcgccacggcgtcctccagcagaaactgtgggacctgggtggacttgccgcagcccgtggcgccctccaccaccagcacggcggcgccggccagcccctccaggacggcctcccgctgcgcggcggcgggcagcgcggcgcgcacggcgcgcatgcccgcatgc

SEQ ID NO: 46095 - DNA, 74 bp, Chlorella protothecoides
ggccgaggcccccgccacgatcagcttgggtctggcgtgcattgggttgggaggagggtgtgggcagcatgggg

SEQ ID NO: 46096 - DNA, 77 bp, Chlorella protothecoides
cccatcgtctgtcgtatctctgttaaatctgtaggtatgttggtcatcaatcacttgtgggagctcaatcagatctg

SEQ ID NO: 46097 - DNA, 61 bp, Chlorella protothecoides
agtggcagaagctggtgacagctgcaggggtgagacagtggagggggtttgcggttcatgg

SEQ ID NO: 46098 - DNA, 80 bp, Chlorella protothecoides
gtcacccagagtacatcactgagaactcaccatggtccttccaggccgcggggacgtggtcgctccagtttccgcccaga

SEQ ID NO: 46099 - DNA, 61 bp, Chlorella protothecoides
cggcaacccggggctcctgcaagctcttcttggcaacccggggctcctgcaagctcttctc

SEQ ID NO: 46100 - DNA, 62 bp, Chlorella protothecoides
gctaggaagtggcgggacatttccagcatcgcagggaaagggaaggtgttaagtctgctgct

SEQ ID NO: 46101 - DNA, 64 bp, Chlorella protothecoides
ctgttgatggcacatgagctgtcgtcacacaaccactgcatccgtgccaccctctctcaagggc

SEQ ID NO: 46102 - DNA, 73 bp, Chlorella protothecoides
gacttcctgattgccaatgcggggacgcgatggagcattaaaatcatcgccgcctccctcccccaagcccgcc

SEQ ID NO: 46103 - DNA, 73 bp, Chlorella protothecoides
cagcgagctggccatcctgcgaccccttgtacaaacccgaccccagtgacgctcccacgtgatacctgacgca

SEQ ID NO: 46104 - DNA, 5129 bp, Chlorella protothecoides
  modified_base (235)..(244): a, c, t, g, unknown or other
  modified_base (754)..(763): a, c, t, g, unknown or other
  modified_base (1945)..(1954): a, c, t, g, unknown or other
  modified_base (4527)..(4536): a, c, t, g, unknown or other
cggggcgagggcggggacgccgcgggcgccatgcccgccgcgctggcggcgctgggaagcgcggcacgctgcgccgcggacccccttgctgcgcgggcccggcttgtgctggtcagtggggctgtgtgagtgagggatgtgttttggggggggcgggaggaggggaggttgaataatcgagggcgggtttgatcgcgctgtgcccgattacccaggggcgaccggaaggcaggcnnnnnnnnnncggggggggcggggggaggggaggttgaatagtcgagggcgggtttgatcgcgctttgcacgattacccaggggcgaccggaaggcaggctccttggtcaccgggccgactcgtcgcgattgtgccagctgtgaggctgtggcggcgggcactaccagccgtcctctgacctctgcctgactcaagaagatccgacagcaaaggcaccacgtggggacctaccacccccccacccccactcttcacaggcccggatcctgtgccacctgggcgaagcgcgtgcagcgcagcgccagctggacgccgcgctgccggtggtcctcgcggcggagtcccgagccctggttggagaggcgcacttgacgcaggccgagtgctggcttgcagccgaggacggcatggatctggccaccgaggcccgcgccaggtgcgccattccactcgggatgcagagagggtagcgggggccacagtcgcgcgcaggcggcgtttggctcggcgtccactctnnnnnnnnnntacttgggatgcagagagggtagtgggggcctcagtcgcgtgcaggcggcgtttggctcggcgtccactcttcctgtcagaccgtggggtccacgtcactgcgatcaactccctgtgccagcttggtcccaaaggtcgtgccgtctgactttgcgcccggagtccacagcgcaccttctcccggccgcagggtgcgtgcgagtctggaggctgcgaggctggagttccaggcagcgggtgaggcctggaacctcgaccacgtggacgaggtgcttgccagcctggcgcagggcccgtgatggggacctgcccgagagcacccaaacggctgatacctggcgtactggtgacacggcacgctgtgatgccttgcggccgaggcctgacaatgaccctcaccccttcagtgccgcgcccaccgcaccagagaatgcatcgacccttgtgactgaatagtccgcaacaccgcttgtcatgcccccttcacccccgctaacccagtctcagaggcatgtattcttggggcttgaccttgcagtcagactgcaaaaaggagacacgctgcgcgctctggggaaaacgagctcacgagtggctggtgacgggcacgaggtggagcgccctcttcaggagggtccagggcgccggggtatcgagggtcaccgccccgaggttctggaggatgtgcagaatggccgagcagaccaggcagaacatgaccaggaggctgatccagaccatcgccatctcccagggctccagcatgtagatgcccaggccgaagatcatgtgctcatacacgcgcttcacccggctgtgacggtggttgtgcaaggggtttggtcgggaagacgctgctaccacaagcagggctgcctcgctgtgcgactcagtcagcccaccccctcctggtctcgcacctgtaggcacgggtgatcacgttacgctctctcctggccttttcctccgcgaggattgcctggaagcgggcgatcatctcgctggggctgggggtctcggcctcgccattttgttcaaaggtggtactgggcaaggggccggtcgacctcctcctgcgagcgcacgcgccacaggtgtatgtcttcattccatgcatagtccagcaacatgccttgtccaccattgaagactcctgtaacacacctgtgtgcacgcgtctcnnnnnnnnnntaggtgtatgtcctcattccatgcatagtccagcaaaatgccttgtccaccattgaagagtcctgtaacacacctgtgtgcacgcgtctccaccgccatcgttccgtctagccaaggcgttcacacacgctgcgtgaggcccgacggctctcaagctagaaattgggtatccttgagtctccctggcgcagtatggtgggggctttagagatacctctcactcgagcagctcgactcccgtttcaaagtgggcggaaggcagtgcgtagtgccgtcgctgacgcgttgctgacggatggtgagagcgaaagaagatacgcgaagttataatatatctgctcggtgacgaatgtgttgctgttgtggcctgctcctcggtgttgaggggtgcccttgccggtgctctccccagccccgcgccctggccagctgcgcacttcccgtgtttcgagggttgcgcctctgctgcgatccttagcaacacacacgcagtaggcatgtgagctcaagcatctttgaatgggatgcaacagcatctgtcttcagtggccagtgctccccagaatggccaagatgctcctcagtccttgttggtgtacccaaagtattgcagcatgggcacctgtgtgtaaagcagtcacgagtggggttcaaacttcccacctcatgcatccagggtcacccagcctggcccactcctacgcagcccatggaacataccacgaatgagatggcgaggagggtgagcactatggtggatgtcaccggcttcttctgctcggtctccgccttggtcttgtacgtcctacgccgctcggtgtcggcacgctggggggcggcaggcacctccttcccctccagccgagcagcaatgcgctccacggaggacagcacctagggatttcgggatggacctgctgagtcgccatgctgtggcgcccggaatgcggctcgtgcaggggtggctgccaggcaaagtgtgactcggaaaaaccctccctggctcacagtcgcattgtacttctcctgctcagtcaggatgggaatgttctcgcccaccacagagtccacaaggtcctctccgacggcctgcaaaggtggtgggtgagggtcaggggcactacgcttgcatgtgtgggtagaaggggtgcacgactcagtgcaatgaagcaatcatatacccttgtcacgacagccaggctcctcccagccaatcagaccttgacaaaggcagggccgccggtgagcgcgccgtcctttccggtggtgacaatgagcaggatgccctgcttgtccggctgcccataccacttgccaagaagcttgtcacccagcgcaaatgcatctggctccacctccagcttcctcacggttgccacctccagcctgtatcccgttgcttcctgtgagcgggatacttcatgatcagtcccctggcttccagcaaaaagcctgcctgcaaaatcaccaccgctgaaacgtaggtgcgcccgtgaaacggcatgcgacccatccaccaacaagccccaacatcacctcaaggctcttcagccgagaccccagctcgctgcgcgtggtgcgattgagtactttggcatcgtcgatgatgtactctgtgggcgttccatcgcccaccaggtcggcctccgaagctgcggccggcaggcaaaccgggctggccacaagagacaaggcagctccggctgctacaatctgaggtgcggggatatggtgctaggaaattcaatcacgttccaaaattgatgctcgggctgaggcgagcgcacgggcatggtcgacagagtccctgtcgtatcgagcgtcattgcggaactctgccgtgcactctcacaccagcacacatagtccgtactgaccatgccagcgacgcggtgtcccagtccagtttccttggtcctgtgttcagcgacgatacattttgcggccaacacgcgaggtgtcgggcgagcgcatggacgtgccgagcggaccaaacatgtccgaccgccgtgcggttgcacactggttcccaagccgacgccgagcatgctggggggtgaatgccgaccgacacagattctgaaaatgtgttgtgatcgagagaatgcgaatggggtttacggtcgcgtgccccttccgtaaacatgctccatccctgtaaatccaacccgatctgctgtcaaccggtgtccccgaccacaggcagcgcgaatgtcgcccccggcgacatggtcctcgacagtcgtacgcgtagggtgatgcataggtaaatctcacactctcgcatgccgtgcaggggcatgcagcactcagtcgtcgcccaccccggcgtcctccggctccgcaaagaggagtttcagcttcggcaccaggctcggcagccggggcaggtccaccaggttgatgcgcatgagatcgaaggcgatgcccaccgatccctgccaaagaggttcgggggggtacttgatcgagggtggggagaaggtggccctgcacagcaggccatgggccctgtgggacagattaagttgctccctcccatgctcagcacctccagctcttgatgtcagcannnnnnnnnntgtgggccctgtgggacagattaagttgctgcactcccaagctcagcacctccagctcttgatgtcagcactcggcaggtacctcgtccctatagagacatgatgatgatcacccccacgaaacacatggttacctggaagtttgcgtcgatgaccgggatcttggggtagcgctgcgagaagtgggtgagcacggtgcggtaggcccccgccgccgccgcggtgtccaccgcctcgctggtggtgcagtggttcttggccagcgcctcttccgccagctcgtcctcgaaggttgcttcgtgcaccagcagggttgccccccgggcggcatcccgcaccgcctcgcagggccgggtgtcgcccgagaagaccagcttccagccggccgcggcctccagcgccaggccgtaggcgtgcgcgcagtgctccacgcggaagctggcgaggcgcgcgaggcccaggtcgacggcgaggcgcgccagcgccgcggccgaggcctccggcacgtcggctgcccccgggacggagcaggccacgtccacccaggcgcagggcgccgcctcgagcgcggcgtacgcgcccagcgcgcggcg

SEQ ID NO: 46105 - DNA, 67 bp, Chlorella protothecoides
atccaggtgcgcctgcggtctgtccgacaaccgatactggccctgcctagacccaccgccttcctac

SEQ ID NO: 46106 - DNA, 61 bp, Chlorella protothecoides
tcgagagctctccgatgccacgctcatgcccgagccgatacatccaaaaggatttttgaca

SEQ ID NO: 46107 - DNA, 61 bp, Chlorella protothecoides
ccaccccatcacccctgcgccgtcgtttccgggccccatcctcctccccacccgcatgatc

SEQ ID NO: 46108 - DNA, 61 bp, Chlorella protothecoides
cttccttttattttctacgtgcaaggtctcacagttgtgattttcgcagactggctgaggt

SEQ ID NO: 46109 - DNA, 61 bp, Chlorella protothecoides
ttcatggtagggcacataaaagtaagggaaagcctatgaggagggtgggagggctggcagg

SEQ ID NO: 46110 - DNA, 80 bp, Chlorella protothecoides
tcaagcccgtgccctgctctgtacaccaacttgcgacagcatgacaactgggtgctgggaaggctggcgatgcctcacca

SEQ ID NO: 46111 - DNA, 106 bp, Chlorella protothecoides
ggcaggcaagctgcaaggtgagtttgtgtacagcatgtaaggggacatacgagataaagatgggaacgttatcatatactgatctcctgccttgtcagtaatgcaa

SEQ ID NO: 46112 - DNA, 61 bp, Chlorella protothecoides
cacgcgcgacggcagcgtcttctgctgggaggggcgcgccgactacttccccgccggcgcg

SEQ ID NO: 46113 - DNA, 72 bp, Chlorella protothecoides
tcgaagcgagagatcgtggcgcaacgggatactgtgggatcttccaaagcaattctggttgcacttgatcaa

SEQ ID NO: 46114 - DNA, 65 bp, Chlorella protothecoides
aagcgtggggcagggttttgttccgcgagggggggaagcgtggggcagggttttgttccgcgagg

SEQ ID NO: 46115 - DNA, 130 bp, Chlorella protothecoides
ggagggagggggtggtaagcggcccggcgcacactacattaccaaccagccccatcccttcctcgacctcacaggaaacctggtcgaggtgagctttgccgagctggaggctgatgctgtgggcacgctg

SEQ ID NO: 46116 - DNA, 119 bp, Chlorella protothecoides
tccagcagccattccagcatgaaatacttggacgtcagatgagtctcccctacagcatgatcgtgagtgatttgacaggattggtgtttccattgccgagactcaggtcactagtcaca

SEQ ID NO: 46117 - DNA, 118 bp, Chlorella protothecoides
acctgcgccgcagcagcatgcagggccagctgctggacgtgaccagcaccgcgccgggcacacgcctcgtgcgcgtcgtggagcccggccgggacggcgggggcggcgcgggggccac

SEQ ID NO: 46118 - DNA, 61 bp, Chlorella protothecoides
cctttcgttgactcctgcgcggtgcacatctcctctgacctaccgcgtcaggacttgcacc

SEQ ID NO: 46119 - DNA, 71 bp, Chlorella protothecoides
gctgagtattcgtattctggaggacctggcgaggccctctggtgcggggaggcgggaagcctgcccgacag

SEQ ID NO: 46120 - DNA, 61 bp, Chlorella protothecoides
gggctcaggaactggctccaagggtggctccgagacaggctctggagagggctcaggaact

SEQ ID NO: 46121 - DNA, 78 bp, Chlorella protothecoides
ccgacgggaacgaatccccatcccccactggtttcccttccaaccctatctgaccagaccctgaacacggcgagcctg

SEQ ID NO: 46122 - DNA, 77 bp, Chlorella protothecoides
tgtcgaagtccaacgccgcccaagggcaccaagtaaatcacgctgggctgggttcccatctactgaaaggcatccag

SEQ ID NO: 46123 - DNA, 72 bp, Chlorella protothecoides
ggcaccagctgccgaggtggatgccgccctcgctcgttccctccaccactaaatcgcacccaagccccctgt

SEQ ID NO: 46124 - DNA, 90 bp, Chlorella protothecoides
gggggggggggggggggggggggggggactgggcctcaagtgccaggggagtccgcaaccccctgggtcgaaatgccatcaatcgaatcc

SEQ ID NO: 46125 - DNA, 80 bp, Chlorella protothecoides
ccacatggtatgcataggagacttgattgttacacactctacctgtcctgatttgcactttcagcaggctaatactgctc

SEQ ID NO: 46126 - DNA, 526 bp, Chlorella protothecoides
  modified_base (248)..(431): a, c, t, g, unknown or other
attcacgctctcgtgagtctgggtgccggtacagtggggcgaggcgggggagggttgggaacctgcgagggcagcctgcctcctcaaaccacgagatgtgcggctggtgcattctgccgtgcgcccctgccccatgtgcatgccgcggaaaggacagcgctccgcccaccctcccacacaccgcctgccggctcccgcccccacgcctcgcaggaaccaggtgaagctggacatgcggacctatttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtaagccggggggggtgcggggggggggtcgtcattggtactggcagttcttgtggtggggcagaaggggtgccagaagcagtccctgcactga

SEQ ID NO: 46127 - DNA, 10448 bp, Chlorella protothecoides
  modified_base (3245)..(3254): a, c, t, g, unknown or other
  modified_base (4097)..(4106): a, c, t, g, unknown or other
  modified_base (4412)..(4421): a, c, t, g, unknown or other
  modified_base (4564)..(4573): a, c, t, g, unknown or other
  modified_base (4965)..(4974): a, c, t, g, unknown or other
  modified_base (5362)..(5371): a, c, t, g, unknown or other
  modified_base (6005)..(6014): a, c, t, g, unknown or other
  modified_base (7555)..(7564): a, c, t, g, unknown or other
  modified_base (9900)..(9909): a, c, t, g, unknown or other
cgcctcgcacagcgcgcgcagcgccgcggccagcgcgccgggggacccgcccgcgtagcgcgtgcgcagcacgcgcgcgcccagcgcggtgtcgcccagcagcccgtccagctcgggctcggtgagcacgggggagcgcaggaccacttgctggtaggagtccgggccggggctgagcaggttcccgcgccgccccagccgcatctccaggctcatcaccaacccctcgcgcagcgggtcgatgggcgggttggtcacctgcgcgaagcgctgcttgaagtagtcgtagagcaggtggggcgagcgcgccagcgccggcagcggcacgtcgtcgcccatgcagtaggtcggctccgcgcccgaccccgccatgccctcgatcaccatcgccgtgtcctccagcccgtaccccgaggccgccatcaggcgcagcgcgtcccccgccgccatggcggggccctccagcaccgtgcgcggcggcacgatgtccgccaggcggtgcgtgcacgccgccagccagtcggcgtaggggtggcgcgacgccacgtccctggcgatgtccacgtgcccctggaactcgcccgtctccaggtcggcgcacagcatctggcctgggcccagccgccccttggccacgatgttgggcgcggaggagaagacgtcgcccagcacgccgacctcgctggccacgtagaccaccccgtcggcggtgcgccagaagcgggcggggcgcaggccgttgcggtccaggcgcgcgccgaccttcttcccgtcggtgaagacgaggagggcggggccgtcccagccctcctgcaggccctcgtagtagcggtagaagtcggccaccgccgcgtactcggcggccaggtcggggtggttgcgataggcttcgggcaccagcaccatcagcgcctcgcgcgcatccgtccccgaccgcaccagcagctcggccaggtggtccaggttggccgagtccgactcgcgcgcgtcgcagagcgggagcagctcgcgctcgcgcccgccccaagcctcggcgcggagcgcgccctggcgcgaggccacccagttcaggttgccctgcagcgtgttgatctcgccgttgtgccccagcaggcgcatgggctgcgccagcggccagcgcggcgtcgtgttggtcgagtagcggcggtgatacaccgcgaagcacgtgacgtagcgcgggtcggtgaggtcgcggaagaagcgcgccaccgcgcccgagttcagcatgcccttgtacacgatggtgcggcaggacagggagcagaagtagaagtcgggcgcgagctccggccccagctcgcgctcgctgcgccgctcgatcagcttgcgcacgatgaagagctcgcgctccaggtcgtcgccggccaggccggcgcgcgaccgcagcaccacctgcgcgatacggggcatggtggcgcgcgccacctcgcccaccgcggccacgtccacgggcacgtcgcgccagcccagcaggtcaaagccctccgcctcggccacggccgccacgatgccacgcgcggtgcccgccgcggcctcgtcgtcgggcaggaagaccatgcccacccccgtggagccctgggccgtgccggggacctcctccgccagcaggtcccaggggatctccagcatcagccccgcgccgtcgccggagacgttgtccgaggagcaggcgccgcggtgttccatgcagccgagggccgtgagggcctggaatgggggagtacgggccatgaagaggggggaaggcagtcgggatttggggttcgaggagggaaagggggggaaggagggcacggggagagggagcgcaggagcttgagcatgccctactggatctcctgagacgatcgtgcccgagaatgcgctcactgcacgcataatggccagtggccgttgcaggaaaccgtacccagacacaggatcttcctcacggatgcctcccagacacctccccacccccccaatccccgcatctcaacagggaatcctgaccttggtgacgatgtcatgggtgcgctcagccttcaggttggcgatgaatccgacgccacatgcatccttctcccgcagcaggtcctcgttgtccaccgccacgccgacgtagggctcggtgtcgggggccgggccgggccccagcaccggtccggcctggccgacgggaacatgggcagggcgggcgggggtggcgatgtgctcggaagccactgccctggtttccgctccgcgacgagtctgcagggaggggtggggggggcgcgacctggaggggactgggcatcgtcacgtgcgggcaccaaaccccaagcccagaccaccggaacccgcccgcgatccagaggcccaaggagacgtaccctgcgccggtgcagccgcggcttatttcctgtcacccccaagacagagacagggggcgctgcatgttgccagggtgcgcagggtgtgacttgcgctgccgtgtgggttgcccgagcttccatgagtcagggccccgtgcggcccttggaggggatgtggtgtgtgctagtgtgtcggctggaagggcgccgagatgtccgatgtgtgctgggagggtgtggtggactagggctatctacccttaacgcttcgccttaactttcctccacgtgcgacacgtgaggatttggatgtcaatctgcccaggccacagaacagggataaatcacgaaaagtgacccggcttggctttactcttgccacaaacggacactcccctcgatgtcccaggcatgaggaagcccttgcaccctgaccatgccttacaacatggtaattcctcacagctgccagtcaatgggttcctgcccgtcttttgccagccaggcattggcagcagagaagtggcggcagccaaagaacccccgagatgcagacaggccggaggggtgggctgctgtcagcacatggttgctggtcctatcgatgagcgcccccttggcctgcacacagcgtgggaggtgggcggtagctgaggctggtcatgctgtgcagaatcgcactccctgggcatgaccatggagcctgcacacatgcaggctcagatgcccccggccccgacccatgtccaagctggcccatcagcccaggccctcaatcataggctggtgcagccccaggcccacacatctcaccccgatcccccccttctggtctgcatccctgctctctccaagccccccacctgggcatggcggccccacagcagnnnnnnnnnntgcactccccgggcatgaccatggggcctgcacgcatgcaggctcagatgctcccggccccgacccatgtccaggctgcccatcagcccaggccctcaatcatacgctggtgcagccccaggcccacacatctcaccccgatcccccccctctggtctgcatcagaactctctccaagcaccccacctgggcatggcggccccacagcaggtaaacgacccccgtacgctcccgattcagcgtccggatgacggcgtcggtgaaccgctcccaccctttcttctggtgactcgccgcggcccccgaccgcaccgtcagcaccgcattgaggaggagcacaccccgctccgcccactgcacacgtgatttgagccaggggtcagaagaccgcgatgcctgcagcctcggatgacatgcattgctcagtcctctcatcggtggttcatcctttccccaaggaagttcctcaatggtaggcaacgtgctgtattcaacctccaatttcatatgcccagcaaaaaatggcgcgtccctgccctgtcctcccaccaaccaggtactccacaagcatgtcaccttgctgaggtccccattcccgggaggtgcgcaccccacgtcgtccctgagctccttgaagatgttgcgcaggctggagggcacagggacacctggcgccacggaaaaggacattcccatggcctgcccggggccatggtagggatcctggccgagaaccaccacccgcaccttgtcgatggggcaggtattcaaagccctgtgatggaaggaatgggggtttgaaaaggcaagcgaactggtccaggcagaggcatgctgcgcagnnnnnnnnnncattcaaagccctgtgatggaagaaatgggggtttaaaaaggcaagcaaactggtccaggcagaggcatgctgcgcagatctgggatctgaaggagcacgccaccatctggtacctgaagatctgatctcgtggagggaatatcggggtcttgccaccccactcggccaccaggaaggcctccaactcccggaaataggacgcgctgagctggtcggccatcaagtcccgccatgcaggggcgaggagctgggcgagccccgaggtgcctctgttgccgcggtcctggtcgggcctgcacgagggnnnnnnnnnnggcgaatgtctgggttcagagaagcctctatccaaataaatgtatcatcatgcatctgatgcgaccagtatagtgcccatccccctctcacgaggattgaagggcatgggtatccagggcagggtcctgtggcgcaagggggnnnnnnnnnnagcgaatgtctgggttcagagaagcctctttccaaattaatgtatcatcatgcgtctgatgcgaccaatatagtgccatccccctctcacgaggattggagggcatgggtgtccagggcagggtcctgtggcgcaaggggggcacctgcggccccagtcttcttctgctgcggatcactgggtggggacgatctcattggtgcttcatgctttgccttcttggctggatgcacgcccaggaaggcgtgcagtgtgccctggtgcgtcatgggccccgagcggtgcagggcctgagggcggagcagcgacgccacacagtggcaggtcctcagcatgcagcggctctatgaccgacgatgatacataattatcgtgtttgggaggttgagtgnnnnnnnnnnttgcgtcatgggcgccgagcggtgcagggcctgagggcggagcaaggacgccacacagtggcaggtcctctgcatgcagcggccctatgaccgacgatgacacataattatcgtgtttgggaggttgagtgcgggcgtggctccttaaggccggtgcacgatgatcgcatcggttcaaatcgctccatgtcatgtctcgaggtcaccaccctcgcgccctccggcatcatcccaaggcgccagaaaacggcgcgcccccgaccagcaggcgagcgagggtacatgtcgtgcaaaccagcaggcaagactctcacgcaagctaacacgggtatacatgtcctagcaaacatatctactccgtaacgcgccgacaagctatccctcgccnnnnnnnnnntctctcaagcaagcttacaggggtatacatgtcctagcaaacatatctacgccgtaacgcgccgacaagctatccctcgccgactctctgccctcccagtccaccgccatgccgaaagtcacacgcaaggatgccgcagaaccgctgcaggaggtcggaccctcgggtatggacacagagggcactccattgcccacgagtggaggtgctcctggcgaaaagcccaactttccccccttgtcggcgtacgagctgaacggcaaggtggtccaattccgtcgggtcccggtgcctcagcaccgcatgacccccttgaagacaagctggctagcgctatacaaacctgtgacggagaacctgaagctggacatgcgcatgaacctcaagagcaagaaggtgatggggcacagagtgaggtaggggcctgtgggaaatgttgtgtcgaccttgtagtcattcagcccgacactccggcccagcaagcctgcaactctctgaagtatggtacaatattgctttcctgtacaggtggagctgaagaccactgagaagacaggggagcttgccaacctccaaagagcagctgactttgttcaggcctttatcctgggtgagcattggtatatgggaatgnnnnnnnnnncgagctgaagaccaccgagaagaccggggagcttgccaacctccaaagagcagccgactttgtacaggccttcatcctgggtgagcattggtatatgggaatggcatccctcttcaaaggatcacagcatgccagggagcatgctgaagctcatcagcatggctcactagtttacatgtatgccaaggggtcgggactttgtcacagcgatcatgctgcgtccatggcaagccaggatgctgacgcccttggctcacttcgaccccaacccatcgttcaatcaggctttgatgtgaatgatgcgatagctctcctacgattggacgacctttacatagagtcctttgaagtgaaggatgtgaaggtgaggagaggtgggcctggtccttgaactaattcctgctggccctgagttcctctgaggggaggcccaagagcttctgagcgcagcaggttttaccatctagcaaggataattgcagtgataggtcaacctcgcttgtgtgagactcccaatgcctcagcccccttgccggcacaagctgcagcctgctgccacgtggctctgcaaaacagctcacacgcccattacctcacagaccttgagaggcgagcatctggctcgctgcattggccgtctggctgggaagagcgggaagacgaagttcacaattgagaatgcgacgcgcacgcgtatctgcctggcagacacaaagatacacatcctgggatcgacgcagaacatccgagtggcacgggatgccatctgtgccctgattatgggctcacccgccgggaaagtagccactcgtctacgcacagtctgtgcgcgcttgaacgatagctactgagaggcactgcatgacctcatcacaattctgatcagagctcatgtcaagagggccaggcctgtgacagatgatttagttctggcggaagctttggaactgagcagatgaaaaggattatgaagaggttgtgcgacaataagtatctcgtaattcatctttctcaggagctccgcctcagcttcacgccgctgactgcggctgatgcaggtcatttgataatcagcccaagaccccctccgaggccgtacgagtttattgaacggtgcattaaagcactcctgcattggcaaaaccagacgataccattgataggttgtggaaccctcatataggatgacgggcgtggagactctgagccccgaggcggacagccaaaccaccacctcccccgcacagtgagttttgggaggatgggcctttgtctcctcccgaactctgtcgtaaacaattctctccgtatcgcagagaggcgacagggaagctattcctcggaggtctgtcctgggatacaaacgaaggtgagaagggggtggggtagccctggggtgccctacgcgcatcctcatgaacctaactctcccacccgccgcgtctcccagatacattgagggaacacttccagaagtatggcgacatccgagaggcggtaagtgccagtcgcgagtccgccaaatgttcccgctggacctnnnnnnnnnntcagaagtatggcgacatccgagaggcggtgagtgctacttgcgagtccgccaaatgttcccgctggaccttaaagtgcccactcacgacctactgcccgtccacgcactcccgcaggtggtcatgcgtgatcgacaaacttcccgccctcgtgggtttggtttcgtgacctttgagaagtcggaggtcgcagatgctgtcgtccaggagacccacgtcgtggatgggcgacaggtgaggggggtgcagattttgggggactggggaggagtgtggtaggagtaggctgaggggccctgctgcagctacgaccttggtcatgacctgcactccacaccagggtcatcaccaaaccatacatacagatcgatgccaagaagtcggtacccttggagcagaagcccaaggcacgcaagatctttgtcggtgggcttgcaccagagaccactgaaggtgatctgggctttttgagtggagatctgggctgtgcagctggcaattgcatcacaagagggacctggctgctttgtctcaatcctgtgtatgggatacatcctggcaagccgagtaccttgtgtccctgacattagcatcggccagaaatggtggcttacccgcctgcttctctcgttgccgcgccactatcagcgctctcagcttgacaatccgtgcattgtaccacagaggccttcaagatctactttgagcagtttggggaggtcgtggaagcccagatcatgcaagatcacatgagtggacggtcacgcggcttcgggtgagtgtttttccggtgtgtcatactggttggggcactgcctgtatgcggtcaagtaagcacatcacgtcctgaatgtcatgaatgaatcacaggaacaatccccttgtgctgccactggatgcttgcatgctggattgtggatgttcatcatgttagcgacgcagccctgactcgaagtcttcagtcagatccctgccgctgtccattcctgtgcatcatgcgctctcacctggagcccatctcacattccccgtctcagcttcgtgacgttcgcggaggatgtctccgccgagcgagtttttgcggccggcgccatgcacgagctgcgaggaaagcgcgtggaggtgaagccggccacgccgaagggctcgggcgtcgccacgcccgccgcccccgcccccgcccgcatccctcgccccatcatctaccccagccaccagggcccctttccctttgtcaccggccaccccactgcctcatacgcgtatggagtgtacggctatccgcccccgggcacgccccacatgctgccagcaggcagcgcctacggcatgcagtaccaccccaacccttatgtcatgatgcagcaggtgccgtacggcgccgcgccggcgccggccggtgcctacacgccgcccgttccggggtcgccctacggcgggccctccccctccctgcgcatcgccaagcccccgtccgtcgctgcgccggcggcagggggtgcggagtctgccgccaccgccaccccgacctcccaggccatttcggacctgcgaaagctgaacctggactgaatggatgatggaactcgcggtgtgctgcgtgcagagcctcagcatgctgtgcgcaaagcgttgtgcggagcaccagagcgatgcgaatgcttccggtccgggattgtgttactggaaaagagcacactccaaggcggctgccagagcgtctggcaatgtccttgcctacctgacgctcgctgaggctcccgcatacctcggccaaaacccaggagaatcaatttgtcctgcttgcccctctccgtcccgcccctgctgcctggtcttcaacccttgatttttctggtgcctcaggaatacgcctcggtccccgtcttcgagtctctacacggggccccagccctcccttcaccttgattttgcacagtgtacattacaactcaccaagacacacacttttggagttgttggggtccgggttgagtccagtcggcaacagtttggtgccgcccacctcaataactgcttggcgatgctgcgggtgtgcaacagcggctgtgtgggattgccaagtaccctcgcatgcacgtgccgccaggctcgtgcatgcccagagtggcgtgggccagactcgtcgttaatgaaatgcccgagctgagctgcgtcgtgtcgcttgcggggtgccgcgtgggactgggcaagcgagaaggggcccggatggggccccagacgccctgcatgcgcatgccccctcaaacagaagggcagcagcgaggcaccgggagcgacagcctcatctcctcattcgtcctcgctctcctgcnnnnnnnnnncgccaagcacccccgcctgcatgtgccgccagactcgtgcatgcccagagtggcagggccagactcgttgtcaatgagatgcccgagctgggctgcgtcgtgccgcttgcggggtgccgcatgggacagggcaagcgagaagggacccggatggggccccagacgccctgcattcgcatgccccactcaaaagaagggccgcagcaaggcaccaggagcgaccacatcatctcctcattcgtcctcgctctcctgctcctccgccttggcatcacctgcagcgacagcctcctctccctcagacgcctcgctctcctgctcctcctcctcctctcctcgtccttcttcgtcgctgtccgtgacgcagagtgccgggtcgcgctcagtgctgacgaagaaggcgagctcggcggcggccgccgcccgctcctcgcccggctcgccgccccaggcctgggccgcggcggccagggcctccagcgccccctgccctgcctcctgcagcaggtggggcccgacgcggagcgggtcggcctcca

SEQ ID NO: 46128 - DNA, 61 bp, Chlorella protothecoides
cactcaatagccaagtatcagcacgatatacaacatgctctttttcaaggtgctgagcagg

SEQ ID NO: 46129 - DNA, 76 bp, Chlorella protothecoides
cagcgcgtctaccgtcttcaggtcggcctcggggatggccgccacttccgaccagtacacccagttgcggtgcctg

SEQ ID NO: 46130 - DNA, 77 bp, Chlorella protothecoides
tgaagcgaaggggcgtcttttgagaattctttgcctcatgagaatcaggactttcttgtcagaggggtgtcccctgc

SEQ ID NO: 46131 - DNA, 80 bp, Chlorella protothecoides
ccagtccaagtgcccctacttgccacccaactacaaaaccgccctcaacccccacctttcccattgcctcaaggtatcgc

SEQ ID NO: 46132 - DNA, 68 bp, Chlorella protothecoides
gtcaagcgggcggcaccccaaggacaccttccagcacgactccgtcagcctgtacactccagccccac

SEQ ID NO: 46133 - DNA, 80 bp, Chlorella protothecoides
ggctgcatcccggaactccctgtgtgtaaatgagggaatttcagcggggttgaaggcatggatacttgcaccgggggcac

SEQ ID NO: 46134 - DNA, 61 bp, Chlorella protothecoides
cctgggccatactgtccctctgaggcgtccaccctcccagccaatatacccctggcaccac

SEQ ID NO: 46135 - DNA, 142 bp, Chlorella protothecoides
gaccatccgtctgcacctgcgggagcaaggaggaggcgggtgtgatctcagccccactactgtctcatgagacagcatgctctgatttcccagcaagacattctcactcaaacataccttgatgagcatgcgatactccaat

SEQ ID NO: 46136 - DNA, 7855 bp, Chlorella protothecoides
  modified_base (412)..(421): a, c, t, g, unknown or other
  modified_base (1048)..(1057): a, c, t, g, unknown or other
  modified_base (1732)..(1741): a, c, t, g, unknown or other
  modified_base (2845)..(2854): a, c, t, g, unknown or other
  modified_base (3891)..(3900): a, c, t, g, unknown or other
  modified_base (4581)..(4590): a, c, t, g, unknown or other
  modified_base (4674)..(4683): a, c, t, g, unknown or other
  modified_base (4946)..(4955): a, c, t, g, unknown or other
  modified_base (5202)..(5211): a, c, t, g, unknown or other
  modified_base (5435)..(5444): a, c, t, g, unknown or other
  modified_base (5970)..(5979): a, c, t, g, unknown or other
  modified_base (6254)..(6263): a, c, t, g, unknown or other
  modified_base (6568)..(6645): a, c, t, g, unknown or other
  modified_base (7551)..(7560): a, c, t, g, unknown or other
caatccacccccccccccactccaacacagggagggtaccgggcctgcaaccggcttggcatctccgctagcacctccccctttctgaaggtcacgttcgagacggcggcctccttcctggtctcctccaccctgcacggcgacgtggaccgcctcacctcccccgcctcccgcatcgtgctgggccagcccgtggccatgggcacgggggccatggacctggtgcagcacctggacgcggcgcgctgagtcagcgcggtcgcgctgagtcagccgctgagtctatgcggctcgctggcggggaccgctcgcgggctcgggccgatctctcctctgcagcggcgcatgcattgcccttgcgtgatgtatgctgttgcagcgaggctttgtcagtgggaaaggcgtcgagagnnnnnnnnnncgggaccgcttgcgggctcgggccgacctctcctctgcagcggcgcatgcatcgcccttgcgtgatgtatgctgttgcagccaggctttgtcagtgggaaaggcgtcgagaggcgtcagggtctgcgccatgcaggggggagccaaagtacacattctgaggaggaaaacactacaagcaaggggcctttggtccttctcaggcctccgcagcagcctggagcttgtgagactcccaggccaggcaggcccgggacacgttggtgtccagcgcggccagcgggcgcagcgcgttggcccgcagctccagctccgcgacccgggccgccagctgcgcctccagggcctcccgacgggccgccgcgcgcgccaggatggactccagctgctcggcctcggcccgtcgcgcggcgtgcagcgcggcccgcacggcccgcgtggggcgatcctctcctgacagagacctgcgagtcgggttgggaggtgccggaactctacagctaactcctgggctcgtgggcgacattgactgaccacttcacgccaggtctctcttggcaatcacctgtcagcgtcactgtcaacggcagccccactggccatgtcgtactacgaaatcatgatgccnnnnnnnnnngcccaactcctgggctcgtgggcgacattcactgaccacttcatgccaggtctctcttggcaatcaccaggcagtgtcactgtcaacggcagccccaccggccatgtcgtactacgaaatcatgatgccaacccccacccaaccgcttgcctggcgtgagggtcatccgacacgccctgagcctcgcacagctcctccagctggtgcagcttatctgtcagcgccgtctcctcgcagatggcgtcgaagtcggactcgatgtggactcgggatccatgcaggacctgggggggcatgttcaaatggagggaaatgcgctaccagggtgtcctgtttttgcgttcacatttggaagtcccggtgccaagtcgcagcccaacccaagtcacctgacgatagccttgccagaggatctccaggagctcgggttgaatgtttggaaaacactcggcgaattgctcctcatcggcgccccgcagtgcatgcttgatggtccgtccatacgcatctgccagggcgctcacccgcctgccttggcgcggagcacactgcttgctggctgtgcgtgggggcgtactctgctgcatttcggacctggttggtgtcaggcatttgcgcagaagtggtatgaagggaaggacgtgtaacgtagtgtcaggcactcgctcgaactgnnnnnnnnnnagggggcgtactctgctgcatttcagacctggttggtgtcaggcatctgcgcagaagtggtatgaagggaaggacgtataacgtagtgtcaggcactcgctcgaactggctgacggaggcctggttgtaatcgaaaggtgaagaaagatgggaatgggaggagggtggagacgtccgtgctagtgtgctccatcgcgtgtggtgttccaggggtcacgatgatttggagccatccttggtctgagctgagagttggattctaacattgtgcaatcgagccgtttctggatcgcgtgatctgcagcccgggggatcactccagaccacacctcggggccgaggtggaggggcaatccccgcggggcagcgcacggccagtgcatgggacaaaatcaaagcgctccaggttctggacaaggaggacctggagacaagcagaatgggcaggtgaggcctgagcagcgacgacctcaacttctggttccggtgatcccctcctcagcctcccgcccttcccgctccaggagaagaagaagaagtatgaaccgcctgcaccccctccccgcgtgggaaagaagcagcgcaagcggggtgcaggggccggcctgggcagcaagctccccaccatcactcctaccagcaagtgcaagttgcggttattgaagctagagcgagtcaaggactggttgctgatggaggaggagtatgttaccaaccaggagcggctggcaccccaggaggaacgcaatgaggaggacaggaccaaggtgagatgggagttgtgagatttagtcacaaggagttcctgtgtgccgcggcatgcggcagctatgtgcctttggaccactcattgatgccttcaagaaaaacttcaactgcaggtcgatgacctgcggggcagcccactctcagtgggtactctggaggagctcatcgatgagaagtgagtagagggctggatattgtattcacatgtgtaagggaatcgtctcctccctttgacttcatgcaaaggataggagaacgtgattcgtgaagtaaccttgcaacatcgctcggcatcctctcaattgtgcagccatggcatcgtttcgtcagccgtcnnnnnnnnnngcgtgattcgagaagtaaccttgcattatcgctcggcatcctctcaattttgcagccatggcatcgtttcgtcagccgtcggccccgagtactatgtcaccatcatgtcatttgtggacaagacacagctcgagcctggctgctccgtcctccttcataacaaggtatggtgcgctgagatcgatgaggggtgcatagtgctctttagcccttgttgagtactgtatgggattgtcattgtacacacgccctgcgcataatgtcacctgcctcgtgtcttcttgtgccagcgacaccactccccacccacacgctcctgcagggcatgcacgtggtgggcttgttgacagatgagtcggaccccgcagtgtcagtcatgaaggtggagcatgcccccaccgagtcgtacgccgatgtgggcggtctggaccagcagatccaggtccgtgcagtatgctgttgagtggctttcttttgataagggtcgacatgggaagtcctaggagcacaggcggtccaccgagcagaccgctgatgctgttgccaggacaggcgcctctgccctgctccattgctcaatgtcccgtgctcgaccggtttccccgcaggagatcaaggaggcggtggagctgccgctgacgcaccccgagctgtacgaggacatcggcatcaagccacccaaggcaagcaccttggctttgcatgcatgatcgcctgggagcccgggcgacagagcatgctttgttgacagcttgaatgttcgactcacccctgctccccttctcagggcgtcatcctgtacggcgagcccggcacgggcaagacgctgctggccaaggccgtggcgcactccacctcggcctccttcctgcgtgtggtgggcagcgagcttatccagaaatacctcggcgacggccccaagctcgtccgcgagctcttccgcaccgccgacgagctctcgccctccatcgtcttcatcggtgtgtggagtgggggccactggattctgttcctcctttcaggctgccttccctgcnnnnnnnnnntggtgtgtgaactgggggcgactggatcctgttcctcctttcaggctgccttccctgcccctggccgagctcttgcacgctccacccaccccctgcaccatcatcacccccctcatccacccgattcccgcagacgagatcgacgcggtggggaccaagcggtacgaggccaacagcgggggcgagcgcgagatccagcgcaccatgctggagctgctgaaccagctggacggcttcgacgcgctgtcggacgtcaaggtgatcatggccaccaaccgcatcgactccctggacccggccctcatccgccccggccgcatcgaccgcaagatcgagttccccctccccgacgccaagaccaagcgccgcatcttcgccatccacactgggcgcatggcgctggcgggggacgtgaacgtggaggagtttgtggtggccaaggacgagctgtccggcgccgacatcaaggccatgtgcaccgaggcgggactgctggccctgcgcgagcggcgcatgcgcgtcacgcatgccgactttgccaaggccaaggagaaggtgctgtacaagaagaaggacggcgtgccagagggcctgtacatgtgatggtgtaatggcccgtgcaaggttgtgggtcagggttggtacagagtggaccccggggtggggggggggggggggggnnnnnnnnnngggaaatcgtgagggggacggacaaccgaggatgaggggggtacaggtcaaggtgtccttctggagcacggagcgcggaggagnnnnnnnnnncggaaagggaggcagggaagtcgtgagggggacggacaaccggggatgaggggggcacaggtcaagatgtccttctggagcacggagcgcggaggagcacccccatccccaagtgtgagcatgtgtgaggcttggaaaggtgggacccgtgcacggcgcagccaacgatgcagcgctccaatctcagcatgtggatggcaagtgatggtggtgcccacccccctgtctgaactgcaagccaatcggcgagcaaccagccaccnnnnnnnnnnaaaataaatgggtagagtttcatcgtcattgattaactcttttcgacaaggtctgcacctttttcgtacgataccgaggcccccccggaaaaacgtgacttctcagcgggtggcagccaccttggtccgaagccatgacggacgggactgtcccagcccgccacgtgaacattggccaaatcgagtgacccggcaagataagccatcgagccgcacccctttccaaagtcacggacgccacttaccnnnnnnnnnnacgtgaacattggccaaatcaagtgacccggcaagataagccatcgagcagcaaccctttccaaagtcacggacgccacttaccgcacccgcattttgagtctccaccaagccgacgagcctcggtgtcacgtgacgagccaaagccaccccgaaattctgggacctccatcccccacgccgtatctacacattacgcctccaccccaaagacgtcctctttcnnnnnnnnnncccccgaaattctgggaactccatcccccgcgccgtatctacacactacgcctccaccccaaagacgtcctctttctggcagaaaatgtccctcttaaaactcacagccgccatggagagtttgagtcggtccctcttacgatcgcctacgtgctcccagctcagtcggtcgcactccccctcattctgcccagtgggccaccccggtgagttgaacgtgcaccagatctgggtgaatgtggcaatgcctcaccctgccgggctggaccgagcaagatctgcttcctcctagtaggtgccaagctcgccttccgacaacagcacgggagcgcggtcgcggccgcagccagcccggccgaggcccttgtggaccatgccgagcctcggtatgacatcgatgagaacattggcttcatcggtgccggccaggtgaggacacaggcgatggggtgggtttggtgggtgggcaccagcagggagggtgcctgtctgaccgcatcctgccagtcatacttgacggcgatgnnnnnnnnnnatgggtaccagcagggagggcgcctgtctgacagcatcctgccagtcatacttgacggcgatgttgatcatgtgcatgggccccaggaacatgataataaagtgctagattattccacgctttttttgtcacaagcaagggtggcaccctgtgctggcctcccagcaatcctgatccgtgcagtcggatttcgcttcgtttaccttttggccccctctccccgcccccccacacacacaccccaaaaatatgctcacagatgggcgaggccatgnnnnnnnnnngggaacatgagaataaactgctagattagtccacgctttagtgtcacaaccaagggtggcaacctgtgctggccttccagcaattggatctcgcttcgtccaccctttggccccctcccccgcccccccccacacacacacccaaaatatgctcacagatgggcgaggccatgatccgcggcttcctggagtctggcgtgtctcatccctcccgcctgtctgcctcggtgcggtccagcgcccgcgccacggcgctgtcccgcctgggcgtcacccgcgtgttccaggacgcggtcaagtccggnnnnnnnnnnnnnnnnnnnnnnnnnnnnnnnnnnnnnnnnnnnnnnnnnnnnnnnnnnnnnnnnnnnnnnnnnnnnnntgctggccgcgctggcccctcacgtcggcccccagcacctggtggtgtccatcgcggcgggggtgcgcctggccacgctggaggcggggctgggcgcgggcgtgcgcgtcgcgcgcgtcatgcccaacacgcccatgctggtgggccagggtgccagcgcctacgcgctgggctccgccgcgggcgagcgcgacgcggcgctggtgcacgccctgctctccggcgtgggcatggccctgcacgtcgacgagcgctgcatggacgcggtgacgggggtctccggctccggccccgcctacgcctacatgatgattgaggccatggccgacggcggggtgcaggcggggctgccgcgcgccaccgcgctcgcgctcgccgccaagaccgtggcgggggccgcggccatggtgctgggcgagggcgccgacggcgccctcgatctcacacaccccggcgtgctcaaggaccgcgtggggtcgccgggcggcaccaccatcgccgccatcgcggagctggagaacagcggggtcaggggcgctttcatgcgcgccgtgcgcgccgccgccgagcgctccgccgccatgggctgagggggccagacgcacccggtgaccccggacctaagccctggagcccgcgatgcagcgcccgatgtcggcagcctggcaaggtctcggcagccctctgcttcgagaatcgcagcacgggagagacccccaggcctcaatcccgggcaccaagtgccccacacactaaaaacgatgccttccatgcccgtttgcagcatgaatctttcatttcccctcgctcaacaagcagtacccttcacccgctctcctctgtcccgggacgtgtagtgctccctgtaatcacctctgcgtgtgcccgtcgctgtctgtatccccnnnnnnnnnntggggcgtgtagtgctccctgttatcacccctgcgtgtgcccgtcgctgtctgtatcccccctcgccactcttccagtactgtttcccctggtgtgttctagccacccattttgttagcaacttcaatcgagccaagggatcatttaggggtggtttctgagggtggctggttgctcgccgattggcttgcaattcagacaggggggtggggcccaccatcacttgccatcctgagattggagcgctgcatcgtcggctgcgccatgcacgggtcccacctttccaagcctcaca

SEQ ID NO: 46137 - DNA, 113 bp, Chlorella protothecoides
tgcctgaaaagggtgcaatccccggcatgcctgcatgggcggtgcgacggtccggtaagccgtcctctgagtcttctgctggacgatcacagcatgtcagtcgaattcagaac

SEQ ID NO: 46138 - DNA, 64 bp, Chlorella protothecoides
cgcgccatcgcccatgctccagagcagtggacctccaggcgtggatggaaacaaaggcagatgt

SEQ ID NO: 46139 - DNA, 61 bp, Chlorella protothecoides
ggcccacgtcacggggagctccaggaacccgggcggcgtgcccagcacctgacccggcacg

SEQ ID NO: 46140 - DNA, 97 bp, Chlorella protothecoides
aaaagactatctgcgatgtggagatccttcgggaatggttgttcctcccaacaacctcgacaacccgacaatgctcccctccctctctgaatcgtcg

SEQ ID NO: 46141 - DNA, 64 bp, Chlorella protothecoides
ctctgcgcgcgcacccggctcggtcccgttctgcgtgtgggaatgagtcccctagccagtcgac

SEQ ID NO: 46142 - DNA, 74 bp, Chlorella protothecoides
aaatctcagccctgcagagtgtttccttgactctacgatagaaatcgatgctgacaccgcataatgcctcaagc

SEQ ID NO: 46143 - DNA, 61 bp, Chlorella protothecoides
ttaactgctcgcctgtgctccaaaccatcacactcctggtctgccctgggcagctgccgtg

SEQ ID NO: 46144 - DNA, 77 bp, Chlorella protothecoides
tggtggtgacagcgctgggggaatgacccttgcattctacccttgggatcagtgtctctggctcggctccctgtgtt

SEQ ID NO: 46145 - DNA, 72 bp, Chlorella protothecoides
caccagcgtctcagtccaccagccctttggcgcacgcccgtgtttcacaaacaattgtgcctgtgaatggca

SEQ ID NO: 46146 - DNA, 98 bp, Chlorella protothecoides
ctggggggcgtggtgcatgcccatggacccacggaagtcagcctgaggaaataccatgtggggaagggggagggagggagagcggtttggaacttgta

SEQ ID NO: 46147 - DNA, 15574 bp, Chlorella protothecoides
  modified_base (168)..(177): a, c, t, g, unknown or other
  modified_base (626)..(635): a, c, t, g, unknown or other
  modified_base (1300)..(1309): a, c, t, g, unknown or other
  modified_base (1707)..(1716): a, c, t, g, unknown or other
  modified_base (2443)..(2453): a, c, t, g, unknown or other
  modified_base (2620)..(2629): a, c, t, g, unknown or other
  modified_base (3245)..(3254): a, c, t, g, unknown or other
  modified_base (4853)..(4862): a, c, t, g, unknown or other
  modified_base (6770)..(6779): a, c, t, g, unknown or other
  modified_base (7014)..(7023): a, c, t, g, unknown or other
  modified_base (7368)..(7377): a, c, t, g, unknown or other
  modified_base (8168)..(8177): a, c, t, g, unknown or other
  modified_base (10320)..(10329): a, c, t, g, unknown or other
  modified_base (12595)..(12604): a, c, t, g, unknown or other
  modified_base (13204)..(13213): a, c, t, g, unknown or other
  modified_base (13663)..(13672): a, c, t, g, unknown or other
  modified_base (13764)..(13821): a, c, t, g, unknown or other
  modified_base (13888)..(13897): a, c, t, g, unknown or other
  modified_base (15161)..(15170): a, c, t, g, unknown or other
  modified_base (15223)..(15388): a, c, t, g, unknown or other
ggcggggcgcggggccgggcgggcgcggcccaccccggccccagcagtgagcgggggtggcgcgcccggcgctgcttcgacgactcggggagggacggccgcgtcgccgcgtgcaggcccccccccactgcgcccctttcttccccctgccgaggtgcccgtgtgcgnnnnnnnnnntggcctcgtcgccgcgtgcaggcccccccactgcgcccccttcttccccctgccgaggtgcccgtgtgcgccacgcaaaccgtgtgcgcgcctcgtgcccaggacggtgtccgcgagctgcggcgcggcgggagccgggcccacaccaggcccaccccacgcgcgcctcgcctagccagctcgcccaagccagttttccacctgcacctgtcccaaggcctcccttcccgctccgtgcatgggttccaagcagcccgaccccatgcacatgtcccttacatgctgcattattgcctctggcgctgcctcgtcctgttgcaggagtgccgatacagccagggcggccaaggggtgcggggcagtggcgggaaagtcggccggggaggggcttcacacaccggtcgttctcgcttttggcccctcggcaagattcctcggtcaagactgcnnnnnnnnnntgggcaagtcggccggggaggggcctcacacaccggtcgttgtcgctggtgggccctcggcaagattcctcggtcaagactgccctgaaagtgggcagggtaccatgccaactccctgcccaccctggatcaagtcgagggttgactcaacattgggtgatctcgaccaggcaagtcagtgccgcctcctggacgtccctgggggctggcttgccggcctgcagctccagcaccagcctcgacccgggcctctgcaccgacacccctccctgggcggggcccgggttctggatcgcggcccggatgaggcgcaggccgtgcgcctccacgcaggccttcaccgctcgcaggcggcgcaggacgagggcctggccctcgtcagactctagctccagggtcacgcctacccagtcccccttggcatcctgtggcggggaaaggtgtgtgaggggtgacggacccgcttggcgctgttgggcatggactaagagggcacgacgcggacctgagcaggccaagtgggcgcgtgtgcagggcacaggccttgcatgcctttcacgccaggtctggcccaagctgaccacgagccgtacgcatgcgacagccaccacgcaattcctgcaacctcctccctgcgtccatacctgaatcatgtccatccgcgnnnnnnnnnnactttcacgccaggtctggcccatgcagaccacgagccgtacgcaagcgacagccaccacgcagttcctgcgacctcctcccagcgtccatacctgaatcatgtccatccgcgagaccacacaccagggcttcgactccactgcaccggcagggggcgcatgcgcggttgcctggggctctccggcagtgcccaacgacggaatgggttggctagagacgcgactgggagccatggcctgggcagccaccccttgggcctgcccacctcgtccgccgtcgccgggcggcgatcccagcaagatggccatgggtgggaggccttgctgcatgccccctttcctgacggcctggtcgtactgatacattgccttggccaggtcgatgtgcgcagccgacnnnnnnnnnncaggccttgctgcatgccccccttcctgacggcctggtcgtactggtacatcgccttggccaggtcgatgtgcgcagccgacaggctgggcccctgagtggctgtggccccgggctcaggcactggcgcaggggcggcggcagccgtcggtgcggccctggcagccctcaaccgggaagtggcagctctggtgttgcggggagcagtcctgggtcggggggaagtagctcctggcacgggaggggcggctcctggctcgggtgtgctggccagggcaggaggaggagcgctggccagagcaggaggaggaacgttggccggagcaggaggaggagcgctggacggagcaggaggagcagcgctggacggaggaggagatgtggtggcacgtgccactgccggggccggcggggtaggcaatgccacagagggggacacagggattgcatgggtgcgggctgtgggtgtgggctggtggggggcggcctgctctgtaccagctgaggctcgcgtgggggctccctcgccggcttgaagtgagggaccggtgcccatcgaggcagctagaggagctcctattgagacaggagctggtcctgcactctcaggctctaggggagatggcgaggtaccaagctggttcctgtccacctgtcccggatcagtgcttgtacccaacgcgggaacgctcagtgcggcaccctcaatctccacaggtgcggcaggnnnnnnnnnnngccttctggcctccgggtgcaggctggctgagtagcgcgtccgcgaccggaagcacgctgtcttttggatgaccgggcgggggtgtgctactgtcttcctgctgcctggcccgcgcttcggcagccccctgctggtcaggcagggtgggaggtgggccttctggttnnnnnnnnnncggatgaccgggcaggggtgtgctgctgtcttcctgctgcccggcccgcgcttcgacagccccctgctggacaggcagggtgggaggtgggccttctggttgaccgagagggccctgtctggttgttcggggcctcttggcgcccgccgggccctccgtcccaccagtcgtggaagccatgctgctgcggcgcggccgcttgccctcaccaaggctgcctctgggtgcctttggtgcggggctggcattggagggtccctccttgggattcgctctggcctgcttgggtgccgtccctcgcagcttgactggcggtggcactggatcctccgagtcctgccgcagcagcatctccagatcttctccctccaacaaagccttcctcttcttcttcttcttcttcttcttgatgttcccatccgcctctgggggctcagctccctgcgactgcagcgcgacgtgcgcctccgccgtctcccctgcgccgccaccggcctttgcaggctgctggctgagcttgccaaggtctggggtggggccagccaccttcccaactggtgcttcctcattgccagccgttctgcgcagttgcagctgtacatctccagcgggcagnnnnnnnnnnggcttgccaaggtctggggtggggccagccgccttcccaactggtgcttcctcgttgtcagccgttctgcccagttgcagctgtacatctccagcgggcagtgcccgagcagcctgccccggtttgactaaattcacggctgtcttcccatgatgcttgcgagagacagcgtcggggtggcttttcttgtggcccatgtgcttaacggccgcgggaacggtcggcaggtgggagttgtccctcttttctgcctggggcgctgctggtcggagaggtgtcccgccctcctccagacgctccacggtctgggcaaggaggtccaggccgttgtcgtggagtctgattgaaggcgttgatgcatggcttgcatgtcgcatgtctggcgattttgaggagtctgaatcccagtcgtcgctcgagctgaccagcgacagctgggaagcctctgctccgtggcttggcggagacccttgactccctcgaagcctgctgacaataggatgggagggtaactgcattgcaacccatatgttcgtaattggacttcatgcttgtgaacagaacaccccgtcaaggaagtccgctgcttatgaatcccaggaaaccctgttacatcccagacctctgcccctccatcactccccccaacctgtcgcccaccttgtggctctgactgcctgggtggtgatctcagcggtcgctcgatcccgcagccagttatgcaaggacttgcccgtctctacaactcggatggagctcttcgcattgcggcaatggccgcgtccgccgtgaatctcccactgccccagcgtgaaggtcttgtaggttggcgcgcactttgcgcagcagcacagtatctgcatgctcttggggtccagtcggccatcgtgcggtccgcacacaacccgcaatgagaaattccgcaagtccatagcggtgctgggagccatcgtctcactagtgtcgcgtaccaactgcatgggtaggaattttttggcggacagcttggtaatagcctaatgaacatataaggacggcatctagatattgaacggcgcactggagcgcttctaggctcctggagacgcacccttgcaattcctgcacctctcggtcgacctctgccgatctcgctgcaaagcctcttcgagcagatgttctggacccagatgctcctggtgctgcctgaagacacgatggagaagttcttgtggtcgactgtggcctaggggtccgcttggagtccaccagggtgggcgacgagccctgaaaagcagggtttaagggtttacgcggaactcagtcagaggttgaaagcagttgccttttgtgccctcaactgggcaccacgtaacacatcaagaagaaattgggatgaatcgtgtccagaacatccattcttttgcgaggtatggcatggctggagttggaagcggtcgtttaattcggaaaacgccgcgaatctcaaaggggtccaaaactgatgcaatatgactcggggcattcccggaccggattacctgggtgcgcgacgccaatgcttgattgtttgtaccattgctggataggaatacggtgggacatttgatagtgcggctnnnnnnnnnntctgggtgcgcaacgccaatgcttgattgtttgtactattgctggatatgaatacggtgggacatttgatagtgcggcttcaaacgaggctgcacagcgccctgcttaatggagtcgcagccggaaggaaacatgtattcgcattacatttctccgcggatttttcaggctttggcggatgattgaaaccctgggatagccagccagagaagaaattggcaacgatcatcttgagcatgacaagtggccagctcactcaagctctccctctctgagtgtgattgctgctccataacatctggcatccgaatcgactgcacagtacaggggctcattaccccgaaacttggattgtgggagcatactgccgcgaggttgtcacaacattcgcaagggaatgcacagagaggcctcgtatgatgatacaatgattcctcaagatcacaaaggttggctatcgcaccagaggctggggttccttggccacaaacccaaagatgttccgcaccatgcggatagtgttgggcgcctctgcatcctcaatactgaagcagcgagccattgtggccttgaaggctgcaaggagatccgccttctctgggtgttgctttcgataggtagtcagtgcggaccagctgttcaaaaggccaacctgtggggtgtgccaggaagttggtttgcaatccagccatgattgatatcgagggctgcgctttcgactgttgttatggtggtgagcgagccacagccctcacacatcagcacagcaggataccactatacggatgaattctgccctgttcatcagatgagcaacccccttttcccagatcctcaccaagtggtcgagcgacatgtcctcccttatggccatcccctccggtagccaggtcacgtccttgaagtgggagcatccaggctccagacccgcataccaggcctcgaccagagccctccctggtgcccagtaggggccgagcccctctgtccccgaatggaactcggtgaacgcggcattggctgctgcaacatcgctgtcgggaatgctcccttgtgccgcgctgcctggctccaagtaaccaaagtcgtagccccatatggccaacactccatcggattttagcacccggcgcatctcctggaagaaccgctctcgatcaaacctggcacgatgggtcggtcatgggtaaaatcgcatcagatgctctccttactgaggagagccggaaccgccctggtccgaaccgcaagccagagtctcgtccggatagtgcagcggacttgtacataccccacatcagatcttactcaccaatggaacgcctcagctactgttgccaggtccacgctcgcatcggacactccctgcaagtcttcggcaggaacatgctgatatgtgatcttggggtgccggacagcctcacggagttgcccggcgctgctatccgtcccgatgacggtttcgaagtcatttgcaagcaccttggcgacctggccgctgcccgtcgccacgtccagtgccgtgcctcggcgtggcagctttgcaaggccatacacggcctcgtagagttcgggagggtacgacggccggaactgggcatagaatttggcttgatcctcgaaaaggtggcccaaattgtctggttgcattgcaattgggggtctagacagggccagcgggaacgaacgtggccagtccaaaaacctgacgatcgaaaggacaatccgaccagacacaaatcgattggcagggggttgagtttgaagccttgcgatgacagaggtttgtatgcgatatttacacacacccggtcacccagcgaatgaggatgcacgtgcgctatggctgcatccctctgctgaccctccaaggcttgcctgggaggtgtcgagatggctcgtggctgnnnnnnnnnntccagcgaatgaggattcgcatgcacgtgcgctatggctgcatccccctgctgaccctccaagactttcctgggaggtgtcgagatggctcgtggctgattgagaacagtgtggctatcactcatacacaggcaacttgggaagaatcacccattaatccaaggtgcagacgacattgctcgttgcacacgaaggtactcggtttcacggcggtaagaaagaatcacaacccacnnnnnnnnnngatccaaggtgcagacgacatggctcgttgcacacgaagctactcggtgtcacggcggtaagaaagaatcacaacccacgaatctgctcagtggcgatcttcacaatacatccagttccaggtgctcctgggcagcggctggcaggttggccagcgcttccagggcaagcggctcccactgggttgctgaggagaagtctttcaactccatccctgatgcaaggcccctcagcaactgtgccagggacgaatggagcgattgtctgtacatgtgaacacaacgaggaggccatgcccaaaccaatgtccaaagatattgtccacgcagttgtctttgccagtctnnnnnnnnnnccacgatgaggacgccatgcccaaaccaatgtccaaaggtattgtccacgcagttgtctttgccagtctccagcacagagatcagatcacgatctgaagtctctccattcccaaccgccccgcctacttgcctgcacaacgcgcatgacaaagaagagatccttggggaagcgggagacgcccagcttcttgatgggagagtcagggtcaaaggggtcaactctgcgtcgtggggtggtttgggagcggcgtcagccttcactccaggatgacctactgtccatactgccggcagggcgtctgggcgcaaggggcacggcaagtgcacgcccaaaatcgcaggcgccacgggcaactctcctcaaccccgcggctcccagcggcctcaactccccccctccctttccctctgccatcatcctcactttccacgggtgtcaaacatgccgtacgccagcttggaggccaagggggggtcctcccgctgcgtctcgacgcccagcgcgcgcagcgcggccgagatccctgcctcatcctcgcggtgcaaggccaggatcaggcgggcaaacagggcgcggtagctgtcgggaagcttcttggactgaccgtagtcgatgaggcccaccgtgccacctgtcgtgggatggtgggacggggagcctgtcagggcgaggattgcaggccaagcccatgggtgtacggtggcgttgcggcgcccttgagcgccgtccatcacgcgagcgccatgagaggagtgccgttgggcgcacagggcactgcgtggaggtgcnnnnnnnnnnggggtgcacggcagggtggcaacgcccttgagcgccgtccatcacgcgagcgtcatgggaggagtgccattgggcgcacagggcactgcgtggaggtgctgtggcgcccggcacgctcctctcccggccaggcagcatgcctccctccccctgcagccccacccttcatgacgaggatgttgcctgggtggcagtcggcctggaagaggccgtccagcaggatcatacggccatacgcctcactcacgcggtccagcacccgcccggccgccagccgcctggtgctggccgacaggctgtgggagcagggggttgccgaggggcaatgggtggggatggaggagagttaggaccacagcagtgcacacggcggggcgccgtgtcaaagtagtattgctcggtccaggccgcacttgcacttgaagaggtccaaggtaagctcaagagggacacgagaggcacccagcatgactcccgcaatcgatcttgccgtctccgtccagatcgaccacgcgccttcccctcatccttctgccatgcatgcacgtgtaagccagcctcctacccatcccactgccacacagccaacccacctggaggtgtgcgccgccagccgggtgatggggatgccgtccagaaactccatcacgatcatgcgatcggtgaccagccccgggatgctgtgaggcaccttgatcttgtgtcccagatgctgcaggttgcggaagggtgaggtgatcgcattggtcttggggcgtgtgtgcgttcgtatgcatgtatatgtttcaaagggaaggagagggattgcttgtgagccagctgcccacccagacaacgcttgggggcactgttgatgggtcttgcactgcacagaccatgctgaggccccacttctctgatctctgaatatccccccctgaaaccccccaccttgaactggtctgccacagcatccatcacgcgcgcctccctgcggaaatcgaactccagccggatctgggcggccagctcgtccacggccgacaccaggtcaaagtctatctcggtcttggacaggaaggaggacaggcggcgcaggttggccaggtccagggtcatgtcattcagggcgtcggggtactggatctggggcggggagggggcggggaggggcgtgacggggagcgcctgtggcgtgggaagcgccatgaggtcaatgggacaaaggacatggaggcaggggattgagcaagcacgagggtcacgtccacgcttcccttggcgcaaggccgaggaccatgagctcaccttgacggccaccactccgtcccggggggcggcggcgcacgcgaggcacatgtccgccccgcccggcaggagggccggggcgggggcgtcccgcccgcgccgcggtttccacacccactcccccagccgcgccaggagcggcctgccccgctggctgggcgggcaggccagctgggccttgtgcacctgcgccacggaggcggagcccagcggacgctccaggtctatccaggcgaagacggaggtcaggggcgccccccccagctccgcctggatcagggacgcggcgcggtcggggctcatgggcggcacctggtcctgcaggcgcgccaggcgcttgcagatgggggcggggacgaagtcgccgcgcgcgccgatgaactggccagccttgaggtagaagccgcgcagggagatgcagaggtcgtgcatggcctcccccgcggcggcgtggtgcggctcccagtgctctgcggtgatgcgatcgggggaccagccggaagccttgagcagctgggctcggacctgggccaccttgtagccggcgtagatggagctggcccgggcccagaagcgggaggagcgggaggcagcctcccaccatggggagggcgcctggggcggacccagcggggcctgagattcatgcggcgccagctggtgatcagaggaggttgcgcgctcccccacagccatgcctgggagcgtggctggtggacggggcgagccactcctgatcttgcgccctgtggctctcgggcaccaccactgattcagccacgaacgaggcacccaaaagcgccaggcagagagtaattggtatctgcagggctcacaatatgtttttgtggttcgnnnnnnnnnncgattcagccacgaccgaggcacccaaaggcgccaggcagagagtaattggtatccgcagggctcacaatatgtttttgtggttcgctcatctgctgcgcgctctgcatgcccgcgcatggatgcgcgaacgcagctggacagtattcaggtcgaccggggtggcgggaaggggggtccccactcgaggtcaaatgagtaatgccccagcactcagcactcgccgcccaggccacgatcattaccacggggtgggagctgtgtgaccctcttcaggatcgtcgggtgcggccacataggataccatggccaagttctcgaccaccgtgacgagctcccggcggaagtgccgcaaggtgggacgggatgccggactcgcgcccggctctggagcccgccctggagactgatggccgggaatgctgtggcgctccttgtcaggcattaccaagtggcctttgatgtattgcgggctcccgtaccctccccgtgtcctctgttcatggtgtgttctcctccccatgtctgcaggcgcacttcaccgccccgtcgagcgtgcggcggaagttgatgagcgcacctctgtccaccgagctgcgcgccaagcacagcgtaagcagcaagactggcgctggcgggaggggagggtacccagtgcccgggggtgctcctcgaatccagtctgtgagcagtgggtgggaagtgcagagccgcgctcattcctgggccccctgcatgccgctgcgcaggtccgatcggtccccatcaggaaggacgacgaggtgaccgtggtgcgcggcaccttcaagggtcgcgagggcaaggtggtgcaggtttaccgtaagaagtgggtgatccacgtcgagcgcctgacccgcgagaaggtgaacggagccaccgtcaacgtcggcgtggacccctccaaggtggtcatcaccaagctgaagctcgataacgaccgcaaggccctgcttgagcgcaagaaggtggggagggtggaccggagtgcatgctgccgagcggggatggtggaggtcagggcttccaggtgtatccaggcgctgtgttgtgggccggctgcggcacctgcatctctctaccacttcacacccttccacttcatttgtcgttgcagggcggccgggcggacaagggcaagttcaccgccgaggaggttaccgccatggagaacgtcgactaggcacctggcctctgtcaactggggctatgcgtgcggcgtgactcgcccgcacatggtcgcctctagctggtgtggctttgccaccgtgtccccctcattccttgccaacacccccggtctggctgtaatcacgatgcagctctcactgtgggagcggtagagggttcaagggtgacaggtggctggacgaccacggggatcggagaggtgctcttcatgtggggaacctgatggaggaagaattgcgagctggaaatagggtggacagctggtgtgaagctgcaggactgctccaagtggaaggtccgggcgactcacaggtcgggctgtgcctaaacccctccctcttgggtatgagtcttccaccccggtctctcgcgcgcggcacggcttgcatggtgctgcacggaggtcgatatgccccataccaaaggcacgacgcgcacagggtagatggtgtcctcccttccaacggtcagtaatgtaggacatgacccctcaggagcccgacacgcccggcgcattcctgcgctaccaccagttcaaggtgtgtacgcgaagtgatcccgtaccagccagccagcccgctccccgcgtgaagtccaccagccctccctcccgtcatatcaggtctccggcgtgctcttcgaatgccccagctcctatgcccccatcaagcccatcgggaagggggcctacggcatcgtttgctccgcctgtgacgtgcgcacccaggagcgggtggccatcaagaagatcggggccatcttctccaacccactggacgccaagcgcaccctgagggaggtccagatcctgcgccacctgacaggacaccagaatgtggtggccctgaaggacctgttcccgcccccctctggccccacagagtacaacgatgtgtacatggtgcaggaggtgagctggctgggtgtgagagaggtgcagggtcgggagccagcgcgctcagggacggcgcctgcaggggttcccagggtgttgctgccggctgctggcctcggcgcgggccggctttttgccgctggaaggggttggggcctgcccnnnnnnnnnnacccagggtgttgctgccgggtgctggccttggcgcgggccggcatttgccgctggaaggggttggggcctgcccgccaggcacatgagggtccattgactctcagagccattccaaggaatgccccaccgcgagccctcctccccatgtgcagctggcagatacagacctccaccagatcatccgctccccccagcccctctccgacgaccacgtgcagttcttcctctaccaggtgacgcccgggggccgcaggccagggtatcctatgccacccctgtggcatgcgtggctcgtgccagtccctcgggaatgccagatcgcggaggagccgccgtggaccgacagcctgctccccccgctgcctgcagatgctgcgcgggctgaagtacatgcacagcgcggggatcgtgcaccgggacctgaagccctccaacctgctcatcaacagcaactgcgacctgaagatctgcgactttgggctggtgaggagggaggggagggggtgggagtcggcgatcagaggggagcagggagcagagggatcggtgcagggcgaggaccggcgtgccatgctcagcctcggccccacacccctcnnnnnnnnnnaaggagaggaggtgggactcggcgatcagaggggaccagggagcagagggatcggtgcagggtgaggaccggcgggccatgctcagcctcggccccacacccctcgtttcacaaggctcgggcggggcccgatatcaacgagctgatggtggagtacgtggtaacgcggtggtaccgcgcacccgagctcctgctctcctgcgccgactacgggcccagcatcgacatgtggtcgggtgggtggcctcctccgcgtgcacgctgcgcgagggagggtggagccggggagggggccgggccgggcatgtgcatgcaggccgccgcaaagtgccaccacgcaggtctgcctgagcctgcgtggccctgcagacgccgtgcggagaggacagcctgcaagccatcgagggcacccctccccctccccccaaaactctgcctgcagtggggtgnnnnnnnnnntgctgcgtgagggaggggggagccggggaggggcccgggccgggcatgtgcatgcaggccaccgcaaagtgccaccacgcaggtctgcctgnnnnnnnnnnnnnnnnnnnnnnnnnnnnnnnnnnnnnnnnnnnnnnnnnnnnnnnnnnagcgcccttgagaccctctttctaccccttcctttccggcaggtggtgggcacgcccagcgtggagnnnnnnnnnntctgtgtggccctgcagacgccctgcggagcggacagcctgcaagccatcgagggcacccatccctcttccccccaaaactctgcctgcagtggggtgcatctttgcagagatgctggggcgcaagccccttttccccggcaaggactacgtccaccagctcaacctcgtctgcaaggtggagcagccggctggaggggagaccggggtgctgtcgcgcgcaggggtcgggcgctgccgtgccgcgccctttgagaccctcttcctaccccttcctttgcggcaggtggtgggcacgcccagcgtggaggaggtcgagcgggtggccaaccccgacgcgcgcgcctacctgcgctccatgccctacatgccgcccatcgacctgggcagcacctttcccgcggctccccccgcggccatcgacctgctgcgcgccatgctgcgctttgaccccggcgaccgcatcggggtccaggccgcgctggcgcacccctacctggcgcccctgcatgacccctccgacgagccggactgcccctccccctttgtcctcaacggcgcgcccgcccagcccagcctcgagcaggtgcggctgcggagggggctgcgccggccgccccagggcgatgggagggtgctggggtttgctgacctcagggtgggtcacgccagaggacttgcagaggccagcatccgccacacctgagccaagccggcggcaggccagcagccccggccggccttgaccgtgtcgccattccaccctgcatccctctgcacacagatccggcagggcctgttccaggagatggtggcgtacaaccccgacctccaggctctgtgctgaagcgcggggcctgctgagcaggtccggagcgccgagtccacgccccaccggcgctcagcccctctgctctccgccttgcgctcgcgtgccccctcacacactcgttgcacggaatcgggcacctggtccctgggacatgcgtaacagcttctctcacgctgcggtctcacagctgtgtggacggtcacgggtcacgggtctcgctccgggctatggcacaggatccggggagagggagaggagcagggccaggcagaccaggccggcggccagccgccagtgagggagggggagtgtgcccgccatcgggtccccccgccaccgccgccaggcgggcagcagggggcgagggagcgggccgcccggccggcccgaggggctgagcaagacgggcgcggcgccccgccccggcgccacnnnnnnnnnngccctcacacactcgtcgcatagaatcgggcacctggtccctgggacatgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcgagggagcgggccgcccaaccggcccgaggggctgagcacgacgggcgcggcgccccgccccggcgccacctgcctcactcgactgcccccctcgggccccagcccccgctcggcgacgcaggctgcgaggcgcagcgccccctccgccaggcgcagcggcgcggccagcgcggcgcaggcc

SEQ ID NO: 46148 - DNA, 61 bp, Chlorella protothecoides
tctgatcttttacctgctcttctccctgcctatgagctacatcaagcactacaagctggac

SEQ ID NO: 46149 - DNA, 70 bp, Chlorella protothecoides
gcgcgcacagattcgcatctcacactggttttgtgccccaggtcgcaccctagcaggaagccgcagctcg

SEQ ID NO: 46150 - DNA, 63 bp, Chlorella protothecoides
caatcttggaagcgccaggtggagatgctgtccgggctcctaatccaattgcttgccagcgca

SEQ ID NO: 46151 - DNA, 72 bp, Chlorella protothecoides
catcctcttccagcacctgattcctctcccaggacatctgcctcgcccctcacaccaacccaacccctgcac

SEQ ID NO: 46152 - DNA, 64 bp, Chlorella protothecoides
gacttcactggggccccaactggggcacgtcagcggaggtgaggtaggtcgatccggtcctgga

SEQ ID NO: 46153 - DNA, 331 bp, Chlorella protothecoides
acgttttctccagggtatgagatattgaagttcgaggagtacagcgtcccattggactcgtagttgtcggcataggtcagatcgcccatgatcagggccacctacgaggggggataagtagcttcagcccatgtccaatgcatttgggcgaacctcaaacaagtgagaggctggcagcaatgcagaagctaggtgatccctcgtcaccattggcattgcaatcgcatgtttgatcaacaaagcgcatgaagtttagagtcttgatgggtttatgaggactcgtgtgcgcagggaagtcaatccaaacccaggagcgtgatcctggtgaccc

SEQ ID NO: 46154 - DNA, 79 bp, Chlorella protothecoides
ctctacccgctcctcttcctgctgcaggtgtgtgcgtatggaggggggctgaatgggggcaggatttgtggatctcgat

SEQ ID NO: 46155 - DNA, 77 bp, Chlorella protothecoides
tgagcgagggtgagagagggacggggggtgatgagagaggagacggcttgtgttgtaggggagggagaccaaggggc

SEQ ID NO: 46156 - DNA, 61 bp, Chlorella protothecoides
ggcgcagcgcctgctgcgcctgctgcgcctcctgccccatgcctttccgcttggcgccacg

SEQ ID NO: 46157 - DNA, 122 bp, Chlorella protothecoides
ggggtcccacatcgctgctccctcccccgggatgcatggggtgcatcaacctgctgccagccggccttgatggcagcagcacagggtaacaaagccctggctgacccaccagtgggggcggc

SEQ ID NO: 46158 - DNA, 61 bp, Chlorella protothecoides
acagctcattgcctctcaagcagtggccacaccagcctctcaggaatctgagccggttgcc

SEQ ID NO: 46159 - DNA, 81 bp, Chlorella protothecoides
agccatctatgcgcccgtgtgcggcaccaataacatcacctacggcaatgcgtgcgtggcagaaggcgcccgcgccgaggt

SEQ ID NO: 46160 - DNA, 77 bp, Chlorella protothecoides
gagccgcagtacaccagataatggctataatgaagcgaaaaggcttctgtgcgtgtcagttagcgtgcaggcttcgt

SEQ ID NO: 46161 - DNA, 7618 bp, Chlorella protothecoides
  modified_base (414)..(457): a, c, t, g, unknown or other
  modified_base (1261)..(1270): a, c, t, g, unknown or other
  modified_base (1689)..(1698): a, c, t, g, unknown or other
  modified_base (2432)..(2441): a, c, t, g, unknown or other
  modified_base (2855)..(2864): a, c, t, g, unknown or other
  modified_base (3515)..(3524): a, c, t, g, unknown or other
  modified_base (3924)..(3933): a, c, t, g, unknown or other
  modified_base (4117)..(4126): a, c, t, g, unknown or other
  modified_base (4302)..(4311): a, c, t, g, unknown or other
  modified_base (4497)..(4506): a, c, t, g, unknown or other
  modified_base (4904)..(4913): a, c, t, g, unknown or other
  modified_base (5208)..(5217): a, c, t, g, unknown or other
  modified_base (5509)..(5518): a, c, t, g, unknown or other
  modified_base (5792)..(5801): a, c, t, g, unknown or other
  modified_base (6159)..(6168): a, c, t, g, unknown or other
  modified_base (6572)..(6581): a, c, t, g, unknown or other
  modified_base (6988)..(6997): a, c, t, g, unknown or other
cacctccccacctatccccccccccctcttcccccacaacccctacacacactctctcacacacaggctggcgtgagaacgacctggtgctgctggaggtgtccatcaatggggagcgggtggagccgctggccgccattgtgcaccgcgccacggcgtacaacattgggcgcgcgctggtgaagaagctgaaggaggtgatcccgcgccagcagttccgggtgcccatccaggccagcatcggcgcgcgggtgctggcctcagaggccatccccgcgctgcgcaaggacgtgctggccaagtgctacggcggcgacatctcgcgcaagaagaagctgctgcagaagcaggccaagggcaagaagcgcatgaaggcaaggggggtgaagggggggggggggggggggggggggnnnnnnnnnnnnnnnnnnnnnnnnnnnnnnnnnnnnnnnnnnnnaggcacgagctggagcgacgaaggctcccggcatcggagggaggaggtgatgcacagtgaggtggcctcaccagcgaggcctgggcagggccaggcgccctgcggtcaagcaccgtgctggtgggcaggcctccaggcgctgtgcctccagagcatgacgccgtgcttccagcgtcgcacggtctcttcctgtcccgagcacggagcccgacgaactcagcgcaccccctttcccccttccaatcctccacgcagtcgctgggcaaggtggacgtgccgcaggacgccttcatggcggtcctgcgcatcaaccgcaccggcggggaggactagccttcgtgggcgcggcggcgggaggggccccactagcgcccggacggagcacggcagcccctcagcgtggctcctggcgccaggggccctccaggtgcgcggcggcgtcccgcaggccggcggccagggcggcgggcgtggcgtcctggcgtgccaggtgctggaaagcgcagcggaggatgagcttgtggtcgaaggccagccgcccgggcacctcggccacaggccaccactgcagcggcggcggcatggggaagtgtgtgggcgatgcacgtgccgaatgcagagggtatcccaggcactgtcatgacccgccgggggccaacccctgggtgcaccggtagcaagcacgctgggagaagagagagccaggggctgtcgctccgtgcaagcaggtgtgcccacgtctgaccacgaggcgagcatccaacccctcgcttcccccccacctgggcctcctcggcgtcgtcnnnnnnnnnnagtgtctcaggcactgtcatgacccgccaggggccaacccctgggtgcaccggttgcaagcacgatgggagaacagagagccaggggctgtcgctccgtgcacgcaggtgtgcccacgtctgaccgcgaggcgagcagccacctccccgctccccccccacctgggcctcctcggcgtcgtcagcccccatcacctcggcttgggcgggcaggagcgcggcgtaggccacgctgacgcaccagcccctggggtcccgcccgggctcgccgaaggccccgacctgtgtgagccccgcctcgcgcgcgctcagccccgtctcttcctccagctcgcgggcggcggcggcgcccagctcctccccttcgtccacaaatccgcctgtgcgggagggagcgagcatgccgtgtctcctgggatnnnnnnnnnnaacctgggtgagccctgcctctcgcgcgctcagccccgtctcttccttcagctcgcgggcggcggcggcgcccaggtcctccccttcgtccacaaacccgcctgtgcggcagggagcgagcatgccgtgtctcctgggatggctggctcgcacccagcacgcgccgagcccaggcaccacacagctgtgccgtgtgcctggggctaggcaccccatgcacaccagccctacctgggagggcccagctcccggcgaaaggatcgttcttcctgcggatgagcaggacctggggcctctcctccccagtcaccatcacggcatccacggtgagaccgggccgggggtacctgcagaggcggacacggtgggtctggggtggggtgcggggacagactggcgcgcactgacggatgacatggatccgcatctcggagctcccagcgcactgatacgtgtgggtcccagacatggcacgcggtgaagatcgctgcgcggtgcgcggggggatcgcgggcttcgagaccagtggtattctcgaccacagcgaccgcagctgagagaagggcccagcaactcgttgcatcacagcacagagtcggcaagcaaaaaaaaggcagcgtctgggtcgcgaggggtggggttactgggatggtgtcccgatggcgcctgatcagatgtcatccaggcgcgggcgctttgtggtagttcagacccatcggagagagctgatcgcnnnnnnnnnnacccgatggcgcctgatcagatgtcattaggcgcgggcgctttgtggcagttcagacccatcggagagagctgatcgccccggtctcgatgtcataatcggtctccgaggagaccccgcatcccccaaaacaccacagggagaaaaacgcaaccctgagctacgcgcctcgacccgtctgtcctctgcatctcacctccaccaccctcctctcgatgggttcaaggcagcctgtgacaacgctcctgaccagcctagggcgattggccaggcaagcacgaaaatgcggtggcagtgaggtacaggaacatctgcaaacactcccgcattttcaaggccaggcagccctttcctgccctcaaccctctttgagctcataacccaggggcacactcgtcgcatggagctgccgtcnnnnnnnnnngccagcctagggcgaatggccaggcaagcacgaaaattcggtggcagtgaggctcaggaacacctgcaaacactcccgcattttcaaggccaggcagccctttcccgccctcacccatcttcgagctcataatccgggggcacactcgtcgcatggagctgccgtcactgccatccgccttcccaatctcagatttgtggaaggatctgcgcaggaggtgttggaagttttgcagccaggtccctacaattcacctgcgcggtggacagctgagtcccgagaggcagcggcggaggaggtccggcgcgctgtggcggagtgggagaggcgccaatccctcagacagcagaggcctggccccgcctgaggcgacggtttgatcgcttgatcagcgcttcaccctccattgagggccgatgcaccggcatgcatccctgatggactccacgcatcagcaacccgtgatgtgtgaaaccccacacgtcttactcagagcctcccctacatgctatgtgttcccttgaagttgcttatgcagcataccagaccatcacagagtactgctcggtcatgtgctcgacttggagagtagaggtcaggggtaatgaccgaccacaggatcctcctgctgtgatcctgagaacctttgtnnnnnnnnnngcgagggccgacgcaccggcatgcatccctgctggactccacgcagcagcaacccgttatgcgtgagaccccacacgtcttactcggagcctcccctacatgctctgtgttcccttgaagttgcttatgcagcaatgccagaccatcacagagtactgctttgtcatgtgctcgacttggagagctgaggtcgggggtaatgaccgaatacagggtcctcctgctgtgatcctgagaacctttatgccttcttgttgatacaatggatgccctcgtgtgagcagagcataaaatcaagaaaaaattggagaaatgcgcatgctcaggtgtaaaggtggtctgagtggatcggggtgtgtgctctgacatgggaggaggtcagcacaacagtatgtcggcnnnnnnnnnngggaaatttggagaaatgcgcatgctcaggtgtaaggatgatctgagtggatcggggtgtgtgctctgacaggggaggaggtcagcacaacagtatgtcggccataaacctgattgcagccgctcagtgagccccagccaagatccttgcactgtccgagtggctccggcatgccttgggcgannnnnnnnnnaattgcagccgctcaatgagccccagccaagatcctcgcaccgtccgagtggctccggcatgccttgggcgacgacttcgcaatagaggctcacatctcccgcaagatgctgtgtgtcgtgcacctgggtgtgcttggcaaggacggtttggcacaagcagggtgacgtgcatgtnnnnnnnnnngctcgcgcaagatgctgtgtatcgtgcacctgggtgtgcttggcaaggatggtttggcacaagcagggtgacgtgcatgtggggcccaagccttgcaagggcccaccacatggaggtcgtcacgaaagtcagtccttttgtggggaggaagaggtgcgatgatgggagtagctccagagatctgtnnnnnnnnnngccacatggaggtcgtcacgaaagtttagtacttttgtggggaggacgaggcgcgatgatgggagtagctccagagatctgttctttcatctcagtcagcaaatcctgtaaccattgatgtttgatacccgacgtgggcatacagggccagggcatccttggcaagcaatctgcatcaagggtagcatgcgctctttctgtagttcaagatcctgtggacgctgatcctctgtccagaaggttgcctgaggatactgaaaaggacataaagaagcacagccagattcaggctgccaaggtggctctgccaacaaacatctccggcagctttgggtcttttcctcaaccaaactcccccgctgagcttgtaatcctcaatgttcgcccatccggcgatnnnnnnnnnnttgtagctgaagatcctgcggacgctgatcctttgtccagaaggttgcctgaggatactgaaaaggacataatgaagcacagccagcttcaggctgccaaagtggccctgccaacaaatatctccggcagctttgggtctttccctcaaccaaactcccccgctgagctcgtaatcctcaatgttcgcccatccggcgatggagaagtgtgcctggcgaatagccaattatttacggcggtaccgcggtacggaaggtcaccttgcgagcattcgaggctgaatttgcacgagannnnnnnnnnggtgcctggcgaatagcctattatttactgcgatatcgcggtacggaaggtcacctcgcgagcattcgaggctgaatttgcacgagagaatgtccctgaaagtgcagtgcttgccaatggtggctgaacatcttttgggaggaggcgacagcacctactgggactcctgagcggacgagggagaaactgggcgtatgggctgtttcttatctatcactggttctcgccagggaagctggatcttgcaccgtcagagtaatcctccggagattaaatccggaccggattccgnnnnnnnnnntaattactggcactctcaaggggagctggatcatgcaccgtcagagtaattctccggagattaaatccggaccggattccgccgggcagcagtttcccgggatgggagcgtgagccggttaaagcggtggtggcggtaactgcatgggtaatttggagtagattgaaggtcccgcctggctaccgttggcagcatcagaattccagagtcttcacgagatctcgtgtgctgatcgctggcagacgctgcaatgacctgccgcagtggcgcacannnnnnnnnncgagcgtgaggcggttaaagcggcggtggcggtaactgcatgggtaacttggagtagatcgaaggtcccgcctggctaccgttagcagaatcaaaattccagaatcttcacgagacctcgtgtgctgatcactggcaggcgctgcaatgacctgccgcagtggcgcacagcggggcggcattgctctcttcttgagctccttgctggtccttcatgcaagcatgacggtgtgttaatgtttatgatggtttaaatgtcaagtagacattcggatactctggaaactgccccgttcgtgctcacattttgacagcaatggacttaccccccaatcgcaggtgacgctcgctctaggccnnnnnnnnnngaaaatgtcaagtggacatttggaaactctggaaactgccccgttcgtgttcacatttttacagtaatggacttaccacccaatcgcaggtgacgctcgctctaggccaggaaaactccccgcctccatctccaccacctacaatcatctcacctccaccacctgttcctatcgcacctgctccaaattacgtctcccagtctccggcagccattcccccggcactcccctcgcctgcaacaacccctgcgtcggcgtcctccccggcaattacccttgaaatgagcccatccctagcagccagccccgagttcccaccctccccggcatccatttacgagtccaccccctcgccggcatccagtcccgagctcaacccctccccggcaccttctcccatcacnnnnnnnnnncccggcaacaacccctgcgtcggtgtcctccccggcaattacccctgaaatgagcccatccctagcagccagccccgagttcccaccctccccggcaataagccccgcgtccactccctccccggcatccatatacgtgtccaccccctccccggcatccatacacgagtccataccctccccggcatccagtcccaagcccaacccctccccggcaccttctcccatcacctcatcttccccaacagccgatcctgagtccagcccctccccagcagctacccctgagtctagtccaccaagtgttgatccacttgacccccctccctcaaccattcctgagcctacgccctccccagacaccacgccatcacccgagcccacgccctcccccgagcccacgcccnnnnnnnnnngaacttgacccccctcccttaaccattcctgagcctacaccctccccagacaccacgccattacccgagcccacaccctctcctgagcccacaccctctccagagcccacaccctctccagagcccacgccctccccagaacccacgccctccccagaacccatgccctccccagaacccatgccctctcctgcaccagctccctctcctgcaccagctcccttccccattgtgagcccctcgccaactccagccagcccaagcccaacaccgccctctccaaagaaatttccccctccatctccacgcaagtctcccccacctccactcaagaggtccccgccaccttctccaaggaagtcagccccacctccactcaagaggtccccaccacctccttcaaagaagtcacccccacctccacccagaaggtctcctccctcccccaaaaggaagtcacccccaccacccaagaaaaaattcccaccaccttctaaaaagaagtctcctccccctcccagaaaaaatcctccccccccaccgcgaaggaagttatccccaccacctgccaagaaatccccaccacctctcaaaaagaagtctcctcccctcccaaggagg

SEQ ID NO: 46162 - DNA, 12400 bp, Chlorella protothecoides
  modified_base (196)..(205): a, c, t, g, unknown or other
  modified_base (908)..(959): a, c, t, g, unknown or other
  modified_base (1188)..(1197): a, c, t, g, unknown or other
  modified_base (1748)..(1757): a, c, t, g, unknown or other
  modified_base (2005)..(2014): a, c, t, g, unknown or other
  modified_base (2087)..(2096): a, c, t, g, unknown or other
  modified_base (2721)..(2730): a, c, t, g, unknown or other
  modified_base (2791)..(2800): a, c, t, g, unknown or other
  modified_base (3036)..(3087): a, c, t, g, unknown or other
  modified_base (3667)..(3676): a, c, t, g, unknown or other
  modified_base (3917)..(3926): a, c, t, g, unknown or other
  modified_base (7678)..(7687): a, c, t, g, unknown or other
  modified_base (7857)..(8103): a, c, t, g, unknown or other
  modified_base (8169)..(8178): a, c, t, g, unknown or other
  modified_base (8394)..(8406): a, c, t, g, unknown or other
  modified_base (8577)..(8586): a, c, t, g, unknown or other
  modified_base (9086)..(9095): a, c, t, g, unknown or other
  modified_base (9167)..(9176): a, c, t, g, unknown or other
  modified_base (9312)..(9321): a, c, t, g, unknown or other
  modified_base (9977)..(9986): a, c, t, g, unknown or other
  modified_base (10459)..(10468): a, c, t, g, unknown or other
  modified_base (11384)..(11393): a, c, t, g, unknown or other
  modified_base (12086)..(12095): a, c, t, g, unknown or other
cggcgcgggggcgcgcgcgggcgcggcgctgtttcgcgccgtgctccccgccgcgctcggcgccccgctggaggactgggtggagggcctgcgggaggaggcggcgcgcgaggccgaggacgaggccatggactcggaggtgttggaagaaagcacgtcggacagcgcccagcgccagctcaacgagctggccatnnnnnnnnnntgaggcggcgcgcgaggcagaggacgagaccatggacacggaggtgttggaagaaagcacgtcgaacatcgcccagcgccagctcaacgagctggccatgtggtcggcctactttgagctggacgcgctgttcgaggagtggcaggccgcctacctggacgcacggggcgcgggcacaagggttgacaacgagggcgaggatgtggacgccggcggaggggtaccgccggcggtatgccggggcctggttgagcagggcctgcccctgctgggcgcgctgaccctcttcctgcgcgacggctgcctggacgtgctggtggacagcgcgggggatgaaggggctgcgtcgggcgtcccggtccctggcgaggccgcggtcgtgctggcgcccgggggcgtggcgccgacgggcgccttccccgccttccccggcggcgaggcgggggtgcgccgtgcgggcgagctgctgctggcgggcctgcacggcaagctgccggggctggcctgggctgcggggcccgccccggagggcatgcccggcatgctcagcgtcgcggtggaggtggagggatccgagggcggcggaagccggggcgcagctgcgctcctgggcctggcgctgaagggcggcctggtgcggggcatggatgcgctgacggtgagagggtttcactttggggggggggggggggggggggggggnnnnnnnnnnnnnnnnnnnnnnnnnnnnnnnnnnnnnnnnnnnnnnnnnnnnaggtgcacagcgggggagcccagtgtcctgcgatggagggcagggaatgatgcagagtgcggagcctgcttgagggattgcactgctccccaggtgtttaacccatcccaaaggtgcaattgagttgaaaaacatagcgcaggcgcatgccccgggcggcccaaatcctctccccttcccacccccacccccccaactcccgacccgccaggtggtcaacatcgaggcnnnnnnnnnngtcccaaaggtgctattgagtttaaaaacatagcgcaggcacatgccccgggcgggccaaatcctctccccatcccaccccccaccctccaaatacccgacccgccaggtggtcaacatcgaggctccggaagcctttgtgggggcgctgtgccactctacctgcctgccgcgcctggccctgcgtgccgcagccctgcgcgaagcgctgtgcttcctggggcatgctggggaggaggggcgggaggtggtcacgctggccgccttccaccaccccgaggccttctcggcggccgaggcggcggagctgctggcattcgagaggggagccgcggtgctggagatgcagcagcgggagaggaggatgcaggcactgtagagcagctgtgcatggaaacaaggcatgacctgagtaattgccggcctcgagcttttcagctaatgaagtcgatgcttcgacaccaggccatccgcttcttgaatttccaacgcccagtcagacacccgacatgtcatggtcccgcggcggcgcccggaatgcgctgtcagccnnnnnnnnnntctgagtaattgccggcctcgagctttgcagctagtgaagtcgatccttcgacaccaggccatccgcttcttgagtttccagcgcccagtcaggcacccgacgtgtcatggtctcgcggcggcgcccggaatgcgctgtcagcccggtgtgattcgcacccctccttcgtgccccttcgatcgcgccccagtgtgtaattcgatgatctgaagcaattacaaccccgaagcaagatcatgcagcctgnnnnnnnnnnaacacaaagtcctagcaatacaatcacggcgttaacgcaaactatttggattcgaatgccctgctgatccggnnnnnnnnnnaattcgatgatctgaagcaatatacaaccccgaagcaagatcatgcagcctctgcttgctatatatgtcaaggtcgtacgcagtaagaggccgtggcggtggcgcacgtgccctccggccccaggcccggcgccgagaccagcagacagttcggagtgcccaccatgttcgaccttcccatggccagtgcttcaaagcagtcgatcacggcaacatcacccacattaaatgatacaaagtcccagcaatacagtcacggcgttaacgcaaagtatttggattcgaatgccctgctgatccgggaccatgcgcgtcgccgcacccctcctcctgctcgccctggttttctgcctcccctgcgacttggacgcccgagagctcctggacgcctctccttcccctcagccctatctgggcatcaagtgcgcgtatggctccttcggggagatcgtgacggtggacgccgcacccacggacctgaagtcctatatcatcaccgccacggatgcggcgggccgggattccctggtgaagaccctgccacagcagctgtccggcgccaactacaggctgcagcgcgtcatgagcctgctgccgacattcacggccgacttcacgagacttnnnnnnnnnnaccgcctttgactgccagctttgtgtctcatttgcatgatgggctgtgcctcggaggcagnnnnnnnnnngcggacctgaagtcctatatcatcaccgcaacggatgcggcgggccgggactccctggtgaagaccttgccacagcaactgtccggcgccaactacaagctgcagcgcgtcatgagcctcctcccgacattcacggccgacttcacgagacttggcctgcagcagctgtgccagaacgacaagctgaggccccatctgtccggcatcgaggccgaccagccagtgtctgccatctnnnnnnnnnnnnnnnnnnnnnnnnnnnnnnnnnnnnnnnnnnnnnnnnnnnnatccggtactcgaatgcaggacttatcgcttctgccctagaccagcgactgcatgtggcctgtgccgcctttgactgccagctttatgtttcgtttgcatgatgggctgtgcctcggaggcagcacgattggcatgcttactcctttccctcgcgcatccgggccctcccctcacactcccctcattcaattttgtgatacgtttgatatgcaccccttgcactgctcgagaccccccctccaccgctgcttgctgtaatcggtgccccaggcccagggtcatggaaggacagggaggagcgaggtggtccttacagtgggtccaatgtactggcattacttggaaagggagcgcgcaaagcgctggaggttggccaccgtccggccgacttgttcaaacacgtttggaccctcagcgggtgccgccccagcctccgagtctccaggcccagcgctcgtccgcatgtgctcctccactatgagcatgagatcctcgtagggcggcttggaccccagctccttgaccaggctgtatcgcccgggacttgtagcatcctccaagaacacctggtagtgtggnnnnnnnnnnggaaggggggttggggggctgaggcaagggggattcccctggtcgggaggatatgtcaagaagaccttccctccccaaccccagacgccacatgctcagagtgaatcgcacacactccttcaaatccatcacgctccagaaggctgccagcggtctgagatccagaaacgacattctcgcatgacccgactcccaacccccacggaatccacccccaacagattcccgcctacctgccacnnnnnnnnnngtcctcgtagggcggcttggaccccagctccctgaccaggctgtatcgcccgggactggaagcatcctccaagaacacctggtagtgtggtgtgatgaaggggggttgggggcctgaggcaagggggatccccctggtctggaggatgtgtcaagaagaccttccctccccaaccccagacgccacatgctcagagagaatcgcacacacttcttcaaatccatcacactccagaaggcgaccagcggtctgagatccaggaacgacattctcgcatgccccgactcccaacccacacggaaaccaacccccaacagattcccgcctacctgccacctgcccgggtacatcttgaagaggctgcccgtatccccgatggggcgcaggtggtaggcggtggtgaaccccgccagcagcccctcgcgcatgcgccgcacgttcagccccacccccacgtccccgctggccagccgcgggttgtacatgaccagggcctggtcgggccccagctcccgcgccagccgccccacggccgacacgccctgcgggtccgggcccagcagcacgaccacgtcgtcgtccggggacgcgggggccctgtcccccagcgaggccaggctgacaccgggggcggtccactcgcccttcagcatggcggcgacgccgacgtcggggaagacgacgcggaaggtcgcgtcggggcgcagcgcgcgcagcgcgtccaggaactgcttggccaggcgccagaagcgggcgccgtcgccctgctgggagtagatggggccggacgcggggtcccagaactcgcccagcaggacctcgacctgcgggggggaagggggggagggaagtaggggcaccggggtcgggtcaggcaggaaagggaaggtgacacacagcaaacgcctcttccctccagaaaacaccggataagcatgcaggctgtcgcttcccccttccatgtactgtcacatgcacgcaccctccccccctcaccatcgccttctgaatgccctgatccaaggcctgggacgtggcagatgctgcggtggcaagcgcatcctccagggagtcgggaaggacgtcgtcgtcccgagcggcctcgggcacataatactctacttcgtcctcggcgtcattggacggcgccgattctggtgcatcatcatacgaggcccccaagggggctggccgacggggtcgtggatcagatgagccatatggcgaacgatgacttgctctcccacaaaggggtggctgccatggccccggccagctgtgccgcgcctttgcagctccgggactggtgggggtgctcacccatgcagccgaagctattgcgcgacatgccatggcccggcgtcgactgctgacgacgataatgttctggatttaagtttaatatgcccgatggagggttccggaggtgctgcattcccatgccatgccctctccatgtcggcaatcattgagcgccactggcatgatccgtcgcgacttgcatgcaagggcgatcgcgaccagtctgagggcctaaccgcacagtcccgtgaaccactgatcacatcatcctagacaaaagatacctgatgcttcagtaggattaaaacttcacgtcggcttgcggcacgtgggacctaggggcgaatcctgaacaaccctctcaaaacagagttgtctggtggccagacacagtctcacggtgcacgcatgtcggcaggatcactgctgagcgcacaacacaacatctcgccatgccataaggagggccgcagctggtgcttgcgcaaagacggcagcagcggtggccgcccctctcatgcacgaccttgtgagtggtagcggggcaggcatcggctgggtggcaggtgggcgctaggtcgcgtcatgcaaagcgcctggtgggcaccccactccccctcacaaccagccaccgctgaaattgacagggattcgggatcatggtccctggtcagcagccacatggcagcagtggcccaaactgtcgtgcgcagcgaagggtgcaacccggtgtcgggcgacggggggcagccgcgatgaagggtcagccccctgccccgcgcgccacctgagcacccttgccagtcaggacctgctcttcctcgtcttgaagatggtgggtgacgggcgaggagaagaggtatgatgcctgctgtggatgctgtgaggatcttgctggcgctccgttctcctgctcatcatccagggtccctgcctcatggtctccccgtgcaaagcaccctgctctcactccaaactcgcatcaggacattgcgcggcagcagcgtcgggccctcatagagggcgccggcccatctctggcgcgctttctcaagctgctgagggagcaggaggcggaggtggaccaggccatcgagaagatccaggccgccaaggcggaggcctctgccgcaaggcggcccctcagccctggtgggctggaccccgcccgtcgcctgcgattgaccctggatctggccgaggccgcgcgagcagaggagtgggtgccggggcatggggtggagggatgaacagaagggggcgagggcccggaatgggtgaggttggcggccttttgattggtgctgtctctccgtcatgatgttcagacgtgagccctcaaaccaacgcacatgctcacaaatcctgccaaatgagcatctcatggacatgctctgacgcacccttccccctctccaccgcacccgccagcttcaaggaggcggagcggctgaaggccgagctggcggcggcgggcggcgagcgcgcgcccccgccccccgctttccacctgggtcagctggtgtgcgagcagggccggggctacacgggcgtcgtggctggctgggagcaggtttgcggcgagggccccgcctggctggcagccgcagggcacgaccgcgcaggggccccagggccctggtacttcctgctggtggaggaggtggcgggtcggggcccccgctccggcctgccccctgtggccctggtgccggagggcgccctggagcccgcgggcgacccctcccttgtccccgggggcgcccaccccctgctcagcctgctgttcctggggaaggacgcagagggcaaccacctgccctgccgccagctgaggcagaggtttggggcggagaggcgcgacgtgcaccctccaggtgggcctttggcggggtgcctatgtgaagtcaggctggaccggaggggtagtggctggaggggaaggggggagaaatggggtcgttgagttggcggcaaagtccgaaagcatgatgcaggctcaccgccccacccccaccccctgccgaacccctgcacagggtcggacgacgaggaaggagatgcagatgggggcacgcggttggaggacgaggagggcatcccgcaggaccctggcaaccggcccagtgggaggaagacgttgcccggcatcgacatgtcctccctggatgacactgggggtgacctctgacttgtttttgctggctggtgatgtgatacatgctcagccatgtcctcatctggcacgcaaggcaggggatgacacaccaaggggaagggggaggaggggccactcgctacgatgggctgtctgccacccctggccgtcagcaacggtaatgattcacagtccctctagtcttgaggccgcagcaatgcagccacctgggtgagacggcgggcgtcgaacttgtgcacatggcagccgccgccctctgctctctgccctnnnnnnnnnncccaggtgggcctttggcggggtgcctgtgtgaagtcaggataggccggaggggtagtggctggagaggaaggggggggaaaatggggtcattgagttggcggcgaagtccgaaagcatgatgcaggctcatcgccccaccccaccccctgccgaacccctgcacagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgatgggctgtctgcaccctggccctcagcagtggtaatgattcacagtccctctagtcttgannnnnnnnnngctctgcgtccgtcaggtccttgacgatgcgatccagccgcttcttgggcacaggggtggagaagccaaaggaatttatgtgcccggcgatcgcgttcacagcggagtaggtgttggcaaaggacggccgcccctgcacactcccttgtctgcagggccggggatcaggagtgatggggatggagtggctgtggggtgcggattcgatggctgtgnnnnnnnnnnnnnctcatggctgtggactgcggattcaatggctgcggtgtgtgtggctccagcactcctcattattttgagtaccttgtcaccccaccgcagctccttggagcttgcaccccgaccttccacccctagaatccaacccaatccacgcaccgtcggtacttggccacccaggcnnnnnnnnnngttattttgagtaccttgtcaccccaccgctgctccttggatcttccacccctagaatccaacccaatccaggatccaacccaatgcacgcaccgtcggtacttggccacccaggcggtggaccggtccttgatctccttcagcacattctcgcggtctggcgcatcacgggacagctgggagacgttcaggatgtccttgatcaggccctcctgggcagagacgggaggtgtgggtgggtgggtggcctgcctggaagctccgacttggagacagacccacccccgcccaagaccgggcggggtgcaaacccaccagcccctctcccagaatgcgaggccatgctacacaccgtgagctgctggtactcggtctctgcggcgttgccctctccgatgcccaggaaagccttggctgccatgggctgtcccatcatgagcagggacagcaccccagctccggcagctctccggctgatggcgggggcggactgctgagcnnnnnnnnnntacccacctgcccctctcccagaatccgaggccatgctgcccaccgtgagctgctggtactcggtctctgcnnnnnnnnnnatgcacagacacaacacattttctgactggtgcgcgcgatgtgcatctgtgcgtcggggaaggggatggggttggggggacacggcgtcgaggtgtggtgccccctgcttcagctgcgggatagctccccaccgannnnnnnnnnttgcacagacacaacacatttcctggctggtgcgcgcgatgcgcatctgtgcgtcggggaaggggatggggttgggggggggcacggcgtcgaggtgtggtgccccatgcttcagctgcgggatagctccccaccgagcctgttcaccttggaatggagggtacgacccttgtgctcgccatctgtgccattttaagatccatcgtggtgcaatgtgtcgcaggagtgtgggccagtggctgccatgacatgtcgttgagtgccggatcttgttatcatgcaccactttgcagtaccgtcatacccacgtgcctccatgcccgcagtttcaagtgcctgacgaacagcccgtggatgggatcacagtcgggcgcagggcctgtggagcattcaactcacacctaacttacgactcaaacgacaaatctgtctctgaggcgcgcaggtctgcggtgctgtcgttgttggctctggacaggctagcaaataggaggagccagagatgagctcgagcaagcaggatcgtcagttccgggcgcttcggcagctgatgccgtggaattgggatgcgaggtgagttaagcctgtcttgatcgaatacccgtagtgcgtctgggtccactgcacgaagacaaacttcacaggtgccacctgcnnnnnnnnnngtcgaatacatgtagtgcgtctgggtccactgtacgaagacaaacttcacaggtgccacctgccggctcaagcaccccacgacgtccctgcaggttggaggagcaccctcccggggagaagtctatgcacgacttccaagatgtgctgagctgcacatatgatcgatccaggcgtcggcgctccgagcctctctccacccctccccccgctctggtggccactccgaaggccaagaccatgggacggggtcagtctgggagtgtgaagaagacaaggtctgcaggagtcaaagtaccccgtacagagaccaggtgagccaacttctcagctgtggtacttgctccgagacgcaagctctgaggcaagcagcaggcagtgctgctgcagtcagtctcttgaatggcaggcctggcactcgcggctgtgagcatagtgcttcacgcaaaacacaccctcaatcttcaacccaatnnnnnnnnnngaccccgtacagagaccaggtgagagccgacttctcagctgtggtgcttgctccgagacgcgagctctgaggcaagcagcaggcagtgctgctgcagtcagtctcccgaatggcaggcctggcactcgcggctctgagcatagtgcttcatgcaaaacacaccctcaatcttcaacccaataccacagatctggagcacctatcgatgagctcaaggttgatcctgtggagctcatcagtgcctctcctttgacaaaactggagtctgcaactgatgaggacagggcttcaggtcaggaagccgctgatggccccatagaggcacaggagctgaacgccatgcaggggctggaatcaccgggaggcgtggtgccagggcctttgccgcccaggatgcacacccccggcctagggatccatgccaccccctgtgctgatgcacagaggtgagaagagggagaagctggcccctttggcttcttgtacaacgcatggtcccaagcaaggtgggctcctgagtctgcagtttgcgctcgcctctctcacgcccagcccctcactccaacatacagccccaggcaagcgaaggaaggaggggagccagctccttgcaaggaccaggatccatcgccgccccaggcaggcgacacctgccccgggccagaggcaccggtgagtggccctccactcagcacgcccaagtgcacagcacaggccccgatcgagaccctggagccgagcagcaagcccgagctcccgcccgtcaacagggcgcagcccgcgcagacccctgtccccgcatcggcctcggggatccccattgccgggaccccccaggcagtgccaacccaaaccagcaccgcggcaaaaggatcgggcagcgctctgcggactccggggtcggccccagagcagnnnnnnnnnngacagggcgcagcccgtgcagaccccggtccccgcttcggcctcgggcatccccatcgccgggacccccgaggcagtgccaacccaaaccagcgccgcggcaaaaggatcgggcagcgccctgcggactccggggtcggccccagagcagcacaccgcgccgcgtcagcgccacctggagccagagagtgcggcggaggcggcgtgcctggtcttcaccccccgcggtgtggtcagtccgggcgtcgcggggcccgtcagctcagagccggcacgcgccggcccatccagcgtcagcaccggcccccccctggcgctgctggcagcgctgtcgtccctgccaaagacgctgcgcagcgtaggcgcggcgacctccgccagggcgaactccccgccagctggctgcggcgcctccccctgccctcctctgttcaaaacccctctgacggcaccccttccaggaggctcgactgccaggtgtgttgggatggtcaggcagggcagcgaaggctcgacgagaagcctgggtctcgcgtgtgcaggccaagcgactttccacagcgatggtcatgcgatgagctgtgccagcaccccaccctcgctctcgaccgcaggactcatcgtcgggtgacgggcgagagtactgcgtctgagccgcgtatgcccgtgagtatggtgagcgacccaagcggtnnnnnnnnnnatcaggcagggcagcgaaggctcaacgagaggcctgggtctcacgtgtgcaggccaggcgactttccacagcaatggtcatgcgatgagctgtgccggcaccccaaccccgctctcgaccgcaggactcagcgacgggcgacgggcgagagcactgcgtctgagccgcacatccccgtgagtatggtgagcgacccaagcggtgcgccatcgcctgccttttcgcattccgggcatgtgcttcatggctggaccctgtgcccctgccatcggtggcggtcataccttctgcattcctcccccccc

SEQ ID NO: 46163 - DNA, 73 bp, Chlorella protothecoides
ggcagaaccgatggagtggggggtgatggagatggcggtggtgggtactgtggagatggggagggagctgcag

SEQ ID NO: 46164 - DNA, 62 bp, Chlorella protothecoides
cccccccccctcatctcaccagggagatggcagtcacgcacgctagacacaagagtaagctg

SEQ ID NO: 46165 - DNA, 74 bp, Chlorella protothecoides
cgagggagcatgccctcatggacatgccacgcacttgcacccctccaaccttcttcccatcccaccacctcgca

SEQ ID NO: 46166 - DNA, 70 bp, Chlorella protothecoides
agggcgcgcacggtcgataatcgaactgttacggggtggggtggggggtgtgagcgggaggggcggagac

SEQ ID NO: 46167 - DNA, 76 bp, Chlorella protothecoides
cgctgcggtggcgggcgtggaccccgccatcgtggatgccgccacgtccgcgcaccaggggcaggcggcgaggcgg

SEQ ID NO: 46168 - DNA, 61 bp, Chlorella protothecoides
ggacagcaccgcccagagcagggcgggggcagggcgcaggccctgggacaccagcaccgtg

SEQ ID NO: 46169 - DNA, 67 bp, Chlorella protothecoides
catccaactgagtgatatccttgcggccagtggtgcaactcgggtacgacggacccctcagtgcccc

SEQ ID NO: 46170 - DNA, 65 bp, Chlorella protothecoides
ccgaccggagctcatggacagacaggtatgggtgtgctgcctacctgaggcctgatgcatgccga

SEQ ID NO: 46171 - DNA, 61 bp, Chlorella protothecoides
cctgcgcatgcagggtggtgggggtcccctcagggggaccaggcgtcccggtgagtgaggc

SEQ ID NO: 46172 - DNA, 61 bp, Chlorella protothecoides
ccacccccgattctgccgtgtagttgcatgaccttgggcagccgatcgcccttgcttggaa

SEQ ID NO: 46173 - DNA, 61 bp, Chlorella protothecoides
gtggccaagcaggtatggttgcatggggtgcagttggatgacagggtatgaccgctggtgg

SEQ ID NO: 46174 - DNA, 61 bp, Chlorella protothecoides
cagggggtagttgtctacaaagtgcttggcaatggcgagggcaaactcctcagggccgcag

SEQ ID NO: 46175 - DNA, 73 bp, Chlorella protothecoides
gagccgttcagtccgttcaggtgctgagcccaccgtcgctggacttggagtgatggttgaaatgtcgcatata

SEQ ID NO: 46176 - DNA, 1147 bp, Chlorella protothecoides
  modified_base (408)..(417): a, c, t, g, unknown or other
  modified_base (492)..(504): a, c, t, g, unknown or other
  modified_base (637)..(646): a, c, t, g, unknown or other
gccgaggcggcgggcgcgcgcctggccaccctgggcgccggtggcgtggcgctggagctcggcacctggctggacgaggtggcggggtgctgggcctcgggggcgctgcgcggcgccatgcaggccgcgcgctccggccgcgagctggccgagctggaggccggggtgagggcctccctcgcggcctgggcctgcgagctggacagtttcggggaggagccggactccgaggcagggcccacgtctgcgcccgcgcccgccccgcgcgacccccgcccagtcccgctctcctgggacgatgtgtgccagtgggcgctgggtgcgccgcgccccctctggccgctcctgctggaggaccagctggtggccagggcctgcgctctggtggacggcgacgtgcgtgacgtnnnnnnnnnntcgccccgcgggacccccgcccggccccgctctcctgggacgacgtgtgccagtgggcgctgggtgcgccgcgcnnnnnnnnnnnnnatgtgtcgtggaggggggcggaaagtttgttggggaggagatgcgatgcgcagggccagggccctttcgaccccgtgtgcagctgagacgggacgcgtgggtaggttccctcaccccactcgacatcatgtcnnnnnnnnnnctgtgtcgtggagggggccggaaagtttgtgggggaggagatgcgatgcgcaggggcagggccctttcgactccgtgtgcagctgagacgggacgcgtgggcaggttccctcaccccactcgacatcatgtcctggaggggtccctctgctctgaaccgagggcagggcggagcagaggcagcgaccctgcatccctggggcgcctctcacaccgacagcctgccgtgccatgctctcactctccaccacccaccctcgccctccgtcccgccccccatcgcaggcgacggggtcgctgcccccaccccaggcgggggacaggggcgccacgccctggacccaggcggtggacctgcacatggggtccgcagaaccctccgccgccgcgcccgacgtctggctggcggccgcggcggccagcgcgaggctgatggacgagggcctggcgcacgccgcacacgccgcgcgcgacgtgtgcggcgcagagggccgcgccgcgg

SEQ ID NO: 46177 - DNA, 119 bp, Chlorella protothecoides
atcttctccctcatgcatacggcagggacatatctagaccttggatgatctggggaagaaggatcagatctccgcaaggggggggttgcaccggtaccaaccacccgattgccgccgct

SEQ ID NO: 46178 - DNA, 117 bp, Chlorella protothecoides
cctgcggaggggttgagttggtcgggttataggggtcgctgtggctcaagaatggtggtcggggagagggcgggaggacggcaaggcaggaggggttgaaacagacgggcaaacaga

SEQ ID NO: 46179 - DNA, 61 bp, Chlorella protothecoides
ggggatggtattggctagctgaggttgagggcctacaaggcatgagcatgcagtttgtccc

SEQ ID NO: 46180 - DNA, 61 bp, Chlorella protothecoides
ggtgtcgtccatgcaaggccaattctccgattacctcaatgccatggacagcagcctgatg

SEQ ID NO: 46181 - DNA, 62 bp, Chlorella protothecoides
tctgcttctcaatccctcgacgggcctgcccaccccctctcaaccactccagatggaaacct

SEQ ID NO: 46182 - DNA, 70 bp, Chlorella protothecoides
ggaggctacgcctcaagttgggcagtctatccctgactcatgagaatgggctggccacgtcgccattcat

SEQ ID NO: 46183 - DNA, 61 bp, Chlorella protothecoides
aagcggtgatcagtcttcctgagcattgtatcggtgacataggcccctctcagcctcccgt

SEQ ID NO: 46184 - DNA, 70 bp, Chlorella protothecoides
atgaaaacagcactagcgttgattcaaggatatatgaagaagcggtcatcagacaaatgcctcggttgtc

SEQ ID NO: 46185 - DNA, 79 bp, Chlorella protothecoides
tcaatggctcaccatatgagtatcatacactcgctttgtgttctggggccctgcatccacgctcggctgctgcaatctg

SEQ ID NO: 46186 - DNA, 61 bp, Chlorella protothecoides
catacgggcatgaggtccctccgcccgagcaccccgccgctcacagaaagccgatgcattc

SEQ ID NO: 46187 - DNA, 73 bp, Chlorella protothecoides
gtggaacgatctgccgcggtgcccatgggcgtggaaggggttctcgtgtgtatccgctgcgtcttcctccagg

SEQ ID NO: 46188 - DNA, 61 bp, Chlorella protothecoides
ctcgagcggatcacctgcatgcagcccttcaccagccatgactggtccgacagcccccgta

SEQ ID NO: 46189 - DNA, 61 bp, Chlorella protothecoides
gcgccaggctgcccaaaccctgcgaggagcatacaggaacctcatcagcaaggcccgaagt

SEQ ID NO: 46190 - DNA, 61 bp, Chlorella protothecoides
gttgggcgtgcgcgcacatcatggcgacatgcccctgcctatccgtcaccagcacccagga

SEQ ID NO: 46191 - DNA, 61 bp, Chlorella protothecoides
gagccctgactgtggaagcggcgcaggcgggcgcagctgcggcacgatcccatggcgccga

SEQ ID NO: 46192 - DNA, 66 bp, Chlorella protothecoides
ttggtagggggcggtaatgcatgcctgaatctcccaaggcaggggagcgagtaggtgtggtgtcat

SEQ ID NO: 46193 - DNA, 67 bp, Chlorella protothecoides
aattgatggcacagctctgatggcacttggttatgatcattcgacctcgcgcaatgctcgccaggca

SEQ ID NO: 46194 - DNA, 75 bp, Chlorella protothecoides
acacgggcagccatttcttctttggactccatcaagcagcccaccctcctctactgcaccctgagcccagcatgg

SEQ ID NO: 46195 - DNA, 61 bp, Chlorella protothecoides
ctcttctggctcctttgtgcgccccgtcgcccaccatgcaatgcctctgatcgtccttccc

SEQ ID NO: 46196 - DNA, 69 bp, Chlorella protothecoides
cgatgcttgcagtacatcatgcttgctccatgcacaactgccatgtgcggaacccccatttcctttcct

SEQ ID NO: 46197 - DNA, 64 bp, Chlorella protothecoides
agttcgacgaggagtacgaggtggtgagtcagcaggcgggatggggaggaaagggcagcagggt

SEQ ID NO: 46198 - DNA, 70 bp, Chlorella protothecoides
ttcctcctcgtcatcttcgctcacgtcgtcgtcactctgaccctcctcgtcagagccaaagttcaggagc

SEQ ID NO: 46199 - DNA, 61 bp, Chlorella protothecoides
taaccccctcctcctccaggcggccaaatcgtggacagggcacgccgagccggcggcgggc

SEQ ID NO: 46200 - DNA, 168 bp, Chlorella protothecoides
gctcccaagagcgtgtcttccgtcgagtactagagtgggtcgatgtaaagacaagggcgggttgtagggtagtatcaccacccagaccagcagcgacagttccctgggaaccgccgggtttgagcacagatctcaatggatccaaatgctatactatcgatgcaagcc

SEQ ID NO: 46201 - DNA, 105 bp, Chlorella protothecoides
gtgctgagccaggcggcggcgcggtaggcttgcgccgcctgcacttcacaaagtccacatgctgcacccctcgaaccccatgtgccctataggcacacatgtgcc

SEQ ID NO: 46202 - DNA, 162 bp, Chlorella protothecoides
cagcgcctcggcgggcaggccgcccggcgcagcgtccgccagtataatgctgtgggcctgcggtaggtggcgtgaggagtgggaggtctgttgtgtgaggaccaagcatgaatactggggatggacgcccagcgagtggcgggcatgggccgccgctgccgc

SEQ ID NO: 46203 - DNA, 61 bp, Chlorella protothecoides
ggcctagcgctcatggaggcagtgcacggcaccgccccggacctggtgggcaaggacgccg

SEQ ID NO: 46204 - DNA, 61 bp, Chlorella protothecoides
aaggcctgcgtgggtgtgggcgccggtggcagggcacaccagttcaaagtgcatggcgccg

SEQ ID NO: 46205 - DNA, 67 bp, Chlorella protothecoides
caatcgcagtggcctgacatttcagggaaggagaggaatggatggctgtttattacttgctcagaca

SEQ ID NO: 46206 - DNA, 148 bp, Chlorella protothecoides
gggaggttgcaatgcgcgcgggtcgacaccgggggtgcattagtggaccggggtttccggtgacagaggctgatcgaggtggtggtctaggtgcaggggaggtcagggccttgatcctgccttccagtgtttgcaccaggggcaggtg

SEQ ID NO: 46207 - DNA, 61 bp, Chlorella protothecoides
cccaaggcgccagaaaacggcgcgcccccggccagcaggcgagcgagggtacatgtcgtgc

SEQ ID NO: 46208 - DNA, 75 bp, Chlorella protothecoides
gcggtgtgagcgggcagggcccggagggcttgattcttcccaccattccccttccaaacccgtcaccccatggtg

SEQ ID NO: 46209 - DNA, 74 bp, Chlorella protothecoides
gtatgtagtatatatatattgaatacatttcgtgtgcaagcaggctgcgctcgaggctgaagggtgtacctagg

SEQ ID NO: 46210 - DNA, 70 bp, Chlorella protothecoides
tgacggcatgctttgtgcggcctccagggagcactggcaattgacagtccggctcctaagcttgcggctg

SEQ ID NO: 46211 - DNA, 64 bp, Chlorella protothecoides
caccttgccgtgcttgagcaaggcggccgcggccgcccgccgccccatgccgcgcatgtggtcc

SEQ ID NO: 46212 - DNA, 71 bp, Chlorella protothecoides
cctcctcctcctcatgctggggagtaaacgtggaattgctatttggggggggggggggggggggggggggg

SEQ ID NO: 46213 - DNA, 80 bp, Chlorella protothecoides
cgaggaccagcagatgtgcctgggtcgaatcaagtgggggggagataaacatcagctggtgggtatgggtgggattgcag

SEQ ID NO: 46214 - DNA, 61 bp, Chlorella protothecoides
gagggcagggatgtgtgtgtgggggggggggggcctgacacaccttgagaggtcgaggcat

SEQ ID NO: 46215 - DNA, 61 bp, Chlorella protothecoides
tgcccagcatcagtggcagcatccttgcggtacgcccataaaaagaatcattaccatgaac

SEQ ID NO: 46216 - DNA, 77 bp, Chlorella protothecoides
gcaggacaaaattccaggggatgcccccgggccgtaaagggcctggggggggtgccgcagcagtaaaagggcaacgc

SEQ ID NO: 46217 - DNA, 77 bp, Chlorella protothecoides
ggggctggtcaaagagggggtggtcgggggttttctcttgcagcgcagaggcgcctggaggcgatgcaaggctcggc

SEQ ID NO: 46218 - DNA, 61 bp, Chlorella protothecoides
gaggcgcctggaggcgatgcaaggctcggcctcctgtcctccgatgactctgcgctgatca

SEQ ID NO: 46219 - DNA, 66 bp, Chlorella protothecoides
gatgttcgtcagagcacatgctttgcaatggaaaggttaagatgctgcctttcgaactcgataaag

SEQ ID NO: 46220 - DNA, 61 bp, Chlorella protothecoides
ccagcatgctagcagcgccgcgtctcctgcaccccccccccctcacccacacgcttcaccc

SEQ ID NO: 46221 - DNA, 90 bp, Chlorella protothecoides
ccgcggcgtgctcgtacacgctgtggtgggacagggggtccgacatggatgaggaatgaatgggtgttttccttgggaaagggggggggg

SEQ ID NO: 46222 - DNA, 61 bp, Chlorella protothecoides
ggcttggactcggggaggggctggggctggatctgggacttggagtcactatgggcggcag

SEQ ID NO: 46223 - DNA, 66 bp, Chlorella protothecoides
gtgttatgatcagtttggttccagtggcatgaagggcatgtgccaatgctcaatgaaggctctgca

SEQ ID NO: 46224 - DNA, 68 bp, Chlorella protothecoides
ggccttgaagccttcaaagggcccgctttcttggtgagacggcggggggggggggggggggggggggg

SEQ ID NO: 46225 - DNA, 69 bp, Chlorella protothecoides
ctcagaggagctagactacggcgaggatgatgagcctgagcctgcaatcccctcccacccctcgacaaa

SEQ ID NO: 46226 - DNA, 281 bp, Chlorella protothecoides
ctcctacttgccaagtaatcagttgacaatgccacttcaatgctcgttgtggtacactgacgcgggtctaacatactgggaagcatgaattgccgacatggactcagttggagacagtaacagctctttgtgttctatcttcaggaacacatttggcagcgcacccatacagtggcgcacacgcagctgtacctgatgtggctctattcccacatgtttcaacttgattcaaaagtcactcagactctcagcagctagacttgatcgcatctttggccatg

SEQ ID NO: 46227 - DNA, 250 bp, Chlorella protothecoides
gaggtcgccaagttggatggacagggaacgtaatgcctgaggaagcctgaggatgcgtcgtagtaatgttgatcattttgagggtgatcgctcgtttgggtggaagacgcggtgcgtcgttgttcatgaggaacaaatggacatgcatgccacaatgcagtgtgcattccgtgtgttgcctgaagtgcctgggttggctgcaatggagcctcaaagatgagttggtagtaaatcctgacgaaggacagca

SEQ ID NO: 46228 - DNA, 90 bp, Chlorella protothecoides
agggggctcggcggggcgcacgccggccggaaaatgctccctccccctccccaggaagtgcagggagggggaggcgtccgccgggggctt

SEQ ID NO: 46229 - DNA, 61 bp, Chlorella protothecoides
tgtggtggggcaatgttttgacctgccacgaagagatgctatatcgatcctcattcaggtc

SEQ ID NO: 46230 - DNA, 61 bp, Chlorella protothecoides
gcttcgactccgacttccggctgaccttctaccccgcgcgctacgcgcccgagaagtgcag

SEQ ID NO: 46231 - DNA, 63 bp, Chlorella protothecoides
tgcccccgcccctcccccgccctgcctccctctcagccagaccctgtgcctgtctacgttcag

SEQ ID NO: 46232 - DNA, 61 bp, Chlorella protothecoides
gaggcggacgaggcggacgatgagagtgacacctccgccagcggcaagaagcccgccaaga

SEQ ID NO: 46233 - DNA, 78 bp, Chlorella protothecoides
cctgtcgccgccctgcaccaccgcaaacctattacctcctacacctatcacagcgcctggagcccaagacattcctgg

SEQ ID NO: 46234 - DNA, 73 bp, Chlorella protothecoides
cggcaagccacaccgcagaccccgctccccccacccgatccggcccgccgccccgcccacctttccgcttgcg

SEQ ID NO: 46235 - DNA, 73 bp, Chlorella protothecoides
agtggtgaattgattctctagggaagtgagtatgaattgactggtgcgaagcccgagatcacttggctttgaa

SEQ ID NO: 46236 - DNA, 62 bp, Chlorella protothecoides
gaggctctggggtgcccgagctgtgtgcccgaatgtacagtcggcgtcccacagcagagagc

SEQ ID NO: 46237 - DNA, 155 bp, Chlorella protothecoides
cactacaccggtgagctaagattttggtggggtcaaggatcatgtggctgtggttgaagtgtgcaaggtgaggagtagtcaggactacgctgtctttgggtgcgcctcgttctctgcggaacgccaccaagacgctgcatcctgccattggcgcc

SEQ ID NO: 46238 - DNA, 64 bp, Chlorella protothecoides
gctcctgcctgcatcttctacatggggagccgtcctgtatcggtccagggccagccggcagccg

SEQ ID NO: 46239 - DNA, 67 bp, Chlorella protothecoides
caggggctgggcctcggcgggccctgctcatcgccgtgctttccatcctgcacctggccgggggacg

SEQ ID NO: 46240 - DNA, 61 bp, Chlorella protothecoides
aatctcctgcatgggtggcaagattggctttggtgggttgcttcatctggtgcagaggctt

SEQ ID NO: 46241 - DNA, 61 bp, Chlorella protothecoides
ccataaaacgccatgagacgacacctgcagcgcttgtggggggaggaaggggctcgatgca

SEQ ID NO: 46242 - DNA, 61 bp, Chlorella protothecoides
cagaagccatggcggggaccggattcttagtgccgctgcagccccaaggcctgccagcacc

SEQ ID NO: 46243 - DNA, 1378 bp, Chlorella protothecoides
gagctggagcggagactcgccgccatgccacaagggaaggagaacttggtgggcgagggcaccgactcagacgaggctgctttgctgcgaaaactgaatgggcggctcctgggagagatcgccacgtacaagcgccagctcggcgccatggagaggcagggagtctcccctgaacaatgttgagagcgaagatgtcctatgctcctctatgtctgcactgttctttgttggaggggttgcgccgcgttctggatcctgggatccagtcacttgatcctctgaccaagtacatatagaatgttttgtttgattgtgataaacctgaagcaaaaaaggcttcttgggcttgaagggctcggtttaccctgaataacccacgaagatgagtcatgacgatgcatgggcgtccaccgtcgaggaagcgcccccgggcacgaccttatgcgatggcccccgccagcatctgccatagtttcggtgctcaaaagcacgatgacaccggtcatgagccagcccaggctggattgccgacatgccctggcctgcccccccattcggccctcgagcctccgatcaatccctttcaccctccgacacagaaccccagccgggcctcgacacacagaccccagatcaggtcgacgagtgcgtcatgtcgtgcgggcgggccaggccacccctccgccccggagcgaccccacgccctcggggcgcatcttcatcttcgcggtggacggcacccgggatgccgaggagggcctgcgctggctcatccgcgccatgaccaagaaaggtgcgtccccagcgcggggtgtaccgaaggtgcccgtgatccagcccggccggagctgcatgccagcagggattgcttggcagggggcatgccccctgttcctgtctcccctgggacgcataccccgccctcctcccccacacccccacaccccctcctcgcaggcgacaccgtgcacctggcgcacgtggtgagcaacccgcgcacgcccttctcgggcctgaaccgcgcgaccacctccggcacctggggtggcccggaggacgcgcagttcatggagcgtgtggagtcggaggcggcggccatgctggctgcgcgctacgtgcccatcgtcaagcacgccggcgtggccttcaccacctgcctcctgcgcctgacggcgggccgctcggccgccgccatcggcgagctgctggccggcgcggcgcgcgacctggccgccggcctgctggtcatcgccagccacggcccgggggtcctggccgactacggctccgtggcacggtggtgccaggaccattcccccgtccccgtcctcctcctgccaccggccgtgctggggggaggtgcggcggcgacggcagc

SEQ ID NO: 46244 - DNA, 7087 bp, Chlorella protothecoides
  modified_base (140)..(326): a, c, t, g, unknown or other
  modified_base (639)..(648): a, c, t, g, unknown or other
  modified_base (1250)..(1259): a, c, t, g, unknown or other
  modified_base (1988)..(1997): a, c, t, g, unknown or other
  modified_base (2631)..(2640): a, c, t, g, unknown or other
  modified_base (3209)..(3218): a, c, t, g, unknown or other
  modified_base (3700)..(3709): a, c, t, g, unknown or other
  modified_base (4143)..(4152): a, c, t, g, unknown or other
  modified_base (4709)..(4718): a, c, t, g, unknown or other
  modified_base (4962)..(4971): a, c, t, g, unknown or other
  modified_base (6187)..(6196): a, c, t, g, unknown or other
  modified_base (6523)..(6532): a, c, t, g, unknown or other
  modified_base (6872)..(6881): a, c, t, g, unknown or other
gggcggcggggggccggcgcgcccgccggcgcgccgcctggcgctggagcgcgcgctcctcctcttccgcctgctggtcaacctggactacgtcccgccgcccagcgacgacgccggcgcggcgggcggcggggaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggcgccggcgctgagccgcgccgccgcgaatgtgggcctgctcgggcgcgcggtggcgcggctggggcccggcgccgcgccccggcccctgctctcgatgcaggacctggagctgggggcggacctggaggcagccctggcgcgggccgcgcaggggggcggcgacctgcggccctcctccgcgcagtgggccgagccggcgcccaagcgcgagcgcctggcctgaggcgatgatgcatgggtgagcaacttcctcgcagtggcagaggaagcagggagtagttgaggggttgagcgacaggcagggcacnnnnnnnnnngtgatgcctgggtgagcaactccctcgcagtggcagagggagcagggagcagttgaggggttgagcgacaggcagggcactcggtgggcgcaagcatggtagatgtgcgagctgttttgctctggtgcctcgacacagcagccgtgtggatcaacagacgagcgagggcaatggcgtgcagaaggaggcagggaagccgggggaaatgccatgcaggcagagacagatgcaggaggacagcatggcgatgcatcgtggtgagcagcacccaacgtcgcgcccgcttacgctgagcgcagcagcggagtcatgccgcgttgcagctgcgcgcggcgcagccgcaggccgacgcggcggcgccctggcctagccacggcgtctccagcgggtctagggtggtgtccttgtagatgaggtagcgcgtgggctgcgtgcccagcgccgcataccactggggcacgtagggcgccatccagattacgtccccagcctggggaggagcggtggggggtggggttggtgactgtgagcataccacaccgaggcatatcatcctcgaaacctttcacgtgcccacgccaggctgtcggaggggacggcgnnnnnnnnnngccagcctggggaggagcggtggggggtgggtttggtgactgcgagcataccacaccgaagcatgtcatcctcgaaacctttcacgcgcccacgccaggctgtcggaggggacggcgagctggaagcatctgcatacccagactggggctggatcgcaggacgaggtttggcgatcgccccctttgcccagctgcagagacgcttcccggggggggctagcgatccagcccccgcatgcccgccaccctgtcccccaacacacacctggacggcgtgccagtcctcgttgaggcggtagatgccctttcccgccagcagcaggaggccgtgctggttgtagtgcatctccttgacgttcaggtgctcgcccggcgaaaagtccatgatgtggatgttgaagtcgtacgcgggggtctggggcaccagcttgcgcagacggaacacctcgcccggcactgggagcaggggcgagtcctcggtgtgcccatgcacgaagtcaggcgagccctgtgatgtgttgggggcaggtgaagggggccgagagactggggacaatgccaggtgatgttgggcgccctatgacctataaggaagactgccagcagcgctcatgatcacagcagtgtccagcacactgcaagtcgtcacacctccaaagggtatcaatacagggtatatacccatttcaacaccccaagttcacctgccctgcatagcgccgctcaaannnnnnnnnnacaggtgatgttgggcgccctatgacctgtgaggaagactgccagcagcgcacatgatcacagcaatgtccagcacactgcaagttatcacacctccaaagggtatcgatacagggtatacacccatttcaacaccccaggttcacctgccctgcatagcgccgctcaaagaccaggaggctggcctcactggatgttgacaggctgtgcgtaatgaggggggaagagggaggggtgggaatggagtatccggcgactgagtgtgcacctcccacatctacatggttcatacatccaccagcacattgtggtgattccttgggcacaactgtcccgctcacctgtgctcctgaccgggcgggaggtaggcatagtcattgtaggtcagctgcacgggagcattttctccgacgacatccagtgtcagctctccgcccagcacaaaaataaacctgcagaaggcgactggttgattttggcacaacttccaggctgagcgtggctggccggcccagcaccgagccagacaaaccatacagatggtattgatgtggcccgcggtcattccacatggagagcactgcattgtcagccgtcataattacctctcgaccccggtcgctggggatgtgcnnnnnnnnnngcatacagatggtattgacatggcccgcggtcattccacatggagagcgctgcattgtcagccgtaataatcacctctcgaccccggtcgctggggatgtgcctgtggagttcaggcccagtttggcaaagaacatggcaaagttggccttgaccgctggggagatgagatgtgcagtgagagcaccaggcctgtcaggaagtatgaggcgggacaatgattggtgcgatccatgcaaacatatgcgcatcaagcacatgctgcgccacagcgtgcactggtcgttcggctgactgctgcacattgccatgcaaaactctgcttcactacccaacaatttccatcccaccatcttgggtgaggctgccagacttgagactcaggggcaatgagggagtatgtgtctcgctgtacacttcgagtgaacccagggacatctacggttgggtttgtttggagtggtcagaacctgctcgagttcctgcacagcggtgccagttcacgcgggaaagaagagcgacaagtacatgagaacattaccgtcaaagacgagttgcgaggctttgagnnnnnnnnnntgcaggaaagaagagcgacaagtgcatgagaacatcaccgtcaaagacgagttgcgaggctttgagccctgggatggctgcagtgtagtcccatgctgctgggcaaaggcaaggaggctggggttgaggtgcggtggcacgccgtgacatgatgggcacgcggtagactaaacccacatcagtgtgtaagcactcttcacctattgtcgaggtcaaagagcatgtcagtaatgctgtatagatgggccaggtaagcagggccgaggccatctctggcacttgcgcggggtgcacgagggtgtgttcgatctcttcgattggcgagctgaagctgttctgttctagactcttcgatacagtactaccttgcctggtgccgtgatctgggtctgacgcatgtgctctcaaatgaggaactcgtacctcacacccaaatattaccacgtgcatcccgatctttatctttgtccgggtcgtggctnnnnnnnnnnaatacattactaccttgcctggtgccgtgatctggatctgacgcatgtgctctcaaatgaggaattcgtacctcacacccaaaattaccacgtgcatccgatctttatctttgtccgggtcgtggctgcaacagttgcgttttacagttgcgggactagcagcctataccaatcaggctctgctagaaatcatcgtcaaaggctcttcgcctctggattgtgacggtggtcttctgctgcgtctgctcgtttacttgttccaagagctcaatcaagcgatcctctgacacctgcaatgcaaacaacgtcggcaaaaacgaaacgctgagaaagtggggaggggttgacaaacccggcatattgctccctatgcagtgctttacgagtggttctagcgaggcatgctgtgccatccagttgacctctcgaattgnnnnnnnnnngacgagtgattctagcgaggcacgctgtgccatccagttgacctctcgaattgcagacaccggtgcagactctgtcccattcctcctctcaatccttctcaccttctgttgtatctgtccgcggcgagccgcgttcaggatgaggtcctcgatggatcgcgccttgtctggcttgacaagcgagatcctggccactgcacgggaccgaggagaatgcgccaagctgggtgaatcaggcctgtattctcctcgcccctttaccacttcccatcgcgcacatgcttggatacagatcccaacttccattgtaatgcagaacaatccctccttctcgaaacccacatcgttcgcgagccgagggctgaaggatggcagccagcatgccccgcctctggtcgtcggctgcttcctgtgcttcctgagcagcctgctgctcctcggcggacctaggtgcctgagcatcgagcggggatgtgttgatgtaccgatgtagtgcttttaagactccacctgatctagagacaccagccgacattgtaaacctactctgccttccnnnnnnnnnncgatgtactgatttagtgcttttaagactcaacctgatccagagacactagccgacattgtaaacctactctgccttcccctcctccagacctggcccccttgctgcgccatgagctcctgcatgcgccgctggcgaatagcctcaagctgcgcatcctccgactgttcggaagaaggggagatttgattgtgaaccagaccaggtcgtgattagtgacctgtgccgcttcgacttaccatacnnnnnnnnnngtcgtatgtgaaccagatcaggtcgtgatcagtgacctgtgccgcttcgacttaccatactcggcacttctcggggcacctcacagccttgcagacgtagccagccttggtaatcactggtttcaccaagatttaatgtctataacaggggatcgaacagagcttgcatacatgttgaagaggtgacctccgagagtggacgtgctcggcgtgaaatgtgggtcctgcctggaccgtgcatgacgtcaattccacaggggcgtcattcgacatgctttcgattatgtatatttaatttcgatcattacagtaacctttaaagtaatggagagttgcctctgattagaaaagggaagcgcgggtgccaggcagaggagcgtatgcgggcggggcagtaatacgatgatggccctgcgtgcatgtcgcatgcgagctgctggagtgcagagggcgagctcaatgttacagactcgcggtgtgtgagcttggatgtatgcgtgcacgctttggatcgcagcctgcgagggagtgcctgctgcacacagtggctggtgtgactccccaaccggacctttgcacatctcacgcctctaccccgccctcgcactccctcgctcccagatgccaccaagctcgctgctcgtgcgctgtgtgcctcttttggctcccaccacccctcccgcctgctggacaatggacccatcggcttcctggtggacgaccccgccggcgccgcccccagcgacgacgacgccggggtcacagatgccgatctgtctttcgccccctccccccctcccttcgagaccctgcccctgggcgcgtgcctgaccagcagcgtgcccagcggcggcgaggagtggcgcttcgagacggggcgcctggcgcggctggccgacggggcctgcctcctgcacgtcggggataccagcctgctggcgacactggagagccagccgtcgcgctccacctggcgggaccccctgagccgcttcgtggtggactaccgtgagaggtttgcggcggtgggacggatccccaccacctacttcaagcgtgaggtctcggccaaggaccacgaggtgctggcggggcgggcggtccagcgcgccatgctgcccctctttccacctggcttcccgggccaactcagggtgaggcggtcaagggggtgtggggcagcaaggggggagtacagcactctgagggaggatgnnnnnnnnnncggcttcccgggccagctcagggtgaggcggccgagggggtggggggcagcagggggggagtacagcactctgagggaggatggggtgtcgagagtggagcaccctgccatgcatcggccccccaccttccctcccatcacccccatgacaccagatgacggccagcgtgctgagtgccacccccagcgctgacctggaggccatggccatcaacgccgcgtcagccgccgccgcctgctcctccctgccctggaggggcccggtgggcgccgtgcgcgtgagcgtgggcgccgatgggaagccggccctggggctcagcgcctcannnnnnnnnngtccctgccctggagggggccggtgggggccgtgcgtgtgagcgtgggcgccgacgggaagccggccctggggctcagcgcctcacatcccgccaacggcgagccgccccgcctgtccttgctcatggcggccacggcagaccagcgcattacgatgctcgacgtggaggtgaggggaggccgaatcggtggctgggaatgcacaggggtgacagggcctgtgccatgcacctggtgccgtcctcaccccaatccccgtgcacatgcctctgtcaagtccctgttctgaacgtatccaccaaccatcccactcctccctgcgcaggcctgccaggtgccnnnnnnnnnncccccatgcacatgcctctgtcgaggccctgttctgaacgtatccaccaaaaatcctactcctccctgcgcaggcctgccaggtgccggaggcggagctcatcgctgcgctgcgcttcggtgcggcggccgcggcggccttggtccccgcgcaggtggggctggcgaccgcggcggcacgcccgccgccccccgccgcggccgacg

SEQ ID NO: 46245 - DNA, 61 bp, Chlorella protothecoides
cagtgcacggcgtcgctggggagacatccagccttcactcccacaccacatccagcttcac

SEQ ID NO: 46246 - DNA, 99 bp, Chlorella protothecoides
cttgtagcttcccacgtaggtcgcatagccggccacagctgattgtgggtatattgggagagtaagagggaggtgcggtggatgcagtatgcaatatgc

SEQ ID NO: 46247 - DNA, 61 bp, Chlorella protothecoides
tgtgaacaaggtacaaacaagaaggtttccacccggcgcagccatgaccggcgtcaggcca

SEQ ID NO: 46248 - DNA, 61 bp, Chlorella protothecoides
tcctttgctcgatgataatgtctcggtgaacaggtgcccggctccatgcttcttggctccg

SEQ ID NO: 46249 - DNA, 13033 bp, Chlorella protothecoides
  modified_base (313)..(322): a, c, t, g, unknown or other
  modified_base (583)..(592): a, c, t, g, unknown or other
  modified_base (885)..(894): a, c, t, g, unknown or other
  modified_base (2783)..(2829): a, c, t, g, unknown or other
  modified_base (3270)..(3279): a, c, t, g, unknown or other
  modified_base (3451)..(3476): a, c, t, g, unknown or other
  modified_base (3647)..(3656): a, c, t, g, unknown or other
  modified_base (3866)..(3875): a, c, t, g, unknown or other
  modified_base (4684)..(4693): a, c, t, g, unknown or other
  modified_base (5128)..(5178): a, c, t, g, unknown or other
  modified_base (6189)..(6276): a, c, t, g, unknown or other
  modified_base (6504)..(6513): a, c, t, g, unknown or other
  modified_base (7093)..(7102): a, c, t, g, unknown or other
  modified_base (7996)..(8005): a, c, t, g, unknown or other
  modified_base (8325)..(8334): a, c, t, g, unknown or other
  modified_base (8586)..(8674): a, c, t, g, unknown or other
  modified_base (9192)..(9201): a, c, t, g, unknown or other
  modified_base (9878)..(9887): a, c, t, g, unknown or other
  modified_base (10207)..(10216): a, c, t, g, unknown or other
  modified_base (10980)..(10989): a, c, t, g, unknown or other
  modified_base (11792)..(11801): a, c, t, g, unknown or other
  modified_base (12084)..(12206): a, c, t, g, unknown or other
  modified_base (12456)..(12465): a, c, t, g, unknown or other
gcggaccccagcgcggccagcgcgggccccggggcgccggcacacaggccgcggattccacgcaggtccagggcctgcaggcgcggcggggccgcccaggcgtcgggcagccgccccgtcagcgcgttgtggctcaggtccactgcgcgcagcgtgtgcagcgtgcgcagcgccgccagcgcgggcgagaggcggccccgcaggccgcgccttgccagctccagcgccagcaccgcgcgcccgcctgtgtcacacaccaccccgggccagctgcagatgtgctggccctgccagtcatcaaacacgctgccannnnnnnnnncgtcacaaaccaccccggaccagctgcagatgtgttggccctgccagtcatcaaacacgctgccacggaggggggcctgttggagagagggatggggggtggctcggggtagaaaggggcgagtgagaagaggggaccaacaagggtgcaagagtggggggaaacgcgaggagtgtctgcatcagggaagaactaggcagaggtgagatgcatggggcaaccgattcttatctttgggacgcgcagtgatcctcatggacnnnnnnnnnncagacgcgaggagtgtcttcatcagggaagaactaggcagagatgagatgcatcgggcaaccgattcttgtctttgggacgcgcagtgatcctcatggacatacaagagtggtgcagggggtgaacgcgacctcgcaggcacgcggggcaaggtcaagggatgtgcacacgcctctcgcaaggcccacaagccatagcggtgagcagctctgccagcatcttgcggcaaaaaggtctgatacatgccccggtcgccccaggatacgacgcctggcacccccagcccaccctgnnnnnnnnnncgactggtgcagggggtgaacgcgacctgacaggcacgcggggcatggtcaagggatgtgcacatgcctctcgcaaggcccacaggccatgggggtgagcagctctgccagcagcttgcggcaaaaaggtccgatacatgccccggtcgccccaaggtacgacgcctggcacccccagcccaccctgaaggcctgcagcagggttgcctgctgtaccaggctttgatgtgggacctctacatccagacagagcccactccggacagccagcaggacgaccgcgcaggtgatgagcggcactgccgggcggggacacacagaggggcgatctgagctccaagccaggctgcacggagagcaccatccagcaacatgccccgagatttggcctccccagagcgccatgtggggaagcagaggcacccggcacctgctccacggctctcaaagggtctcatggcagggctgatcaggcactcccacagcaactcctgggggcggcagcctgcgtgatatgcagtggaaggttgggggccgtccaagggtaacgtcccgatgtgtgcatacaggcaagccaaacctctatcgatgcgtgtttggggtgcgcaacccctgtttgggtcatgggcccagccctgctacccgcggggggtgcacctggtccccgaggtactcggcctgcctgcgagcacggggcaggagcccctgaactccacaacccacttcagatgggagtgtgatgaggagtactgggggtggacgtcagtctcttgccgagggggtgcccgttgctcattcccaatcccgccacgaccatgggtgggggtgagtcatgcgtcatgctgcctcaccaatatggcggtccaggcatgctggtccagcgagcaagcggaagcactccatgcatccaccctgaaagtcttaaaaagtttgttgttgtcatcgcttggggaggaataagggtgacattgccgcgtcgtcatcatgtcgtccacggcggtcgcggctttcagcctgaagaacttcaacaataacggcatcccctccaccagcgacgtcggggtgggttggcgaatggatgtggtcatttcctgggacgggttcaggtgcgcatttcccccggtcccagcccaacccccccaccctcccacacttcctgtgccagattgcagcatcactgaggaagaaggtggatgatgccaccttcaccttttccttcacggattcttcgctgaaggagcctaagctggggaagggggtcgtcctggccgtggagaagcccctggcaggtgtggcggcagggtggggtgtgtgggaagggaggtggctgtccgaaccggtgtggttgaatttgagcacatacagctctctctggtcccgccgcatcacttcaagggccatctgatatgctggcagggtcagcagcgagtcccggctccgtgcatcgccctcctcaaacccccctccctcgaccccacagatggcttgaaggccagcctggcacatgactttggcgccagcaacagcgtggcctccctcaccctgaaccggttggtgaacggctcggatgtgcaggtgaaggccatctacaagcgggctggggatgtgttcatcatggaggagcagtggaaggtggacaagaacacgcgcatcaatggcaggtgtgtaggggcaggtggcctgggagggggcgcgggggggggcggagggatattcgggacacaaagcgtgcaattgaacgagagctgagcccccaggcaggcatgcagggtgagagttgagacggaccaatcgtgtagaggggccttactgacgaggtcgccaacagattgtggtaacgtgcctgctcggttcgcacactcacaccttcctcccccgcaccccacccnnnnnnnnnnnnnnnnnnnnnnnnnnnnnnnnnnnnnnnnnnnnnnncccgccctcctgcagctacaactttgcgtccgaggaggcggcagcctccgtgacccacaccaacggtccgtggaccgcctccgctgcctacaactttgcgcgcgccgcaccgctgctcagtatcagccggaaggcgggtgctgacacggtgggcgccacctatgcggtcaacgaggacgtcgggacggtgcactggagccgcaaaccagtcagggtgagcatgtttcctgttcgagcattgggtttgcctgctgctgaccggcccatgttggaaagttggatggcgacctttggcctcagatggtggggtttcttgccccgcccctgtcgaagctcctgggccaatccctgctgtgatccctcttcacccccaattcctcctaaaacctgcaggccaccctgagggcagccaatgtgacgggcaagccggcatggagcagnnnnnnnnnntatcactcttcacccccaattcctgctaaaacctgcaggccaccctgagggcagtcaatgtgacgggcaagccggcatggagcagcctgtctgccagcattgtcgccacgcacgaattcgacttgtgatgcggcttgcaatctgggcagcgagctgtggggctggcggcacnnnnnnnnnnnnnnnnnnnnnnnnnnggcctccactcagaggtgtggaatttggcgtgcatgatcgcaaggctttggggcagagttcaccacagggtcgacgatctttgggcccctgagagtgatttgcaccctgcgggatcctttcagccctggcccttgaattccccactatgaacaatgcaacacttgaagtgnnnnnnnnnngtccactcggccctggcccttgaattacccactatgaacaatgcaacacttgaagtgagcaagggtttgtgtcggccgcgtattaaggcagaataggtccagtcctggctcgtgtgtccaagagtggaaaggggggcatgcatcccaacaagggcctgggattgcccagaaagagtcgaggtgagggtctgctggcaagcacatggaggnnnnnnnnnncatcaaggcagaataggtccagtcttggctcgtgtccaagggtggaaaggggggcaagcatcccaacaagggcctgggttgcccagaaagagtcatggtgagggtctgctggcaagcacatggaggaaaatacgggtggacagcacgggcaatcccgtaatgtcttgccaggcctgccatttattgcaaggtgacacagtggatgtgtgtgtggaacagatctgcattcatttgggtctgcaactcaagtgctcgttcctggagtgggttggagcccttcaaggaaacccagttcttgaagatgaccttccctgctagcagcggaagtcctggctgagtggcgctcagagggtgggattttgccgcccgccttggcccctcccccccgtgccgtctggcgtctcccgcgcggcctccttggccgcccccacctccccgccctcggtgcgagcgctttcggcctggctgcccagctccatgctctccatccaggccagcgcatcggcccggcccttgtcgatcagcgacaccaccgtcgcctcgtcggccggctccagggcccaagaaaccatggaggccaggctgtgcggccatggcgtgaaggtgtctggactgatgccaatcctgtgggtggcgcggggcgaacggaggggtcgtagagagcacaaaacctcgaacgaggaccccacagcgagcttgagccggtaccctgacagccgcagcgacggtgcaacacaggattgccctccagacgcccatcttcccccaagggctccgagctcgcctgtagatggggctgagctggcgcnnnnnnnnnnggaacggaggggttgtagagagcacaaaacgtcaaacgagggccccagagcgagcttgagccgttaccctgacagccgcagcgacggtgcaacacaggagtgccctccaggcgcccatattcccccaaggcctccgtgctcgcctgtagatggggctgagctggcgcgagggaaagcagcagacgcgcacccccgtcgtgccagggggaatggggatgaagttggtcatgccgccgtccatgacgtaggacccccggaactcggtgaagaggctggagtccagccagtaggggatgtggcaggaggatagcagggcggcgatgaggtcctccctgtcctggaactccgagagcagcatgggctggagcatggggaaggccttgctcaccccgatctgcagagtggaaagggccgggggggggggggggggggggnnnnnnnnnnnnnnnnnnnnnnnnnnnnnnnnnnnnnnnnnnnnnnnnnnncgaggttgaggtttcccagtcgaggggtgttgcagtgacctgggaactgcaatgaggatgtcagcagcgtgccacgggagccaagcagctggctgctgctccagggccaccccttcccccaacccccctgttgcatcgagcccctacacagcaccctgcatagatgtatccagggtctgtaaccccagctcccgcatggccatcttgtctcacgctcccttcctgttgccactcacatacgccttgccctggaccttggtgtgagcatcctccggcaggtgcttgtgcagggtcctggcgagcacctcccccagccggccccgcgtgccatgcagccggcagtcggccatcagtcgcaggctgaactcggtgatgtcatccagccgcatgccggaggtgaggcacaccgccagcagcgagccggcagaggacccccccaccttggtgttggctgctcggtgcgggacgggacgaggggctctcagcgagggaggccaaggggacatggcgaggcgggtggggagggcacagccccccagcagccccagaatcgatacggccttcccctcagccctccgcgcctgcgcaccagtgagtatctgcccatcccgaagggccccagagactccaatatagtacgggaagaggcacccgcctgcaggtggtgattggggggatttggaagcatgaggggaaagcactcgagggcgctgcccggccatcctgcgcagcagccttccacttctgctcggggtgttgccaacatcgatgagacgccaccctctggatctgggcatcgcttttgtcggcccacctgcgctgaagccgaagctcagggtgccttccttcactgctttgtgcacggtgtccttccacgatgcattgctcacaatgagggtgccccccaggttctcgaagactgattcatttgccacggcactggtggtaaactgcagacgacaggctgagctcgagagtgcgttccgtgcaagagtgtgtgcacggcgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnngactccggccaggatgttcgaggcgaagcgcatagcccacaagcgcgtgcgacgagttcgcgtgatttgtgtaaattgcctccactaccactttacactcatgccctccctctggcgctgctggatggtgaggggaagcagagctggaactttattcattgcaaattcctgcaccatgctcggaggaaagggcgcgtgactggagttgcctggcgggaaattcggctnnnnnnnnnnagagttcgcgtgatttgtgtaaattgtctgcactaccactgtacactcacgccctccctctggcgctgctgggtgctgtggggaagcagagctggaactttgttcattgcaaatttctgcaccatgctcggaggaaagggcgcgcgactggagttgcctggcgggaaattcggctccagtcggcggcaagtctgtaggttcatcacgccaagtccggccccacagcgccctctctccctctggataagcagagggtgcctcgcgggagcggttagtaggcgcaatgaagcagttgatttcttcgaggacactcgctctcccctccggagtggacgtggaggtcaaggcccggcaagttcgcgtgaagggccccaggggtgagtctcggcgacttcgtggtctttggggatgagagaatggcttagtttgtttttggagttatggtgcggttgctgctatgcggggagagcccgggggttccctcggacctcggcgcggagtccgtcgcgccgtgcccgcctgggctccacccaccgcaccaggggcagtatgctgcataagtctacgcgtgcccgacccnnnnnnnnnntttccctcggacctcggcgcggaatccgccgcgccgtgcccgcccgggctccacccaccgcaccaggggcggcatgctgcataagtctacgcgtgcccgacccatcgcactcacagcccgcactgtgcgggggcgaggcgcccgtggtcacaccaggccttgcggcacgcccacctgggctcagcaggccatccaggatcacggcccggcacccttggctggcatcccgcctccccacccactcccatccctcctttccccccacacccccccaggcgtgctgaagaaggacttcaagcaccttgccgtggacatgttcctgacggaggaggatgggcagaaggtgctcaaggtggacaaccactttggcaagcggaagagcctggcctccatccgcacatgcatctcgcacgtgcagaacctgatcacgggtgtgaccaagggcttcgagtacaagatgcgcctggtgtacgcgcacttccccatcaacatcaacctggagggcaacggcaccaaggtggagatccgcaacttcctgggcgagaagcgcgtgcgcatcgtcaacatgctggcgggcgtcaagtgcgagcggtcctccgccgtcaaggacgagctggtgctgaccgggaacgacatcgagctggtgtctcgctccgcggccctcatccaccaggtctgcctggtcaagcacaaggacatccgcaagttcctggacggcatctacgtcagcgagcgcggcaccctggtgaaggaggagtgatgggcgtgaagccctgttcctctgcccccgcccagtctgtaacgtcactgccctcggtagggggacagcggggaggagggagaggggggtgggaggggatttatggccgccggcgccctgactgcagcggccannnnnnnnnngtcctctgcccccgcccagcctgtaacgtcactgccctcggaagggggacagcggggatgagggagagggggggaaaagaggggatttgtggccgccggcgccctgactgcagcggccagggtggggagccgctgcgacagccgtggatcgtcacagcaggtagacaaggaggaagaaggcatcggtgaggggggggggggaagtggagcgcggctgatctcttcatgatcacgctggaggggatgagtcatgccatccaccgtgtgggtcggaccgagaatttacgctacctacctgctgccttcagccgcgcgttctnnnnnnnnnncggggggaagtggggcgcggctgatctttttatgatcacggcggtcggggtgagtcatgccacccagcgtgtgggtcggaccgagaatttacgccacctacctgctgccttcagccgcgcgttctcagtgccgggcatgtgcattagagctgtgcgatgcatgcacatggactgtgcattggatacagagaggtttcgagagctcgctgaggccgttgtgcggggccgatcgcgcagtccgcctcgagggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggaccacagcctttacgattgtgaagaagcatgattgtctgacgcacctccgggcagctgtctcttcccagtgctgcgctgtggtatcgacccgtagtacgtcgacacgccccaccgcccgtgctccccatattagtgcagcgagggccactgctcgatacgtatattgacagggcatcatctcccagcacattgtaccaggttgccgggggagaatgggaagctcccccccacactcccggcccccctccgccgcggactcggtgggcgacgagcgggccagcctcatcccccgacgccacctgatgtcctacgtgtcggagccaccctcctccctgttcgccatggccaagctggcggaggaggagaaggcgctggagcaggaggccctgctcaaagccatggacgtccctgagggacccctgccccgcctggggcccagggcgatcagcctgcacccggggggcgaggcccccgtgcccccaggcccccacctgaggagcaatctggtgtggnnnnnnnnnngaaagccatgcacgtcccggagggacccctcccccgcctggggcccagggcgaccagcctgcaccccgggggcgaggcccccgtgccccctggcccccacctgaggagcaatctggtgtggttccaggctcgcgaggccagccacttccaggagcgggtgctggagcacccggtggcgggcgacctggcggtggcagaggcggccgagacggccgcgctgcaggggttccctcggcctggctcacggagcccgggcgcaccccagcacaaatccccgcccaagctccccgcaatgatgcccgagaatggagccccaggccacgccgccggccgagcggccggcggggtcaaggctgacctcgggccgctgagtccgaggggccggggcgagaagtccggcggccccaatggtgctggggatgatgaagaagtggtgagcttggctggagggggttgggacccttgattgtggagggccagcgggggctgctggggagagctcgttgccgtccaggcacacaggcaggagtcgggttgcccaagcatgggggatgaagacccagaatcgttgagctgttccccctcccccatacttgccatacattgccatctactgtaatgggacacgctcagtatccacacccctcccggcaggaccccctggagaacgatctggnnnnnnnnnnatttggctgttcccccttccccatacttgccatgcattgccatctattgtaatgggacacgttcagtatccacgcacctccccggcaggaccccctggagaacgatctggactggacgacggggaagcggcctgcccaaaagttttacaagcggcgctggttctggctgtatgtcatccccctctccatctccgcaagcctcgtcatcctggtgaggggtccggtaattgaggaagcgacgctggggcctttcatcggggatgggtggttgcagggaactgcatgttcacaggaggggtcccaaatggcatgggggccannnnnnnnnntgtcatcctggtgaggggcccgggaattgaggaagcgacgctggggctattcatcggggatgggtgattgcagggaactgcacgtgtccaggaggggtcccaaatggcatgggggccaatttttcaaccccgcatcccctgcctccccatccttccatccccagggggcatgctatgtgcactttgcaagcagcactctcctgggggatgtccagctctggaggctgctcttcttcctggcaggactccccatcatctggtgcggcgcctggggctgtggtggtaaatgagactgaagattgtggcttgaatccatacatcgcagtcgctgcccccctctgtcactgtatgtcgtttcccatcgacctgctgcctcgcctactccctgcccactccatgctcaggtactttggcgactttgtgacatgggcggcggtgtggggcgtggagaagtcgcttttcacttggaagaatgcgctgtactttgcctatgccgtccgggtgagggcggggtctgtgtggtttatcctggctgaaagggacatgccgctggataggagggaccacagctgtctgcccttcattgccccggcacatgcctgtgctgccctgtactcccccccgcgtgcaggcatctgacgatgcctgtctcgtcaggccaggcccacctatcaacgtgcctcgacattgcgatgtgctcctgtgctaaggtgttacctcaggcctctgcgtccaagagacctcagtaaccctcacaatgcccnnnnnnnnnntgtcaggccaggcccacctaacaacgtgcctcgacactgcgttgtgctcctgtgccaaggtgttacctcaggcctctgcgtcaagagacctcagtaaccctcacaatgccctcccctgccaccattccacgcagcggcccctgtccaacgtcctgcgtgccgccctggggctcgcgtggtgggcggggatgatgaccatcggcgcgggggcgcagccctccaacctcaacaccgcatacaccatcatcctgcgggtgcggccgggtgggagctctttgggaagatgatggttgggctgccagggtgcggtggtggatgagacccagtaagatcgatctcttgccttgtcaactccacctcgagttgctgctttgacgcgaggtgcgatgtcgcttgtgggagcgtcttgcctcagccccgctttccttttttcatcacaggtgtgggcatgcatcacgttgatgatgacggccaacctgctcaaaaccctgattgccaagctgctcagctccaagttcgtccgcgagtcgcacctggcgaagatgcagcagtccatcaagaaggtgtttgtgtgtgtgtatgtgtgtgggggttaatcgtgccagtgcaagcaggtcgagtggaggttgggaaggcctgagctgcatgctggccctgacatttatgtgagggttcctcccacaagtacgatggagccatgcccccagtggacatgcagcaagcctgcgtgcagaagcttgcccctgcatccatcatcgtgtgccccatcacccccaaacccgcgcacaggagcacctgctgcnnnnnnnnnnggcctgcgtgcagaagcatccccctgcgtccatcgtcgtatgccccatcactcccaaacccgcgcacaggagcacctgctgcacctgctgctccagccccggcagtcctacatagacgccgccaaggagtacgaggtggagggccccgacacttgggatggcgaggcggaggccgacaaggccagggacccaggcggccgccgcacgcagagcgccttctccctcagccctggtgcatggagcggcaagaaaggaggcctcgccaggagggtcaccaaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattggtccctcccggctgattccagtgccgctcgcaccgataggctgggtgtgcctgccctgcaaacccccttcctcatcacaaggacctcatcatgctgaggctgtagcgcccacgacagctcgctcccctcacatccccccaccccaccccaccccaccccacctgtacagctctttgcccgaaaggacaagccgggtcccgggcccggcgacgatgtgcagcccccgcgcgatctggagaacccgnnnnnnnnnngacgcagagcgccttgtccctcagccctggtgcattgagcggcaagaagggaggcctcgccaggagggtcaccaaggtgggaaggggggtgcaggtgtaggcatgagtttcaacgatgcccgagagaagtacagggtttgcctggcgcatggaaattgccggatatggggatcttggcagacgggtgattggtccctcccggctgattcccggtgccgctcgcaccggtaggctgggtgtgcctgccctgcaaacccccttcctcatcacaaggacctcatcatgctgacgctgtagcgcccacaccagctcgctcccctcaaatccccccaccccaccccaccccacctgcccagctctttgcccgaaaggacaagccggctcccgggcccggcgacgatgcgcagcccccgcgcgatctggagaacccgccccctccccgccccgcgccccgtgcccaggccaagacggagtcgctaggcgccgaggccgcctggggaaagggcgggacccccgactccacgccacgcgcctcgccctcgcagacggcgtcgcaagcatcgcagcc

SEQ ID NO: 46250 - DNA, 80 bp, Chlorella protothecoides
gggatggcaggcctgcccatgccccatgctctttcccacgtgtatgcaacgacaagccgcctcgtccacgatcgccaggt

SEQ ID NO: 46251 - DNA, 62 bp, Chlorella protothecoides
cgcccctaccatctcatgctctcccccccctctcctcaccaacgacaggttttgtcagggtg

SEQ ID NO: 46252 - DNA, 111 bp, Chlorella protothecoides
tgctgcatgctccagcaggccacagggcgctggcggcagcgctggtcccggcaacaccgcatttggaatatacgggcagggttgaggcggacgggccagtggccgacagca

SEQ ID NO: 46253 - DNA, 69 bp, Chlorella protothecoides
aaggtggagctcttgcgtcatgctgttgaaattgaccatcctgtttccatgcgatgtgcccaaggttca

SEQ ID NO: 46254 - DNA, 61 bp, Chlorella protothecoides
tcccgggagtgggctggcttcctaggcgggggttgcctgcactgatcgtcggggatgaggg

SEQ ID NO: 46255 - DNA, 61 bp, Chlorella protothecoides
acttgtctcaccattgctcatgctcattccacccttctcccaccaccccagggtgtgaacc

SEQ ID NO: 46256 - DNA, 80 bp, Chlorella protothecoides
tggcaggagatggaagcaggagactggaatgcattgagtctgcagctttaagctcactgcacgtgcctcattggtccaag

SEQ ID NO: 46257 - DNA, 85 bp, Chlorella protothecoides
ttcatctgatgctgaacaagcagtacggatccacatgccgcaaagttgagacagttgtcactgctgctctgcctgaacagcgtcg

SEQ ID NO: 46258 - DNA, 61 bp, Chlorella protothecoides
tgcaggtggttttggtggggttattcgaggagttcgctgggacgagtgcttgacctcatgt

SEQ ID NO: 46259 - DNA, 61 bp, Chlorella protothecoides
tggcgtttcagcgaccagacgctcgcagaggaatgtcgcggtgtcgtacaggtaattgcct

SEQ ID NO: 46260 - DNA, 75 bp, Chlorella protothecoides
atgctagtgaggtcatgcatgctcagtagacggtccaatgtaatttcacgtcgacgtccttctgacgtggcaaag

SEQ ID NO: 46261 - DNA, 110 bp, Chlorella protothecoides
ggcacgatactcagtttgcctgtggttgaataagtggggtagccaccagcatggggatccccagaaccggcccaacagatgacgcattgtgacatcgagcaatgcatcac

SEQ ID NO: 46262 - DNA, 61 bp, Chlorella protothecoides
gacccggacttgctgaagcccttataccttcaatttgtggagggtggacgtgtatagatgg

SEQ ID NO: 46263 - DNA, 80 bp, Chlorella protothecoides
gaagatagactcgcaactcctgagctgtgcagaaacgtgtgaggcacgaatgctggcacatttcggagaagcacagagga

SEQ ID NO: 46264 - DNA, 78 bp, Chlorella protothecoides
gcagaggcccaatcgccttgcgatgatgcttcatgggagaaggaacgcctcccaagttcactttcctgcttggtgcta

SEQ ID NO: 46265 - DNA, 86 bp, Chlorella protothecoides
ttggtgagattcggtctgggtggtgcccagatttgttgctttggtggatcgtggacggatggggagggaaggtgcctgccccatcc

SEQ ID NO: 46266 - DNA, 74 bp, Chlorella protothecoides
ccagcgtggtgcacacctccatgcccaggccgcggacgtcacgtaccatctccagaacacgctggaactggcgg

SEQ ID NO: 46267 - DNA, 18100 bp, Chlorella protothecoides
  modified_base (1582)..(1591): a, c, t, g, unknown or other
  modified_base (2600)..(2609): a, c, t, g, unknown or other
  modified_base (5143)..(5152): a, c, t, g, unknown or other
  modified_base (5919)..(5928): a, c, t, g, unknown or other
  modified_base (6732)..(6741): a, c, t, g, unknown or other
  modified_base (7508)..(7517): a, c, t, g, unknown or other
  modified_base (8789)..(8798): a, c, t, g, unknown or other
  modified_base (9685)..(9694): a, c, t, g, unknown or other
  modified_base (10614)..(10623): a, c, t, g, unknown or other
  modified_base (11425)..(11434): a, c, t, g, unknown or other
  modified_base (12391)..(12400): a, c, t, g, unknown or other
  modified_base (12923)..(12932): a, c, t, g, unknown or other
  modified_base (13197)..(13206): a, c, t, g, unknown or other
  modified_base (13911)..(13920): a, c, t, g, unknown or other
  modified_base (14079)..(14088): a, c, t, g, unknown or other
  modified_base (14527)..(14536): a, c, t, g, unknown or other
  modified_base (14676)..(14685): a, c, t, g, unknown or other
  modified_base (15756)..(15812): a, c, t, g, unknown or other
  modified_base (15978)..(15987): a, c, t, g, unknown or other
  modified_base (16067)..(16076): a, c, t, g, unknown or other
  modified_base (16156)..(16255): a, c, t, g, unknown or other
  modified_base (16857)..(16866): a, c, t, g, unknown or other
  modified_base (16966)..(17160): a, c, t, g, unknown or other
  modified_base (17621)..(17630): a, c, t, g, unknown or other
gggggaaagggtagtgagggggtgggggggtggggggaccgcgagggtgtatgcttcgggttcggtgccgcctcacaccccgtcaccccgctcgcagatgcaggagctggagccagcatcgaagaagtaccattgccccgacggacactcccctgtgcagcctgacccacgcgacccaagcacaggtcgctgcacccttgcaagcattgcgaggcagaaagtcggtcgcaccgacacccgcgccgaccctcccgaacggtatgagccgcttccgggccccctgaccccatacccaggcccctcggccccgctccatcaatgacgtctcatcaagcggcctcacctgtcgcgtggcagctccagctcgtccagggtgcgggtccagaagacggcatacaggagcggagagagggccctgaacgtggcctggctcgccatcagccgctccacctccggcaggatgccggccagggtgccaccgacgccggcggccgcgccgtttgcgactggcagcgcgccgtttgcgactggcagcgcgccgtttgcgactggcagcgcgccctcctccgcggcgctgtccgcctccatcgggccagcctccgtcgggccggcctccccttcctccagctccccctcctccccggccgcagtgctcgcagcggcagacggcgccaatgccgcgcggggagggacagcagctgccttcaccattgggcgcaccagctggaacaccacttccggctcgatcaggtagtcatctaccatgctctgcgggccaagcagatggaaatgaggagggacttggaggggatgaggctgggacaggtgaggggccaggctacattggatccgccccttggacagggccccgggatgcacttcctcagaggcggggccgcgccctggtgaaagtccctctgacgccaggaggaaaggtggacacggcaccctccgggcccttgggagccagcttgcagcattgcgtcagacgatgcgatatccaaagctgtaatgtcgtggtagacgacaacccacacctccaccggggccgattttctggcccacctggatggatggcagcaaggcggcgtactgggtcggggtctgggccgtctgcaggaagtcgatgtactgcagcagcgtctcctggcagctgtcgtacagctccgccaccagcttgaggtgcgagtagcctgcctgcagcgtgatcagtcgcttctgctgcgccagcaggatgagcaggggcagggccagctgcttagtctccggggcctacgcagcgatccagtgggagagagtgaggggggttgaccgaggatcttgcaggcgggcgaggggcgcagcagagagttttcctgcgctccgtctgtcgtgtccttgtgccagaacaagaggttgcggccattgcttggcgtccacaatgtgactggaggcaggccagcactgccatccgcaccccacgctgcagtcatcccttgaccatcaggaggggcgagttttgacgcccttgccacctgacgaaaggggaagtgtttgcccgccaaccccccaatccagacccagacctcagccagtattgccnnnnnnnnnngccccacgctgcagtcatccctcgaccatcaggagggcgggttttgacacccttgccacctgacaaaaagggggagtgtctgcccgccaaccccccgatccagacccagacctcagccagtattgccccacctcagagtccttgagggcggccagcaggcgccgggtaccaccggccagggccttgggagatggcctgaactggccctggaagaagacctcaacatgcagcgccttggaccccgccagcgcgtccagctgatgctcggagacgtcattcacgagttcgattccctgttgggcataggggtgaggggcagagccatgaacaggtggggatcaactgtgcagcaggttggaggctgaggcatgagagaatggggaagtggcagatgtccgagcatcttcagggccagctgtcgcagactgctccccaagcacagactgatgctaggaagccttgtctggggcagtaaccataatgcaaggagtgcagaggctcagagggcaggaggaaggggtccatatccctgccacacggtcaccctgcctccacaacagcagtacaggacccgcaacaaccacgtgccctggccctcaatgagccctacggaccataacataccgtcatggcagtgaggatctccttgagcaccaggaggtccagcgactcagtggacttgagctggttggtcaggtactgcagcagcgcagacagctccatgctcgggtacctgcggcagatgatgcccgtgaacgctgccagccactggaaccattcctccatgttcacgccgtcctcctggcgggtgcggggcgggaaggcaggcttgtggagagggaggcagggtgttggcatggccaatatcaccactccaccaccatgctctggctcagggtgtgtgatgccaatttaaggggacccccacgcccacccagtgaatgcacagcaacaccttccctggactagggcatccaaccccccactccccctgccacaccttgagctnnnnnnnnnntagggtgttggcatggccaacatcaccactccaccacccatgctctggctcagggtgtgtggtgccagtttgaggggacccccatgcccacccagtgaatgcacagcagcaccttccctggactagggcatccacccccccactccccctgccacaccttgagcttgcgcttggccgcagacagcttgcgcaggatgacaaaggtcagcgcgtcgaaggtcatgggcgtggacagcctcaggctctctgccacggtcagcaccatgcccggcatgcccatcacctggacaaaggggtggggggctggggtgctgcattctgcccgctcaaaaggaagcgggtgtaagtcgtccagagcatgaaccttcaccccctcccaggccctcctgcggtgtgctgcacctccaccttcccaacaatgtcccccctgacgcttgaatgccggccttgcacgcccctgctgccccctccacgtcgctaaaatgcacgcacctggcggatgagctgctccgcgatgggcagcggcacggcgtgggtcagcttggccaggcgccggcccaggggcttcatggccgccttggcctccttgtggctgctgggagccgtgacgcggcgcagtacgcgacgcgcctcagtctccgccagcttcgcggcggccatcagcaggggggtccccgccatcagctcctgcgggaatcgagaggggtgggccgcgggtcgggcacgtgggagccatggatgcttcgtttccacactaccgccttggcggagagaagccgccgtggaccctgcactccctgcggcctccccacaaccaggtccctttcagaacaatggaaccttccccacgcgcctcccccagcgtcagccggcccacctggagcgaggcgtagagggtgaagcgctgcgggtaggagaagcgctggagcacagcccagagctcggccaccagggccacgttggtgggcaccaggctgcaggccggcatcaccacgcccgacaggatgtcgttgacctgcagggtgcagaaattgtgcgagcgcttgcttgtgtgtacatgggaaagggggagaatgccacgtcttgcatggcgaggggggaggccgaggcgcgtgccccgccacgtcaaggggcaggtgccccgcgcctgggtgcctcccaatcccgacccgccgccctgcctgcaaagcctccaagccaccccaccactcctctcacacacacacacgcacatacacacacacacgcgcgcgcgcacacacaaaaccccacctgctgctgcagctctgcgccgagctcgcccccgctggccaggcaccggcccagcagacggatgagccgggtcagcaccaggacgtcgcggtacaggtagacgcccagcgtgcgcagcgtatcaaggagctgcatggggagggcgtccggcgcagcgccgccctcctcgctcaacccgcccagggcccgggtgatcagcgatccagcccgcgcagacagggctctgcccaccgcgggaaaggcggcgggctgggcgacgcccaggcagcgcagccagctgagcagctcgcgggcgggggcctcggcgcccgccgcgatcagccccgccagcaagtggagcttctggttgttggcgcccagcgcctcaccgtactcatccgcgaagccggaggcgctcagccggagcgtgcccaggccaaactgcccgacgggcgccttccctgcctgcccaggaagtccgatggagggggtgaggaccgtcccgcgagggatcacatggcccagggccatgtgatccacacgtttaacgacacctggcctgagcacatggcaccccactgcccagcaggaaggccccctggcagtggaagggcagggtgcatgcataagcccactcaagaaaagtcacagctgccaggcggctccctgctccggggccagatatccctcccaccttttcgacgaggctgatgatgccgatgcgcgagaccgactcacgcagcgcggcctcggcggccgcgtgcgcgtccgtgaggtcctcgtcggcagggttgaggtgactcatgattgcagccagaggcacatgcccctcctacagcaccggggagggcaggggtacgctcatgaaattgctggggaagggggtgcttggggccggcctgaggaccaacttcggcccagcgctgcgggacccattcaccacagtgcgggatggccggcgcagcacccactcctgcccaggatgacatggcaccgcctcgtacctgaatcaagcgggcggccacggtgaagagaccagcgggagtcacctcctcccgggcccccacacgctcgaagtgccagcccaggacctgggacatgtcctcttgcctgcgagtgcgggcaatgcatgggttcggggctggcgggaggcaatgcaaggcctgccggcgcgtcgggggggggcacaccagctggggccaggcacccttgctcctcacctccacccccacgcaggtcttctcccacacacccacccacctgaacccgggcaggaggtgcannnnnnnnnnctcggggctggcaggaggcaatgcaaggcctgccggcacgtcaggggggcacaccagctggggccagccacctttgctcctcatctcacccccacgcaggtcttctcccacgcaccacccacctgaacccgggcaggaggtgcaggaaggcatgattttccggctgtgccacccaggcatcaatccagagggacagcgcccggtttgggtcgaggtcgaagtaaccgatcagggccctcagctcctcaagctgcaaagggggatggcatgctggtaaggcagggggagctgaggcctggggatacctttttgggtggctgaggatcgcagcagctgtgactggatccggagcccatgggtctggcctggtgtggggcctgttgtggagcacaccctggcatggggtgctggcaatgcaggcagcatgcgacccctgaccctaacactcaccacggcgcccgcatttgcctcggtgaccttccccgccccggactggttcagcagcgtcacgagcttcgcccagccctcgctctcctcccgcagcaggttgtacctgggcagcgggcagactttgctttgatgacggcggacaggaatgggtaggggcataccggtcatcacaggggagggctgcggcaatgaaatgatgtagagagagggggaaagcggggtgccatgcatgaatggcgcatgggtccaggcccgtgctcgtaggcctgtgaagttgagagggacgccccaaccagggttggacgctccgccctgannnnnnnnnnagtagacagaggggaaaagcggggtgccacgcatgcatgccatatgggtcccaggccgtgctcgcaggcctgtgaaatcaagagggacaccccaaccagggttggacgctccgccctgaccccaccaatcccaagacgtcatcccctggcagcagccccgcgacacccacttgcgctgttggtagacgtgcttggtgttggtccgaatctcctttcggcgccaagcatctcgtgagacgaccagccccacctcctccaggaactcgccctcacccgtcatcatcagacacttcctggtcacctggacggggcggtgcgagggtgggtctgtgggaggagggaggcttgtggctggaatgccgcgggcggatgactggccggcagcctctgactcggcagagggcggcgggtctccaacccccggcaatgcatggggcacagagatgtcttggtcggatttctcgggctccacagattccgataaggcgcggcgcgcagcacagacccgccgctcaccagctcgttacgcaggagctgctgcacagcatccctcaagcgcgaccgcttttctgggtcctcctccagctccagctcggcccaggccatcctggaatgggtgggcactcagggatgagtgttcagacacatgctaccccacagagggatgctgttctcactgcttgatacagagtcagagggccatgtgtgcatgctccatgctcgacacgggtcaggccacgcgtcaggccaccgcccaccaccctcaccagacggcatcggcgatcatgagtggtagactggcannnnnnnnnnggggccatgtgtgcatgctccatgctcaacacgggtcaggccaccgcgtcaggccaccacccaccgccctcaccagacagcatcggcgatcatgagtggtagactggcagccttgtgctttgttaggcctgctgcagccagtgcagtgtccagctttccaggctccagctgacccaagaccacctgctctagcaaatccatcaggaagccacaggcgagctcctgcgtcactcctggaatggtctcagccacatcgctggccaccacctgcatcgaagcggacatcttaaagactcacacggttccaaagtggatgatggagcctcacgggcgtgcatctatggcaccgcaggcagctcaccgagccatcgttgaggcccttcaccaaagcagccgtgacgagcgactcccccatcctgggtctttgcacacaggccggcgtgctgttagtaagtcctttgcagaagcgatcggcgttacaagagcaggaggctccgtctgctcgacctgcctcacgcactgctcgtggaagggtgcatcgggcttactcccctgacatataacgtttgtcaatgtccttgggcattaccaatggatagtgtttaaaaattgatgaattcccaaacgatctgaagatcacagcccattctcagagaagtgccattgatcggatgttgcagccccgagaggaggatggtctggcgccacgccgtcctctgtacttggccggataaatcgacggcagctcgttgtacctcggagctagnnnnnnnnnncatagtgtttaaaaattgatgacttcccaaacgatctgaagatcacagcccatcctcagaaaagtgccattgatcggatgttgccagccccgagaggaggatggtctggcgccacgccgtcccctgtacttggcaggatgaaccgacggcagctcgttgtacctcggagctagtgagtgcgcaatgccattgatacaggcgcatcagtatttcaacttcacccggcgcgtcattctcgagtgccctaagagggggtggcggagctgcagggcaaacaaggtcgtgccaccacatgcgatgctggagcatcttcctgccctgaactcccagcgcatcattctggcatctgcatctcccagaaggcgggagttgctgcagcagataggcctcaaattccaggtactgaggcacatctggtcaatgctgggtggcattgtcccccagcctctcatgttccatcccctccctcaaagcaggtggtggagagtggcttcgaggaaaatctgccaaagacatcggctggagagtatgcacagcgcacagctttgcacaaggctctggacgtcgcccgcagcatgcatggcaagtttgacctcatcatcgcggcagacacagttgtgcaggttggcgatcgcattctcgagaagccaaatgatgacgagcatgccgctgagatgcttgagtccctgtcaggaaggcggcaccaggtgtgcaccggtgtcgtcctcctgacccaacacggtgagcccaccagctttgtggagatgacggacgtgttcttcgcgagtctgacgaccgcaggcatcgaggcatacatcgcgacaggtgaggcacacaggtgcatgtacggagatgtcgatgcgatcacacagccatgcatccaacgtgcccgaacatccggcgcgcaggggagagtcgtggaaaagccggggcttacgggatccagggagcagccgcatgtttcgtggaacggatcgagggatgctacaataacgttgtcggatttcctatctttgcgttttccaaggctgtcgcccgtcttgtgggtaagaagaagctgggataaccaacgaatcgaccgttagcttgccgatgtcctggaccggcacataaagtgttgcaacacagggtgagatgggtagtagaaattctcagtacatagacgaataagcctccattgattttttcaaggactgtttaagcaattaaaatgcattgtgggcgatgcccgtcgcatgtctaaaggtggatgtgtacctgcatcccggtacnnnnnnnnnnactgtcgcccgtcttgtgggtaaggagaagctgggataatcaacgaaccgaccgttagcttgccgttgtcctggaccggcacataaagtgttgcaacacggggtaagatgggtattagaaattctcagtacatcgacgaataagcctccattgattttgtcaaggactctttaagcaatgaaaatgcgttgtgggcgatgcccgtcgcatgtccaaaggtggatgtgtacctgcatcccggtacacgggaagccagacccagtagctacacgaaaagctgtaccccgccggctccggaagggtccacgtacaaagacccgaagcacgtagagatgatttccgcgaccgtatttccagcggtttcagcggtatgtagtggaatataccattttagaagtattgaacaaacatttgttatgctctggtgagggccaaggatcccgaagcaggcgtctgccggcgtgccttcccacctattattgcagattaagggacatcccttacctgccggctgtacgcttcgtggctgctttagagcacacagctggacgccatggtccccaagggccttgtaggcgtcgagacatccacacgagcacctcaggacggtcgtgatgccgagggcgagctcgtagcaaccacccaaacgcctggctctccgagtaaggatacccccctacctccccctcgcgtgcgacgtggccgaccgagaaatgagcaacaatcttgtcaaataaccggttgccaagcaaacttgagcctgctgggtgcctaccatagagcaagtcgttggcaatccacctcagttatgaaaaatacatcgcaccggaacccctccaaacggcacctccgccacattccgcccgcagagatacagggtgtgcgannnnnnnnnntaagtcgttggcaatccacctcagtgaagagaaatacatcgcaccggaacccctccaaccggcacctccgccatattccgcccgcagagatacagggtgtgcgatgtgcacatgcggtcgctgtccgtccctttccgaggcgtggacagccgcttctgccaacaggtgcatgggaggaggggtggagatgttgttccccgcccctgccgcatggtcacaatcagcaacaaagtaccccccaaccactcacagtgcggccgcttccaggagctgagcgcctttgacggcgagcatcgcagctgccgcgagcgcctgctgcgacacgctggccgccgccgccggcagtcctttctcaatagcatctctaatcgtgccctgggccgcagcagcgatgaagactcgcatggcacgccaggcacatccaagtcaggttggtggcctggggtggtccctgtgagtgcatcgtgacggggaggggaccgcaggaaccggtgtgagccctgcatcagaccgagcgtggcgtcatgatggtgacacatgcaggcacgcatgcgccggctgacactcccccaagcatcgcctcggggtgggtccccccgcaagaccctaagcttgccccggggattgagacccatcgctcctgcttcatccctcatgcccgcccatccaccctcctcacccgcttcccagacgtagggtctgcatgtggcgggagcccggagcagcaggcggggcccctcctcccccgcccgcgtctctcagcccggcgagcgggcgtgccacctcggcgccgccgcgccgcaccagagcggctccgccggtgccacggaggccatgctaggcctctccatgcagagctctggcagcctccccggcgacaccccccccatccccatcctgcgctggggccaccgcaaacnnnnnnnnnngggcctctccatgcagagctccggcagcctccccagcgacaccccccccctccccatcctgcgctggggccaccgcaaccggagactcaactcccagcccgagctgggcgcctcggaggagcagtacccacaatgctggggcagcaccttcccccccacatctggccacaggaatgccctgctgcggccctctgtgcagccggtggcccgtcccatatggtcgccgacgtcggccttccaaccctacgcgctcagcacggcgccggagccagggaccagcggaattgtgccccccgcggcgaaccctgccgagtgggcccggccctcccgggagtacgcccaggcggagcacggcacgggagagcaggcaagagagcctcgccccctctccgatgcccatgaaaggtacacaggcctggatgccccagacacgctgcagcgcacctcggaggctcaccagcacggcccggcggcgcggcagtcgcccccgggagccccagagccgcccaaggcgacgcggcgccagctgctgaacctactccgactgctgcgcatcctgggccagcgacagcagatcgaggcaaggcgcgatccccctgcctaccatggcggctctttccatggcgctggatgttgaattgcttgctcgagggattcagccccattttcctatgatttgtgagagccaccttgccgccaggcatggccccccttcctccgtcctcgtgcaccaatcgcacagaatcactcgggttgtgttccaccacatgggaattcttgcttccccgcttgcccccatgcnnnnnnnnnnattgaattgcttgcttgagggattcggccccattttcctatgattcgtgagagccaccttgccgccaggcgtggccccccttcctccatccttgcgcaccactcgcacaaaatcactcgggctgtgttccaccacatgagaattcttgcttccccgcttgcccccatgccagagggtttgctcttccgccgctcagctatgtgcaaacccctggagtctgtctccaccatcccagtgcgaagaaatctgagctccctccccagacttggttctgacaaaacgttgtctcctcctcccagcatgaaggcagcgctcccctctgctaacactgtgccattttttcgtgttgtctcttctcagtccagacgacaggcttggtggagggcagcgaggttcgcatgcagcgcgccggggtcgacgcacaggtcagaggccaccctctccctggcagccaggtccagcgcagtccaggtggcgagcaggccacagtccagcatggtcgcaccatccggccggccacgccggcgccatgccaccgcgttgaggccggcaggggctgggccggcgcatgccagggcccgtgccagcgatgccggggggcagtggggcgcgtcggccccgtcccaggatgggcccaccacaaggcccaccgcgccggaggccgaggccaccagcaccccccaggtgggggcggggctctggagcgcgccggccctcagggctgccaggtccacctgcgccatgaaggtcatcacctccccagtgtgcagcgatgccctgggtgtgggagggagcgtgggtttctctgcactgtggccgcgcagcccgggtctggggccgccagtcgccatggcgtccgcggtgcgccggcctcaccacagcacgcggccggtcgcctcggattccccctctgtaatcctcatcccgtgacccctgcgcacctgtgcacgaggcgcnnnnnnnnnntctcaccacagcacgtggccggtcgcctcggattccccctctttgatcctcatcctgtgacccctgcgcacctgtgcacgaggcgctgccccttccagctgttggcgtgcgtggggtcgtagcccagcatgcgcagcgtgccgtccaaccccgccatcaccaggtgcaagcgcttgcccgagaccagcagtgccgtggctgcgggctggacgcgcgccgcgtccttggagagcagcacgaactgccgtgtctgcagggggaaggggtgaggcgaggggacggtggtgagctgagcgggtgcctcacgaagcgccggcaggcacctgcagggctgcatgccggggggccccccgcctcgcccctcgcctctgtggagtaggtgaggaacgtcaggcccagcaggatgtccgccagcaggatgaacttcttgatgacttgcagactggtgatcagcacgggcccgtcgtaaaaggctgcgggggaggggtgccggggttcgtgcgcatggtgacaggcgggggcnnnnnnnnnngctggtgatcagcacgggcccatcgtaaaaggctgcgcgggaggggtgccagggttcgtgcgcatggtgacaggcgggggctgtggggccagaggggcgtcaccaacaacgcagacccacccccccagtggagcacccatgcctgggcaccagacggggccacggttccctggtcccgaggcaagatcctggggacctcagcatgcagcgcatcacgcctggcccatgccagaccgccccacgcctcaccgcagcgctgcagctnnnnnnnnnngatcctggggacctcagcatgcagcccatgacgcctggcccaggccagatcgccccacgcctcaccgcagcgctgcagcttgtacagcgtcggccggggctccgccccgggggctgcgtcctcgctccccgccgaggagagcaggaggcacagctccaggcggttacccgtggcgaccagcaggccgccctccaccacatccagcgcgcagactgcggccttgaactccctgcgcggggtgcccagggccagggctcgtcgagctcgggcgccgacgccgcgctcgcacgagccggttcccccagcggcgtggcctcacccctgggaggccatggcagccccgtgtggcggccacgcatgcctccccccggcgcccaggggctgcccgcgccggccgcgcggggcggcctcaggtgcgcgggcggtgcggggcgcggccggcgatggcgcgcctcccatccccacccacgtgcgctcacctggcgtaggccatgcgcgactgccacctgcctccggcgccccgcctgatctcgcacagcagcacgcggcccccgcaggggtagtcctcccccgccaggaagccggcgcccaccgccaggaacggcacggtggcctcggtgcgggcttcgcgcaggcgcaccgttctgatcaccagggcccgctcccccgggagaagggcatgccgccacagcgcatcccagctgnnnnnnnnnnccggtgcgggcttcgcgcaggcgcaccgtcctgatcaccagggcccgctccccagggagcagggcatgccgccacagcgcatcccagctgccgggctccagcaggcgtacctgcgcggggatgatcaaggggggggggggggggggccccccggggggnnnnnnnnnncacctgcgcggggatgatcccgggaggggggggggtcccccagggtgcactgcttttggggcgggagaggcggcatgctggacgcacaccgcatgccagcctggagcagcgcggaggaggtggggagtctcctgccgtgacacccctcgcacctgcccatgtgctggcaggaaaggtcctgcgctgcgggtgcgctgccatgccgtcaagcagccccggccacccgcctcacctcatgcacgagcgctgctgggccagcagcagcggcggctgcgtcggccagagcataggagtaggcagcatggggctcgctgccgtcctcctccggcatcgcaggggtgtagggcgcctgcgcaggcgtggaggaacaggttggcaggcgttgctgtcaggtcgcacgacctcaatccctcgccggacagccggccaccccactccnnnnnnnnnngtgccagcctggtgcagcgcggagggggtggggaggctcctggcgtgacacccctcgcacccgcccatgtgctggcaggaaaggtcctgcactgcgggtgcgctgccacgccgtcaagcagccccggccacccgcctcannnnnnnnnntcaggttggcaggcgttgttgtcagatcgcacgacctcgaaccctcgccggacagccggccaccccactccatgcatggcgcacgtgtcggcagacgaggaggccgatcaaggaggcctcagggtagaaggtggcctgcaggggggtggcacgcagcgcgatcttctgccgggcccaaggcccgtccagccgggttcgcggagggagctgcccaatgtgcaggcccccctgactccgagccacgtctgtgaacccgggggggtccgaggggggagaggcaaaacggtggtttggcggccgcccaggctcgcagcgatgcgaggcagggcgcctggcaggccacccagtcgcccagcacctggcgtcgctcatgcgcaccccaaggaacatggcagggaaagcagcctggagggaggcggcccctcacctggtgctgaggccacaaacccaaaggggcagttcacgttgtggaagggggtgaaggctgccagagggaggtgctggcccaggccaaaggggtgagggaccagggtgttcctggaagccaccagcagcaagggcttggcacctggggcaggcaggggtgtgcgcagcaacgtggatgcgagtggtggggccttgtggtaggaaatatcagaagggctagagcagttgggcaggaacagggtgtgtgctgcttcatggccgcgtacgaggggggggcgcctgctgccatgaccacatggcgcagccttggtgggtccaagatcgaggcccacagctgtcgtacgaccaaggtcttaccagccaggaggaagccgctgcaggccaggtcctcccccatgccctggaagaaggtgaggcgaggtggaagtgggccgtcaggcaaacctgggcatggagggaggcaaggaggcacgtccaggagcagccgcttgaaccgcagctggccccctgtccagaaggcgcggtaggcctgcgggtgtggttgtgtgtgttagaggggttgcacacggtcttccggcgcgtcagcggttccaaaatgcccccgctccggttcccatcaagcagggggagtccgctgctgggtcnnnnnnnnnnnnnnnnnnnnnnnnnnnnnnnnnnnnnnnnnnnnnnnnnnnnnnnnnctcagcagcgccaggaggtacgggtgctggctgggcgcgacagcgctgggccgcgccgcgtcgcgcaggtctggccgcagggcggcaagactcgcgggcgctgcgatgagcacctcggtcgcctttatgggggggtggggcggtgccctggagcttgagcttggtnnnnnnnnnngcattgcgcccgataaggcaccccgttctggcccgcaacagcctcgccaacagcctcactcaccagcagcgtcccgtcgnnnnnnnnnnacagtgcgcccgatgaggcaccccgttctggcctgcaacagcctcgcccacagcctcactcaccagcagcgtcccgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggctgcaagactcgtgggcgctgcgatgagaacctcggtcgcctttatggggggatggggcggtgccctggagcttgagcttggtggcaagccggcccccagcaccgccttgccgcggacaaagtcctcctccctcagcaccagctcccacgtgtcggcatcgtagacctccagcgcgccgccctcccggcacagcgccacaatggcccgctgcaatgtcgacccggccgccggcaggctggcaaggcaggcggccgtcgctgcagaggagccggtcagcgtcgggggtcctgagccgtctggttggccgaggccatcacggccgccctgcgccgcgccgagtcgcaccggcgccagcgcgagggagtcggggtccaggcgcaggagcgcgagcgccccgcagctcaggcgcaccagggcggcggtgtcagtgatgtgtgccgcgaggacgctcaccccggggtcaacagggtcgacgcccgcgccgcgcgccaggtcagcagcccagtggtcaaccagcatttcggtgccccctgtgggggtgtgctctgggccctcgatggagtgcagcgggtgtgtcggcaaaggtactcacgccatnnnnnnnnnnactgcagaggagccgatcagcgtcaggggtcctgagccgtctggttggctgaggtcatcacggccgccatgcgccgcgccgagtcgcaccggcgccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcggtgccccctgtgagggtgtgtgctgggccctcgatggagtgcaacgggtgtgtcggcaaaggtactcacgccatgccaccggactcagctggcccaagaggttgtcgagtcccatccatcaaaggtccatgcaggcccccaagtcctactcccattacacccatctccatcatcacaacctcactccagacttacgtagggtgcgcaggccctgagggaacacctgcagcagcagtcgtccgccggccatggaccctgcagccaaggtcctggtgtccactgcaaactccactctgcagatcaaacggcgcgcaagctgaggggctgggcagcaatgacagcgcgggaagggagcagggtggactttgagtgtgagtaagacgccacccggcggccaggaacattccttccgacactcacacgtctgtcgcctcacggagctcatcgccggtggccnnnnnnnnnncagcaaatggcgcgcaagctgagtggctgggcagcaatgacagcgcaggaagggagcagggcggactttgagtgtgagtaagacgccaccctgcggccaggaacattccttccgatactcacacgtccgtcgcctcacggagctcatcgccggtggccagcagcttggtgccgtccttgaaactcatgacgaggtaggagtggtggggttgtggggcggaagcgggcgctgtgccgtctgccgcctcgctcttggcacaccacacggcccacaggccaaggacgcctgtgagaggaggacatgtgcaggcttccagaatgatgagcaccccaggatgaacatacaacattcccaaatgaggatgcctgcgcccctctgccggcatgccctactccaaggctaccagtgcggcagccagatgaagaatcttccaccccctgaacgccacacatggagctcagccccccccc

SEQ ID NO: 46268 - DNA, 72 bp, Chlorella protothecoides
tgggcagggctcggagggtggggccaggcgctgcccgcagcagcaggtgtgccctctgtgcgtgacggccag

SEQ ID NO: 46269 - DNA, 80 bp, Chlorella protothecoides
gggcggggtgtgactcgtgatcgccatgcccagactgccaccctgccagaatccctccttcaagtgctccgccacccacc

SEQ ID NO: 46270 - DNA, 73 bp, Chlorella protothecoides
cacgctcagtcctcaagaagctggtccaagtgtttgagagcgtgctgggaagcccctccggcttcaatcccac

SEQ ID NO: 46271 - DNA, 66 bp, Chlorella protothecoides
gcggtcgtggtggcccgagagccggctagtcaggggggagaagcagctagagcggtacaacccttt

SEQ ID NO: 46272 - DNA, 63 bp, Chlorella protothecoides
gaaatgcatgtatgtttgctgcgccgtattccctccagaacccaaggccgagcccagtgagac

SEQ ID NO: 46273 - DNA, 61 bp, Chlorella protothecoides
gccgatgacgacccctgtgccgtggtccagcagcacccccgccccgatgcgcgcggcgggg

SEQ ID NO: 46274 - DNA, 61 bp, Chlorella protothecoides
cggcggcctctgcggcctcgacatcggcgggcgtcatgggtacccgcctggcttgatcact

SEQ ID NO: 46275 - DNA, 73 bp, Chlorella protothecoides
tcccaacatcacgtcaccgaaagcctaccggtgacgctggaccccgggatgttacccaagcctgctgtgcgca

SEQ ID NO: 46276 - DNA, 10486 bp, Chlorella protothecoides
  modified_base (100)..(109): a, c, t, g, unknown or other
  modified_base (169)..(178): a, c, t, g, unknown or other
  modified_base (925)..(934): a, c, t, g, unknown or other
  modified_base (3665)..(3674): a, c, t, g, unknown or other
  modified_base (4068)..(4077): a, c, t, g, unknown or other
  modified_base (5254)..(5263): a, c, t, g, unknown or other
  modified_base (6863)..(6872): a, c, t, g, unknown or other
  modified_base (7192)..(7201): a, c, t, g, unknown or other
  modified_base (7640)..(7649): a, c, t, g, unknown or other
  modified_base (7930)..(7939): a, c, t, g, unknown or other
  modified_base (8435)..(8444): a, c, t, g, unknown or other
  modified_base (8992)..(9001): a, c, t, g, unknown or other
  modified_base (9653)..(9662): a, c, t, g, unknown or other
  modified_base (10071)..(10080): a, c, t, g, unknown or other
  modified_base (10403)..(10412): a, c, t, g, unknown or other
aggtcttgcgcctggaacgtgggcgcctgtcgcaggaggggaaaggggatttataggtccctctgtcaggagaaaatgatcctctacaccacccctcacnnnnnnnnnngctttgggacatcctaatcgccaagaaaaccaccccacctcacctgaggatagtggatcnnnnnnnnnnactttgggacattctaattgccaagaaacccaccccacctcacctgaggatagtggatcatgacatcaatgcatgcaaccgtgtcaaaacaacccgagcatgattccaggtcttgcgcctggaacgtgggcgcctgttgcaggaaggaaaagggggtttataggtccctctgtcaagagaaaatgatcctctacaccacccctcacccatcccaacgcaggagcacctggcgcaccttgcggggcttcttggcacctggctcactgctcgctgccttgtagcgctgctcagcctcctttgccatggcctcggagatgtcggaagccgtcaccgacgctccctggaggcagcaagtggggcagagtgtcgtaaaaatgtcaaccaacttgctgggttctctgttccagcctgagatgaacaccagaaaccagacatgcactataagttacgaaaaccctgcccatgagctctgcttgccttgagcgccagggggatggccaatgatcccgtgccgcacccgatgtcggcgatagtgacgccatgcagagaggcctctccaagccagttcaggaccttgctgacagtgacggcatggccctccctgatgtccagttgcacctgagggatcccgtacatgttggagtgtcagaaaatctgccttggaagatctgcacaatcaataacgtcatgtgtatgtgttggctgttgcaagccatacctacgcacccctgcagccctattcacagnnnnnnnnnnggccgtacatgttggagtgtcagaaaatgtggcttggaagctctgcacaatcaataacgtcatgtgcaggtgttggctgttgcaagccaaacctacgcacccctgcagccctattcacagcgacctgccacatgcatcccactcttggcaagatcaatgcatgcagaactgcccaacacggcaccagaaaacgcatcatgcctgaagtgcctccagccgcatctggaaagccatagcaaggaagcccacccatctcaccttgttgacgttgtcggtggtaccgtaaatcctgttccacctctcgaagccctgggtgttgaagtagttggccacggcctccagctcattgccaccggcctcctgggtctgcaccgcacgcctcttctcgggatcagcggccagcagtgccgcagacaccgcggcgaccgccgcggtcccgccaacagctagtagggcagatccatcatccatgacacggaaagggcggcagtgtcgagagcgaggggcggtgccccgtggcacgaatgcgcgcgagagtggggtaggcttcaggcatatggatgcgtgcatggctgcaacggagatccgaccgaaaggccggcttgcctgctcgacaggcaacgtacactctccaagtattggattgaaggtagtcttgatcacaggtgtagggagtagtatgcgcggatcgtcggtggagctactgaataacgataggtcccaaaaatcctcgcgataaggaattgggttcactactaatatgttagtcaccccatgtctcgcgccctgaccgccactgaatcattcttggtgacgaagcagactgtgctgcagttgcaaagcaggtggcatgctagcgacacgtacaggttgaatactcagtttctctccgccacggtcgctgcaacgtgcaagacaactgggggagcctacaccctccaatgttgtccttcggcgcgtgtcaagggagaatttccactttgcaggcttacagctccgccgcaaggacgccgtcggtcacgcggcatggagttcaagtgatcaccgtcagaccattcaagtcacagcatccactactgcatagacggatagctctgccatcgaggcactgcggcctttgtcgagccacctccccaggggaagccaccgagaaggaagctctggtaaaacgggataccgagcacgtcgaccagcttacttccactacagaaaacgagcacaactatgccaatggaaaagagaatggggtcgcggaggccacggccgatgctgccgcccagcctgccaatcagaatttgtatattgcggtgaggctgctttgcattcatttggcagtgactacaacctttgcatcacctcatcagctggagattttcaactccaatgccatttttgtgactcccaatcttaaatgtccccttgcaggcgagcgtcgcagctgtgttcatcttgggcattgggaatcgtgtgctctacaagctcgccctcgtcccactctccgattactcattctttctagcacagctacaaacttttggctaccttgcagtctacttctccgtcctggcctacagattcaggtggcttttgggacagggtttaggttaggtgttgacccttaggatacatgatttctacacatgcaggtgggaaattggacgattcaaaccttgcgatccgtacatctgcaaaggggaggcgcagttcacccctccgacacccacccaattgcacctctgtcttcatatcaagcagagccgggaagatcacaagctccatgatcggggtggctggaagcaagaagaagctcctgtttctgattggcggcgtggaagccgtatcatccgtcctgggattctatggagcttcgcagctcccaggttgggttgggttgggatgtcatacggacagagatggtgcgagtctgttgaaggttgcctctcctggctgcgactgaattgggctcgcgttccatcaccatcctgtcaacattttggcagcctcattctcatcaatgtctcgcctctctgcaggagtggtattgccgcttctcggacagacggtgttattctggcaggtgttctttgctctcaccctcctgaagaagcgtctgagtacggtgcaggtgggtgagggattgtgttgtgggatgcacatgtgggggtagcgtcccatcagtgtccctgcacagcatctaaacgagcacagcttttatcaataagctgttgattgataatttaacgcctcacctgtgcacggtggtccagatgcttggtgtggctctcgttgtgctgggcgtctcggcggcagcttggcccagcaatggttcgtctcctcttgcaaatgtgagatacatctgcgtaaggggcaagactcattgggagctactctgattggatgcacctttcatgcgtcagggagtcaatgctaaacggtttttgagtcgagcttgtggttcatagctcagctttgcatgtcatcagtaccctcccgatgcacacctcatcaatctccttgcccaggtaaatctcatgtttgctgcaatctactgtgcgtccatgattttcccagccctcgactccatcttaaaggagcgtctcttcaggtcaggaatcggcgctggttaagagggtttgggcagcacctccccatgtctacgggatgtgcttgtggaatggcgtggcctttgaggtggtggaactgcttgagcctcttcaaaggagcactcttnnnnnnnnnnaaagagggtttgggcagcacctccccctgtctgcgggatgtgctcgtggaatggcgtggcctttgaggtggtggagctgcttgagcctcttcaaaggagcactcttcctttgaaagcgaagtctgtgtcgctcaatctgtggattcaagattcctccctacctcgtgcatccaccaacagggaagccaaagagactctgaagggcaaggatctggatttattcgttgtcaattcttttgggagcctggcgcagagcgcctgcatcctcctccttttgccgttgcttgcccctctgcgcggcatccccctctctggattgcccggataccttgctgaaggtgagctgcggggggggtgaaagaagcagggaggtgtactgtgactctctgcctcnnnnnnnnnngttgcccgggtaccttgctgaaggtgagctgcaggggggggtgaaagaggcagggaggtgtactgtgactctctgcctcaaaactcaatctggacgatctcaggacaggagtgcatggggttgaagctcatggctcagttgatcaccgccatccattgttcattcatttcattcctcgagcatgtcacaccatcaggctggtcggtgttttggggcctggctggaggtgccactggggcgcccatgctccccctcctgtacatcggcgcaaacctggctttcaacatcgcagcactgaacctcgtgcggtctgctgggaacgtcatcacctcactggtgagaatgacggcgtgctgggatgtgttactttctggtggaatctgggtgattgtgtgcgtgctttgtatgtcgctagaggtaaacagttgatcagaaggtattctatcccttctccctgtctgtttaccgcgcaggtcatggccagcatcgttcctttcaccatctatgcattcactgtgagtggattggtggagagatggggtatccccatgttgtgcaagagcgcagcttgaggtgtagattctatcaagctctgctcccacaacatctcgcctcccacctaccctccccctcacagtttgaccttccgttcctcccgctgaacccgcccctcggcctcccattcctgcttggcaccgtggtaatggtggctggactggctctctacaacgggccgcagtggatcggccctgtgcgcggtatgattagcaactggctcaacacagaagaaggtgtgcgagtttctaggagctggagggaacatgccagtctgacgtcatctgggagttgcaagctgattgatcgtagattcacaatagttttgaatgtgcagcttagtgccatgcccaggagcaacactgttctcctgtcatccccttgcagcatgatcccaacagagactgctcacaggcggctccctgcttgtgacattgcaactttcttatattggtggcggcttatcagcacgctgaattgttacacgcaccaccccttcttcggtgattctgtatgcatggtgtgcaaaaggaggcacacagaggcgagtgcacgccttttagtactctttggcattgtgtggagggattgtgtgccggaatttcaacctgtatgaaagagnnnnnnnnnncagtactcttttggcattgtgtggagggagtatgtgccggaatttcaacctgtatgaaagagtggcgtggctcaagctggactatgtgcagctgagtgctttggggtgcctcagtacaggcgacagacacccgtctatctcatgggctgtaaatctgcttccctgtcccaaggatagcagcggattcttacttttcatgaagcaatgcaaacaaagtacgatgcatgagaatagtagctggaccaggaagtagttgacaacgcagcacattccgagctaaactagggaggggatcagtcaagggcaggacatgtttgatagcactgggatgggcggctgcgtggacttgaagtttggagcttggaaaaggggtggcattctgcgaggtggagaaagacgagcgagtgatacatcttcttggttgagttctatgccaagtttccgtatggacttaggatgggagctgtgtactgtgttattatagcagggggagatggtgaagaggttggttgacacaaaagatcccgcgcttcctcctttcctcccatgtcttgacctaggacgcgccaccaggggatggacctcaaaaccccaccctcagagaagatcggggactgtttgtgaagacctaattcaggctgcgtagcagcagtccgcgccgcggggcgctttaccccgcacacgtctgctttccgaaaccacaaatggactcctttgggtgttgggggccggtgctggatgcacccccgccccgcacgggcaacggaccgcccgaccgcagcatgttgcggagttaacgacagtattggtacgagccttgcggccggcgcgtgtccggcagccgagtcaaaggcgggaacgacgcagcgcatggagcctcagacccctgtcgccatggctgggttcagcaccaagagttgtgctggccagcacagtgccctgccaccggcacgcacatcggcaaaacctggtttgacacggccgcgaagacggccctggccatgatggaagttggttggtcgaatgcctgagaaggactacaagatattatctgcagtgctacagtctacgctgacggtgccattggaggccctagagagaggctacctcccggaaatggccgacagaatcgcgcaatttgcgaccgagcgagagaaagctgagcatgaggaaggagctcgagatagagatatgagtcctatacaccaacaacacctcatcaatgccattggagagagaggagccttggaccattgggagaggagaatcttcgccgcgtggcgaagcacggggcgtctgtccgaccaggcgtgacgcctggcagacgcctgccacaatttgcggcacacggccgcccgaccatctgggagcctcctgtgggcatcatcacgtcatgcttgagtcgagatactcaaagaaaggatggggaagtatgatgaggagcacgcctgttcctgtcctccccttccctttgccacctgctggaccactctggactatcgacctgactcctagaggaggttgaggaactgttgtaacagagctccttcaagttgcagatggtttccgagcggggcaccttgtgataaggtgcatggtnnnnnnnnnncgctggaacactctggaccgtcgacctgactcctagaggaggttgagggactgttgtaacagagttccttcaagttgcagatggtttccaagcggggcaccttgtgataaggtgcatggtatacttatgacgcacttgtgtatgcagatggcacactagtactgagggccaggactctccttgtacaagagaaggacagtcggttgctgttgagtgggcctgtgctgcaatggccagcatggcggctgctgtgtatcaatgtagctgtaggaacatgcacattgtagagccccccattgtgctcctgtgaaggtccttgnnnnnnnnnnaactgctgtgtatcaatgtagccgtaggaacatgcacattgtggagcccccccattgtgctcctgtgaaggtccttgcagacatcactgctggctattctcgagaagcactcttgagatgcgacgctggacgtgcccatgtgctgcgcgcagctctatctgatggagaagtcgcgttgggcaggcaaacagtcgtgcaggaggggatgtacgtctccgagtctgttgtatgatcagtatgacggtacgagaagggacctcggcctctcgggtgggtgcacgtgagcctcccaaattccatcctgcggtaggatcttgttgaaatactcccaagttgtaatgaaagattgtaggacgagtgggcgctcgtcttccgcaccgaaccagccggtaaccgctcttggaattgccccactctgggaatttcccctatccgcacnnnnnnnnnnactcgggtgggtgcaagtgagcctcccaaattccatcctgcggtagtatcttgttaagacactcccaagtcgtaatgaaagattgtaggacgagtgggcgctcgtcttccgcaccaaaatcagccggtaaccgctcttggagttaccccactctgggaatttcccctatccgcaccgcgggacccttcccatctctttggaggttgcagccagaggataatcggcatctaatgtcatgttccactttaacgcgcctgtctcgactgccgaagctcgcgcannnnnnnnnncgaggatactcggcatctaatgtcatgctccactttaaagcgcctgtctcgactgccgaagctcgcgtacgagcttcctggaccccacatcccgtggacggcgtaggcgtgcggaacttaacaacggagaccccttgtgctccgaacatctcccatcagagccagagaaataatcctcgtggagaacgcataacatcgcctatcagcagtaaattcgcgtaatacaaggttatgcggctcgtttgcctgctctcaaccctcgtcgtcatgtacacgacaacgacggcgggcatgtgcgtctcgtgaccctggcaagtgccacggtcccgagcgcacttttggtctgatcatgcaccgatttgagctttgcttaatcacattcttccccaaggtattcgagtggaaagaggtacggtagcgtggtaggcaaactgggggaaaaccccagctcagctgcccatcccatatctgcgcagagaatctcggcactgccagnnnnnnnnnnccacattcatccccaaggtactcgagtggaaagagatacggtagcgtggtaggcaaactggggagaaaacccagctcagctgcccatcccgtatctgcgcagagaatctcggcactgccagaagccaggcctttaccggagtgcgactgccagagagtaccaccaagatgaaaaactccggagcatacggccacaaggaagcccagtcgggtgcagatctgtgcgatggcccagtttcgaggcccaagtcccctggaggctggagtgcgtgtggcgaaaggtctgtggggctggccttcgatcggcccttgaacatttctgctccggccggtggacttggaaactcccatgcggacgtttcgcgtcgtcccagaccgtatgttgccggttgcccgggatgagatatagcatgcatgcagtttcaaacagagcgtagtatgcccgagtattcacgctataggtccagtgtatctgtggtgacactcaacggcagtcaccatgagaaatcatgggcccttggccctcatcatggcatgcctgctccttgnnnnnnnnnncgtgacactcagcggcagtcaccatgagacatcatgggcccctggccctcatcatggcatgcctgctccttgcggcaccgacctcgggaagatcgatcttgtctaggtgagtgaggggcagggcatatgcgtcatgagggaaacgatctgcattcctctctttccgagtcatctgacgatggtgtttcgagcgaggaatggccgatgaggcctagagaggcatgtgtgagtgctgcgaatgcggctagtcgacgagagtcacacactccaaacactgattcatccgcacagaaaattactgggaagcttcagcgtgggcggttcatcggatggcacggtggagggttcgggttcggcaaccacagacggaggctatagcgcatccggaggggtcacaggcgcggccagcggaatcaatgcaaaggccgaggctggattggatgcaaccagcagtggaagcggatcgagtgtcgacggattcggtcgtggatcggtaagttccggtgaggagaggaccctccgtggtgtatgcatgcgttcattgtgtcctcactctgtgccacagaagtgtgaaacgacctctcacgcagttcgacatctgatgtgctcatcacatcatgttcaccacatcatccctctgcaggcggagagnnnnnnnnnnctcattgtgtcctcactctgtgccaccgaagtgtgaaatgaactctcatgcagttcgccatctgatctgctcatcacatcatgctcaccacatcatccctctgcaggcggagagcgatggcagtttcacggcacaggcttccggcagtttcgctggagttgcagcagggcccgacagactggccgtatcgaattacaatgcattctcagagtcgtcccagcctggacctgtgagcgccgagggatctggcgcggctactgcggacgaatctggtgttacggtgagctaaaatgcatgaaactgatatgggggagaggtggtggggagattctcaggagaatgaccctcaaactttccatcattggctcttccggaaccccacaggcttcgggcagcagtatcttggaannnnnnnnnncaacgcatgaaaattgatatggtggagaggtggtggggagttgctcaggagaaagaccctcaaactttgtatcattggctcttccgaacctccacaggcttcgggcagcagtatcttggaagttaatgggaccatccagaccgaatcaggatctacctcaggattaacgggtgcagaggcgtctggtaacactacaaccgctacaccttctccgtcaggagtagcaccaactcctgaagggtccccgagccctttgccatctcctagtccctctcccgaagagacacccagtccaactcccagcccaacttccagccccgagnnnnnnnnnngttccatctcctagtccccctctcgaagagacaccaagcccaactcccagcccaacttccagccccgaggagtc

SEQ ID NO: 46277 - DNA, 15599 bp, Chlorella protothecoides
  modified_base (946)..(955): a, c, t, g, unknown or other
  modified_base (1625)..(1634): a, c, t, g, unknown or other
  modified_base (2275)..(2284): a, c, t, g, unknown or other
  modified_base (4685)..(4694): a, c, t, g, unknown or other
  modified_base (5597)..(5606): a, c, t, g, unknown or other
  modified_base (5914)..(5923): a, c, t, g, unknown or other
  modified_base (7140)..(7149): a, c, t, g, unknown or other
  modified_base (7219)..(7228): a, c, t, g, unknown or other
  modified_base (7332)..(7341): a, c, t, g, unknown or other
  modified_base (7690)..(7699): a, c, t, g, unknown or other
  modified_base (7998)..(8007): a, c, t, g, unknown or other
  modified_base (8440)..(8449): a, c, t, g, unknown or other
  modified_base (8714)..(8723): a, c, t, g, unknown or other
  modified_base (9302)..(9311): a, c, t, g, unknown or other
  modified_base (9575)..(9584): a, c, t, g, unknown or other
  modified_base (10269)..(10278): a, c, t, g, unknown or other
  modified_base (10656)..(10665): a, c, t, g, unknown or other
  modified_base (11831)..(11840): a, c, t, g, unknown or other
  modified_base (12667)..(12676): a, c, t, g, unknown or other
  modified_base (13287)..(13322): a, c, t, g, unknown or other
  modified_base (13374)..(13383): a, c, t, g, unknown or other
  modified_base (15468)..(15527): a, c, t, g, unknown or other
ggccagcatgctgcgacccagggctgccagggcggagggaggcggcgcaggcgcggggctggcgccgccgcgccacccgccgccgatcgccgtcgcttcgcccggcggcccgtccacggcccgggccaccgcataggagaacccgctgacagacatcaaggtccagcctaggaattggagtgtgggggggaggtgttttgttgggagcagaaccggactcagtgcccgccatgggtggctcgagagatctgtgcgactccatactgctccgtgctcaggagtctatgcttctcatgcaacacctccctgcctgttcccgcctggcagcgtaagtcccttgcgtcaccctacccacccaccctcccctcctgtccgctaaatcaccccccaaccccacccccctctcaaacccacccgacaggttgcggaggagggaggcggaccccagacccagccccgccaggaacatgctcgccgagccctggctgagccccgcccatggcaggcccaccaggtcgcccacgccttcctgcaaggagcgtacaaggcccgcggggttgagcagcagggccaaggagcccagcatgcgcggcgcgcccaggagcgcctccgccagcgcatgcgccgccaggccccgagccagcacgtgcggccggaagagcgcgtcgcgcatcgccagggcggagaaggaaagcggggcgctgtcgggtcgagggggagtggatcgtgtggagctttggggaaggcggggagggttgcatggaatgaggttcatgcggtgcacaggatggtcacggggcaatgagcctaaaaaccacgggtgccagcgggggcgccaccggcctgcactctccaccgcccaagcacgcggatccctgcctcgtcatgaacggtgctccatcctcctcgggtcctgaggccctcccatccacgttcctgcctcccnnnnnnnnnntatggaatgaggttcatgcggcccacaggatggtcacagggcaattagcccaacgaccacgggtgccagcgggggcgccaccggcctgcactctccaccgcccaagcacgcggatccctgccttggcatgaatggtgctccatcctcctcgggtccggaggccctcccatccacgttcctgcctcccggcaagcccccctgccctgcccaaccagtcaagcccccaacccaactgttccctcatccaggcacctcgtcgtgtccaacgccacggggatgccggctgtccccgccgccaggtgcacgtccaggaggacagagatcggttgcaccatgcaggacgccacgtagaggcggctggccgccgcccccgccgcctcggccgtcagggctcgacgaagggcgccgctgggcgacatcggggtggtcgagtcctcgaatcccagactcgcgtcgccgtgctcggcctcaccagcctccaacgaccccagcacgcgccgcgcaaaggccaccaccccgtcgtcgacggcggcggccaggggcggcagcgccaagcgcgcgtcctgcacccaggcgttgcggaagctgggggccagtggtggctcgcccggcacgtgcctgacgcagatctgcgcccagggcgcgtcgcggagagaggcggaggccgtgnnnnnnnnnnaaagctggaggccagcggtggcgcgcccggcacgtgcctgacgcagatgtgcgcccacggcgcgtcgcggagagaggcggaggccgtgccgccgccaagatttccagagccgcgcccggcgtcataggcgcgggtcaaacttcgcacaggcgcggtgcgcaggacaggcatggtccgtccttcaccagccaaagcgtccagctgcagcgcgcggcaggcgaggtcggcggccacctccacgccctcgccgcggaggcagggcgccaggtcagcgcgcaggcgcaggccgcgcagcgccagcgccgcgacctcccggccggcgctgtgacgggggtcggcgccctcgcagcgccgcggcgggggcgccagcagaccgcgctcgtcgtcccacagacagagctccaggccggccagcgccagatcggcatgcagacgctggcacggcggcgcctttggaggcagggaggccggggcgctgcaaaacgcgacgcgcagccccgcgcagcgccgggcgacgtcgacggtcaagccccgcgccagctcgtgccggcccgggcgcagcaggagcgggtgcgcccaaggctccccggacccggccctcctgagtttgagcagcggaagccgcgcatcctttctgctgnnnnnnnnnncggtccccggactcggccctcctgattttaagcagcggaagccgcgcatcctttctgctgcctttcggtggtgactgggggtccgccgcgccgccgccgggcgccgcctcccacgcctgcaggcagtccaggaacgcgtcctcgtcctcgctgtcgtcccaggccgtgccgctgggtccggtggcagcagcatcgcgcctgtgaagggtgcagtgcccgctcattggctggttggaggagcaggctcatgtggaccaggaaggagaattcctcctataagctgtccgtcccactctgttcaaaatctccagggacccccgatctcctcccgctcacaccctccgtcaacccccccccctccccgcaccttggggacaggggtccctggccggacccagccctgagctcccctggccgggccagccggtgaggcagtagctcggcctcgacttcctcccctggcggaatctgctgatccggtgccaggggtactgccatcgtcgcatgtgcaccctcaagagagcaggctgccctgatgcagctcgggaagcgcacggaggagcccatgccacccaaggcagctgaccccttcatgccacacagaaccccacactcccaagcagtggtttgctgacctggaaaacggtgtggggcagggaagggcgagagtgacctgccttcgactccgagggagcgaggaagatgcccacctccagtgtctcagaggtggcgttgcacagcacacccggcggctggcggtccctgtcagaggaatgggggagtgtgttggaattgcctggaccaaggaagcccgcccccgcacatggcagcgccctgtagcactcccagcgctggcagtggctggcgctcgctcccatccatgccccacagctccctcagcaacagcccacagactttgtgccccccccgccatcaaaactccccgccaaaagcccacctgaagacgatcaggtggctcctgttccccacctccaccaccctccagctggccatcagcggcgctctggcgccctcgccgccagcctcgtcgcaggccccgagcaggtgcatgcgctggcggcccagggcatgagatgcgcagatggcggggccccagagggggtcgcgtggggcggagcgcgcgaagcgcaggcgcgggccgaagaccccctcgcccccgccgggcgtacgcggggcgccgagcagcagggcccgcgtctcgcccggcgccaagcatcgctgccacggccccgcccggccggcgcctgatccccctgcgctgaaatcgaccacggcgccctcggcctggacctccagcgcctcctccgatgcgttgctcacgtgcagggcgggcgccaggctggcgtgccacaccacggctgcgcgacgatggcggtgtgtgtgtgtttgtgtgggcgttgaggtgtggctttcaggagacggcgtgactggaagtgtgcaggtgggcgctgcaggggtggcaaccacccagcactcagacggtggcacatgcccgcgccctcttgagcagccttcacagacggccactctccctctgtcctctccaccgccctccccacctgccccgtggtggtcctcacgccacagactgagcagcacgtgcagctccagggcgggtgccgccgcgcccgccccgtcagcgtctgacgtcagcaccaggcgccgcgtccagggccccgcccgctcgccgcctgcttcagccagcgacacagcttcgctgcggcagaccaggccgcccgggcccctcacggcgatccgcagggcgccgaggggcggggcgggggcgtcggaccccgggggatcgtcgctgtcgcaggcgaggacggcgctggcgctggggtgcaggaatggggcgcctggtttcccgatgccggcactcgcagcagcagcagcactgccgtccccgaggccgcagccccaggccgcggcctcggcgcccagcaggttgtgcaggagaaagcgggggagcagcgtgaccaccagcgccgccacgcccagcgggccgggggcacaggtcgtggccagctggcatggcgcgggggctggaggggagcagggagtgctccccaggtgcacgcgcgccgcggagccgggcgggggcacgaacgccggggtcgcgccgccggatcgaaagccgcccatcgggggcggcgtgcgcaggggcgagccgctgggcgtgacgggctgcgggccgcccgcgctgggcagcagcggagggaagacgagcgccaggctgggggtggcgacgagcgcaagcgcgccccggtcctgctcgccccctgccgaccccggtcccgcgccgcccggcggctgagggtcaggggctgcactctcgaccacgcaggcgatgccgccgaccggcaccaccgccaggtcgcannnnnnnnnntgcgccgcccggcggctgaggatcagaggctgcactctcgaccacgcaggcgacgccgccgaccggcaccaccgccaggtcgcagctcgcgccggggtcaagcacacggaccgcgtcgccgcggtggcctttgggcccccccaccgggcggactcgcacgggcactcccaggccgttgcgcaggcgggccggggccgccagggtcacgccgcccacgcccccgcggcaccgcacgccggcgagcagcgctcccacgggcgcgcaggcggccgccagctcgggcgggggcggctggggctgcaccctggcgtccggcaggagcacctggtggtcgtgtcgtgtggggtgcttggcggcatcctgggcgtcatgttggcctgcatttcatccaccccgcccgcatcctcgcgacccggccaccgccggtcaccaccaccagtgcacctcgcacctgggatccgcggccctcgccaccgtcgctcccagtgagatccagcgccaccgaccacccgccccccagccagacccggaggctgggcgaaggccccgcggcgcccagggtcaggatcgcgcccctggacgccccggggtcgatccgcagccagggcccgccgcgccctgcctccgcgccggcctgctcgacagcgaccccgccctccagcaggcccaccagggtccagctgctggcgttggcgacgcacaggccggggcgcagcgtcacgcgccgcgctgcgccctcgcccgccgcgacgcgggcgcggaggccgaggtgggcggagggcgaggatggatgcgggacccagacgggctcctccccgcacgtgacggcctgaggggaggggccggggcaaggcatgggtggttgagaacacgcacgtgcaccagggggttcagcagccatcnnnnnnnnnntggcgaggatggatgcgggacccaaacgggttcctccccgcacgtgacggtctgaggggagggggtggggcaaggcatgggtggttgaggacatgcacgtgcaccagggggttcagcagccatcgccaccggcaagaccaggcgcagtcggaacccgcacccccccaccatcagccagtgcatggccgtcctgcaaccagtactcacatcgacgggctcgctccagcgggcagtctcagggccaggggcgggcgcggctcccttgtggtacgccgctcctgccgcggccagctgcagtcggcggcggnnnnnnnnnncgcatggccggcctgcaaccagtacgcacatcgacgggctcgctccagcgggcggtctcagggccaggggcgtgcgcggctcccttgtggtacgccgcgcctgccgcggccagctgcagtcggcggcgggcgcccggcaccaccgcgggcggcaggggccaggcgaagggcgcctcctccccgctccccagtaaatgtgcaccctcggcccccgcctgccgcaccaccacagccacgggcgtggcgttggtcaggaccagggccggcgggagggcgcggcgcaggcccgacagccggctcagcgccgacggcgtccactgccaggcgttgacgcgcagggcggtggtggcggagacgtggaggctggtgcgcccttgctgaggcgcctcgcaagacagcggcagctcgcacacgtccagggggagggcggcgtcgggctgtgaagtacagggggtgttcctctcgcccggcccctgtgacggagctcgtctgggtccctgctgccagcgcggcgtgaggacaccgtcatccgtgtcgacgtcgtcctgctcttccctccccccgcatgcgctcccctctgcgcctcggtccagccggattctcagcatgcaggcctcgaccaggggcgcgggtgtgagggtggtcggctccgtcaggtgcacactcacctccccgcccagcctggccgcccaggcgccgtcggggaaggcgtgccagccggcctccaagcccgaggcgtagatggaagtcagtggaggccgcccctccgggccgtactcgtgcagtgccactgccaggcggccagctcgcagtgcgaggctcgtctgcgcgctgagcgggggcagtggatccaccgaatcgaagctcggcgggttgatgcgcagggaggggagcagggcatgcgggctgagagggccccgccagcacagctggtggcactgggcgggcagggctggttgggcggctattattctccagctgcagccgccgtcgtcacccagggcttccaggcggagcgggatggcattcttgctttcctcacttggcgcgggaagcccggggtcgaaggcggtgaggccaaaggcggcgtgcaccacgtgcgacgcctgccaaggaatgtgagagtggaaggagtgctcatgaagattgctccggcatctttttcgcgcagccacaccttgaacccgacgtgtgcatcccgtgcagggacccctcannnnnnnnnncgctccggcatcttttccgcgcagccacaccttgaacctgacgtgtgcatcccgtgcagggacccctcannnnnnnnnngaagcagggtttgcgtttggccccatcgccacgccccctgaagcatcagttcgtgcctgtaccctggtgcactcctcgccagggatggagcgtggagatggagnnnnnnnnnntggagttcaacccccacccaggagcgcccagcgtggcagccgcacctgggcccgaaaggtgaggcaggccacgtggcgcggccgggggtagcgccagaggaggtggtgctgtgctatggcgtcctccatctccacgctccatccctggcgaggggtgtaacagggtataggcacgaactgatgcttaaggggcgtggcgatggggccacacgaaaaccctgctttcctggacagggcacgccagccctcgaatcaatgcatagagagatcctggacggtgctcacgtccgcgcatgcatccctacacaagatccaccacccccgcacctggatctgagagggcaggatnnnnnnnnnnggagagagatcctggacggtgctcacgtgcgcgcgtgcatccccacacaagatccaccgcccccgcacctggatctgagagggcaggatctcgcgcccggcgcaggccgccacggcaaactgcccggccgtcagatcgtccgagctgtcggccgccgaggagcctgagccgctggccgccgggtcaccatcacgtttcaatagcaccacgtcttcgctccccccagctggcccgtccctgcttcgccccgcttccatggccccatcatcacccctcccgagggcccttgccatcgaagnnnnnnnnnngatggcaccatgtcttcgcttcccccagccggctcgtccccgcttcgccccgcttccatggccccctcaccacccctcccgagggcccttgccatcgaagccaggacctccaggtcccgccacgacagggcggaggtgaggtcgccggcgtgcacttggacggcgcggggcccgagcggccagaccccggcctccaaccgcaggtcggtgggggccagcagcagggccatgtgccgctggccaggtcgtgttcctgcgcacccgtgttggaaggcgggttctgtgggaatggaagctcggtggtggtcggggcggttgttgatcagggtgtttgggcgagggatggctagcttgatctcccctgccacacccgaacgccccggctgaacccacccaggcatcaccccgcacacccctggcaactgaagcatcnnnnnnnnnnctcctgcgcacccatgtcggaaggtgggttctgtgggcatggaagctcggtggcagtcggggcgatcgttgatcaggatgtgtgggcgagggatggctggctcgatctcccctgccacacccaaacgccccggctgaacccacccaggcattaccccgcacacccctggcaactgaagcatcacagaacaaattgacaagccaccgacacccagcgcacccgggtacgagagggtcagctgggaggcgagcaccgtggcgtccgnnnnnnnnnntggaacaaaccaacaagccaccaacacccagcgcacccgggtacgagaggctcagctgggaggcgagcaccgtggcgtccgcctggcttacgctggtgtgcgccggcatccagggccggttctcgctggcgggggtggataccagggtcaccgccagctcgtccgactggaaccggacggtgcaggcgttgagtttggagggcagggcatcgcatctgtcatccgccccgccctcctgctcctgaaagcctgcagtcgtgctgaggctgaggtccagcctgtcgcaggagacgcggaggtgcgaggccgaggccgggaggggcggggggtcgtccaccggcgcgagggcctcagcccagccccggcacgccgtcagcgcggcgcgcgtcagcgccacgtccacgccgcccaggtgcacgcccagcccgctgtgctcccagtcggagctggcgagcaggcgcagcgcgggcgcgccggacgagtgggcggcgacacgcagcagggcgcggtgcggttctgcggcgcccaggtccaggtcggcagccagcctgcccagggtgacctgtttgggcgggaggnnnnnnnnnntggtgcggttctgcggcgtccgggtccaggtcagcggccaggctgcccagggtgacctgtttgggcgggaggcaaagtgggatccagggagtgtacaggggctgggggtgggctggctgcgaggcgatcgcttgaatcaccgatccggcaccagccaggagaggtcgacccttgggtgcctggcaatcttcgcaccaggcatgcgtcactgaatgagtacctgtacctccgatgatccaacacatacacaagtcagcagtctcnnnnnnnnnnaaaaccttgcaccaggcatgcgtcactgaatgtgtacctgtacctccgacgatccaacacatacacaagtcagcagtctcacctcggtgccggcgccccaacccacgcagcaggcctgcgccgccaggcgcactccctggagcccactgccctcgggctgcagctccagttcgaaaagacccaggtgcagggaggactgggtggagggggttcccgccgggggcgagggcgtcggcgggccgggccgcggagcctgtactggcgcgccgggcgccggtcctcctgcccgccgcgccagggccgggcggcggctcagcgccaggccggcgtgggccaggcgctcggcggcagaccgcggcagggtgcctcgcgcgctctccacctcgacggccagggcgccgtcgcggttgcagcggacgcgccccgggccaagggtcagcagctgtgcctgggtgccaccctcaatccccgggggtcccgacagcacaaggctggaagcggggacggccacgctccacgtgctccctggctcatgatatgagctgcctgcaccggaagccccgcttgtttgtcctgcggcagatccgtcgccgccccccgccgcgcccctgatactcccctccgccgcagcgggtgccgccagcgcccgaccgagcatctccagggcgatgccgccgctcaggcnnnnnnnnnnaccggcccccgcctcgcccctgatgctcccctccgccgcagcaggcgccgccagcgcccgaccgggcatctccagggcgatgccgccgctcaggcgggcctccagcgcgcccaggccctcggccagcgtcgccgtgatgcctgcgctccgcagctgcagcctgtgctgcgtaggaagggagcctagggccccagcacctgtgttggaatcgctctccacggcctcgagccgcgcggcgtccagctgcagctgcagggtctcgagccagggccggtcccagaccgagagcgggaaagaatgtgtggtggtgtgctgtgcgccgtcggccaacacattcttgccagggaccatgtatacttcgtctgggtggttgccggnnnnnnnnnnaagagcggggaagaatgtgtggtggtgtgctgcgcgccgtcggccaacacattcttgccgagggccatgtatacttcgtctgggtggttgccggcaagagcggccagctgggccgcgctggcagtcaggagcaggggcgacgtggcggcgctgacgaggtgcatccccctcacgcaggcctccagcaccagcgcagaggtcagcaggctgggggatgcgtccagggactctgcgccgctccccgccgagtctgcgcagggctcgcgcagtctgggcacgacgcagagccgcgtgacgggcacctccaggcgcatggcgggcagctgggaggaagctgccttgaggttggttttcgcggcggcttggctgggggcatcgccaagtccaccatcggcgtcttcgtcaccgccgatgttgacctgaatgggggggttggcagagggggagtctcgatgctcccattcaaggtgcctgccgccaccctgccccatccatgcaggcaaggcaatggtggccaggtggaggcaggaggtgttggaagccacaactcacgtaccgaggataacccccaagacgtcagcgcagacctcgccccggacacgcacctgcaggcagctactctccagcaggatccaggcggcggggagcccccacacgagctgcacctgggacagggccaggctgccacccgtgcatggccagatcgcggtgttgccatgcgccgcatctcgcggcacctctgaacccggccactcgtctgacagggcagtgtcagcccttccattcccgtcgctcctcgcaccacaacccccgccgccgctgggcgcaggggcttctccacgcagcgccgctgcgacccggcccaaggcggcgagggcggtgggcgagccggccagcagcaggcgtcccgcctccagggtcaagctcgtcccccaggcctctttggatgcctcccgccctgccggcgccgcaccgtccccggacagcgactggaagtgggcccgcaccgccgcgccccgctggccccggatctcattttctgaatcttgcggcggccggagtgccaggacctcgtcccagacaggaccggtggcgccgtcgggatgcgcggccgccgcgccgccttgcaatcggccgttcgcgacgccatcgacggcgcagcgcannnnnnnnnncggtgccgtcgggatgcgcggccgccgcgccgccctgcaatcggtcgttcgcgacgccatcgacggcgcagcgcagcgccaacgcgcccagctcggcgctggcgccctccacgcgcccggccagccagagcgcggcaatccgcaggccctccgcccgcgcctgccacaggggcgcgggcgtgggcggggccggctcctccgcgctggtcgtcctgcggtgcagaggcctcgtccgcaccccctggcccatgcgcaacaccacatcgcccggggcaggggctggcgccggctgtgctgcagctgcggggcggaccgccgataccccaaagcacgcgtggatggctgtaagcagtgttggagggttgattggaaaacctcagggctactcagcgtaatccctagccttgttcctgaaacattggacgtaatcattcactccagcgccaagcaatctgcacccagtagtcaggcacccctcctcaccctgcatcgtgagcgaggccttgacccgggatgccacgcgcgcggccacctgcgcccaagctgccaggatggacgctgcctccagggagcccaccgaggcagcatctggcaggcccaggtctgcgggagggggaaagagcagccaggcagcgggtttgacggaagcgggacatactttaggagctcatgcatgcaactattgggtaggaagaggcagccaggaagaagacgccgtggaccttggcccattccctttgagcatcacacagacacaacgtgtaatggtcccttgtacatttgaagcgcacggtgcgtccacacatcctcatcatcgagctttcccnnnnnnnnnnaaaagagcagccaggcagcgggcgtgacgggagcgggacatacgttaggagctcatgcatgcaaatattgggtaggaagaggcagccaggaagaagccgccgtggaccttggcccattgcctttgagcatcacacagacacaatgtgtaatgatcccttgtacatttgatgcgcacagtgtgtccacacatcctcatcatcgagctttccctccctcacctgctgctgctgccgattcgttggtaatgtacccccacatgcgggaggccactccccctggtggatttttcaggtctggtcccgcgatgggaggaatcaaaggcagactctcctcacgatccccgtcgctgagactctgctcgcgcaacagagtcctggcaggaggctgtgaatcctcccgctccagcacgcttttcccccggggctcaaaggcagcggcgcattcgctgcacagtgtgcgcagcgtgcacagctgcccgtcggtgaggctgagggtggggtcttggagctccagcaccagctcagtcagcagtgggtcgtcgccacatcgctcctcgtcccagtcctgtggtgagaggacggcagcgcagggcactcttgcactgaggggnnnnnnnnnnnnnnnnnnnnnnnnnnnnnnnnnnnnaagggaaatgtttatgaccacatcacagtcccgcaccctccgtacctcgatnnnnnnnnnnatggacggcaaaaattgcccctgcagcaccaaaccctcaaatcctgctgatccagttgggttacattgcatttttttaggaaatgtttactaccaaatcacagtcccgcaccctccgtacctcgatgaaggcattgatgggggagctgagggtcaggcttgcatggggaagcaccaagagggggcccaggacgccgccgctagcctccctcatgctgaacgacaggtttgtgaggctgaggcactttcccagccacgcctccggtacctagtggggtagaagataatgtagggcacatggggcagatgccaatgtgaagtacatggttgcagaggagtggcttgcatccccctggatccgaaagattctttcatcatgctgtggaatgcagcggtgtgacgcagtgcccacactgtgcaaggctgctgacacggccgtcttgccatcccctcctgccccattccatgaaggcctgcttgccagatccagaggccaacccgtccaccctcacctccatgtcggccacgaggctggggtctgtatagaactcaaggctctggaaagcgcagcgcgccgccaccgacccattcgcgccgacccaggccagcgagacgtgcttcagcgtcacctgcatgttgcacagcgtgcgcagcagccagccctgcagcgccccgcccagccatccaggaccccgccctccctcatgaggggcctgggaggcgagattggtctgctgggccttggtctcaggccctgcatcagcagaggccggctcgggccccacctcgatatccacagctgtgagcaccacctgtgggtgggcatgacgcaggccctgtcatggggcgaagctcctcaaaggacaaccgatcgcattccccccctcgtcatgccgcgggtcccgcacccacctggatgggctgggaggacaggcccgcccagggtatagtgatctccagggccctagccagggccttgtgcaccctcagccccggcaccaatgcatccagatcgagttccaggttgtgcaggagcagggtgcctcgcgaggagaaggagaccttcagggtggagccccggctctccgccgagctgcgaataaaactccggagcagtcgggtgaccaggggggtcagcaccgccgatgccatgatggcgggctgctagtcccgctacatcactcccagaccgtaattcggtgtgcatggagcatgttgtgtccgggctgcatgtgcagtgacttcgaaacctggcatgcagtgctgggtctcgagcatttccaggcgaccgaacgcacggacacgtgtccccaatcgcactgtgatctgagcctcactgctctcactcacttactgacatggccccggggaaaccaggacagctcctcaatgccccttataagcacaagcaaagaccaattggcccttggcactggtatcgtatggtaccgcagatcagtcttacaggccggcgttcggaagcggcatgcttccccacaacccgacaagtatcacgctcggctggccacggcgccgctccacagctcgcacagccgggccagggtcgggggctgctgggcctcgcagcccgccaggagcatcgccttggcgccctcccgccgccgcgcgtcggcggcctcctcgccggccggggcgggcgcgaagacgggcgtgggcggggagctcgctcccggctccaaacgcaggcgcagcgtggcccagcgccccgcgccctcgccggcgggctcgcacgcgaccagcgccgccccgtttgcggaggcgccgagcacacgcaaccgcgccgcgccacgcgccgccgcctgcgcctccgcgcacagcgtgtccgcccagcggaggtcggggtcgggagagggagcgacgggcgccatgcccgggtctgtggtcgccgcctctgccccgctcgccgccgcaccatccgtggcgggggggatcacacccgcatgccctccggcagccccgtccacgacgcggaagacccggcccgcaccggcgggcacccggacgatggcggcggcgacaggcaggccgtctcggatcgtacctgcaccgccccccccgacgctgnnnnnnnnnnnnnnnnnnnnnnnnnnnnnnnnnnnnnnnnnnnnnnnnnnnnnnnnnnnnagcccccgtccgctccctgacgcgctgggcggaggccacgcagcgcgcggccacgggcccgccgctgcggtc

SEQ ID NO: 46278 - DNA, 67 bp, Chlorella protothecoides
aacatttgcagcccagcccccccccccccttccctcgcaccggcgatggtaagctccatgggcaact

SEQ ID NO: 46279 - DNA, 70 bp, Chlorella protothecoides
gcgtcttggtgcttgcgtgtatcatatcaccaatagttttggttggccaacacattctgacggcttgtct

SEQ ID NO: 46280 - DNA, 64 bp, Chlorella protothecoides
ggtgacactgcagcgtcagccgccgcagccacatagctcaagcgcaaggttgaggagcgtgcga

SEQ ID NO: 46281 - DNA, 61 bp, Chlorella protothecoides
agggcgacggcatcggccacctggcgggggtgggagtagggcccagtcccggccaggctgg

SEQ ID NO: 46282 - DNA, 65 bp, Chlorella protothecoides
atgtatcagaatatgttgtgagcgcacgaagcgatgcgatgcttggaagctatgagacgagtcgg

SEQ ID NO: 46283 - DNA, 21216 bp, Chlorella protothecoides
  modified_base (102)..(111): a, c, t, g, unknown or other
  modified_base (311)..(320): a, c, t, g, unknown or other
  modified_base (2018)..(2027): a, c, t, g, unknown or other
  modified_base (2247)..(2256): a, c, t, g, unknown or other
  modified_base (2477)..(2486): a, c, t, g, unknown or other
  modified_base (2905)..(2914): a, c, t, g, unknown or other
  modified_base (3652)..(3661): a, c, t, g, unknown or other
  modified_base (3942)..(3951): a, c, t, g, unknown or other
  modified_base (5515)..(5585): a, c, t, g, unknown or other
  modified_base (6786)..(6795): a, c, t, g, unknown or other
  modified_base (7580)..(7589): a, c, t, g, unknown or other
  modified_base (9958)..(9967): a, c, t, g, unknown or other
  modified_base (10318)..(10327): a, c, t, g, unknown or other
  modified_base (10488)..(10497): a, c, t, g, unknown or other
  modified_base (11036)..(11045): a, c, t, g, unknown or other
  modified_base (11897)..(11995): a, c, t, g, unknown or other
  modified_base (12554)..(12563): a, c, t, g, unknown or other
  modified_base (14249)..(14258): a, c, t, g, unknown or other
  modified_base (14804)..(14813): a, c, t, g, unknown or other
  modified_base (15927)..(15936): a, c, t, g, unknown or other
  modified_base (17359)..(17368): a, c, t, g, unknown or other
  modified_base (17734)..(17743): a, c, t, g, unknown or other
  modified_base (18493)..(18502): a, c, t, g, unknown or other
  modified_base (19530)..(19539): a, c, t, g, unknown or other
  modified_base (19830)..(19842): a, c, t, g, unknown or other
  modified_base (19930)..(19939): a, c, t, g, unknown or other
  modified_base (20267)..(20276): a, c, t, g, unknown or other
  modified_base (20420)..(20429): a, c, t, g, unknown or other
  modified_base (20641)..(20778): a, c, t, g, unknown or other
  modified_base (20918)..(20927): a, c, t, g, unknown or other
ggggataccaaagtgagaatggggacggtgggacacatggctctgcggcgcccgctgcaagaacaacatcgtctcagctacgtgaccagggtctgcgagcannnnnnnnnncgacacatggctctgcggcgcccgcagcaagaacaccatcatctcagctacgtgaccagggtctgcgagcaagcaatgctctgatcaccaatgaaagcgtccatgtggatcacatgggtggagcaaaaaaggcaggggtgcaagggccacccccacccccccaaaaaaactcttgtcagccaccagtccaagtaacctgnnnnnnnnnnggcgtccatgtggatcacatgggtggagcaacaaaggcaggggtgcaaggggccccccccccaaaaaaaaagctcttgtcagccaccagtccaagtaacctgtaggaaacgggtgttcccggtcttctcgatcacgttgtagggcgagtcgcagcaggtgcagttgttgcagctcatctggcagaaacctggaggtggccggtcgcatggagagggcggtgaggatggggagggaaggaatcgagctatggtaacatgcacagcatagggcacatacacccagaatccccgtaccacctcaccgtcactctccaccagctcctccagggcacccttcatgaattcagcctcgcagtttccaaacagggcctgatggtagcagttgtaagtcaccgtcagggtgtcgtccgagcgaggatcggcatcggaacagatgcactcctccgccgtctctagactagccacggtggccgtacgaggcacggtcttgtgcggatcattgtaaaagaacgtcatgccattgtgcgtgttgacgacaactgcggcatggacgccgcacaggcagaccgcccctgtgccagtcgtgggaagtgggggaatggggatcacggggggttctgggcagcatgcgcacttgaaactccatcacaggacatataatgcttacctagaaggacagccagcgctgcagtgaaagccttgcctcccatggtcagggcccgaggagctcgcggcgctgtctgcgcgtggtacggacgtgccacgcagggagcggggaccctgaacgagggattgacgctatagtctgttcaacaatacagagcaatatctatcgtattggcggaacaggtaatgtccggcagctccacattgcatggcatcccgacggacctcggacgagtcgaggaaggtatgtggagagggtcagacgcgctgatcgtcggttcccagcacaccgactgcgctgcgcacgggaggtgcgctcgaccgctatcaagtggctctgttgtaccgtcctcgctgaaagagtatcgtcttcggcatatctgctgccatcatgagggtcgctcttgctttcgcggccttcctcgtgttcctggccagctccgtcaatgcctacacacaccccgaagaacgtaggtcgcgaggttggaaggaccctctaatgctactatctgtgcatgcagggccatgcatggcgctgtcgaggctatgccgggaagcacgctcatgccccgcgcgcataccctccttcccaatgcagtcgcgaggttgatcgccttccgggacaagtacaggccggtgggctggggctggcagtacgccttccgcacctggaacgtgaggtttgaagaggggagggggccccgaggattcgcaaagagttgtggggcggccgcgcacatggcggtccggtgtgtgatcggcacaaccctgttcccatgcccacgccccccccaccacgcagtgtcccacgcgcgcaaacaacagcgacagcgagtgcgatccctgcggccgcgagtggtggggggtgagtgggaggggctccctgagagctggacattacggtcggaatggtgctgccctcagggtgaaggtgtcctctccaagcttcaaggagcctgcatataataatgtctgacagcttgcttgaagtgagtcactagtataactcctccactctgcagaactgggatnnnnnnnnnncgcttcaaagagcctgcatataataatgtctaatagcttgcttttattgagttactattataactcctccactctgcagaactgggatcacatttcctgcaggagcaccgacaccctcttccgtgagtttctgaaccatgttgcttcaagggtttggcccaaaatgtgcaactggaatggagcccaagttgcactgccactgccagaccttgcgcttgcnnnnnnnnnngcatgttgcttcaagggcttggccaaaaatgtgcaactggaatgggctgcactgccactgccagaccttgcgcttgctctgcctggggtggcattgaccatttgttcctttgagtcatctcctacccaaacatccgcaacccaccaatatagcagtctcctgacgaccttcacaacccactccctcctaccccctgcaggcaatgatcgcatccctggggnnnnnnnnnncaacatccgcaacccaccaatatagtagcctcctgccgaccttcacaacccactccctcctttcccctgcaggcaatgatcgcatccctggggagggctgggtcactaacatccatttctccctgacgggggcggaggggacccctccccgggacctgtgtggattcgtgcatgccaaggagtgggacttcaaggtgtgcaacctcaacggcaccctgcccacctacctcggaggcgacggctcctgcatgccgctgctggaggaatgggacttctcccgcaatcacatggaaggtgggtccttgtcttgcttgtttgtgtggttggtggacctgacttgggcctgggtgtggtcatacagggaaggaatgcaggtcgctgtgagaagatggcatggcgatggagtgacagagcagtcnnnnnnnnnnttcttgcttgtttgtgtggttggtggagctgacttgggcctgggtgtggtcatgcagggaaggatgcaggtcgctgtgagaatatggcatggcgatggagtgacagagcagtctgggggagaagcaggcgcccatgctgtcagccatgtcatggtgtgaacagtacactgtactggacagcaacgcaccagtcggcatctcgcttcttgaatcctgcaggtcccatcccggagtccgtggggaccatcgagaggctggtacgcttcaagatgcagggcaacaagctgactgggccaatcccagccaactttggggacctgaaggcactggagtggatccgcgtctttggtgagttggtgggactggagaataggaccgtcctcgaccatttcatgggcctccatggtctcaaacagcccatcggcaaagcgtccatggggaggcagcgacagtgcctggtcccctgaatgaggccggggccagccatgcaaggctgacctgctcctcattgctccctcaccagacaacaagctgtctgggacctttggcgagaccttcaaaaaggtgaacccgcggatgacccagctggccataggtggcaacgactttgaaggcgagctggggggggttgtgaggacgcgggatgggccccggcagaactgcttcatttgctgcgggcaccttgccataatttccttgcctgaattggacttgtcgagcgaattaccccagcctgannnnnnnnnncggtggcaacgacttcgaaggcgagctggggggggtggtgaggacgtgggatgggccccgtggagaactgcttggtttgctgcgggcaccttgccagaatgtccctgcctgaatcggacttgtcgagcgaattaccccagcctgacaaagaggttgtgcaggtgtgagctgtccagcgcacacggcatgtgcccaaccactgcctgcccttcctgagggttcccacttcacacacccatacccttctctcgctcctccacacaggcgacctgtacaacttnnnnnnnnnnggcccaaccactgcctgcccttcctgaggcttcccacttcacacacgcatacccttctcttgctcctccacacaggcgacctgtacaactttgcggaggtcagcctgcagaatggcaacatcacctacctgcccaagatgtgcggcatgatcccagtcggcatccaatttgccaatggctacgacatcggcggttctccaggcctgggtctcccctgcccagatgaggtagcaaacgggtggcccaatgccctttgatctcttgggtcaggccatgaatcgtgtgttctgtcagttcatcaagcgcgtgtaactatttacattttgcccagcggctgtacagtgactccccgatgcgatgctagggattccccccctaaccggatgggttaatttccgtaccacagagattacgtcaatcatcacatgcgctctcaagccgcaaaaataaacaagagcacagtccacatcgcgaggaggtcgagctcgaaataactgcaaatcgtgggttccgaggtgctgggcagacggcggtgttgtcagtgtcaacctccgttcgactgtcgcagcctaatcagctcgaggctctcacagcgcctcctgaaacgccgtcggtggccttgcgatggccattaaaacacagtggaagctgaaagatattcaatggagggaggtcttcaaacgccaggtgcgtcgcagtcatgccctgacagctcggtgcatggcccgggagacgcggtagggtccccaacccactcggcttgcccacacctcctcccaccgcatgctcgcaggattatgccacattgctcctcaccgcctgcttcatcgtcggcctggtgatcccgtacgccatctctgatccccggtccagcgcctacatcatctacgatgccacgatctccaatgccggttatgacaatttcaagccgtctgtgcccaactttgtgcctgtactcgtgcccctcctcaccttcgctatcactgtggtggttggggagttgattagcagcaaggcccagcacaacaccgtcacagaggctgtggcatccgcactcttcttcgtcctggatggcattcaggtgggcatgccggcttggccatgccttggaggggcaatgctcattgcatatcaggcatcttcttgtagattacaaagcttacttggctctcactggccggcaatgatgaatggcaacagagccattctggtgtgtgctgtgatccaacatgaagatgtctaaaccagcttgtgccgcttcccaccccttgccatgctgcccacacacaactccaacccccaacagtcctttgtttgtgggctcctggtcgtccagatcaccaagctggtggtgggcaggacccgccccgacttcctggctcggtgcaatcctatcatcccgggcaacatcaccatcaccattgggggtgacccaaatgctctctggccctgccaacgcccctatgacgatgtgctgaaggatggctttcagtcctttccatcaggcacggctggggtggggttcgctgcgctgcagtctgcctggtgtgcgtctgggaagccnnnnnnnnnnnnnnnnnnnnnnnnnnnnnnnnnnnnnnnnnnnnnnnnnnnnnnnnnnnnnnnnnnnnnnncgttgcccattccaaagtgtagaaggaatcccttctcctcgccgcccacccactcaattcctccaccccctgcaggccacacctcaaccgcttttaacctcaccgtctacacctctgcatacctcatctggtgctggcacatgcgccttccctggacaccagtccatctcagcatgaagcagcagttcctgctggacctgcgcaacgtggcggccaagctctggatgctggtgctgctcggcgtggcatggggcatcgccatctcccgcatcatcgacaaccagcaccacccctccgacgtcatcgcgggagcgctcatcggtgggtgctcggcaagtgggtgggatccattgctggcgcaaattgagtgcttttaatcgtagagtgactggggctcatgggcgagggcctgggaaatttaaaactgattgtgtcgcaaacctgatgtcgcacattcgcttgggcttgccaggccgtgactgctcctcagccccctcataaccacccccatttgggcaggcatctgcatcgcactcatctatgtcctgcgtgccattccccgctacaagcgcgtactgtcgccagaagtcaagtctgcacagggcgacctcgatgaaatgtcggtgtagagtccgcctggcaagaaccccagcccagtactccttctttgtgtcaagtatgcgctgagaatttgtgttacagattgctatcacatccgtagagagatacactcctgtgcggaggcgtagacctccccaatgcatacccaagcgacaccccagcttgacccttgctcccagctgtcctgcagtaatactcaatcacccgaacacaggaagccctcgtcagggcggggcctcctcaaggtagctctccatgccaggaaggatggcagaatctgcactgagaactggggttgtgagacggcagggggaggcagggatgggttagtggggacacaagggggcagactgcaattttttggttccgcaacacagagaacgccatgttcagggcaaggaaagcgtgcaagggctggttccagagactatacggtattccgcggatttgaatcggtattcagcactggattgctctggcaagctcccgcgtcccccaaccactccctgccctcacagtaacacgcaattcccacggcgcaccaccatgcctgccatacctgttgcagtgccctcattcnnnnnnnnnntgcagactgcaattttaggttctgcaacgcagagaatgccatgttcagggcaaggaaagcgctcaagggctggttccagatacggcattccgcggagttgaatcggtattcagcactggattgctctggcaagctcccgcgtcccccaaccactccctgccctcacagcatcacgcaattcccacggcgcaccaccgtgcctgccatacctgctgcagtgccctcgttcgcggccttctccggcaaagcggctggatggctggcactggcagtcgcataatatgtgggcgcggagggcacctgcgcattcgcaaaccccatggtctctcttcctatgtgacaagcaatggtgtagcatgccagacttgtggagcctcgtagtcctgcacgcggtgccctactccaccggccactctcacctgaggcgctctcgagtctggcgcgggtgcctcgctgaacctccgcttccgggcggcgggcgcagctatgtgccccgtgtctaggtgtgtatcccggacagctgggggggccgtgcaagcgacaggcgggtgcgcagatgcacactgggatgtctgttggtgtgagcgtggcaggttggcacctgcgggcggcccagcagcatggtgtggaggcggcaccgctgcgtactgcggcggcggcaccgctgcgtactgcggcggcggcaccgctgcgtactgcggcggtggcaccgctgcgtattgcgggggcggcacagcggcatactgcggaggcagcacagtcccatacggcgggggcggcacagnnnnnnnnnnaggcggcccagcagcagggtgtagaggcggccctacggcgtactgcggcggcggcaccgctgcgtactgcgggggcggcaccgctgcgtattgcgggggcggcaccgctgcgtattgcggaggcggcacagctgcgtactgcggaggcggcacagcggcatactgcggaggcggcaccgcgtcatactgcggaggcggcccagtcccatacggcggaggcggcaccgcggcatactgcgggggcggcacagtcccatacggcgggggcggcacagctctgcggtggccttgctggggccgaggaggcccacccaccaccccggtcggcacagacaccggcatcggcactggcggcgggggcaggggcggcaggtaactccccgagcccggcggccgcggcaggcccgggaaggccgtgacgaagtcggcgcgcacggtgtcaatcaggctggtagtcagcccacgcgccttctccagcgccgccccgtcccccgccgccaggaagacgtgcagcggctcgcgcgtctccggcacagtggcggagccggcgccgcgcagcgccgcgacgcaggcgcaggcgccggcgatgtgacccaggtaggcgttgtcggggcctcgcacgcgacccgccaggtcccaggaggcggggcaggaggcggggatgcccaggtacctgcggggagcagggatgggtcgagcagagtttgtggtgcacagtgagggaagggcagaataagaagggaaggatgagcgaagagagggcgggggtgtttagggagtgcgcccaacacctaaattaccctccgagactgccactcagcgatggcatctcgacagaccactccacggcatcccacacgccacggactcaacccccaaaactcacaagcagtggaagccggggccagatatcggatagggcgaggcgtcttgggctggcaagggagccgttgacacatggggctgggaggagtgtggcagcgtgggaggggcgccggggagaggctttccgcgcagcagggcctcgatgtctgccgcggcagcggcgcaggcagacaggcgggatgcgacgtcctgcagggggaagggtgtaatgcaagtcatgctggggggagagtgccagagcagagccccctggagggatgctgaggagtaagcactcctgtactgtcctgcggcacggactctgggatggaacacattcgccatccccctgtgcatggatcacgcaccttcttggcaagttctgtgccgggggcgattcggagaaagatggggggatcgctgcctgtgggcggcaccacacccggcgggtagtaccgccccttggctaccacgctcacgccccaccgctgctctatcgagtcgagggtgctacgcttggagaggtgagcccgatggtggggctcacttgcattgatgctgatgtcggtgaagctggccgatgggtgagcggcagaggcctcagggctaggtgcaggggtccctgcgctcggcgctggattggagggccccaggcggttcaaggcctggcaggaagaagcgtatgggctacgattgagttatttttagttgattaatagtgattacaccgccaagtgcacgacaatgacggtgggtcactaatataacagaccagtctcgacctgctgagcgatgatgcgagcggcagccgctgcgctctcctgaatggagcgcgcaacgtcgaccggttgtgaggcttgaggttcctcaacgtcccattttcgtcgcttctgtcggggcgctgcaccgtttgcagccataactgggcggcccagctatcatgcaactcacaccctggcgcttgtgacacgatgcatcgcatgcagcctcaagtcgttgaagcaaacatgtcagagcgatgctcgattattgccatgatgtccccccgaggccgcatggcgagctgctccttcacgaccacaatccattccagggcgcgagatccgcggtgcaacttctcgaatgcagaggacaggaggcagcataaatgcatgtttaaacttttcatggtcgtcattcgcaactataatacaaacttgatgatgagacaccgtgacgagggcttgaaccgagtgtaggggccttctaaacatggacgacatcgagttcgacttcgagaggtcgctggcctctcaacggcaacagcagcagcagccaccttctaccagcagactctatgagaatgcttcgggagggaagggaacggaacgcccgcgtaattacagacaggtgagaaaggggaagtggcctgcttggctgtcaactgtgagggcacctcttcccaatgggctagtttccactcctaactcaccacccctgtccgtccatgcagaccgtgtgcacannnnnnnnnnggtccccgtcccaatgggctagtttccaatcctaactcaccatccctgtccgtccatgcagaccgtgtgcacatactggctgcgaggactctgcatgaaaggcgatgcctgtggtttcctgcaccagtttgacccagcccgcatgccggtgtgccggaacctgctgaagaatggggtgtgcaaggatgtggactgcccctacaagcacagcatggaggagatcaaggagtgcaacatgtacaagctcggattctgtatctacggcccagcggtatgttggtcttgagggggcaggagcattcaagtttttgaagagatttgacagtcgagtggcaccatagtggtggtttnnnnnnnnnngggagcattcaagtttttgaagggattcgacagtcgagtggcaccatagtggtggtttgcctcttgagctgccgtgcccgtatgtgaattttcctgtgaacgtcgacaactcaagactcactcgcgcccatcctccttcccccccagtgccggttcaagcnnnnnnnnnnttgcccgtgtgtgaatttccctgtgaacgtcaacaactcaagactcactcgcgcccgtcctccttcccccccagtgccggttcaagcacacccggctcgcaggcccccccgcggagcccaaccagctggaggccgccaagcccaaggagtttaggaacgtgagcatcgtggcggatcaggccaaccgcggcatccacctgctgggaccccacggtcggccgcgggacctcaacctgccggcgctcacggccggcccaggcacagcgccgaggtccagggccatggtgccttcgggtgccgttcgatgatgcctggtgctctctggtgtttcttgcacctgcttcactcctcccatggttatttaaatgtgcatgcaccaccgtgcacagattttgagtctgccccccttcctcccttgctcctgcgctatatttgtgagcatgttccagcagtacagagggacactatgtgccagagtccagcagtggaaagtcctcgaaggagaaagatagagcaaacatctccagacaaggtcgagnnnnnnnnnnaatgtgccagagtccagcagtggaaagccttcgaagggaaaaaatagagcaaacatctccagacaaggtcgagtccctcaggcccccctcttctttgctgcactctccttgagcttgagggtgggtgtggcggccagcagcgctggccagtcgggaagccccggcccagaccccgagatgcagccgtccaggtccagcacgatgtacccggtctcgggggcggtggatggggccgaaggggaccccagcagcccgctctccgtggcccacgccttccactggtcggggtctgcgggctccagctgccagcgtggagcgctctgcgtgtgtggcatgatgaggagggaggctctggtgatccaaaggtgcatctcagaggggcagggaaatcaccacatcaggtgcctctattgttccaccacccacttccctcttcacagacctgcgccggcgccctgggcgagggccccgcggcaaacccctccccgcctgcggcccccttcccggccgcaaactcccgcctcagcccctccagccactccgccgtctcgctgtcctcctgcagcaccaccggcaggacgcagatgccacgctgcgccagcgcggcggcgtgcggccgcgccgaggcgagggcggccgccgtgaagctgcggcgcccggcgaggaccaggggccggcggctgccgcgcagcgtgcgcagcgcacgtggcacgcccgcctcgccccgcgccgggggaaggaagcgcagctcgcccagcgcctcctcccgcgccgcctgtgccacgccacgtcgccccgccgcccagtcccgggccagcaggaagccggccacccctgtcaccgccaggttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgccccaggaaccccgccaggcgtgccgccagcaccgcggcgcccagcccggcgcccagcgtcacgccgcccaggcccagcaggcgcagcgtacggaaggggctgcgcgcctcggcccgcagcgcggtgctggactgggcgccgcgcgcggcctccaggcgggagcgcagcgcgggccagccgggggcaaggcgcagggccgccaggtcggggtcgcgctccgccacccgcagggccaggtcgtgcactgtcaccgcgctctccagctgcgccagagcctcctggtaccggccgagcgccgtcagcgcgcaggcgctgttgtaggtggccgccctcgcctcgtcgggggaggggcgcatggagaggccggcgcggaagagctggagcgcagtcgctgggtcgccatcagagaagcgctgcaggccggcctccactgcatccttggcactcgtcacggagagcgtggcgggggatggaccgctgcggatcatagtggtagatcgggcgggtctcctgcgggggtggctgggcggggaccgccgggcgggtgccggcacnnnnnnnnnnggtcacggagagggcggcgggggatggaccgctgcggaccatagtggtggatcgggcgggtttcctacgggggtggccgggcggggaccgccgggcgggtgccggcacagcaggcagcgatgcatggatcgttccatgcctctcatggcatgtcccccatgccgtccgattcgccaggcaggaaggcaggccgagcagccgcataaagcctaatgccacaatgacagtgtttgggggggtgcacgagaccgcagcacagataccgagcgctgtaatgaaggcgacatgtgccctgcccggcggacatctcccaggtggaaagagaccctggatacctcccacaggaccttacgccctcctcccacactccatctgcaagtcgcagcgccggcctagcacagcacatttgtatcgatcgactgattgaatgcatctgtcgttcccctggaggcgatagcgctggtcggcctacctcgacatgtctggggctccgtgacatgtcgagcacctgacaatagacccccgactgttaggaagcccttctactgttagataccgagcatataggatacgtcagcatgttttttgatgatggggacgaagacgaacgtgagggggctggaggtagcggggtagcctgggcctgcaggaatgtgccgtctgccaaatcttgtcggatgtgctcatgaaatacccccttcccatccctctgactgcagccttggtgcccgcacggcacaccctgtttcggggccagaagccggttcaggagtggctcaaggagctggagcgcgtcaaggtgcgcctgactggtttgggcgacctggcggaacaatgccaccttcgccctggatactgggtgctgtgcccacctccacactgcggccacaggtcaagcatccaccacgacgcattatcacctctcgaagtcttggtctccacctcccaccgacaggaggacgcgctggcgcaccccagcaaaccgaggctcacgcttcaggatgtcgccgaccgcgccatggactcttcgttccgcggccggctggtgcccaccagtccccgctccattgacgcctgcctgcggctgggcatagaccctgccagcctgaggcacatccctctggaggcctatgccaaatgggagagggacccggagctggcgcggctggcgtatgattcggaggagtcgctgcgccaggcaagaatgacagtgtatggcagcgaggccgagggagggaccctgttgtgtgtggtgtgataaccaatgcgtggcacgcagggccctgggaagagacacccacgtcgagatcagcttcaagccatgtgttgcccctgcccaccgagcagactcgagtgaagaacctgttggaagaaagggcgcggctggaggaacagggcctgagcggccagcgtcgcgccaagggcccctcccagcccgggagcccaggtcccggaggcggggcgcttggacaaggtggggcgtggggggtgtgcagggcgcatgacaagttgtgcaccccacccactcggagcgacaaagtgtggtatctcacagccacccttgggagcgcatgcggtgctgctgcgtgggacaccttttcttccccttgcggcaaggagaagccttgccagcatggctttgccaccctcctgttgtctaggtgttgggcaggatgccacgatggnnnnnnnnnngctttcttcccctagcggcaaggagaagccttgccagtatggctttgccaccctcctgtggtctaggtgttgggcaggatgccacgatggacatggtggagagggaggccaagcgcctggaggtcctgcgccggcggcaggagcgggagctgcagcagatggtggcgcacgaggtggctcgccgggagcaggagcaaaaggccaaggccaaggtgaggcagcagggagtaagatgccatgctgctggaactcagcggggctgctgtatcccagagccatgttctactgattctagtattgggccaaggcagggaagccacagcaccatcccccctaatcgtgcccccttgcatcagatcgaggcgctggagcggaggacggaggagcagaggaaggctcgggaagcggctgcggaggagtggagtcggcagcagagggaccgtgcccttgccaagaagcaggtgtggtttcgtggctctctttgacactatcgtgagtttgtgccaaacgagaactgcccatgtggatccaacacttcacaaggcnnnnnnnnnngttcgtggctctctttgacactatcgcgagtttgtgccaaaggagaattgcccatgtggatccaacacttcacaaggcatccgaagaatgtatgggtcattcccagaaccgcccatgcacatgcaccacaaggacacagattccatttccagcatctcccttgccccctccttcaggaagaagctgagaaggaacggcaggaccgggaacaggaggctgcacgccacgcgcgtgaggcggccactgctgcagccgaggaggaggaagctttcaagcggcgccagatgggctaccagaagtgagtgaggatgcacacagccacgtccattcgacatgtagcggcatacgtcaaacacaggagcaacccctgagatcaagtcgtgcacctgaccaccctttctgggaggcactcctcatattagggacaaatttccaatgcatcaaccccctctgcgcctgcagagaacttgagcggctcgcaaaggccaatgctgcccgagccgagaccgatcgcatcctcgccgagcaggaggctgcgattgcggcgcggcgcgaggcaatccagcagcgagaggcccaaagggaggcggccaaggtgacccatagggagctggggtcagggggtgggcgcgtagggttgctccgctgtagcttcagggttcctgtcgggtctggaaaggtgcatctgacatgggccggggcctaaagccttgattggtccacgtgccgcagcgaccatcctgttcccctgaacttccctccccaggcggcgctgatcgaggagagggcagcagcaaacgcactgcagcagcgactggcggaggctcgcatcgccaccaccctggagagcaatcgccagaagatggaggagaagatcaaggcggcccaggatcgctgggaggcggcagaggctcgttccaggtcggcgtgatgtggctattattatctgtgggagggaggtgtgttgctcagcggatggaagtggtggaatacagcttccatcctgatggcaggatacctccctgcactctgcgaggatgaccaggctgtcttgccatgtcctgctgcatgtaaggctcccaagactctctccaccttgaatctaccgcctggnnnnnnnnnncacagcttccaccctgatggcacgatacttccctacactctgcgaggatgaccatgccatgttctgctgcatgtaaggctcccaggactctctccaccttgaatctaccgcctggtccctcctcaagcagggccttggaggctgcacgtcaggccgaggacgaggagaagcgccgacgtgaccgggagaaggaggagcagcgcagggccacatacgaggacgcgcggcggcaggaggcggagcgcgtggcggaggtgctgcgccgcgccgccgacaaggacgccgacctggcggcgctggcgagggagagggaggccgaggcggcgcgcaaggccctggagcggcgcctgcagctcaagcacaaggccgaggcggtagagcagatgaagcgccgcgacgccttcgaacgtgctgaggcgctgaagcgcattgaggaggaaacctcgcacgcacaggccctgctggcgcagaggagcgcgctccaggtgtgtgatggtgcaacgatgaggggccggattgtgtcacggtgggccgctgatgggtgtcacggcgcacacctaggtgcttcatccagggtttggcaggcttgcaaactgccagtgacgctggcaagtgctcccaatggcttttttggtgcggacgtcgtgagatgacccaaaacattccctctttttgtccaccaccccttcccccttcccttgcagcaacaacgccgtcaggccaacctggatctgtcggtccagaggcagcgtgtggcggagagcatgtccaagctgctgagcagcggcggctgggaaagggccctggcccaggggctggatgtctcgtccctgctgcgcaagtagtcgcagccgccagcgtgcaattttgcagttgatagcagagcggaaactgtatgacatggggacctggcaatggctggccaggtggtgagacctcagtcgacactttctgctcatcctgcaccatgcatggtctgcatcacacattgacctggcccccgacatttgagggctcaaacacctgaccctcacgtgacaaaaagcctcacccttagcgcaatccctgccatcactgtgtggacctcctctgacctcatgcccttgacacgtccccgtgaatgctgtacacaacacggtcagggtgggggagcgcctggccgagataccctgcatccaagcaccctcctgcctaggctatgtagcggtacagcgtcctgtctgtcgcgtcccgctccatgaagtctctctcgatgaggctctcgatccgcttcttgatcacctgtgaaggagggggcagggggctcggcgttgcatgttttcagctggtgctgccctcgccaatacaagagctcggggggaagacgcgaggtgtgcaaggaaaccacttccgtctgtcaccatgcagtgtcccttccatgccnnnnnnnnnnggacgcgaggtgtgtaaggaaaccacttcctctgtcaccatgcagtgtcccttccatgcccgactcccgcctcgctacctgctggttggggatgaagcgcacagccagctgtcgcgtcacttcgctcacaatgctgttgtgcgacaactgtttgcgagcctgaggaagtgtgggacgataggggtggtcagatgcgggcgacacagcctgccacgcgtgcgacaacggaagcaacagtcgcctacaagccatgagacgagcctgttctcaaacctcgagctcgagcacacccgctccaaacacccggccagcagcacagcaccttcatgatgcggacaatggcggcctcgatctgcggtttgcggnnnnnnnnnnaacaacggaagcaagagtcgcctgcaagccatgagacgagcctgctctcaagcctcaagctcaagcacaccagctccaggcacccagccagcagcaccgcaccttcatgatgcgcacaatggcggcctcgatctgcggcttgcggtcctcctccacgcgctcccgtgtctcctccttcccctcgtcgctctcacgctgcattgccattggttggaagggctggtcaggtggggcacagggccagtgggcggtagggcgggggctcgtcgccccaaagagctcacagagatctgggtgccatgcttgatctgcaatgcccaggcgccagcccttcacatgatcccctcctcctgtccctctctgtacatgaaacccccctatcgccccatacctgggccaccaccatgccgatcttgaccttgtacaggcgcgattggaaggagtcgttgacggagaacacgtcctcgtccccaatctccttgctcattggctccttgcgaaggacgtttttcccctggagaggggtgccacgtgcgacagtcgggcaagcgccagttggaaggaggggcaaagcggtgtgcgcttgattggcgggctgggtgtgcagcccaggcaagaggtctcctccagtctggggcgtccatgctgcatccgaactccagtccgtccgcaaaaacacaactcgcacatggacacccgtgccaccctaccccctgcctcgcaccttgacacaggccaggctctgcagcnnnnnnnnnngaggacgttcttcccctggagaggggtgccccgtgagacagtcgagcaggcgccagttggcaggaggggcaaagcggtgtgcgctcgattggcgggcagggtgtgcagccgaggcaagaggtctcctccagtctggggcgcccatgctggatccgaactccagtccttccgcaaaagcacaactcgcacatggatacccgtgccaccctaccccctgccgcgcaccttgacacaggccaggctctgcagcactcgccggagctcggcgtccggcacctgggtggcggccaggatctcccgggtggtgagccggtcactgtcgttgaagagcatgagcaccaccatctggtgcgtgttgcagctgagctcgtgccgcttccctccgaagttggccttgatctctgctgtgcccatgcccggctgccacgtcagcttgcggcctggtgggaaaggggggacggaggggggttggctgggatgctgtggatggccgacacgcagtcagcagagcaggggcggtgagatcatgccatggactgggttggcgcacgccaaacgcacacgcggccggcccttgggaggctgtgccctgcctgccaccacccacactgccagcagtccccttctccgtgagtgcagggcagcatgcccttgcccattgggagggacgacgctctcgtcatccctcccccccctccctccctcgcccctcctccgtcgcccctcctgccgtcctggccctcacctgagtgcgcggaggtgtaaaactggcggaaggcgtcggtggcggcttccacctcgcgcggcagcacgcagtgcacggcctgactgttttgcgcgggccacgacccagtcgtgagcacctgaaggagtgggggggaagggtggaattggcgtcggggctgtgcgcggtccgcgacgcagggtcagacagcaggatgatgccgctccaaggccggctccccgacccgaacgaaagccccacagtagccccaacccccctgtcctgacacccagccgacaccctnnnnnnnnnnccacgaatgccccacagcagccccggaccccctgtcctgacacccagccgacacccttggatacctggacggagaggtccagctccaggttgccggcgcaggcggcggggtgcgcccggaattcggccatcatgtcgcggctggtcttgacgtcggtgaacatggactccagcttggaggtgaactggtacccgcactccgtcttcagcttgaccagcagcgagcgctctggagagggtatgggcgtgaggaaagcgtgagtcgtgagaccaggccgggggaggagagtgnnnnnnnnnnnnngaacggctccctcctgacctagacaagggctttctgagcgatttccacacaccatcccccctttcctctcacacacgacctcttcccnnnnnnnnnnaaacggctccctcctgacctagacaagggcagtcagagcgacttcgacacaccatcgcccctttcctctcacacacgacctcttccccgccatgcctgcgtcgtcggaggagatgcggccctgcagcaggcgcttggccaggtgctgcttgtagtagcgctcaaacacgtccttctcctgcaggaacctgaacagcaggatggccttgtccagggccgactccagctcctcctcgctggtcccctgtccaggagtggtggtgggcagggggttgtggtggggtacatcaggagggctctgatggggacgccaccgacaagccccccannnnnnnnnngggggactggggagcagagggtctctgtcactcattgctgctggttccttgcccacgcttgcgctggagccgccgcgtgggctgctgcggctcaatcccccccccccaaaaaagaaagaaagaacccttcgcccaccaccctgnnnnnnnnnncatcccacgacaaaagccccccaccttgagaccccggcgcagcttgtcgtccatgtacagcgagatgtactccggggagcgcgggttcaggttcaggaacgcctcgaaggcctgggcagggtggtgggcgaagggttctttctttcgtttttggggggggaaggattgagccgcagcaggtcacgcggcggctccagcgcaagcgtgggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaaacgccttgtcgaccaggttctcccagacatcacgctcctgggcgtcggcaggaagggtgcgtggggaaggtgagtgcgcaagaaaggacctcgcgactgcacacgcggcgccgagacgccagccaaccttggatnnnnnnnnnnagcaaacgccttttcgaccaggttctcccagacctcacgctcctgggcgtcggcaggaagggtgtgtggggaaggtgagtgagcaagaaaggacctcgcgactgcacatgcggcgccgagacgccagccaaccttggattccagagcctagtaatgcataggaaccagctcccaaactcacacacactgacccgggaggaccggggcctcacagttctgcgaccccagcccgcagccggcctctcccgcccatcccccccacccctttcccctcccctgatcccccccc

SEQ ID NO: 46284 - DNA, 92 bp, Chlorella protothecoides
ccaggccgcgctccgcgagcactgcgcagggggggggttggagtttgaggcaggatcaaaggaagctgcgcgtcctgcaggctgggagtcgc

SEQ ID NO: 46285 - DNA, 61 bp, Chlorella protothecoides
cctcactcgagctagcaggtgtggctggggatcatcgtagccctgcagggccagctccacg

SEQ ID NO: 46286 - DNA, 109 bp, Chlorella protothecoides
tggacgcaaagctgcctgtggggtgtgtggtggcgcggcagtggatgctggccctgttcaccaccccggcctgtgcctgcctccaagcgtcccacgccttacctcctgg

SEQ ID NO: 46287 - DNA, 61 bp, Chlorella protothecoides
gacctcctcggccaggcccacgcgcgcgccggagttggcggccaggtacaccaggggcagg

SEQ ID NO: 46288 - DNA, 73 bp, Chlorella protothecoides
tgaaacctcctggtaacttcacatcccgccccctcccccccctttccaaaccccacctctcgtcacgggtggc

SEQ ID NO: 46289 - DNA, 62 bp, Chlorella protothecoides
cgtgaaccgatatttttcacttgctcgttagcttccgcacacgcactctaggtttcctcagc

SEQ ID NO: 46290 - DNA, 13407 bp, Chlorella protothecoides
  modified_base (271)..(280): a, c, t, g, unknown or other
  modified_base (742)..(751): a, c, t, g, unknown or other
  modified_base (1102)..(1111): a, c, t, g, unknown or other
  modified_base (2446)..(2455): a, c, t, g, unknown or other
  modified_base (3104)..(3146): a, c, t, g, unknown or other
  modified_base (4531)..(4540): a, c, t, g, unknown or other
  modified_base (4607)..(4616): a, c, t, g, unknown or other
  modified_base (4710)..(4719): a, c, t, g, unknown or other
  modified_base (6435)..(6444): a, c, t, g, unknown or other
  modified_base (6909)..(6918): a, c, t, g, unknown or other
  modified_base (7479)..(7488): a, c, t, g, unknown or other
  modified_base (9031)..(9040): a, c, t, g, unknown or other
  modified_base (9461)..(9470): a, c, t, g, unknown or other
  modified_base (11203)..(11212): a, c, t, g, unknown or other
  modified_base (11642)..(11651): a, c, t, g, unknown or other
  modified_base (12745)..(12754): a, c, t, g, unknown or other
  modified_base (13339)..(13348): a, c, t, g, unknown or other
ccccccccgcccaccgccaggtgcgccgcgacctggggcagcaccacgtccatggcgtggtagcgccacatgaggtccagtgagctggcggccgagccgtaggccagcatggcgtggatctccatctgcacccgggcctgcgcaggttttgggtggagcgggggtgtcggccgcaccgtgtggtgggatgtgagatgcagagcgcggccacctggtcgtgcgcacgtcgcactgaggcggccctgccccctcggtcccagcggcggggagnnnnnnnnnnaaatggagcgggggtgtcggccacaccgtgtggtgggatgtgagatgcagagcacggccacctggtcgtgcgcacgtcgcaccgaggcggcccggcctcctcggtcccagcggcggggagtggcacaggcgctcgtccgccccccagcccgcgcgccccaccaagttcaggccggtcatctggtgcacgccctggacgagagcgcggcgcgtgccggcctccagcgcgagcccggctcgggccgcgaggcgcagcgcgcgcagcatgcgcgcggggtccgtctggaaggacggcgcggcggggccgatggtgcgcagcacccggttcctgcagtcctgtaggccccccacatagtcgtacagcgtgcggctgcggggcgttttgacagggtgggagggggctgacgaggcttcatggggagggctgactaggcattgggtggacggcagagcctggtactcnnnnnnnnnncaggccccccacgtagtcgtacagcgtgcggctgcggggcggttttgacagggggggagggggctgacaaggcttcatggggagggctgactgagcattgggtggacggcagagcctggtactcccagtgcccagcccacgccgaccggccaggtcgcttgcgggaaagcattaccagcaggagagcatcaccatcatcaccagcaggaggaataccttcaacctgagcagtctcctaccaaccacccaccctgccctcacacctgaatggctcgtacagcagcccattgacggtgaagtcgcgctggatggcgttatcacgccgcgcctgcgaccacgacggctgggggnnnnnnnnnncccggccaggtcgcttgcgggagagcattcccagcaggagagcatcaccagcatcaccagcatgaccagcagcaggagtaccttcaatctgggcagtctcctcccaaccacccaccctgccctcgcacctgaatggctcgtacagcagcccgttgaccgtgaagtcgcgctggatggcgttatcccgccgcgcctgcgaccacgacggctgggggagcaggaagttgtcgggggccgggtcctgggccccctcccccggcccgccgtccctcaggaggcggtgcgcgcggcgccgctccgccgccgccacggcgtcgtgggtcagggccccaccggcgccgagcgccgcagccctcgcggcggcgtccggcggcaggcccacccccgcggtggtggtgccgaaggaggacacctccagggtcaggggtcccgccgggacgtggcagatggggaaggcgcggcccacgatcatggcgcgcttgaacagcctccgcacctgttcgtggcgagcgaggggcgtggatcgtggggagggaggtcatggggaggaaacgtggtggcggcgcagcagttgctgagcaagtggtgcaggagggtcgagaaagtgatcaggagaggtttggatggttggcatgggagtgaatgatgtcttcgtctcgaggggtagtgcttccatgaggggggggaagcatttcaacgcgctcccatgccagccccaactcaggccagccaacaacccccccaacacgcatacctcctttgtcgtggcagtggtcaggatgtcggtgtccttgggcgtgcctcccagcagcacgtcacgaatggcacccccgaccaagtatgtgtcatgacctgccgagtaggggaaagagatcggtaccttggtcaagcttcatcgctacagatgggtgcagcaggacatgggccctcggtgaaggtccaggcacctggtgcccgtcgtgcacagggtttggccctgccggcctgggacacgccagcctcacccgcgagcctgagcctcagcaggaccttccagacgtggctgttgatggcactgtcctgcaagtcgtgctccccgtcctgcagcgctatgggggccagggagacggcggctcgcaggtctaccagatcatccagggatatggtgcgggtcttcccccgacccctcctgctgaagcccgggcgccgctccggatcctcccagggtttaggaggggtgtcggggtccagaactggggtgacggcgttaccgttgcttccctcctcctcagaggctgcggagctccaggggagcccatgctggccagggatttttgaggggggggcgccattctnnnnnnnnnnccagaggctgccgagttccaggggagcccatgctggtcagggatttttgaggggggggcgccattctcaccgctgcgaccatctgggtcaccacccaaaacggaggctgcaagggtttctcgggcctcgacgccctctgccaaagcctccaggcgatgctcaaggcgtgatagtgggatcggggacggtgcagggtccttctcggcctcaactaccgccgaggcatgccggtgggtggggcgtgccggcaccgccgtgaaagggcggttcctgatacactgccgcgccaaggacagcaggctcctggcacacttgggaacatttgacatgcggtgaccgccgcctcaacaagactgtgcggcgctgtgactggccattcaacgagacacgctcgccagcgacgcagtgggtggtgcacctgctatcgataccaagctagacagcaatagtcgggaatgcatgcattgttctgacatggacagacaatatctctgcgctccagagatgctcactctcctgctttgcagcacaggacgccatcaaagggtgcccaaacatgtctggggcgcatgaaatctttctttcttggcgcgctgtccccaattgcgatcagttgtccagggaggcaggcacccccccgccccccccnnnnnnnnnnnnnnnnnnnnnnnnnnnnnnnnnnnnnnnnnnnatgcaagggccaccccatgccccggtccatgatcaagcaagtgctggaccggggacgccaagcagctggcgcctggcctggagctgtgcaaatccgtcgcgcccgcctccccgaaacatcccctcggcctgcgcggaggccgggcccgggcccagccgcgcatggcgacatgacggaaaaggatgaagagccccgggacgcggatcatcaggttctggcgccggagcctctggaggatgagcagcggctggcacgccgcacgctgctggcggagtgtcgcgaggcgctgaaaccactgccctccgatgacctccacgagatcccagggaggtcagtggtgtcacagggaggggctcaggattgcgtgtgccgggcaatggcggtgcatcgcgccgtgtccttgggccaagtgccaggaatcctgcctgcaccgcctcctcccccttgcacccccagccattttgggagccttgcctgcaggcacgccgctcagcaatctgcccgggtggtgtccccccctccacgaccctccccccactccctcccccctcacaggccgggggtggtgtttgctgtcaaggactacagcaagcccgacacgctgcgcgagctgagtggcaaggaggcggcccgcaaggacgcccccttcctgttccgggccttcgagaccggacagccgcggccgccgcagcccgggtcgaagcgcgcggcggccccccgggccttcaccatccacgagtacctggactggacggtgaccgcgccggacccggtcacgctggacgacctcgactttggcggcttccgggtagtggtcctgtacccacgctacctttccctctggcccgcgccgggcgccgtcgaggctgacgtggcggccgctgccgcggaggacgagcgcctggcaaaggccgggggcgccgccgcggcaccgctgcgccaccgccgcctcgcctgcagccggccagccatgccggtgctccagacgcacgcgacgcccatctgtgcggcgaccattcgcgccggacccgggttcctggaggtgccattctacgccacccacgagtccaagcggaacaagggtgagacatgtaggagcgaggggggtgcaggactgggttcgtcgctggaggacctgtgccctggtgcgcccccctgtatgcagtgggtttcaaaccctgcaatcgcattcattgccaagaccacattcccccgcacaccaacaccacaggctatggccgggctctgctggaggccatcgaggccatctgcagggccacaggcatccccaccatcttgctctgtagcacaggtgggatcatgcagcctccgcgtctggaccagggtcgagggtgggtggcaggcctggcattggcggcggtctnnnnnnnnnnacgtctccctgtacgcagtgggtttcaagccctgcgatcgcattcattgccaagaccacattccccnnnnnnnnnnccgctcccttgggcgtggtggctggggactcttcatgcctggcccatgttatggctcttttgtccctgggagggtacaatgccactctcaggannnnnnnnnntcgctcccgtgggcgtggtggctggggagtcttcacgcctggcccatgttatggctcttttgcccctgggagggtacaatgccactctcaggaaccccatcccctctcctcatggacacacaccgccccacacacaacaacaaacctgcagatgaccccaagacgagggggacgtggcagcagctgggcttccaggtgtcgtcgcagagtcagcttgacgccctgggggttacacacatggacctcctccacatggacaacaccgtacaggttgggcagtgattggcaagcggggtcttccgggtattccggcgtgcccctctccggcatgcttccagccatcttattccccaagctcgtcaccctcgttgcacagatgcacaaggaggtgccgccccagcggccgtggcactccctctgcatcaagcatgaggcctaccgacagcgggtgtactacctgccggggtaccaggtgccagacccggtgccactcccactgtccagcgcctttcctagcaagcccagcaaacccaccaagaagcggcccaagaagcgcatctagatctgttttccgaatgacacgtgacacgagtttctttccgttgatgtaaggctgcagcacttggaaggcctgagactgatctgctggggtcccctcagggtccgggcaccggcgctccttcccgagtccccggcacctggctgttcatacgcatgggcggtaggtgacccatgcacatcccttgctaatggtcaggggtaccggaaaagcatgccggaaggcttggccacattgaaacatccaatgcctccgacttgagcgctgagatcacaaccccagccgacgacgggcatggcgcgcaaggccaagccaggcgctggggccaagaaaagagcttcaggcactcatttacctgtcgaagaacttgttgccttgcagcagagcctcgattcaggaggcccgctcgatctgagcctcgtcctccgcttcctaggtgtctccctggggagccccgattccagcaccggcggcaaggcaagcctgggtgtcggtgtcttcgaaactgctgccttctgagtgcatgtggtacatccacatggtggcattgccgcatggtcataccccgatgcttccctccactgcacaatgggcattttcgatggaggcccccatgcacggtggcgaaatgacatccatcgttgcaagccacaatgcaccaaagcgccctcccctgtcacatactgtgcaggccgccacgaccagtctaaaaaggctcattccagaccccggcaagcaccgccagaaggggctgtgggcgaaggatgccgtcgccctagcgcacctcggcccggatccagcagagatgcagcgcggcgatcttgccgtccctgtggggctggtcaacctgggcagcacctgctacgtcaacgctgtgctccagaccctgtacgccatcccgcccttccggcaggccctctacgccgctcggcctccactgtcccaggatcctgtggtggcccagctcaggttggcgatggagggggacggacacggccgggaggaccttgctcttgagactgggtcacgatgatagagtgttgcgccgctgattctgggctgcccagggcagcttgctctgcaggagcttggttgtaccctgcggtgagcaacatggacagagcctatggggcgcttgatcccaccctcgtcctcannnnnnnnnnggccccgctgattctgggctgcccatggcagcttgctctgcaggagcttgggtgtaccctgcggtgagcgacatggacagagcccatggggcgcttgatcccaccctcgtcctcacccgccgcggcggaaatgcagggagctgtttgcgtgcatggagtggggtaggcgggacccactagaccctgggcccctggtcgctgccctgcagctggaccatgctgtgcagcaagacgggcaggaattcatgaagctcttcctcggactgctggaggcccgcttccaggcacaaaaccccctggatgccttgctcagggtgcgagagaggaaagggggtggaggagaggtcaggaggggcctgcagtgccaccagatgagcgtatccatggctgtgctggattgtccagatggcagtcactcaccactcaccgttgtgcccgccgacacgcactcagcacctgttccgnnnnnnnnnnagcctgctgcgccaccagatgagcgcatccatggctgtgctgggttgtccagatggcaggcactcaccactcaccgttgtacccgccgacacgcactcagcacctgttccggggagagagcgggtacgagacgcggtgttgccgatgcggccgtgcctcggcctcctctgggcggcgagaggggtactatgagctggcggtgccggtgtcgggcttccagaccctacccgagtccctggcctccctgctggccccggaaaccctgtccgggtgcaacagcctggcttgcgagtactgtggcaccaagacggaggccgagaggaagctgcgactggcctccaccccgcccctgctctgcatcagcctccagcgctttgtatttgattaccgggtacgctgggggttggagcggttgagtggtggatgtaggtgtggcgacagcgtctggcaggaccgcaaaacagagactcttgcagtgtggctgtcttcctggtctgaatcaaacccaccaacaaccagcacccgtgcctcccgccccagaaaatggaccgggtgaagatnnnnnnnnnnctgtggctgtcttcctggtataaagcaaacccaccaacaaccagcacccgtggcccccgccccagaaaatggaccgggtgaagatcaatgaggccctggcttgccctttgacgctggattttgggagcatcctctcgccagaccagggagctgctggtggggaatgcccaaggtacaccctagcagcactcatgctgcacaagggatctgcagccagggctgggcattatggtgcggcgaactatactcggtggcgactcgttgatgtgggaagggcgtccgatcgagcaaagtccccctgttgggttgtgacaatgagcctgggatccattctggacaatgccaagtgtctgctgtgcatgaacagtcagactttgcatgaacagtcagacattgcatgaacagtcagacattgcatgaacagtcaggttatgcagcaggctgcggcattcagacagctcacaactctccccccctctgcactgcagtggcgcatgtcaaccactccatgttttcctcagaatacccggctggcagcagtgcctggtggaggtttgacgacaccgctgtatctgccctggcctcaggccctcgtgcctcatccgaccatggctccgccctcgctctgcaagcagccaacgccaaactacctccggtgaggatagggactcgaaggagttttggtgattgcttgcgtgcgccaggcacgcgcacagagtatgaccctagcagtggggcgctggagcaagccgctttccccgagtatttggtcatctgatgagtaatcgccttcctcatgcctctcaggaagtggcggccggctccatcgcctcctgcactgcctaccagctcttgtaccggagggaagatgctgtgttgccgtcagtcgccctttcggaggctgccgaggcctggtgagggggacactgcgctgtagaacagtgggtgggattgcggatgaggatgacagctacaccgctgctgatccagaggccgcacagtgagctccatgctgcgcaagaccaactccgaagactcatccctcgaaaccaggatcgattctcgcaaggcggaggctgccgcggagggcgaggcaagcctcaagacgtatgtccaggccaaaacagacttgctgcagcggcgaggcgagcgacaggcagccattcaacgcctcctgaaggctgctgacccggtcccagagtcagatgcaggctgctttgtgaacgttgcctggctgcggcgattctgcgatgccgagccagggagcgaggcggctgagcgcgatggggaggaaaggagggaagggaatgccggcagtgctacgaacagcctgctgtgtggccatggctctcttgaccccgagcatgtggcgtcaggtgagctgatgggcaatgaggagcttggatgtctcggactatgggtgaggcctgccggtcatgaaatggagcaccctccattgaggcaacacctggggaacagctggcgccatgctccgacgccctcactcgacctcgccttcatgcttcatggtaggtgcacgccnnnnnnnnnnggggaacagctggcgccatgccccgatgccctcactcgaccgcgccttcatgcttcatggtaggtgcacgccttatatcgagtgaagcctttggcctgctgtgtgatctggcaggcccttgccggaggctgggacccgcagacatctgtagggtgtgcctgggcgcaaggtatcatcccagcttgggcggcgggggtgcctgggctgtgcagccccgtgtctcatccccttgcgtgctcctgctgcaatgactgcgaagccggcccaatgcagttctgagcgctcgcgtacacgtgtggcttggccaggcttgctgagatcagagcgcccgtcctgtgaggactcactggatgcatcatgcgcactgtctcacgcaggctgcagggcattgcagcccaagcagacgctgcgacgcagaggnnnnnnnnnnccagagcgcccgtcctttgaggactcactggatacatcatgcacactgtctcacgcaggctgcagggcatcgcagcccaagcagacgctgcgacgcagagggagtggtgggtgcagcaagcctcagacgccctggctcgagcagatggcgagggtggagaggcgtcggggagaggggaagaggacgcctcaagcgtctacgtctccagagcctggctcaggttggtggtaggggtcaggggacattgcaaggaatgctgactctatacattcgcgggttccttgacgtccaagctcgcacctcatgcagcggctatgtgacgaaacgtgggcgcttcagcctgcatgtgaggctcagcaccggcggtggactttgcaccgagcccttcagtggagtcctctgcccccacggcctactcctccctgagagacagaccggcagtcgacgggtgcgaggtttttggggctggcgagtggatgcgccggggcggtgggccaggccaggagaggttgcacggggccagtgttcaggccgtcatgtccagtgcccattcatcggcgtctcatcaccctgcagccacctcgctctgcgcagagccgacgagtcgccgtccctgagccgctctgggctcgcctggcagacgactggatgcgggcatggaaggagaggggaacgccgggagagggggaggacggcagcccacctgcccttcgtcctccgccagcatgcttcaccccagagtgccaacagtgcttggccgagagcgagagcctcgcagccgccagcagggtggcatcccagcagcggcagccagcgaggtcggtgctggcgtgcctgaccgagcaccccccgcccctgcgggaggtggctgttggcgaggctctagccctggtgcccgcagccttcatgcatgcctggagggcctgggtcaaggtgacttgttttttggaggggggtgggaagcgaggggcgtacaggaggtgtgtccagacgaacggaacggtctgcatattccacaacctgcttcttcttgcattttagaagtgattggcccaacccaaactggtgagcagggcaaggagtctgagcctcccagtctggcagaggccatggaggcttgcctggaggagacttgcctggaggaggctgcgggactgcccgagacatcagatgcgagaccccaggaagccgatttagtgactgagattgggagcgccgagcgtggtcttgccgtggagccgccgaaagtcgttgtccgccgtggaaagtgagacctcattgtggaggagctgttgcaggttcggcttttgagtgggatgcattgcaacaccccaccagttgtgcttcgaacagggatgcaacccaaacaccttcttttgcagtgcagggtaagccccatagccatctgctatccgtgcaaagaatcgccatcaccccacttacgttaacctcacctcaacacagattctttgtacctgcacctgccaagggtaccgtgggtgatccaggatttgaactgctcagcctagagaactggcagcagctcgcaaacttccatgaccttcctgagcacctcagcaggcaagtttcccctgagtgggaggagatgtagattgcagaaattgggctgttaccgtcgtgacatttgtcgtgggtggtgattggcagtgtgaggaatcctcttctctgtatatatagatgtttgagcgcactctagacaagccatcgcatcnnnnnnnnnnggtgggaggagatgtagattgcagaaattgagctgttaccgttgtagcatttgtcgtgggtggtgatcggcagtgtgaggaatcctgttctctgtatatatagatgcttgagcgcactctagacaagccatcgcatcacacgccctcgtcactcaattccttcaggggattcaatgtcacattgcaacgaggttcgtcagaggcaacgcatgtcaacaatgctgaaacactggctgaagcatcccctgtcggtgtgcagaactggtccagggaaaatgctggatggctgtctaccacctggtttcactgagaagaatgcaagagatccctgctccaacatacctgggaatactgtcttgtaggattgcaagcaacaccccgaacttatcaaacccagcccaccaacacactcacataccgacaggccagnnnnnnnnnnactgttttgtaggattgcaagcaacaccctgaacttatcaaacccagctcaccaacacactcacataccgacaggccagtctgagggtgtcgaatggattgccaaccctccggtgtcgcaagcagccgtccagaggcgtcgagaacgccatgaagcatctcttctatcatatgaagcagctgagatatctgtcaggctagtgccagcagaggaagggccaaggtctgacgatgacattgacggtgaggtggggatgtcttggggcagacgctcccagtgatggctgggtgagatcgtcattcgcagccactggattgcacatgtttcgggcaaacaaagccaacaagtttcctcttagcaggagccaccttctctcacccatatcagtactacttgctcaatccatggtcctcgaatgccacctgcagccgcggctgtgagagccagcaagcggacacgaagggaccgcgtggtgttgaccttggcctccacgaccaccttgcaagtgctgaggggtcacgtgtatcaagccctgggagtccatcccggcaacgcacaattctacctcgggtgagcgagagcgctgtgttcaagagtcaacttcgcatctcagccgtctggatcaggctttctgggttgcttcaggtgatgcacaccctgtctgctcacactccctttgcaatccccaccccagctcccggagactccaggggtccccagatgaaaccctggcgagcatgcgcatcttccccggctcctgcctcaaagtggtgggttgtgaaggaagctggcattatggagtgacacacacacttgacctttgccttgcatgtgcacctctacgtctggctcatcattggttgctacaacatgtgcaggtggacactggcgagcacgctgccgatgacctggcccggctcatcccggcatccgcccacacctccaagaaagaggagggcgctgggtttgggggaaccgtgcttgcctcgtcatgaggtgagagagtgcctaggaatgccgtcgccagcgatatggttgcgctcagcccctgactggcaagttcctgctccctcctccacaccgacattgggacnnnnnnnnnncgagggtgcctcggaatgccctcgccagcggtacggttgggctcagcccctgactggcaagtggctgctccctcctccacaccgacattgggactggccaattacagtaggttgccaggtggccctgcgccccgccgccggccctggcatgcgccccctccccctcccggcacccatgcgtgctgtgaatctggccgtcctgctgggcgagcctctccttgtaacccataactggccatctccagccaccagcgcgacacaacgagacaacctcagaatcagttgcgaggggaagagagcacaggggtaccactgtttatgaaagccggaagtttcgcctgcgtgcagggcccgccccttccacgtacgagtgtgcgtgggaggggagggggtggggtgccgggggttccaggacccaccctgccaggcataaaatggggtgcggccggtcgccgcgcgtccagcgtcaaaccaccgcggccgcggcggcaggcggcgcgtggcccggcggcggcggcaccagcgcgggcgcgccgtcctccgccagcacgccgctggcctcgccctcccgcgggctgttggccnnnnnnnnnntaggggtaccactgtttattaaagtcgggagtttcgcctgcgtgcagggcccgcccctt

SEQ ID NO: 46291 - DNA, 61 bp, Chlorella protothecoides
ctccaggctgcacgaggcggggaaggtgctatccctggagctgcgcgccagctgcgcgccg

SEQ ID NO: 46292 - DNA, 61 bp, Chlorella protothecoides
ctgcaaggcggcgggctgcgacgcggcgtcaccctccctaaggctgagccactgccgcacc

SEQ ID NO: 46293 - DNA, 61 bp, Chlorella protothecoides
ggccagcagcgcgtggtgcgcttcgcgcgctagctcagcgtcacgctgggcgcgctgcgcg

SEQ ID NO: 46294 - DNA, 61 bp, Chlorella protothecoides
tgtgggaatggagccaagcgagctttcgcagcagccacatccatcgcatcggaaacctgtg

SEQ ID NO: 46295 - DNA, 112 bp, Chlorella protothecoides
ggcatccttactgtagcatatttcagtcatatcacatgcagcatgcctcactgaccacccccctgctcccttgggacagggcttggacacccggcaggatgtgcccacaccc

SEQ ID NO: 46296 - DNA, 61 bp, Chlorella protothecoides
acacatggacatgcccagaacctgggcgccgtggaccacggtgcatacctctgcctcagca

SEQ ID NO: 46297 - DNA, 61 bp, Chlorella protothecoides
gacagctcggacgcacaggcttgaggcgggggatgaagtcatggccggtgtctcactcttg

SEQ ID NO: 46298 - DNA, 63 bp, Chlorella protothecoides
tcccgtgtgctccattaagtgcatgcaacaccccagcggtgggtatgactcacgtggctacaa

SEQ ID NO: 46299 - DNA, 14373 bp, Chlorella protothecoides
  modified_base (5055)..(5064): a, c, t, g, unknown or other
  modified_base (5602)..(5704): a, c, t, g, unknown or other
  modified_base (5783)..(5792): a, c, t, g, unknown or other
  modified_base (6808)..(6817): a, c, t, g, unknown or other
  modified_base (6871)..(6905): a, c, t, g, unknown or other
  modified_base (7327)..(7336): a, c, t, g, unknown or other
  modified_base (9116)..(9125): a, c, t, g, unknown or other
  modified_base (9700)..(9709): a, c, t, g, unknown or other
  modified_base (9809)..(9818): a, c, t, g, unknown or other
  modified_base (9960)..(10075): a, c, t, g, unknown or other
  modified_base (10192)..(10201): a, c, t, g, unknown or other
  modified_base (10300)..(10309): a, c, t, g, unknown or other
  modified_base (11459)..(11468): a, c, t, g, unknown or other
  modified_base (13427)..(13436): a, c, t, g, unknown or other
  modified_base (13764)..(13773): a, c, t, g, unknown or other
gcccgccgcccggccgggcaccggcggggcctcgccccagcggccgcgcccggcggcggggccctcggcgtccgactccagcatggagggctgggccgggtgggggctgccctcacgccggatgtgtgcggcctcctcgggggaggagagggagggcgagggcttgaagaagaactcgctgaccccgctggcctcctccagccccgaggcggcggcctgccgctccgcaaaggcctccacctccgcctgggcgatggaggccgcgctggcggcggacccgggggcggagcgaggggcgaggctgacgggacccgccgtggtggccccctgccacacgatgggggagtgcttgcgcttggcgggcggggagcgcgtgcctgcgtccggctcgccctcaggggaggggctgcgccaggcggcgcgccttggcggggtgtcccctgaggtgctggcgggcatgccggcgggcatgcgcactcgctcctccgcggccctcttctctcgggcgaggcgctgtgcctcggccaggatggggttggagggaactcgagcgggccggcggctgtcctccgtctgggcacgggagcgaggtggagaggaggaaggcgtgagtccagggaccatgggcgcaagagcatgcatgtggggtgtctggcacgcaaggggggaggtgggtgaggtgcccacgcccctgggcagtgcccgcgtcggcccctctgctccgagggcggtgcccatctcaccctggaagcgggccgctccctgctgccactccgatccctcctgtacaccctatcccgatccctcctgtccttatccgagttataggtcggcctgcttgcgaggatgcgtggggaagatcgatgaatgccctccctgcactggtaaacctgtgggtgtcccagtcccgcggcgcagctcatcagaggaccccagttgtagataggccgcaacagaatgcgcactcgccttgggggcctcgccgggggccggcgatctgagctcatgctgatgttggagggtagactggcgacagggctcagtcggggctcccccttcctggcaagagccctgcggccattcaatgtcggctcgggaaaatcctgtaaaccgtctttcagattgaattgtttcaatgcatggccctgggatgaagtgttcaggactcgacctgctgcttccgtggcagaactggtagcaccttcagtgcacggtaccacgggcccttgctgccatcgccccaccacctccactccaatccggccccaaggccattcccccctccagagaggtacccaggttgatgtcgtagagcgacaggggcatcgcaccaggtcactccccctgcaaatacccctgtcctatgtacctgtgacccgccctgcccaaaaccttctcggcagagccgttccggggcatcggatcatgacgctgggatccgatgacagcctctaccccatagccgtactgatgtgagctggatgtcgatggcgtgccaaggctggcgacagtcgcatccacgcccctgcggggcctggatcgctgcccatcaccccctgccccaaaccccctccaccccgacccctgcagcgacgagctccgcaatgaggaccctgccctgcgcctcaactcggtgcgaaggctgcgcaccatcgcgctggccctgggcgaggagcgcacccgccgggagctcatccctttcctgaacgagaactcggatgacgaggacgagatcctgctggccatggccgcagagctgggcgaattcgtgagcctggttgggggcccggagcacgcccaggtgctgctgctgccgctggagacactggccaccgtggacgagacggtggtgcgcgacagggcggccgagtcgctcatcgctgtggcctcagccatgcccgtccccgcactcgtggagtttttcgtgccagctctgcaggtgaggcatgtttgggctgggcaggaatggggcttccccaggggtggcctgctccctgcagggagtcccaccttgctgaggagacatgtggggtgcactctcaccgcttacagatggggtgcaaattgacaacggggccaagagtgttcctggcggatcacgccccttggaatggcagctcaggcccagggcctgactgcctgccgaggctgtatggccaccctgcaccgcccagcccgctcaagtatccagaacccctctcgacgacctccgccaccctttctgcagcgcctggccggcaaggagtggacagcccgcgtctcggccacgcgcctcttcacccccacctatgcgcggtgcccgccggagcaccgccccgacctgcttcgcgcattcctcgccctgaccaaggacgagacgccgatggtgcgtcgcgcggcggcccaggccctgggagactttgcgcaggtggtggaaccggagcccctcagcgccgagctgctccccgccttcctccaactcacccgcgacggtgagagctctgggatgctggcaggggagaagtcatgccttgggggtcggccatacgcgccagggagcggtaggggtacgagggagtgcgcggctgcgtgccaggctgggtgagtagggacccccctctgcgacgcacccaggccccgcccttcccacccccaaccccgcagaccaggactcggtgcgactgatcgcggttgaggcctgtggccccctggccaaggtgctgccgcgggaagccgtgtacgagcacgtgctccccgtcctccaacactttgcgctggtgaggctgtgtgggtgtggggtgggcggggatgcggcgtggcggtgttcctgggctgtcctgccagagtccagggtcacctccaccgccggcaagtacccctgcctgtccctgcatcgtctccatcgccgcgccccatgctctctccctccccacctcgcaggacaagtcgtggcgcgtgcggtacaacgtggcgcagcagctccctgccctggccgaggtgctggggggcgaggcgacgcgcgccgagctgctccccgcctttgtccgcctgctccgcgatggcgaggcggaggcgcgcgccgcggcggccgcccgcgtcgcgaccgtggcgcgcctgctccccgcgcaagaagtgctggaccagctgctgccgccggtgaaggagctggcgggggacggcaaccagtacgtccgcgctgccctggcctccgtggtcctggagctcgcgcccgtcgtcggcaaggcgagtggagacatacccctgggaggcggggagtgcagcgacgtgtcggtgcccatgtagtctcccgcccccaaaagtgaatgtccaatcccccagccccccaacccatccccccactgccccaggcggccaccatcgagcacctgctccccgtcttcctcagcttgctcaaggacgagtgggccgaggcgcggctgaacatcatcggcaagctggaccaggtcaaccaggtcatcggcgtggacctgctggcacagagtttgctgcccgccatcaaggagctggcagaggtacgagggtgtgttgctgcgagtggtggggggactgcagggggtgcatgggcgtgccctcgcgtgaggaggaggagtgatcagcatggggaaggtagtgaggcgccgcgtggcaacatggcgcactcatcgatgcggcgaggcagagcccgcccacggcaaggtccctgcctgctcaggcgcctgcatgggatgtccacgcttgggctgcaaatgctcagaggccagcgctgcatcagccacggagcacagcgatgcctgtgcctccgcggggccgccaccggccagccagcctgggcacgctgccaccatgcccacccagctccctgattcagaaacccacacatccacccaaacaccggcttgcaggaccgcaactggcgcgtccggctggccatcatttcgcacatcccgctgctagccggccagctgggcgccgactttttcgagcagaagctggggcagcagtgcatgcgctggttgcaggtgtgctggtgtgttgatggtgggggggagggcagggcaaggagtgttgggaggggtccagagcgcggggtccccgtaggaccgggcagctggagagctcgacagagacttggaatggatccaggttccggccccggcccggcccggcatgcgtttagtaagggtgttccaggcttttcgcccgctaggcagcatgccctgtgatcttcacgaccctggcgccgagcccctccctgtgtcaacagagtccagtcgccccacttcccacctcctgacatatttgcaacatacctgctcgtacccccgcccccaaaaccccttcatcaggacacggtcttcagcgtgcgggaggctgccaccaacaacctccggtccctggcccaggaattcggcgccgactgggcgcgggagcatgtggtgccgcaggcgagtcgggcgcaggcttctcggagtttggctgagggatgtcgtgtggttgcagcagagcatcattgtccatggagaaggaagctcttgcctgacagtgccctgacccaccgattccccatctccacaacgatatcccctcccccaggtcttggccctggcggggcaccagaactacctgtaccgcatcacggtcctagcggcagtgtccagcctggcggcggtggtgcctagggacacgctctgcaacgccatgctgccgacagtggtggagagggccaaggtgcgaactctcacgggatggagcagggggtgaagcagctggcctgtgcgctcgatgatcaaaggtctgcgcgcagtacctccgtcccctgtgtctgcatgctcggcaggggcactgcttgccctggccaacccaccaaggatgtatgggtgccgatcaacccccaccccccattcacccatttccccgctttcccccctttgggccaatccgcacaggatcgggtgcccaacgtgcgattcaacgccgcgcagctgctcgagcggctggcggggctggtggatccccccgttgtcgaccaggtgatcaagcccgtcctggcggagctggcggcagacagggacgcgnnnnnnnnnntgcgcagctgctcgagcggctggcggggctcgtggatccccccgtcgtcgaccaggtgatcaagcccgttctggcggagctggcggcagacagggacgcggacgtgcggttcttcgcaacgcacgcgctggcagcctgcgacgacctggcggccatggcctgagccaagggggggccctggtggggatccatgcacgccatgctaccaggcgaccgtgcccccgtacggagcgaaacttcccccgactcatgcccggcactccttgctctgtgccatacttggaccgcatgtccctgcttggtggcaaggagaccacctgtaaagaagggagtggaccaggtgcaggatgatgctgagccacaatgtgcagtcctggcactgtcgcgatggggatattgctgaggatgtgcaacttgggattgagtgtgacaaagaggctcatccaactccggaggaggcaggatctcgtcgagacgctggccccgctacacaatccaacgggccaggggggaagtggcgatcgacctgtggatctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactctatgacatcctcttccagaatgagcgatgcaggagcccaaggacctgacaccgcatcgccgtgcgaagaaccnnnnnnnnnngcacggtacacaatccaatgggttagggggaagtggcgatcgacctgtggatctccgatgggacggaccagaagatcctggatcggcacggcttgcaggcatacccttgaagatttaaactctatggcatcctcttccagaatgagcgatgcaggtgcccaagaacctgacaccgcatcgccgtgcgaagaaccgggcagtgccggctcggttgcagatcacatccagttccgcattgtgtacggcaggaatagcaagtcggtctccaggtccccgcagcacacagtcagagagctaaaacgggagatagaagagcacacaggtgagctgccgatgtttggtgggcagtcctgccactcatgagtgtcctcctggctgagcctcatcagcggctcatgttggcaggtgtcgtcgttccaaatcagaagcttctatgcaagacccaactccgtgatcaccagactctctccgaggtacataaagtttgaggacagggcctgtggagtaatggcaacgcacgactcggactgcggcagtgcttgacagggaacttgaaaatagagtatcagcgcacctctccgtgccctgcgctcccattccctcccaggctggcgtaaaacaaggctccaagatcatggtgctggccatccggcctcagagcagcccagcgacgccccagactgccgaggggagcacagaacacgcgtgggatccgacccctgccgctgaggtctgggccgaccaggagcgccacaagaaggcaggacaaggggggcaggagtgccggggcccctgccctcctccccggtcatctgggcttgatgcgagcctcttcatcccccgccatcgccgcaggttctggagtcgggtcgaccggagggtggctgggtcggcatcgcagaccggcaggtccctctggatgacaatcaggcattcatcccggccctcctcacacaggccagggtcaaggtgcgtgggcatggggtcctgcgaggagggcctgcttcaagggctcnnnnnnnnnncttcgccgcaggtcctggagtccggtcgaccggagggtggctgggtcggcatcnnnnnnnnnnnnnnnnnnnnnnnnnnnnnnnnnnntgcataagattttgccgagggcgccctccctccccacctgtcagaagcacccctctaatgctcatggcccaagacattccaccccggttgccaggtgcggctgacgttcaagcccgagctgcagcaggtgtggctcgggtcggaccacagcacccaaaaggtcccctacagcagtgtgcgtggcatcatttcccagcccatccctgcctcgcctggctactccatcctgtgcctctctttgggctccgggagcagccagctgtggctctattgggtaccctcgcaggctgtgtcaggcatcaagctgagggtgctgggggtgcaatccctattatgacaggacgagttcttgtggcaaatatgcagcgttccaagaacagcgcattgtgagggggggggatgggcagaatgatccaggttgnnnnnnnnnntttatgacaagccgagttcttgtggcaaataagcagcgtttcaagaacagcgcattgtgaggggggggatgggcagaatgatccaggttggcaaaggtctcaaaagagggtggatctgcaagcacatctccagccactccagcttgggtctgcgctagttcagccaagcagacggcacggatgcctggcgccttcgtggtctccatgcagctccgacatcacttctgcgccgcagccgacgccgtgagctccgcatcgcgcttccccaggtaccggtcccagtagtccacgcccacggccttcggcttgccgtagaaaaggtgctgcactccgcttggaaggccccccatgcccgtgacgaggaccaggataatccccaggggcagcatgccctcagcccatggcgccagcatcgggcagttgcccgaagggtgttcccacgggtccgctcgtcgacaggtttgtcttgccaggcaagcacccaaggagttggagcgcccggttggaccagatgatgagctcgataatcctctccagagcctcctgcggctcgtatcgggggggctgtgggagagacgggtttgggcatgggtgatgctcacagtggtagtaccctctgcaaggcgatggtaccgcgaaggtcccttcctcaccaaagaatgacgtgtgccagcatacaacacgttctgctgtgtgccccgcaagcctgttgagctcatccaacaccgtgacacactcacgcaatcactggaatcttctcatcaaatcgcaacatggcaggtgggtgcttggagtcttctggatcgcctgctatgttttcgtatacctcgggcgacctgcggcttgtgccaaaccatattttcacgactgatccattcttagaacaatcacacgaaagctcctgattatggcaggcggaaaggtcgtggtcgtaaacagcaaagctgagtgggaccaggtgctcaacgaggccaagaactccggcaaggcggtgagcattcgaaagggactgaatcggcggtaatactctttgggtgatgtggctgggtcttggctgtcgttcaggccctcatcaaggggaggtggaggcctcgtctgggcccgtgagctacctgcgcgtctcaggtttcccctctgcctccccacacatcccccctgacctccctcctccaggtcatcgtcgacttcttcgccacatggtgcgggccctgccgcctcatctccccctacttccaggagctgtcctccaactatgacgacgtcgtgttcgtgaagctggacgtggaccaggtggaagaggttgcccaagccctgggcatcaccgccatgccgaccttccaggtcttccagtccggggagaaggtggacgagttgatcggcgcgtccaaggacaagctgaagagcctggtggaaaagtacagcaaggtgggagtggctgcctgagtgccccgctgcagaggtccacatccaggaccatgccataccattttctctcgagacaaagcaccccgctcggccttcacatggtgtgagtgtgacttcgtcgcatcctggcatgcgtcttgacgtcttgtacagagcctagaatgaatgggtacccatttgcttcatcagggagggcagaggctcacaacgagaggatgcagagagcagagaatgggagaatactggttcctgggaagcaagcactgtgctctggggatctagacaccgaacgaaggtcgcagacacgggcatgactccccttgcaggagcaaaacagtccctttctgatcagtgnnnnnnnnnntcatttgcttcgtcagggagggcagaggctcacaacgagagcatgcagagagcagagaagaggagaatactggtccctgggaagcaagcactgtactctggggatctggacaccggacggaggtcgcagacacgggcatggctcccttgtaggagcaaaacagtccctttctgatcagtgtggcagccctggccaacagagggtctttcattaacatgcactaatcgtgcttctttccctggcaatggaggtgggtggcatgcaacaaggtggatagagcacgagggagggcagcccgctctcaatctgagatgatgattagatttgtgaggatgcaatggcaagccctctattcttacactccggtcatgctgcgcctcagggatgatcgttgccaggtttaaagaggatgagattagctgggtgaatgcattggattaggaaggcttttagcggtgaaagatcggccctagggcgcagctcatgacgggcccggccttccattcccgggtggataatgaaaaagagcgaggatttcgttctacaagtctgttccgcatgcgacagtgggagcnnnnnnnnnncgaggctgtcaattgaaccacggcttggcagctggcccacgtgcggtgcggatgccacgccggcacgatgcggagatgcccttgcacaagacagaatcgnnnnnnnnnntcgggcccggccttccatttccgggtgggtaatgaaaaagagcgaggatttcgttctgcaagtctgttccgcatgcgacagtgggagcagcccttgtcttagggaccatttggcgccctcaacggccggtttatccgacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacaatgcactcacataagcccccaccctgaaattggcccacccttagccctccaattttcatcactgaatccgttataaggatgccatctcgaggacacgtcgcttcgccagcaannnnnnnnnnagaggctgtcaattaaccacgggttgacagctggcccacgtgcggtgcggatgcaacgccggcacgacgcggagatgcccttgcacaagacagaatcgnnnnnnnnnngtcactgaatccgtgataagggtggcatctcgaggacacgtcgcttcgccagcaacgccacaggtcgccaagaatgctcgcccgggcatctccggggtgtgtatgctcgcgcttgtcctcctgatggcggttgccccaattcaggcatccagatccataccctcagtcaccgttattagcagcaagtctcactggggcgcgtcgctcgctgctgccagggaacacaacatgacggtgcgtgctgggcttgagactgcacggagcccgctgtgaggttccggaactgggtgggtcgagttgacgccccccaccggccctaccacattgctctgccagactcgatcgacaccactcgctctcgccccgcaccgcctggttattgtggagttccgcgccccgtggtgcggcccctgcaggggcattgactctttcatcggacagctgtccgccaagtacagcgatgtactcttcgtgacagtggacgtggaagacttggaggctctgcagagggagtacgacatccaggccacgcccaccttcgtcgccctgcaggggaccaccgagaaggagcgtaccttcggggccgtcaagcccaagattgaggccatggccaagagattcagcaagtactgatgaacgtgggctcacagcaaccccctttggagaagtgcacacccaggaggcactccccctggtctggacaagtgcaggctcggtatctgtccccctttatccccaaaatttacctgctgctgcctgccgctctgaatttctggaaccaccaggactgcgttgcagtgcgatcaccaccttcacttgccacagctgccggattggactcaggcaatgggtctggtggtgcaattcccgcccgctggacacacgtcttctgtattgccaggcgagcaaacacatgtcctccgcccttccgtcccgtgtaacaccacactgtgaccctgctccggcgtcaagcaatgccacgaggagctctcgctccatgcaagtgctccagccgcgacccgtggcacatcagttcgcagttgcatccgcgtgatgttccacgctgcccgccagtcccagcgtgtgtgcgctctcaatatccatggccccctgccacgccagccccagccgtcgccgacccaataagccnnnnnnnnnntcccggggcacacctgtacgcagtcgcacccgcgtaatgtcccacgctgctcgccagtcccagcgtgtgtgcgctctaaatatccatggccccctgccacggcagccccagccgtcgccgacccaataagccagcacatcggcaccgcccctggcatgtggctcacccgatccaggtacggtccaccagggagcaagggtgctggttgcccttccagtaggcggcttggtgcagcctcgccgacaatccaggccttcccgtctggggagaaggtggacaagctcatcggcacgtccagggagaaggtcgagagcgtggtggtaaggtacagtaaggctggagttcccatttgagtgccccaagtcgaaaatccatggtcaggacccttccgtggtgtccccgccctggactgggcgttcacgccgctacatggttgatgtttgaatgcgacgcatcctgacatgcgtcttgacgttgtgtacagaggctacaacgtccaggtactcactcgaatccacagtgagatggaggtctccgatgacagcaagcggagtgcagagaaggggagagcatgatggccccctgggaaacggtgatcctatctgcagataaattatcgtggaggacagcagaatggctgggcatggcaccaccctggaagagcagttgagaattggcgtgacaatctgacgaggctggccacgcgggagctcttgtaaagcactttccagccttggacgacagactgtctcacacccaggaaccagtcagtcgtgcgacaagggtgagacggtgcacgaaagagggcggagcgttctcaaactcaccaagacaaaccttcttgcgtggaagcataggttaccctcgtcgtttttacattactgtcatgctgacatgcctgcggggtccaccggtgctgctccacctcacaattggttcatgtaggtgccaacaatgtttgcgggggttacaggctgtgagggaccgacgagcgcgcaatcctgcaaaatggtccgatctaggaacacattgggggttgtggaactgtaagagaactggtatcatcaggcggacctcgcagcttgatgcctggcgacagcagcgtgaaactgaggcatgttttggcgccttcgatgtccggagggaggctatccgatggatcactgctcgccagctggtcggcggtccggatcgaccggagcagaattctcgcggcaggacagagtaggggggttcggcctcagtcatacattttggctcgtacgcactcgccagcgagggaactcgcccatactgaccctccaattctcttcgtagagtacgtatcagcgatggcacctcagggacatgtcgcttcgccggccctgccacagggctccaatagtgcccgccagtgtatttccggggtgtgcatgctcgcagttgtcctcctgttggcggtcgccccagttcaggcattcagaaccctgaacacagtcgtccccgtcaacaacaaggcccagtgggacttcgtgctggctgactccatggccaaaaaccagacggtgcgtgcggggctggagcctgctgttgaggttccgggaatggtgtggcggaggcaatacccggccgaccctgccacctcgctctaacggactcgatagacaccactcgcgcacgctccccaccgccaggtcatcgcggagtttggggccgtgtggtgcggcccctgcacagccctccgctcctgggtccaacagatgtccgacaagtacaacgacctgaacttcgtggcagtggacgtggacaacgctaaggaggtggccaagcagtacgacatcatcgcgatgcccacattcatcgtcctgcaggacaccagcgagaaggaacgtgctctcggggccatcaagtcgaggctcgaggccatgtttcacaagtacagcaagtactgatgggtgcgggagtgaggtatcccccccnnnnnnnnnngcagatgtccgacaagtacaacgacctgcacttcgtggcagtggacgtggacgacgtcaaggaggtggccaagcagtacaacatcatcacgatgcccacattcatcgtcctgcaggacacccgcgagaaggaacgtgcttccggggctatcaagtcgaggctcgaggccttgtttcacaagtacagcaaatattgatgggtgcgggagtgaggtatcccccccggctggggggagtgccggcctcgcggtcctccccctgatcctcaagactcacctgctattgccttgcgagttctccattgagaggccctggcagcgcctgcaccnnnnnnnnnnacggtcctccctctgatcctcaagacccacctgccattgcgttgcaagttccccattgagaggccctggcagcgcctgcaccgcgacccccacctccatcttcagctgcagtgcaatcccggcgaggggcgggcccagcccggtccatgccggaatgaccctgacctcgccaatggcgacatgcactctggcacacaattccccgccttcctgcctgtgcaacccttttcatgtaacaacacactggggcaccactctggacgcgccacatcaaggcctggctgtccctgttccaggcgagtgctgtggccacgaaatgcggcaccatggcaccggcccgcgacctggcggcatccctcgctgcatgcaccatgcccagcgtgcccgcgctcacgcctctcccgccccctcgccgcgccagccccagacgccgcagacccagtggtccagcacctgggggctcccataccagacgcggcgctgggccggccgcggcccccctgccgcgtcggactgggcccccacggcggccgcccccaccgcgcccaggtctgagacccccgtccccgctgctgccgtcgccgcggctgccccagccgc

SEQ ID NO: 46300 - DNA, 71 bp, Chlorella protothecoides
tcctcaccgacggtgcgtggtgaggagttgaagtgtttgtcgtacgcccaagcatcagccggggcaggaac

SEQ ID NO: 46301 - DNA, 61 bp, Chlorella protothecoides
ttgacgtcgcggttgacaacgttgaccttgaagcccttgttgacacagcgcttcgtgtccc

SEQ ID NO: 46302 - DNA, 104 bp, Chlorella protothecoides
gagcctgcccgcatgcgccgtgccgtcagatgcgaccctcgactttcaaacccccccaaccccggtcttccaacctaggctgaccgaggggccagccagcgcgc

SEQ ID NO: 46303 - DNA, 61 bp, Chlorella protothecoides
tggttggcgccgcttggccgatcgtggcccagagcgatcctgatcgctgcgcggtgtggcg

SEQ ID NO: 46304 - DNA, 61 bp, Chlorella protothecoides
gagctggacgtgctggagcagctgcgggggtgccccgccctggtccagcatggcgaggagt

SEQ ID NO: 46305 - DNA, 76 bp, Chlorella protothecoides
aggtgcaatgaattgggcatccatgacatcatacccggggtccacacgcccatgtcgtaccaataactcaacacga

SEQ ID NO: 46306 - DNA, 147 bp, Chlorella protothecoides
caggtatggagcacaggcccggcgcatttgcctgcctgcaaacgcatgaaatcccgccgggagactgtcacctgccagcattgtcctcccatacacgcccctcctcatccccattccatcccttctccatggcccgtctcccctgcc

SEQ ID NO: 46307 - DNA, 63 bp, Chlorella protothecoides
cacaggacaggcacatgtgtagggccgggcagcttgccaaccccccttgacactgtcccccca

SEQ ID NO: 46308 - DNA, 17875 bp, Chlorella protothecoides
  modified_base (1098)..(1107): a, c, t, g, unknown or other
  modified_base (1509)..(1518): a, c, t, g, unknown or other
  modified_base (4577)..(4675): a, c, t, g, unknown or other
  modified_base (5245)..(5254): a, c, t, g, unknown or other
  modified_base (5797)..(5806): a, c, t, g, unknown or other
  modified_base (6081)..(6090): a, c, t, g, unknown or other
  modified_base (6156)..(6165): a, c, t, g, unknown or other
  modified_base (8330)..(8339): a, c, t, g, unknown or other
  modified_base (11017)..(11026): a, c, t, g, unknown or other
  modified_base (11507)..(11516): a, c, t, g, unknown or other
  modified_base (11710)..(11731): a, c, t, g, unknown or other
  modified_base (12906)..(12915): a, c, t, g, unknown or other
  modified_base (16416)..(16425): a, c, t, g, unknown or other
  modified_base (17387)..(17396): a, c, t, g, unknown or other
  modified_base (17795)..(17804): a, c, t, g, unknown or other
cccccccccttcatccaatgctgcaacccaacccacatgctggggctctggagacttcagaacccccatgtcgcccaggggcccggatggaaaacatctggccccccccgggccctctgacacacgatcagcagcttgctacacccatccaccagttgatgtccacccctcaaatcaccgtcccttttgacattgatgcttcctcttgtgcacccccccccccagccatgcccctgtggcccccacgggcacagatttcaccttgcacacaccaccgtgtcggtctgcctgacttgaaacatgggctcaggcacgggagaaggagacggggctggacagtgggcggcaaacgggcgaggccaaagatgcgccagggtttggcaagctcatcctggggtcctcaccgacccaccgcctgctgcagatccgacagcatggccttcacctgcagggtgtaggggcgtgattgtggggagggggggcacgctgttgcaacggctcgtgctagcgaaccgcgtgcgtgcgcagatgccctgggagacggatgcccctcgaaacgggacactgccgcgtcgagcagcccgatgggcgaccatcgccctgcccgcaaccggtccctgggccaacgtgcacacctggagccccccgttacacacccctccagataaccatcacctgagacgcaaagatggccttggccagggacccgatggcgtgcggcggcttgctggcgaggtgtaccgccaggctgtactgcgtcctggtcagccccgcgtcgcccggcgcggcctgcaccgaccaggtgcctgtcaggtccgccaggaacccggactggccggggacgaggctgaagctgacgcggtgcatggctgggtcctcgctcacacgcagcaggctgtcaaactggccggagaagccgaggaactcccagaggcaggtctgcggaggcagggggtaccggcggggcggggtggggctgcgctgtgggccggcagggcggtattaagccgtactttccccagcgggatcgctccaggccggggccaggggggtgtcagccgcaacacgtgatctcattcacacgaggaccgcgccgcnnnnnnnnnnagtattaagctgtattttccccagcgggatcgctcgaggcaggggccagggggttgtcagccgcaacaggtgatctcattcacacgaggaccgagccgccagcccttgatgcgggggagcagccgaccaagcatcacctgtcgcaggagtgagtccccctccctccctgcctcctccctgcactcggcgatgctggtgaagatccggggcagagtagggtagtctgtgaggaggtcgtacacagtgggtgggctggcagctgtcaggaagctccccacagccttgtacacgccagcctgtggaggtgtccatcagacgtagggcaggtagtgtcactctgggaaggaagatgcgtgggactgcatctggtgcttgatgccccacacttgccaaacagtatgnnnnnnnnnnaacgtagggcaggtagtgttactctaggaaggaagatgcgtgggacagcatctggttcttgatgccccacacttgccaaacagtatgagcgccagtcttgctgccactcttcagtgcacatgtcccgtgtcgccacccatttgccccacctcatatgtcacttgctccaaaactatgtcggaggtgggatccccaccatctccagcctccatgacggcagtctctgcacagtcctcgtcacgagtgctcaggcctgacatggggagcactgccgacacccggccctgaccactcgtcttgcgtggcgccctcttatgttgcaggagcgtcaatgtaattccaacctcccataatctcacagcctgacacgttgtcggcgtcctcaacgcctgcatgctgcatttggaaagcttcacggtacggaagaggcgcgtgcactccatggagaagcacggcccatgcaaaggtcgagacgctcaacaaataatattttgactcattgtggcagaaattgaaggcgatcagtgtggtgccgcatcatgtcgacatgctcccgggaagagctgtcggtgtcgctggctgttggatctcgccatgaggaggggaggaggccggctgacctgctagccgcttgagaaagaaatgggggcatgcgtcctaaccccaatgctgagaggttcccccctccgatgcatggtacgacacagagcaccaagtgattgcatgcatcagtgagtattgcccttcttttcccgggtagtgtcgtcgcgtgccggacctctactctggggaggccggatacagcactgctgcctggaccattggtaaacgtccctattattgcgccaatcgtcatcagagggtaacctggcagccatgtactatgataatcacacccatgctcagttttcccagcccaccaaggtattggcgatggtattggtgttggtctcgagggattgcctgcgcagggtttgtaccgatgcgcgaatgtagtgtggctgtgtgaccagctgtgaccgatggcctttggttgaaggacatcatatgttccaacccccgtgccaggtcattcatgtgcgcaacctgcccttcgaggtgacggacgaggagatcatagaaatgtgcagcgagttcggcagcgtgatcgcagtcaagggacggattggggagaagaaaaaccaggcgtttgtggaattcgctgagctggagtcctccatcgccattgtcacccggtatcaaggccccgccgacccagcaagggtgagggatgccagggggtcagaacagtgattgccttgctgagttggtgatcaagttggtgacaggggttgccactaggggtcttcgatcttgacgccaatcgatgcaatgtccctggcaatgactggcatacgtgtgggatgcagcgcctgagtgcctccacctgcactgggggtgcgcctggcaggctcaccatgagtctcaggcatccaggcgccagggcaccctcccgcccctcccacatgcgcaacacccccgctgacacacgccttcccgtcccatctgccagctgcggggccggccggtgttcatggcctacgcggggcgcgaacacctcaccaatgtcacctcctcctacaccagcccctcccccgtcgtcatggcccgcatcacccacatctcggtatggtgggtggggcttctattctgctacattcctcaaagtggtctgtccctcgtgtgcttgatttgcggctgatggatggcccacctccttgcatgctcctgcttgatccctggcggctgcccggcgaggcaccgagtgcgcgcggacacccatatcagagcccgaagttgaggcgccggtgtcatgctggcacacggcccctcaggtccctttcttctgttaaccgggactcctcatcctgccctccctcgcatgcttccaaccctcccaaagagctcttccccccttcccccctcccgctcaaggaaaccttggccccgctgctgacgctggaggtgctgaacgcggtgttcgcggcctttggccccgtgctgaagatggcgctgcagccgcaggggcccagtgaggtactggccttcgtccagtacggcgacgcggcgcaggcgcaggccgcgaagggcggcctggccggcgcacggctccccgccggcgcgtttgaccccggcgccgcccccgccgcgccgggggatgcgccgctggtggaaggcctgcagtactgctccgcgcgcaacctggtcatccccgtgcagtcggcgcacacgcgtgacttcacgcgccccgagctggcctggggcgagcccaaccgcgcctacatcagctccctggtcccagccgccgacgcgggcggcgccacgcgcgtgctcagcatcacctttgaccaggccacctaccccgtgaccctggaggggctgcataccatctgctccacctacggcgcggtgcagaagatccacacctacgagcgcgacgcgcgaatcgtggccctggtgcaggtgtgtggaaaacgggaatcgagtgggtcgcagggcacccttttcgttgttctgccttgggagaggggcgagctggggaatgggccctggcgagggggagtatggacccagacgaaggggggctggggcgtgggagtgggagggtcatgcacatgtcatcagggtgagggcaggcaggccgggctgcccgttgtgagtggttgtgtgcactgctgcacaatgcaaccaccgtaaagcatgccgctgattgatggcccccctcctctccccccctctgataacaaatcctgcagtatgcggagcagtcgaccgccaccgcggccaaggcggcgctggagggccaccccatgtacggcgacggcgccaacgtcatgcgcctggtctactcgcgccacaacgacctggtcatccgccccggcgagcggtcccgcgacttcgtgcagtacccgcccggcaccacaccgcccacgcccacgccgacgcatggggcggcggcgccgggcgccgccggcggtcagcagggcggccagccggcgccggcgcagcagtacgcgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaggccgggcggccaccccgccacgcagcagcagcagcagcagtaccaggcgcggccggggggttaccctggctacccgccgccggggtcctggggtggggcgatggccccgcagccctacgcagcctatggggggtactatcacccgcagcagtaccaggggtaccccccgccacgcccgccgcaccaccaggtggatcaggggggagggccggatgccccacggggggcagtgcggtggacgccgtgcacaacgctcgccactctccgtgaccccctccccctccccaaacctcctcaggggtactaccagcagccatgaagcgtgcaggggccggaccttgccaagcatctcactgccgccgctgccgagagggccccgtcacatcctggcatgtctcccctcacctcccaatccccctccctacctccgtgagcatcccctcacctcccgtggcctgtgcatgtccccattctccactctgctgggacccaaccctctacgtgccctactcctgtgatactgggtggcaggtcccggcttccctcccttgtccaccttgtcctcnnnnnnnnnncagcccgtgcatgtccccattctccaccctgctgggacccaaccctctacgtgcctactcctgtgatactgggtggcaggtcacggcttccctcccttgtccaccttgtcctcggctccctctgacactcgatacggcatttttttcagtctgcaagtacacggctccctgtatgtcgaggattagcagggtcgggggtcgagcgtcgtccagcgatgagtggcatcgccacacaaggctcctgagaccgacgttcggcagccagggtcgccaacatcctccagcagcaggctcttgacagagagccccgcccacgtcgtagcctagcctggagactccagggccagccccggttgcgtgcggggcgaccacacctcgtcctcctcaccagagccatcctccgcctctgcctgcgaggcgggggtgatggcagggtgtgaagaatgctgcgggaaagcttgtatgcgagaagacactggaggcccaacgaagcaacaaccccaccctcttatttatcaggagcagcggcctttgtacagaccnnnnnnnnnnagagaagactctggaggcccaacgaagcaacaaccccgccctcttagttatcaggagcagcggcctttgtacagaccatgagccatgaccagcatgggcctcgccccgacccaccgtgccaaacatagcggcatgcagggctcggtagtccacttgcgcacgcctgcgtcggccctcgaccaccagcgtctgcgcttctgggtcttcgggcccgacgcccgcggagctggtcgccaggctggaagcggggcgccccgggcggcgccgccccaggnnnnnnnnnnccccgagtcggagctgctgtcactgcgctcggaggagaggccaggaggcacagtgcaggtcaaacnnnnnnnnnnctcgggcccgacgcccgcggagctgttcgcgaggctggacgcggggcgccccgggcggcgccgccccaggtcctgccccacgccgtcgcccagtgaccccaggctgccctccgaatcgaggccgctggagccggagctcgcgcccgatcgctgggaggcggggctggaggggagggaggtggggtctgagcccggtgacgccgtggcggccccggctccctcgcccctccgtccatcctcgctcgcctgggacgctactcccgagtcagagctgctgtcactgcgatcggagaagaggccaggaggcacagtgcaggtcaaacagatgggcaccctgcagcgctgcccttgtgtcgatccgtgcagagggtgcatgcaccagagcccataccactccccctgctcctcacccctcgaaatccgaatcctcctcgtcctccgaaggcaggtcggcgccgcccaccagcaagcccgcgccgccctcgcccacggccacagcctccccctcctcggccccgtcactggcagggaggctgccaggctccaggatctgctgccacccgtcctccagaccatactccgtgtcgaactcgtcattgatgagcgacaggatgtccacctatggcgataaaggaggtgaagaggaggtggggaagggtggcagatcgggggacacctggccttacgctctgcaatacactcccccgggacaggcgacccaggggccccttattgaatcatgaaaccctgaagtcatgagcactgcccaggcccccgcccccccgcggctcaccttgtggtcgcaggcagggcacagccagccctcatcctctgtcagggtgctgacgtccaggggcggcacgatgcacttgcagtggtaggctcggttgcaaggaccgtcgcacagaacgatgtcgttgtcctgtcggcagtgggcgggtgggggcattgagtggccgcgcaggcatcatcggggtgggcggggcgaggagatgttctgcaggggggaaaaacaaacccagaggggcaccggagggaacaggtgccttgacgggcccgtagaattggatgctcaccgcccttccctctttccgctcagttctgggcccctgccaacgtgtggaactcacgtcgtcagcttcccgctttccgcacttggcgcagaagatggcgtccgagtcgagctccccctcctcatcaaagcagctggctgggattggggtgtctccctctgtgtgtgggtggggaagtaatgtaatcacaccggctactcaggcgtgcctgacaggcatggcaccaagcacagcggcagtgtcacatcctctgaatggaatgaagctctagcgacccgacacccacctgcctcctcgcaggtcctgacacactcccgcacgatctcgcggcacctccggatctggtccttagcgcgctggatctcctgcaggggtctcaccttctcgcgtgccgccccccgccagccgtccgccgcataggcatcaaccagcgcctgctcctgcctgaggacggtacaggcgggacgcggacggcacatagtgtgcagggccacacacgagtaagatcactcgggccgatcactccaaggattgaacctcctgctgcagtgcacacgctgcgtccggcttgcatgtagagattcaggcgctccctccacttcaccaccctccccgccagtcacctgatgcgggagagctggtggcgggcgcgattcagcagcttgtcgtagatggacttttccggacggtcctcctccatcctccttcgggaggctcgccgcagccttgggcgcttggcgggcgtggcggcgtcgaaggcctgcccatccaggggacctgccggacgccgctgccggcgcggtctaccggagctgaggcggtcggatgtctcgtccccactcttgccggacagggaggcagctcggcgcgacgacgccctgctagatggttgcggatccatggggcagtcttcctgcagattgggagagggatgatttagagggccaggcaaagtgttataacccctgcacagactgtttttgcccgctgttgagggaggggggagaggaaagtgatgcaccatgcatgggccttcaaatattttcaattggggactagtcacgttgctgggatcccgggctggtggactcnnnnnnnnnngtgcatggcccttcaaatattttcaattaaggactagtaacgttgctgggatcccgggctggtggactcacccttgttgggatcaagggggtgaatcaagtccacatggatcctccagccctctgacagagcacctggcacagggcacctgggccgacacaccgccccgatcctggacgacagccgggtgaatgtgatgtctgggagtccctggtgcagcacgactgctgacagagcgcggtcgacacgaggaccaccccgctggcaactactcgacttgattcgcgagttcccacaggtgcgagcctcacagcaggcaccgcaggcagctttggggcaaggccacggccaggccagggttacaggttcacgattgccgcgtgccaaatatgataggattaagttggaccgacatggatgcagatccctggccgggtgtcggcagccccggcatggcgcccctggaagtgatcagtttcggcacgtgaacgatctgacggcatggctagcttgctctcaagcatatctcgcattccgccttcaatactaggagccatacagtttcgttgttaccatgacatccccggtcgtttcagggtcctggcctggggctccggcgcccaggtatgtgtgttgtggggaagggggggtgatataagtcatgcctgccacggttgtcccgaaaccacacaacagcctcctccaaatggagcctgcgcgcaaggcccccttttcccccccacccgcaccccccaaccagggagctctcggtcgacccgatgccggggactggtacgagccagagcccgtgcccggcctcccctccgacctgatcggcgtggctgcggggcactacacctccttcgccctcactgctcgcggccaggtgtggagctggggcgccaacgaggccctgcagctgggccgccgccagcgagacgaggcctacacccactcccccccgggtccgatccccggcctaccccccatcgcgcgcctggccgcctcgggcgtggtcggcttcgccgtgaccacacacggcgagctccacgcctggggcaccagccggcgtggccagctggggctggggccgggggagacggccgcgccggcgccgcgtcgtgtggaggcgctggcggacgcggcggccgtgacccaggtgtccgccggctggggccatgcgctggcgctgaccgtggacggcggggtttgggcctggggctggccggccgcggggcagctgggacacacgcttcctcctgaggacgccgacgaggaggcgctggcggcggcctgcgtctgggcaccgcgccgggtgcatgcgctggatgggcgcggcatagtccaggtggcggcggggtacgaccacagcatggcgcttggggcggacggcaggctgtacacctttggcgacgactccctgggacagctgggcaggcgggaggctgatgtgggggttggggtggcgggaggggccaccatcgttcgggagtcaggctctccaaggccaggccaggcgccattggccagccaagggggtgccgccccattgccgggcattttgagagcccagcccggccgtcccaatgccgcagcgcccaccacacacacctcccagcctggcccggccgacgcgtggctggtgcggggcgctcccgcctttgccaaggtgacggcggggctggggcactgcctggccctcacgccctgcggccagctgtacagctggggctggaacggcgcaggccagctgggcctcggggcgggggaggcggccgaggtggtggccacgccgcagctcgtgtacggcctgccgcgcaacaggttcgtggaccggggaggaaccagcggcgccccgcctcgaatgcacgccaggcaacgcattggagggccagcgattgcactcctgcaggcgagtgtgagggcccaccaagcactttgcatgctcatcccccccatatgcaccgcattcctgctttcctcgccaggaacgcactgctggccgcggggcgcgtgcactcggtgctggtcacggacgaacgggacgagcaggacggcgcggagctgaaggacaacgaccacgcgggggccatggccggcatgtgcgccagctggggcagcggcgccaacgggcggctgggcacggggcagctggaggaggtgcaccatccggagctgctgcccatgctggacggggaggaggtggccgagctggcggcggggctggaccacaccctcatcctggcgcggtgatgtcgtgtgggagcagtgcagggcagaggcatcctcgaaacaagcaaaaggatgtcggaatgtgggcttgccgtccgccaggtcggaatgtgacactggcaggcactcatctcgcacacgcgcaccaggccacgagggcaccggcagtcagcgggcagacatcacgctcaggcgagtccactgtgaatcgccatccatcctgaggagcttgtctgaattgaggaatacagactaggtgtaccaactatagaacgatcctgttcaagtatagtcgatgtgaaattagcatgtgattcactatatatacctgttgccatcccgcgtctcaggattatgggttttggtctgcaacttgtgcggcgctcgactaccacctcccggggcgacacgagggaaccaccggcatgtacttggtgtcgtatacnnnnnnnnnnagaaatcagcatgtgattcacaatatatacctgttgccatcccgcgtctcaagattatgggttcgggtctgcaacttgtgcggcgctcgactgtcacctcccggggcgacacgaggaaaccaccggcatgtacttggtgtcgtatacgaggttctgggttcaacacacgagtgtcggcgcggcacaggcaggctgcgcaccccgagcggtcggttccccacacatcatgacctgtcggggtgcagtcccgagacccgtcttctcgccaccatcgattgccagcaggtttatcagcgtaagtactgactcacgaggcttgaaaccaaacctgtatgcatgctgtggtgcgctggatcagatcccgctcctgctttcccaccgcaacgcacgggctggtttccagccaatagctcgaatccagctccagcagattcacatctcgacggctgaaaacacaccgattgcacaaaggcgatgctgnnnnnnnnnncatcccgctcctgctttcccaccgcaatgcacgggctggtttccagtcaatagctcgaatccagctccagcagagtcacatctcgacggctggaaacacaccgattgcacaaaggcgatgctgctggaaagggacacctatacacagtacggagcagtgctctacagtcacggcatgcatgaaatggcggtgannnnnnnnnnnnnnnnnnnnnnctgaagtgcgttgggggcttggtggcgggctgggtcgccatgtcaccgctcaggggcttcatggggagtgtgtggtggtggtggtgggggggatcttgtcagctgagtcattctcaggagtgtgctggaagatggctgctcggatggatcccttgtacaagcacactgctcatggtgtgccatgcgaacaggctggtgcaggaaggcgttccctgctgggatgggcaacagttcccagaccaacatcttcagtcctagaactccccaggacacccccgcccatcaagccatcccacatctcatactcaccgcgtcgccgccggcaccggccgccgctgccggctcccccggtcgcacgaagcgcgtgaaggaggcgcccagcttcttgaaccccgcgcccatggcgtcggtggcggcggtcacgcggtcgctctccagcacgcgggtggtcacgtcggccacccgcgttcccgccttgttcagcgccgcgacggtggacttggtcaccgcgctgtcacgcaccgcgtcggccgcgcgccctgccttctcgctcaggtgcaggcgcgcgtcaaggtccagcacggcgcggccggtcttgtcagccacgtcgcgcccggcggccgccacgacatcggcgccgcgcgcgcgcgcgacgtcgcccagccccagcgcgaactcctcctggacctcgtgcacggagtgggccacgtccaccgccactgcgccctccagccaggccaggagggccgcggggtcgggggtgtcccacaggctggtggaggtgctgccggaggtagggatcagctgcggggggtggggagggtcaggaggggatatcagacagtgtggggaccttgggcaatgcgggcaccctgggccggcggtcaagggccctgccaagcgcgtaaggccacgggtcaagggccctcccacactaccactgcctgcccgtcacctcgctacctggcgacatttgtgctcagcgggggccttcttgtgcaccacgatgtcctggagcaagatcgtggagaagggcaccgtggcggagacctccttcacggtgtgcaccgcgagcaccagcaccatcgtgccggggatctcaaagtttaaatggggaccgggccgactactgcacgctatcgacgacggagctcgcacaaggaaggattcgtgtnnnnnnnnnngaagtttaaacggggaccgggccgactactgcacgcaatcgaagacggagctcgcacaaggaaggattcgtgtctcctgagtgtccaagtgatcgacaaaaggtatcacacttggtcctgccagcggcatggtgacggagccagcgatccctccggtcgctcgaatcaaatttcagacggcgggcctctgtcgagagtctccaggcacatgtccacaccattgctcggccacactcgtttgctagattacatggggaaccgacatacaggggcattttaatcttcatcattcacatgtagtgtgagggatcagagtgctatcatacagctgcaaaaaattgtgcgcaggaccgtcgggcccacggcatcttctcagcgactacttctcagatagggtacagccccctcccgaccacagagtggcaggcagtcgtcatgcagctggacggggaaggagagtagtggggaaagggggaaagaaaggctgttgtgcaccctcaggctggtgagcagctggccgtgcggggcgtcgtcgctcagccgctgcctcaggcgcgggcgggggcggcgtacaagggattcgggacagaagcgctggagcaggatacagggcggcgattgatgcgtgtgcgccaagggtacagggcagaggtctttgttgctgtatttcgggctggagccggtgcagtgtgtccttccagcgtgcctctgaatgtatagattttaggatgagagggggtttgagcagatacccggcaccagccacattcgggaaacatcaagaaggtgacctattgtaccaagcaaccctggtcctggccgtgggcaagcaccctgcatgcaagcccgccacgagtctgccagcgcagccactcacaccatggtgatccgtgtgttccatacacactcctgaccaacacctcatcacccaacccccccaacatatcagaccactgagtcgtacctcagaacagggtgtccatggccctggtgggctgacggggcacgatggaggtgcgcaccacagcctcgtgcgtcagcacggagcgcaggcccaggaatgctagcgtcgagaaggcgagcagcgccacgcgcctcaacctccaggcatcgaaagactcgcactggagctgcaggtcccggcgccgcagccgatcccgggcgctggccagctgcttctcggtggcgagggccctgtgtggaggggaatgattggggtggctgagggtcgcaatgcgggggcctgctgggaatagggtcctgactcgctgccgccgctgcgcagacctgcagggtgacagggtcgatcgccccatcgaccgcccacccacctcttctcggcccggtcgatggaggcgtggagggaggccacctcctccgcgcgcaggacgcgcagggggcggtcggtcagctccgcgtcgtcctcccctcgctcgcacctgtccctggcctcaaaggcgtccggggtcgcgccggagcggggggcctgggcggcgcaggggggcgtcgtcacctgcacgaagctggccgccaggtccttctgtgccaggtctgcggggtcggccgcctccttcacgtccccctcccagccctgcggcgtcaccacctcgatcaggagaccctggtcgggactcaggggggggcagagcctcggcagcgcctcctgagggccgtcctcgccttttattattgaggggtgggaggatagtggaatgaaagtaggtgggacctgggggctcctgtcgatattctaggacagtaaagacgccggtgcagcaccttgaagtccaaagccccgctgtcgcacctagatctaggagggaaggaccggggctccggggtggctcagtgcctgcttcggagtcgtccacccccgtcaggacttcccagtcctccgcggtgtcacccacactcatggcctgcggaggagccttatcgccggcttcgttatgagattacaacttcgtgaactcaccaaggaaaatcgtcaggcgcagatggcgcaccgcccgcttgcctggccccgagtgcctgtaggcagctgaccccacacgacgacccagccacccttcaaagaggcgcgcgcccaccatgatgaacttctcatgagagttccaggcttcatgcagtgtatcgagtcctctctaaccccccagatcccgcgcttccccctcaccgtgtctggaacgccttgtggggcccagggcgtgtcggtgtctccctgtcgccgcgtcgccttcagcgggggaccaacagatgccgggacaatgtatgtatgtggcgagcgggctggattttgaaatgctcaggcggtacgagatgaatataccgtcgcgcccgggatccaaacgcgcgggcgcctcgcaagatattgtgtatctcaggatctacttcgggaccaggctgtaatctggtcagtacaacaatttgttcggacaaagacacagaagccagcaggatcatgtgaaggcagacagttttatgccagaggatgagcagagcttgatgaacacctcctccagggtggcattggacacaccccagtcgatcacatccaagacacccctgcatgtgtgggggtggatcaacactgtggtggatcaaagccaatcaaagcatcgctgtccattcaattcaagcaagcaccaggcgcaatcaatggactggcagcacccctaacaccgctcacttgagtttgatctcctccatcgtggcgaatactgcatccaccgaggtctcctgcaactgcagctcgaacttctgggtgcctcccagagcatacaccggccgggcagagggggagatgctctacacagaggggttgtgggagggtcctttgactgctaatttaccccaggaaagacttgctgcgacatacagctctcttgagcaagttgcaagcaagggactgtcgtgtccacatggccgaataacgagccaccttctcacaggtgatgagcgcgaaaacttaccctgaccactgctgctgctgctgcctcctgatgggggggcgtcgtgattgtgaaggacagatagccgccgaagcgggcagtcaggtcctgcagtgaggaagcaatcaaggggaggagaggtaaggtttacagattcattgtccatctgtttaggcacttgggctgctgttccttgcaaaaaagaggctctactcctcatgcaatggaccatattcttgttctgatccctgtgagtggctgattatgcgcacctcccattcccgtcctggcctctacatctcagcgcaccttgggatctcccaggcaactaagccgcccaccgacgaagatgccgagacggtcgcacagggcctccgcctcctccatggagtgcgtggtgagtaccacggccttgtcgcgccgcgccttcttgatgacgttccacagcagccgcctgtggaaggggcggggaggagaatgaagtgcccccctgtgtgctctctgggaacccagcgcggccctgggctgagtaatcctggacagcacacgnnnnnnnnnnaaaggggcggggaggagaatgaagggcccccctgtgtgctctctgggaacccagcacggcctgggctgagtaatcctggacagcacacggatagccatgcccagcacgcaggagtgaggagggcacaataccaacccccttctcattcctccattccaaaccttgatgcggggtccaggccggtcgagggttcgtccaggtacaccaccagagggtctcccatgagcgcgatggcgacggagagccgcctcttcatcccgccgctgacgaggggtgttggaagtggcggctgggatgaggaatgcacagctggctgacggaaggacggcagagggatcacacggccactctggaacattgggactggttcccaaggcatagctgtcgtcagggcaccacagtgcatgtgcgatccccgcccgccccccccaacttccccccctctccttccatcttcacctgtagctccctgcgaggtcgtccgccaccgccgtcaggttgacggaggccaggccttcggccacggcactggtcagcgctttcccccccaggttcttcagcctgccgtaaaacatgaggtgctcccgcgcggtcagccccgaccagagcaggtcgtgctgggggcaggcgcctgtcaggccgtacaccgtgtccatctcgttgcggatggagtgcccacccacgatgacctcgccgtcggagggttccaggaaaccctccatcatgcggatggtggtcgtcttgcctgagggtcgggggcggaggggaggtaatggggtgtccagctgctggactacgaaggtggccggggttggctgccagctcgctggcacctgtcagctcagggtatccatgccgcgcaccgagcccgcatcccagccccgcaaggcacgccccttacacagccgacgatccagccccagcctccttttcacacccgcagcaccaaaaagaaaggagcnnnnnnnnnnggggggaggtgatggggtgcccaggtgctggactacgaaggtggccggggctggctgccagctcgctggcacccgtcagcgcagggtgtccatgccgcacaccgggcccgcatcccagccccgcagggcacgccccttacacagccgaccatccagccccagcatcctcgtcacacccgcagcaccaaaaagaaaggagcacctgcgccgttgggccccagcaggccgaaacactcgcgccggtagatggccagggacaggttgtccaccgccgtcttggggtcgcagccgtgcgcccctgggtacaccttgctcaggtggtgcagcaggatggcaggcgcctcgccggcggccgccgggggcggggagggggcgcggccccttccctccccccgccannnnnnnnnngtcggcccaggccgcctcggcgcgtgccgcctcggccgccacgtcggcgccatccaggcgcagctgctccc

SEQ ID NO: 46309 - DNA, 61 bp, Chlorella protothecoides
ccccctctcacaagccgtcacctccgccgcttgtcaagaagccgcccccaaagagaccctc

SEQ ID NO: 46310 - DNA, 61 bp, Chlorella protothecoides
ggagacacttggcgatgggccgggcctccgaagcgggggtggtttcccgccacggatcccg

SEQ ID NO: 46311 - DNA, 61 bp, Chlorella protothecoides
ataccatttgtactatgggacgacctctacctccgggcaaagttacgaggccggacgaggc

SEQ ID NO: 46312 - DNA, 217 bp, Chlorella protothecoides
ggtgatggcctcgagctggtgtccagattcctgttcaaacttggtttgcaggcgcgaggagaccctctgggggtggtgtgcgtcagcgctcctgtcgcctcgtctgcagagcgtgtgagttgacgcacgcgagtcaggtaggaactcatagaaagacccgcccgcccctgtcgctcagtcgctgcatgccagcttatactgcaagccagcaagattc

SEQ ID NO: 46313 - DNA, 61 bp, Chlorella protothecoides
ggcttcagaaacgggcatctgcggcaggaggtgaccaaaagctttgtgagatcgagtctag

SEQ ID NO: 46314 - DNA, 61 bp, Chlorella protothecoides
aagtgcctaaacagatggacaatgaatctgcaaaccttacctctcctccccttgattgctt

SEQ ID NO: 46315 - DNA, 72 bp, Chlorella protothecoides
tgtgatgtggtgtggtgtggtgtggtgtggagcaaacttggaaggcgcggacatgcatttggcagccgcagt

SEQ ID NO: 46316 - DNA, 73 bp, Chlorella protothecoides
cgacaacaggcagcgaggcctcgttcgtcccggggaaccaaaagggacaaggcacgtggcagccccgcagcaa

SEQ ID NO: 46317 - DNA, 70 bp, Chlorella protothecoides
cttgcataatttcttccgtgcacagcagatgtgtcagtctatgctgtgtacttcctgtctcaccatgcca

SEQ ID NO: 46318 - DNA, 65 bp, Chlorella protothecoides
ggctccagctggaagctggagtcgggggtgagccgctccggctcaaaggtctcacgcagcaacct

SEQ ID NO: 46319 - DNA, 61 bp, Chlorella protothecoides
tgcaccctgagctcatggcatcccttcatcaccctcctgccaggggcgatctttgggctcg

SEQ ID NO: 46320 - DNA, 67 bp, Chlorella protothecoides
ggatacctggaccgtgcaggctgagattgcgtggggggagcaggcaccacatgcctgccagccgtgg

SEQ ID NO: 46321 - DNA, 61 bp, Chlorella protothecoides
aggggtgaggctggctatcatccttcagactagcagaatggaggattacacccacagacca

SEQ ID NO: 46322 - DNA, 61 bp, Chlorella protothecoides
acaagaatgcacacagggttggcaagaacaatatgtgggaggccatattggcacaactcgt

SEQ ID NO: 46323 - DNA, 62 bp, Chlorella protothecoides
tcatgccccttataatgctgcatacctatgtgtgacatcgcaggaggggagatcctgggtca

SEQ ID NO: 46324 - DNA, 61 bp, Chlorella protothecoides
tgaagtctgcatgcaggtagatgctaataagatccgagatgcaacgaaagatgcccacata

SEQ ID NO: 46325 - DNA, 61 bp, Chlorella protothecoides
tctggctgttggagccgcggaaggtggcgtaccccagccccttcagcgcgatcaggcctgc

SEQ ID NO: 46326 - DNA, 66 bp, Chlorella protothecoides
tgtcggtcgtagtgccttcaagacattggataatcctcatgtgccgagggaaaatgatcgaaggat

SEQ ID NO: 46327 - DNA, 80 bp, Chlorella protothecoides
cgctggcttccgtggcagtcacggccatccaccgtgggtgcaggctcgcgctgcgtgggagcgaggacggctgcggggat

SEQ ID NO: 46328 - DNA, 15825 bp, Chlorella protothecoides
  modified_base (1679)..(1688): a, c, t, g, unknown or other
  modified_base (3925)..(3934): a, c, t, g, unknown or other
  modified_base (4746)..(4755): a, c, t, g, unknown or other
  modified_base (6872)..(6881): a, c, t, g, unknown or other
  modified_base (7594)..(7717): a, c, t, g, unknown or other
  modified_base (9618)..(9627): a, c, t, g, unknown or other
  modified_base (10244)..(10253): a, c, t, g, unknown or other
  modified_base (10607)..(10616): a, c, t, g, unknown or other
  modified_base (11267)..(11276): a, c, t, g, unknown or other
  modified_base (11568)..(11577): a, c, t, g, unknown or other
  modified_base (11797)..(11806): a, c, t, g, unknown or other
  modified_base (12365)..(12374): a, c, t, g, unknown or other
  modified_base (12591)..(12600): a, c, t, g, unknown or other
  modified_base (13039)..(13048): a, c, t, g, unknown or other
  modified_base (14037)..(14046): a, c, t, g, unknown or other
  modified_base (14890)..(14899): a, c, t, g, unknown or other
  modified_base (15125)..(15134): a, c, t, g, unknown or other
  modified_base (15301)..(15310): a, c, t, g, unknown or other
  modified_base (15659)..(15729): a, c, t, g, unknown or other
gtcggcgccggcgcccagcgcgtcgccctgcagcggccccgcctccaccgcgtcctccacggtggtcaggtcctgctccgccagccagcgctcggctgccagcgcggcggcgcagcccgaccccgcggcggtcacggcctggcgccactccttgtcgtgcaggtcccccgcagcgaagacgccggggacggaggtggccccgcccgcgcccaccgccacgtacccgcccgcgtccagctccagctggccctccaggaagcccgagttgggctggtggccgatgccgtagaagaggccacgcgctggaatggtgcgcgcctcgccgccgccgtccgcgccgaccgtgcgcacccccgtcagcaggcggccgtcgccctccacgtcctccaccctggtgttgtagtgcacggtgacgcgcggcgcgcgcgcgacgcgctgctgcatggcgcccgaggcgcgcaggcgggatccgcgcaccagcaggtgcacgtgcgtcccgtacttggtcaggtacatggcctcctccaccgcggtgtcgccgccgcccaccaccaccagcggctggttgcggaacagggggctggcgccgtcgcagatggcgcaggccgagatgcccgcgctccagtaggtggactcggaggggatgcccaggcgcttggcggtggcgcccgtggcgatgatcaggctgtgcgcgcgcgcggtggtgtcggtgccgcgcaccgtgaaggggcgcgcccccaggtccacagactccacgtcctcagtgaccaggcgcgcgccccagcgctccgcctggcgccgcatcaggtccatcaggtcggggccggtgatgccgtcgggaaagcccgggaagttctccacctcgttggtggtcatcagctggccgccgggggagcccccggcctggtacccctcgtacaccagggggcgcaggttggcgcgggcggcgtagatggccgcggtgtagccggcggggccgctgccaatgatgatgagccgctccaccgtgtcggtggagggcggggaggccccgttcccgtccgacggggaggcgcgggtgggggcccaggtccggcggggcctgggagcttggtgatcttgtgatctggatctatcatgtgcggcgcgtggcgccctggcatgtcgcggcacgctcttggcgctgggctggaaggggcgggggtgaaggcgtgacacggcccccgtcatgccctgagcgctcatcatttcgccaggtggagcaccagtctacccgctcgatccgaggtgaaacgccgtgaaacagcagcaagagctgtttgtgggtcttctcgcagtcggcaaaggccgcaatgcgccggccaaaatgggagatgagggggtgatgctcgagcgcgcgcgcggtgggcgtgtgatatgccaagtgggtgcacagtcccttgcagacccacaaacccctccaagcctgtgcacggcactaaaatgtaccttaatacataatattcctgtttgggattgtgtgcgcaatgaccggcaattgccatgcaggggagtgaagggcaccccacccccacgggtgtcgcacttcccatgctggccggagtacaggcacgtaacgaggatgggacccagaagcacgccgcggacgactgtatattgcccacatgcacatgtgtaaccagtgcacctcctcgcaggtnnnnnnnnnnctgcacgccgcggacgactgtatattgcacacatgcgcatgtgtaaccagtgcacctcctcgcaggtgttcatttcggagggcgcccgcatccccctgcgaccggcacgtaagaagctttgggcggtgaacgtcccggccgcaggtgggaccctcctgcgccaccaggcgggggcgacacacatcctgctgggggatgagcccttcaacaggatctgcaagaagctggagtcccaggcaggcgtggcccctgccctggtgcactacaactggctgtcgcagacgctgaggctggggggccgccagaacgaggacgactacgcgccccctgctttactggcacacagggagtctgccggctccactccggtgcccagcctgagcgttcacgaggttcccagaggcaccacactgccagatgtgcagagtctcatcctccacttgtgtttgggatctccggcgccaaagaactttgccatcgtggtgaggcggggaatgggcctggtggtggctttcgaggaaagatgcattgggggttgattcctgtgatgtgatcgaggggtggtctcaggctgccacacatcgattgccttgtgacttggagggctcatggtcgtctgtgcctccaggtcgggggactccctggcaccagtatcatccgcagccccagctctcgtttcccaaaccaagcaccctcaacctcactccgataccctccagggcggaccgccctcgacggtgctgctgctgtgcctgcccggcatcggctgggcgcagcgtgacgcggtcctggaggccctgcaaccgtccaccccattgtccgtgatgcagctgcactccggggcacggctagaggtcccgtcgcagaccctggccaacctggtcaccgtcgcccgccccaagcgtgggcgtgagggggaggacggccaagtctctgtccccggcccccgccccctcgagttctacgccgccaccgcccgccagatggcggctgcagggtatccggggtgcgaggaaagcggggccacacatgtcccggagggctatgcctccaccgccgacttcccgagtgagctggtctggtggattcgggcctgggcaggagcgttcagcacacacccttgcccgccacccatcacttcatcaccctccatcgccccccctcccctcccccccctcgctcagagctgcccgggcaggcttccctcgtggcggtggactgcgagatgtgcatcacggcccgcggcctggagctgacgcgcgtgacgctgctgcacggcgacgacgagcgggtcctgctggacgagctggtggtgccggacgtccccatcctggactacaacacccagtacagcggtaggggtgtggggcctggcgagtggggcggactggggtcggcggcggcagggttggggggttgtgtgggagtgcggcgtgttctttcggcgggccggcgcgccccatgccgtccccgacatgcacagcgccgtgctgcccaccttcaccgttcgcgtgcaccccgccgcacccacccccctcaccgcacccgcaccgcgccaggcatcacggcggagatgctggagggggtgacgacgcgcgtggcggacgtgtggcgcgctctgcgcccccacctgggcccccagacctggctggtgggacacacactggagaacgacctgcgtgcgctgcggctggtgcacgcgcgctgcctggacacggcgctgctcttcccacgcccgcgcgggccggcgcaccgaccctccctccgccacctggccagccagcacctgcgcgccgccatccaggccggcgcgcacgactcgcgcgaggacgcggcggccgcgctgcgcctgctgcgcctcaagacggatgcggggcccacgctgggcgtgctggcgcgcgccggccccgcccacgctcacctgctggatgtgctgggtgggcgggggccgggcgcgccgcgcctgactctggtcgaccggcccgaggtcctggcgctgcacgctgcgggcgctgcggcggcgctcgcctgcgaggacgacgacgcggtggtgcgggggctgaaccgagcgctggccggcgccggtggcggggccggagacagcggcggcggtgacccgggggtccaggacgagggcgctgaaggcaatgcccagtcgaccccgaaagcgcgaggtccaccaccccagcactttgtcttcgcctcgctcagcgacgtggccgagcggcaggagcgcnnnnnnnnnntccgagagcgcgaggtcctccaccccagcactttgtcttcgcctcactcagcgacgtggccgagcggcaggggcgcgaggcgcgcgccctggacttctcggacagggagggctgcgccacggcctgtgctgccgccgcggcggggggcgtggagccgctggtccaggagacggcgcgccgcgtggcggcggtggtgcgggccctccccccgcaaaccctctgcctgctcctgagtggggcggggaacacagtcctgtgcaggtgcggaactcctctttccggagaggggctgctgcgcaccggcggctgcgagagtgcgacgcgggctcggggtctcactggccggggtgcaggcgagcgacgggcctcgtgtgggtggacaaagatgcccagcaaaggcctgggatcttcctggggccctggcgctggccttcctctcatgctcctccccaaacctacaccaccctcgtccaggacgctgtacggcgactcgctgcgggcccgcaaggactgccagggcgcggggctgaccgcgcagcgtgccgcggcggcggcagacccggccatcgagcgtctggcggcgacggcgagcaggggcttctgcgccctgctgaccaccccaaacgcggagtgacccgcgaggaggcccgcactgggaccagccactcttggcccattcaatacacagataccagcaacccgtgtcgtatcccttgtccacgccccttgtaatgcctcctccccctgactgtgcagcaacccagtctgccaacggggcaacagggtcgggagtgtgtggtaagacgcggggnnnnnnnnnngaacgcggagtgacccgcgaggaggcccgcgatgggaccagccgcccttggcccattcaatacacagataccagcaatccgtgtcggatcccttgtccacgcccgttgtaatacctcctcccccaaactgtgcaacaacaaagtctgccaacggggcaaaagggtcgggagtgtgtggtaagacgcggggcaagtgggtatcacgacagcaggttttattggcagtgctacacgggcgtgactcggcaacggaagtggtcgtccagcagcttgagccggtcaatcttgaaactgccgcgcgctgttggagctgccgggccgccggccgcggctcgcggcgacatccgaggagggtatccgctggagtagccgggtgtgaacggcctcctcgaccccgtgcacgccggctatggggctgaggctctccctctcccccaccccgtcaccccccagcaggccagggccccctgaagtgcagcccggcaccgggtagaacagcagggctatgccgctgatgaccagcagtgcccccagcagcgccatgggggccccgtacccacccaggcgctgggacagggtgccgatgaggtagggcccggcaaacccacccatggaccccacagagttgatcagtgcaaacgctgctgccccggtgctgcccttgaggaagacggccggccaggtgaagaaggggcctgtggcgtggcagtggggaggctcagaggcaagggaatgcggaagggtgcaagatggcttgtggcgccaggggctcaatctgcccctcccagacgcatcacaagcggaggaagccggaacattccaatgcctcctgatccaacagatcttgacatatttttgactgcccagcgctgcacgaaacaggcaggcgggtctgtgcaggtcgcgcaccacgcatgctgcccacattgtcgccaggcctttcacaaggacacccaaagctcaccatggaagctccacacggtcccagcggccatcaccaggcaggcaaagccggctgccggccccagggtgcggtgcacgggcaaggtggcggcgagcagcaccccgccggcgaccagaggcacggctgcgtgcaggcggcgctcgttcctcacctcggcatgcctggcattggccagcgagccgagggaggcagccacatatggcattgtggtgaggagcgccacggtggaagtggacgcgacggcgtggtgcccccctgcaccagggcgggttgggaggaaggtggctccgggacaatcagatggaggaagtccataagaagcgggttgggagggaggcgaggctggctaccagaaattgggcccgaggcggtttcgatcgccgtgcagcgcggcagcatccatgcgcatcccccgggccccacctccacagctggcgccctcttccttgggtgcagcggccgagccggcgttgaacatgtcggagatgaggagcggcgcccagaacatgatgccaaacatggcgcaggcggtgagcagccagacgccggccaggtacagcacccgccagtcccgtgccacgtctggaaaggaggggcgaggggggaggatcctgaccccatgtggccaataggtcagtgcatggcctgctgctgggcactcatgtttgtcgcaacgaatttacagctgcacgactgcacacaagtgcacactcgtcctcaccgagcatggctcgcagcttgctgggatgggaggagctggcctgggcgctcgccgcctgccgcgcgtccagccacccggcctcttccggggtcaggaaggaggccgaccgcgggtcacgggccagaaacatgcaaaggaagatggcgaagaaaaaggtggctccccctgttggaatggtgaagattggtgcgttgggcgaatttatgtcagagggatcattgagagcatcaggggggtgggtcacaccctgagactccccgcgacaaggtcacacaggcacgcagcctgcctcatcttccatggcctgtcaccaaagccaggtcggcatggagcaggccgccttccgcaccagggatgcacaaacgcggcatatggacggcatccctctcaacgcccacgcccccccctccccctctccctgccaagcccacnnnnnnnnnnaggtcacaccctgagagtccccgcgacaaggtcacacaggcacacagcctgcctcagcttccatggcctgtcgacaaggcctgctcgccatggagcaggccgcctcccgcaccagagatgcacaaacgcggcatatggacgacatccctctcaacgcccacgctcccccctccccctctccctgccaagcccacctcccaggaggaagagccactgccagccgtgcacgcccaggacgccattcatgcgcaggatgccggcggacaggggggcgcccagcacctgggcgatgctggtgcagatggagaccttggcgtacgcgccccccatctcggcgggggagtagaaaagggagaggtggtaccacatggtggggaaggcgctggactccgccaggcccagcgtgaagcgcaggaggtagaaggacagcgggccgcggatgaggaaggcggagccggcggtgaccaccccccacaggaggcacaggccagtgagccacacggggctgccaaagcgctggggccccagggtcagcggaacctggaagagggcgtagcccacaaagaatatgcctgtacatgtttttgattgagggaagggatgtgtggggggcaatccagcttgcccagtggcaggacagacgtgggatgggtccacgcctggttattgcaaagtggattccattcgtctgggcgcactgggatagagaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccgctcgacacccaccagcgccgaagccataggtcgcacagtcgaacccaaggtcatgattgagctgtatggcaccgaagctgagggtggttcggtcgaggtagcacaggaggcccagggagaatagccagggtatgacgtggttgttgagtttggacagtactcgtccgccatgtacctcctacgaggtggcaagaggggtgtattcaatccagccctttcaacgataatcaccccctattgctcatgtgcagcgccagcatgcccaccttctccagctggagtgtttgagcgtcgccctgctcgaacgaccccatggccccgagctggcgcaggtcaccggagctcggacatgggcagatattaacgaaggaaaatactggaatcttggtacaactcgagcgctgggagcttgggagcttctgatcaccgcctggttgggagcgcgcatctccggggcgctaaaacccgatctcaccccagcgtcaaggcctgagtttcagcagccacggacaagcagacacggtcggtcaatcaatcaatcatgtttcttgaggcgaagaggtgcatattatcttctcatgagattcaggggaaaatacatctactgggaaaaggaggggggaaaacggtacagcgggacagcacatcccacaggtttctacttggacaccaaacagcgtagctctttggaggtgggaggtggtacaggggacgagcaggaaccgggaaccctcggctacaatatcaggggccgacgcgcggcaggctccctcgctgctactagcagcgtcagcatcgccggcggtgcggcggcggcgacaaagaattcggcaactggcgtgggcggccaggagggggatggggcatggtgccagtatctgtgcactccgccccccctctaccccgccacctactggcccggcagcatgagggaggcccggttcctcttcttgcgctggtagtccctccatcgccgcgccgcccgcgccaggctggccgggctggccttctgcccccggcgtgagggtcgccccgtggggttggaggtgacctcctcctcctcctcctccccgctcccctccgtcgacttccagaagcgggagaggacgctgcgctgcgcggcgccgcgcagctcggcctgccgcttctcccaggcgccgctggcctcgttgaacacgtcgatgttggtgcccttgcccccgcctgtcaggatgagccaggcagccacccgctccatgcgcgacatggtcacctccagcagcgccagctgcccctccgacacccagtggatgcaggacacggggcaggtgtctatggcctcctggacccggggcactgcggggtcacagcgtgcgcagcatggttgagaggttgggtgtgtgtgggggggggatatagtgttccacccactgctgccaggctgatgcatggcacacgagccgcatccgggagcaccacgttgaaacataccggcggccatcctcaaccccgcaacccactgaacacccgcccttccccccgcaccccccccccctcaaatcaagagagcgatctgctcaccggtgtccaggccctggtcgaccactcgggcgcggccgtactcgtcctccatctcaaaggtccgggggcagacgttgttgcagttgcggcagccgatgcacgagaactcatccacgaacacctggtcgcgctcagcatgcacgtcgcggaaggggttggtgccgcccagctggaaccccgagatcgcatcgtactctgccctcttctccgggtccatcagcgtctctgcaccgccatatggtttgtgtgtggtgggagggaaggggtggcatggcccagcacacatgatcacaaacatgccgagattacgcctcgctctttttgggaaaggaagtnnnnnnnnnntgtgtcccagcccacatgatcacaaacatgccgaggttacgcctcgctctttttgggaaaggaagtcaagacaattgcactggtgacatgccgcaggccctgatttctatcatccagccccagagcatcccctcccaccgtaaacatcattgaggaagatctgaaagtcggtggcctcctcgtccatggagatgtctgggtggtgatccttgacgatgacgcggaaggcacgcttgatgtccttgacagaggccgcgctggagatcccgagaaccgagtagtagtcatcctgagtctcggtgtcgctgtccgccatgcgaacggcatgcgtgcgccagtgcgagacaggatgcaacttgggccctcgcgcaccggacctgtgctggctgcacccagggacccccctgtgtgcgatctggtgcagctgaagtggggctgcacagctagaatctacgccatggactcccctgctcggctggtgtcgttggcaaggaacaccggagagcggggccatgacgcgctggtcgacggacctggaactctagattggtacaggtgatacagggtcaggcgagcgctgccatgtgccgcgagttgtatgtttgatctgttagcgnnnnnnnnnntctggaactctagatttgtacaggtgatacagggtcaggcgggcgctgccatgcgccgcgagttgtatgtttgatctgttagcggagtcctgtcctctgagggtactttccagtttccgtgcccatgctagcgcagcacgcgcagcgcggggcagaggacggattcagattatgatacgacaggcgccgatacggcagacgcaaagttttgtacagctgtgtgaagctctcatgcccttgatacggaggcgactgatgtgtggatcgtcctagaccgttgcgcccctctctgctgagcgtggcaccgaacttgccacctctctgaaatcgcagggatggatgtcgctcgcaaannnnnnnnnngctgatgtgtggatcgtcctagaccggtgcgcccctctctgctgagcgtggcaccggacttgccacctctccgaaatcgcagggatggatgtcgctcgcaaaagcaatggaccgccggcaaatgtcgaaaatgtgggaaagaacgcttatcgcgcagcgcatgcatcgcccgaggaactcgtgagtgtttaaagctgcggaggagtgctctggctggctctgaaggcaaggcaggtgtgcatgcccctcccctctccccgagacatgcgccagtcatgcccatgcgcctcccacagctcgacagcctgggatgcaagctggtgaccgatggactggggaccccggcattcgaagtgcctgatgtccgttcatttcggcgggggctagacaaggccctcgccctcaatggcacccttgccgcggcggtggccgagcatgtcgagcgtctgtgcaaggacgccgacgtcctgacggccgctctgtcgcccctgctcctgaccagaaaggtactgggagtcagatccgggtgcttctcattgcaaaaagctccccatggcgctctcctcgtccccgcttgacaacatttgctggaccacaccgcctctttctatgtattttcaccttgccacacgcaccttccttcctctccannnnnnnnnnatgcaaaaagctgcccatggcgctctcctcgtccccgcttgatgacatttgctggaccacactgcctctttctgtgttattcccccttgccacacgcaccttccttcctctccacccaggacgcggtggacaatggggacaccctggtgcgcgtcatgctgagctcgctcagcctgcagcccctcctggcgccgcccctgctccagctgctgccccagctctgcaacagccccgccgcacaccaggaccagtccctcctgctcctgggccagctcaagtggcttgagagggnnnnnnnnnngactgcctcctcgaggtgctgccctccgtgcatgccgaggctggagccgccatcgcaggactcatccccgagatcatcgcccccggccagcttcaggtgagggactgatgtcgctgatgtggatcttgcaggggcgagggcacatcacactttgacacaggtcataacaccatgtgcccaggtcttgccgcgcgtcctggtccacattccaggcctgcannnnnnnnnnagactgatgtccctgatgtgggtcttgaaggggtgagggcacatcgcactttgacacaggtcatgacaccatgtgcccaggtcttgctgcgcgtcctggtccacattccaggcctgcaaaccgcatgcctcctggcagccttcgcccccctcagcttccctaccctctgcacatggccaggaggccgtggctgccctcctggaacccagctgcccggcgccgctggcctccgtgctgggcgcgctgggcatgctgggactgaaccccgacctgcaccgcaccataggcgcgtccctcctctcgcgcctggggacggacgcccccgaacaggcgcccatcctcagcttcctgctgacttccgccccggaggacgcgctgccggacgtgctggcgaggctggccacctctgtgcgcctgggcggccagggccaggtgggggccggcggtcccgaccggcggcgtcgctccgcgggccgctgcgccagccaggcggaggactcccccaactgtgaggtcgcgagggcgatgctccaggcgctgcagtggcggggcgcggtgnnnnnnnnnncgtctcggcgccctggatggtgaggtggcgtgggggtgctggagcggcagggtgggcatgctgttacctgggaggcccttatcactggaggaccttgaggctgaagcggcgcgccacgtgcgtggccctccctatgccagacacagcgggaaaacactcgtcgaacacatcctgcgtctctttgactccggcacagcgatggcggggctgagcaccnnnnnnnnnngcgtgcgtggctatacctatgccagacacagctggaaagtactcatccaatacatcctgcgtctctttaattccggcacagcgatggcggggctgagcaccctggatgcttggtgggcgatcctcctgtgcgcgctgggccagcctcaccggagactggcagagggtgtgctgctcaagttcatggcactgccagcgggtgtggagtggctgaagggggcggtccaggggcacaaggtgagccaaggcctgtggcagaggggtgaggggagccagatacctttctggttgcgattcgacagggcagcggtatgctttgtgcttcacccatgctgaccccttgtgggaggggtccacagggttcagcatgtcacggatcccctgggctactgagtgcaatgtaatgtaacactcaggacgtccctccagatccttctccnnnnnnnnnnctactgagtgcaatgcagtgtaccactcaggacgtccctccagatccttctcccgctctacatcccctcaccaggctgcactggccagcaccttcccggtgctcctgagcatcgtgcaagccctgatgcggtgcaccagcctgtcgtgcacggcaggcgtggacatgatgtgcacgctgtgctcggaatttgacgaagaggaccagcaggaggtagggtttgggggtgaagtggggaccgcgggaggtgtcaggatggaccgggattgttgaaggcatgcgccagtgcccatccatcacagccattctggggcctcatcagtgcacaagctgaccagcgctggtttccgtccaggtgcctgagtcactccgtggctctccctccccattcccgctccccaggctccagccccatctcctcaaccctttccctcacaaccttcgtctcctgcaggccctgctggtcgcgctgcacgcccacctgggcagcggccagcgcgcgcagtgccacgccgcgctttccacgctgcagcacgtcgcgtccgagcggccccggaccctgttgcgccaggcggcctacgcccggggcctggtgcgcctggctctcgacctgcccgcccccttacagcaacgcctggcggaggtgctggggtcgctgctggcctgtgaagccccggagtgagcgtccgagtggggtggggtggggagacatggaaggggcagggcaagggccctggtggttgcagctgagcgccgtggtctcatgcgcgttctggtggtccagatcgggcgatgtgtgaacggctgcatgtctccacgcatgcagactttcaggccctgctccgtccccggcagctaccgtggtttgagccatgcggcatgtcatggaatcctcttgccgtatcgcctcgggcaccctcctgcgactggcctgcttccctcgcccccgtgcccactcaccgcctgcctggacgccgtccaccccccccnnnnnnnnnntcgtggtctcatgtgcgttctggtggtccagatcgggcgacaggtgaacggctgcatgtctccacgcatgcagactttcaggtcctgctctgtcccggcagctgccgtggtttgggccatgcggcatgtcatgaaatcctcttgccgtatcgccttgggcactctcctgcgactggcccgcttccctcgcccccatgcccactcaccgcctgcctggacgccgttcacccccccactcaccccccaccacactcacacgcaggtccgaggccttgcttgccagtttgacgggcgcggtgcaggggggcctggccagcatagaccccgaggagcaggcgggcagcctgactttgggcctggccgccgtgcggcggctgggcgcccggggcgggccggcccccgcgctggctgcggcccgccgcctgctgcagctgctggtggccgagtgccgcgcccccccggccttcagcgccctgtgccggggcctggcggccggcgaccccgggctggggggcatagaccccgccctgctggccgacgtggccgacctgctgacggggctcatggacggcacctacgtcgtggacgcgccggcgccgggcggggccccgccgcaggcgaggctgggcggtggtcccgtgacggctgcctgctggtgggacctggacggcggcgcctcgggcatcgccgtgggcatcctgcccctgctgtcccgggagctgggctgcgacgccgggcgcagccacgggtgggtgtgcacgaggcgatggtgcctcctgagggcgcgcgggaggctggtggtctggtgtctggagagtggagtggggcagggtggggcctcggnnnnnnnnnncggtgcctcctgagggcgcgcgggaggccggtggtctggtgcctgcagagtggagtggggcagggtggggcctcggtctcgaagaacctggcacgggaacggcatgggtctcctggcccatacatgcagcgtcggcggtgcttcatgagcctcggtcacggtgcatatggcagacccgcgcccaacctcctcccctggaacaacacttcgtcggacaacccccccnnnnnnnnnncaagaacctggcacgggagcggcatgggtctcctggcccatgcaggcagcgtcggcggtgctccatgagcctcggtcacggcgcacatggcagacccgcgcccgatgtcctcccctggaacaacacttcatcggacaacccacgccccccccccccccaaccccccnnnnnnnnnnctctcagcacgcgcactgcgcggctggtctgcgcggcgcccgccctccggctgctggcgcgcctggagaccgcgctgaacggcaacctggccgccatcgacgcgctgctgggcgcgcccctgctcctccccgcccccgcccactacgcggcctcggcctttgccgccggcgcggcgccgcagcgcgagggcctgctccgtggcctcctgcacgccctgacctggctgcgcgcgctggtggccgccttcgcacccgccgcgccgccgccggagcgcgagaaggtgctggcccgggcggaggcctgcgtgcggctggaggcgctgctcgggggcctcctgcccctagcgcnnnnnnnnnnnnnnnnnnnnnnnnnnnnnnnnnnnnnnnnnnnnnnnnnnnnnnnnnnnnnnnnnnnnnnnactcggggagggcgacgcggcgggcgcgaccagcggaagccgcaagcggggcgcgccctcgggcgcgcgcagcggggcccgcagggcgcacagagc

SEQ ID NO: 46329 - DNA, 73 bp, Chlorella protothecoides
gccagcgacagcactgccattttgcccccctttccccccccctctactttcaacaggcgcacctcgtccgtgg

SEQ ID NO: 46330 - DNA, 1261 bp, Chlorella protothecoides
  modified_base (618)..(650): a, c, t, g, unknown or other
  modified_base (721)..(730): a, c, t, g, unknown or other
gtccgccaggggcagcgcgccgtagctggcgtcgccgcagcccagcacgccgccgtcggcggtgacgaagagcgtgtgcgccgcgccggcggccacgcagcacacccccgcccccgccagcgaggccaccgccaccggcagcgtgctcgacagcacatgcggacccaggcccagctgccccgcgccgcccgcgccccaggcgtacacctcgtcggcggtgtgtgcgacggtgtgcgccgcgccgcaggccacgccgtgcacgccgctcagcgccacgcgcttgggcaccagcacgtcgcggtcggggtgggcctcgcccagctcctccacgggcgtgcccgggtcggcggccaggtgcgtctccagcacgtcgtccgggacggagaagagccactccgccgccacctccacgcccacgttcccagtctcgtgcagggccagctcggcgcggtcctgcgggatttccatctccagcatggcggtgaggaagcgctggttcacgcgccggttcacgcgccggcgctcgctggcgctgcggtgcatggccgcggccgccgccacctcggccgccgcgggcaggcccagctggccctggcagttggcgccccaggtgaacannnnnnnnnnnnnnnnnnnnnnnnnnnnnnnnnccgcctcgcaaccacaccacccagacacatccttcaacgcagacgcactccccccgccactccacctcacnnnnnnnnnngctgtcgcctggtgtgagtttttgttttttgggggggggcattgagtcgggtgcatgggcacacgcctggatccgtcgccccgttctccccactctcgctcagcgcctcgcaaccacaccacccagacacatgcttcgacgaagacgcactccccccgccactccacctcacctgcccccagctggagcacgggcagggcccagagaccgtccaccagggtgggcgtgcgccggtcggccacatcgcccagtcccagctggccgcgcgagttggcgccccaggcatacacctggctggtccccgtgacgcacagcgtgtgtgccgcgccgcagaccacctgcgtgatcatgaggtcgtgcaacatcttgatgctgcgcggcttgacccagtccggctccgcccgctcgccgtgcccgcactgcccgcggtcgttggcgccccaggtgatcacatcctgcatggtgaaggccacggtgtgcgccgctccgcaggccatgcccctgcaggcgggggagggggtgggtgggagg

SEQ ID NO: 46331 - DNA, 69 bp, Chlorella protothecoides
gctgtcaggtggggaggcaggggcggggtcgaggaatggtttgtttaattatgaggagggagggtggag

SEQ ID NO: 46332 - DNA, 72 bp, Chlorella protothecoides
tgtggttgccacactcccttgcaaagcactagccccacgtaaaggcagcgcagggactcctgctccttcagg

SEQ ID NO: 46333 - DNA, 80 bp, Chlorella protothecoides
gcacctagcttgcatcctggcagtaccctcaaaacctgccactgatctcgtaggtagtggaacctcatgtcaagaccttc

SEQ ID NO: 46334 - DNA, 614 bp, Chlorella protothecoides
  modified_base (96)..(105): a, c, t, g, unknown or other
atgggggttcgagagggggctgattgagggtcgagggggggctgattggggggaaagggggggtggtggacgggaggaggggttcgatggggacgnnnnnnnnnncgagggggggctgattgggggggaaggaggggggtgtggacgggaggaggggttcgatggggacgaaaggtaaggccacctccccattcactcggccccctgctttgacgccctgctcagcccaccttcaccacaccatgcacccccctccccgcacacacacgtcctgcagcgcgacctggacctgaaggagctgatgctgtcggcgtacgagacggggcgcctgcaccccatcctctgctttgtgcgctcgctgctggaggtggggctggtgtcccgcgtcttccgcccccccaacccatggttcatgggcctgctggcgctgatggccgaggtgtacaagctgccgggcctgcgcaactccatcgtgttcgaggtggagctcctgttcaaggccgcgggcctggtggtggccgacgtggcgcccagcgcgctgctgggcgcgcgccgcgccccgcccccggactcggccgactttggcggcggcgcgcaggggcccggcgtggccg

SEQ ID NO: 46335 - DNA, 61 bp, Chlorella protothecoides
catctgcgagcagcggagcgagggggggggggtgagattgggatgaaaagaggaccgagtg

SEQ ID NO: 46336 - DNA, 80 bp, Chlorella protothecoides
cctgtcatggccggccagctcctaccccagggaggtggctgcatgaaacataggctgtgtcttcctcagccaagcattgc

SEQ ID NO: 46337 - DNA, 67 bp, Chlorella protothecoides
tcacctgccgggcgtgaggagacggggggggcccccgggggtgagtattctggcctgggggtcatcg

SEQ ID NO: 46338 - DNA, 61 bp, Chlorella protothecoides
atatattcacggtatcgtgtacaagtgtgcacctgcctcgaatcttgatgaacacactgtc

SEQ ID NO: 46339 - DNA, 65 bp, Chlorella protothecoides
ctgcgcccgcgtgcccgagcatgcgggccccgcactgtgcatggcacctgccagtggtcccccac

SEQ ID NO: 46340 - DNA, 61 bp, Chlorella protothecoides
cggtggcaatgccccaggcggagaggagggtgatcgtggccagagcgagcttgggtccggc

SEQ ID NO: 46341 - DNA, 61 bp, Chlorella protothecoides
tctggtgtacaaaccacagtggcggggggggcgcttcagtccaggtacaccttgaagttcc

SEQ ID NO: 46342 - DNA, 74 bp, Chlorella protothecoides
acacccagccttcctacccctgtaggtcgttgtcggactccatccccccctccctcgacctgctgtcagcatcg

SEQ ID NO: 46343 - DNA, 73 bp, Chlorella protothecoides
aggaggcggtggcaacatgaatggagggggggtggactcagtaggcggagggctgagagacttcttgggtgga

SEQ ID NO: 46344 - DNA, 76 bp, Chlorella protothecoides
attgagcccttggaaaagtgtttgtcaaaatggggagctcttcgtacccctccatgggcaccaacctgaggctcca

SEQ ID NO: 46345 - DNA, 67 bp, Chlorella protothecoides
gggcaagcaatgggaggagggctcgagtacaaacatcatactcctggcaggaggtgcccaaccatgc

SEQ ID NO: 46346 - DNA, 74 bp, Chlorella protothecoides
cccatcgagccactcctcaccacacgcgtggcatcgaccacctgggtggcatccagcctgaacaggtacatggt

SEQ ID NO: 46347 - DNA, 69 bp, Chlorella protothecoides
agcatggcacagccacgatcgaaaactcgggggtcatcaccccccccttccactttccaagccactcac

SEQ ID NO: 46348 - DNA, 61 bp, Chlorella protothecoides
gccgttggtggccttgacctcgaacacgccgccggagatctccaggatggacacgtcaaag

SEQ ID NO: 46349 - DNA, 61 bp, Chlorella protothecoides
agcacacccacacccacccaccttggcgagcgacacacgaccgcggtccataatgtcaatt

SEQ ID NO: 46350 - DNA, 61 bp, Chlorella protothecoides
tgacacgcttcgcccttgtccgagcacccctcccccccccctttctctgcactcttccctc

SEQ ID NO: 46351 - DNA, 97 bp, Chlorella protothecoides
ctccttcccgccctcttcatactcccccacatgccctgcatcagtctagcactctgaatcacccacccacacacacctcttcctgtccttcttgtgc

SEQ ID NO: 46352 - DNA, 61 bp, Chlorella protothecoides
cacgtggtcggtggcctggaggtagccctgtaggagcgggagacgcggggggtggggaaac

SEQ ID NO: 46353 - DNA, 9723 bp, Chlorella protothecoides
  modified_base (270)..(279): a, c, t, g, unknown or other
  modified_base (543)..(552): a, c, t, g, unknown or other
  modified_base (835)..(844): a, c, t, g, unknown or other
  modified_base (1316)..(1325): a, c, t, g, unknown or other
  modified_base (1441)..(1576): a, c, t, g, unknown or other
  modified_base (2074)..(2083): a, c, t, g, unknown or other
  modified_base (3592)..(3601): a, c, t, g, unknown or other
  modified_base (4312)..(4321): a, c, t, g, unknown or other
  modified_base (4392)..(4401): a, c, t, g, unknown or other
  modified_base (4465)..(4474): a, c, t, g, unknown or other
  modified_base (5014)..(5023): a, c, t, g, unknown or other
  modified_base (6157)..(6166): a, c, t, g, unknown or other
  modified_base (7970)..(7979): a, c, t, g, unknown or other
  modified_base (9093)..(9102): a, c, t, g, unknown or other
cggggcagcctgggccgggtggccgtcgcgctgcgcgccgcgcgacacgtgccgcccgacgcgcacgccgcgctctccagcctcctggcgccgcacctggccgccgcgctggccaggacctttgccagcacggcgcacgccctgggcctggacccggccgccctggccgggacgctgcgtgaggaggacgatggtgctggtgggggtgacggggacggcggccgttgcgcggccgtcggagcgcagaccggcggcacggcgggggggggnnnnnnnnnncgggcgttgcgtgaggacgatgatgatgttggtgggggtgacggagacggcggccgtcgcgcggccgtcggagcgcagactggcggcacggcgggggggggatcaccagacgctgatgcaggcgatggtgatgcgagtttagggccggccgtggccgctccaggtgctggtgctgcggatggaggacacgggtcggccgcatcgcccgacgccagacctttggaatagcacttcctgtgcctctggcgattccaacaggaacgnnnnnnnnnngttagggccggccgtggccgctccagttgctggtgctgcggatggaggacaagggtcggccgcatcgcacgacgccagacctttggaatagcactccctgtgcctctggcgattccaacaggaacgccgccgggccccctttcagaatctgcgggcgcatgttacagggtgctgggcaagtgcgctcatccctgccctgcacgcatggctcactgctgtgttctggacgggcattacgtgagccaggcgacgcaggggagcactggcgctggggagcaccgtnnnnnnnnnngatccctgccctgcacgcatggctcgctgctgtgttctggacaggcataacgtgagccaggcgactcaggggagcactggcgctggggagcaccgtcgctctgacggcgcagtgcatcgcaggacttgggcaagaagctgctgtacaattgggagttggaacaacgccgcagggcaacaggggtttgggggggcagcctgcggagagtttcccccggatgcagcacacacaggtacggcaggcagcagtgcgatacgctggcgtgtctcggcgcagcctggtcggcaagcgctgcaggcacgatgaaaagccggaggcgcggggaggtgcgctccggggtccggcgcgcagcgggtggagcgggaaatctgggacggcccggggccgctcgaagcagggccgggccctgctcgccgccgatcgctctggcgctcgccgccgatcgctctggccctgctcgccgccaatcgcnnnnnnnnnnagatgcagcacacacaggtgcggcaggcagcagtgcgatacgctggcatgtctcggcgcagcctggttggcaagcgctgcaggcgcgatgaaaagccggaggcgcggggaggtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgctcactgcacctgcggaacgtggggaagctccggccccgcccccggcgacgcctggccggcggcggcggcgccgcgccggcgccgcgcctcctcgacctcccccgcctcggcgtcccccgccaggctggcggagctgggcccgcccgccacgtcggcacgcgccagctggcgccgcaccagcgcggcgtagacgccgcctgcgcccagcagcgcgtcgtgcgacccgctctccaccacggccccgccctggatcaccaggatgcggtccgcgttgcgcaccgtggacagccggtgagcgatgaccagcaccgtgcggccgcgcatcgtcgcgtccagcgcctcctgcaccagcgcctgtgcagcagggagggagggggggcgtggtcgggtgaggaggagggaacgtagatgctcctcggccctgcataggcccgaccccgtgcgcgacagaccggagggggggacaccccaccggcgggcgctgcggcgcgcnnnnnnnnnncggagggagggggggcgtggtcgggtggggaggagggaacgtggatgctcctcggccctgcatgggccggaccccgtgcgcgacagaccggagggggagacaccccaccggcgggcgctgcggcgcgctccacactccatccaccgcccagactcccgtctcgccaccctgcctcgtccgcaccacacaggcatgacacgccaacgcatcgtgcccacccctcagcacctcggagtcggcatccagggccgaggtggcttcatccagcagcaacacggcgggcttgcggaccagcgcccgcgccagcgcgatgcgctgcttctgcccgcccgacagctgcaccccgcggtcgccgcactccgtgtcgtacccgtccggcagcgccaggatgaagtcgtgcgcattggccagcctggaaaggggggggggggtatgatgcgcgcggtgttgtcagctggagaccatgggggagagaccagtggatgcgggtgtcgcacctgcctgcttcgccggatcgaccgtggcccacccagcatctcatcacccctctttctcaaccacacgcacccctcccaaccgcctctcctccccacctggccgcggcgtggatgtcggcgagggtgggcacctcctcctgcggcacgtcgtcctccggctccaggccgtaggcgatgttgcgcgcgacggagcgcgcgtagagcaccggctcctggctgaccagggccacgcggcgcttgagccacttggcgtcgtaggcgcccacatccaggccatccagcgtgaccgcccccgcggaggggaggtagagccgctccaccagcttcaccacgctggacttgccgccgccggaggggcccaccagggccaccacctcccccggctccaccgacaggctgagccccgtcagcacagggtgagcggggcgggcggggtaggcgaagcgcacgtcgcgcagggccaggcgccccgccaggcgcggcggcgcggcgcgccccgccggcggcacgcgtggcggcctcagcatcagctccaccaccttgtcggccgcgcccacggcggcggccagcgcggagaagacgtcgcccagggcctggaaggcgccggacaggctctgctggtagagcatgaaggagaccagcgcgccggcggacatggaccccgccagcaccaggcgcccgccgtagaagagcacgcccgccaccacgctggcgcccaggaaggtgttggtggccatgtagagcgcgtaggccgccgcctcgcgcagctggagcgagtagaagcgcgccagcttggccgcgtaggccgcgcgcgtggagtcctcggccgcgtgcgccttgaccgtggtcatggaggacagcgcctcctccgccacgctgttggcctccgccagctccgactgcacgcgcttgctcagcttgcggtagtaagaaccgtacacctgggattggggtgtgtgtgttgaagggggaaggttgtacgcgtgtgttctgggcgtgtctctgtgtggannnnnnnnnncggagtgggtgtgttgaagggggaagggtgtaggcgtgtgttctgggcgtgtctctgtgtggaggggggtaaactgagacacgggggatgcggaggaagtcagcatctaggtgggggcccctgcaccaacgccacagcccgccccccgggacaataccttgcagatggcgaggacgagggggaccatgacaaaggtgacgacggtgaggcgccaggaggcgtcaaacatgaaggccagcaccaccgccgcctgggtgagggagcgcagcatgatgttcaggttgaggcagacctggtccgacacggtggtggtgtcggcggagaggcgggaggtgatgtcccccgtgcgcgtggcgtcgtagaaccccgcctcctgggccagcagcgaggcgaagagcgcggcgcgcaggcgcacgttcagccgcgtcatggccacggtgaagaggccgccgcggaggcccgtggcggccgcgcaggcgccggccacgcccagcaggcgcagcgtgaagcggcgcagcgccgcggggtcggggtcgatgctggccgcgtcgatgatgcgccccgtgtagtaggggatcagggcctggcccagcgcggccgccgcgccggcggcaaaggccagcgccaggatgggcgtgtcgctggacgccatgcgcaccagcgtggacacagtgggggtgtcgccgtgcgcgcccttgtggctctctgagnnnnnnnnnnagcggggtcggggtcgatactcgccgcgtcgatgatgcgacccgtgtagtaggggatcagggcctggcccnnnnnnnnnngcgttttcgtcgtcgtcgtcggggggcagtgcgtcgccgcccagcaggggcgcggcggcgccgnnnnnnnnnntcgttttcgtcgtcgtcggggggcagtgcctcgccgcccagcaggggcgcggcggcgccggagcgggtggcgcccgtgcgccgccgccagcgccgccgccagctgctcgccagcgaccgcgccgccgcctgttcgacgaaggagcccaccagggcgcccacaatggaggcaaacatgcagagcaggcccacgcggccggcggcgctggcgccggcggcggcgctctcttcggagtcaggggggagcacctcctcacgaccccacaccgccaccgccaccgccttggccagcagcaggagttggaccagggggcccagtacgcggatgcccagccgcacctgccattgtcaagtgggtggggcgggaggggtgggtcggggtgggcgctggagattcttggcatgctgtggcaccaggcatgtgtgcccaggaaagcggaagggtccacctggctggcacagcttcatgagtcaccgcccccacacacaacacccccaccaccctgccccaccctggtgaagggtggcgaccgcctcatgnnnnnnnnnnagtccacctggctggcacagcttcacgagtcactgcacccacacaccacccccaccaccttcacctaccctggtgaagggtggcgaccgcctcatgtagccccgtggaggattctggggcgtcatgatgtgggccagcagcaccagcagcaccccggtgtgcagccaggccagggccaggacatcgaggttggagtcgggcagggtgtacagattcactacgctccggtaccgtttcaggtgccacagccgatctcgtatcggccacaggcccgcaaaagtcaccaaggtcagcttcaggagggtgctcacccagagggcggccgctgcggggcggaccatgggcagccgcgagggtgatcacccggtctctaccacggttccccgcacccaccctgagcccccgatcagtgtgcagatgcgatgatgatcgagtttattgtgcagatacccctcaaatccaagctcgacacgctccaggcagactgtcggtggggtttgagtccgcagggtttcctgccagtggggtgccgggaccgccccgacctatgcatgggatactggaagggatcggagtgccggatgatgatcttgcagtatttcaggaatcctgccggcacaaatgctaggcaggggtgatctcagcgcgcggggacagtggcggagggcccacgtgcacgatccccccgcgccctcgccaggtcgctcagaaggccacgatggccatggtatggttgaagccgcaggacaccgcctccgccttccaggcatgctggctcagccgcctgcccccatcaaacacgaattccaccggccagggccgctccctgtcgccgcagtcgggcccatgccccagctgcccgccgtccgccgccccctcctcctgccagctgtaggccgtgcctacgcggagggggacccgcaggagttgcactgacatgatccagactgcgtgcggcgcggcatgcagggatgcccatgctcctcccagcagagacgcatgggacaaaccattgcttcatgcaccctgcagctgatgctccatgacctgacccggcacccaacacaagctcgacgtcacacgccccagccgccaattgccccctaaccttggctgccgccccagccccaggtnnnnnnnnnngcattgcttcatgcaccctgcagcagatgctccatgacctgacccggcacccacaacaagctcgacgtcgcacgccccagccgccaattgcccactaaccttggctgccgccccagccccaggtccagaggtggccgcggtggtcgatggcggcgcagtgctgccagccggaagccatgcgcatggcgtggatgcccggcaggggccgggaggggcccgaggcgccagacctgcccagcccaggcaagccggggccccaggaatacaggtgccccgcgccgtcgcggcccagggtcaaggagccgccacatgccagctcagcagcgtggcgtagggggacctgaccagagtggggggcgcgggggtgtggggatggggaagggatgcgaggcagatcgcagcactcagagccaacaacaaaacccctggacaaggcacgccgtgccaaagcgttttgctgcctttcgactggctgctgtagaataagtgctggatcggagtgcggcccccagcctccacgccgtgcgcgcgacccagtcccaagtaaccccgcctcgaaactcccagcccctccaaatcgcacgctcccagccccagctcaccaagcgcggcgtgtcgaccttggagaccctggccctgctgacgccggggacaaagtccgggtcgccccagaggaaggcctcgccgcccgccgtcacggcaccggagtgggcgtacccggccgacacggagcgcacgtcgtgcgtgctcagcgtgcgcagcacgcgcgggcgccactccgtcccgcccccggagaaccagccgccgccgtggcccaggcagccctgcgcgtctgcgccccaggtgaacacctcgcccgaggcgctgagggccatgctgtggtgctggccgcaggcgatgccctggacgcgcgtgcctgggaatgtgggggggcacattggggctgggaggagggccattccgatgggagtcctggagagaggcgtgcccaggtatacatgaaagcacgagaggatgtgcccggttcccagcgcgagcgccaggagtgcccaggcacgacatgagcaggccccgcatcggtgggcagacggggcgggaggaagccacatttgcacctgccctgcacgctcgctgcgcgcccagccacccagggcctgcatcccccgcaagcacccgcgcactcgccctggaggtgcttgacgaggcggggcggggacacgggggggcagtcgcggcccagacccagggccccccgcgtgccgtccccccacgcccacaccctgccgtcctcggtcagggccaggctgtgcgagtggccggccgccaccgcagtggcgggctccggcaggagcacctcggtgggggtggggacctggggagaccgaggcgtgtgccccagctgaccccggtcgttcaggccgcaggagtagaccgagccgtcggcggcgcagaccagggagtgggcgccgccagccgccacggccctgacgtccccctcccaggggcccgccagcacacgggggaagaagatgctggccaaggggaggcccagccccagccggccactgtcgcccgtgccaaacacgacgacccggcgcagcatggggatggtggctagtacatgtgcatatatgtggtgtaatgagacgatgcggctggactctgggatggaagagatgcctagggtccaagtgccgggcttagagatcacttctggtcataaagggtgcaatgagtccatttacccccatctcatgctcttcaccgcaactgcattattctgaaagtggctatgaatcgcaannnnnnnnnnctcagaaagggtgcaatgagtccatttaccaccatctcaagctcttcaccgcaactacattattctgaaagtggctatgaatcgcaatatagcggtcgcgaggacttgggggttgggcaaacgtcgggactggccgacaacatgtacctcatgcggagtgcatggtgatctgacgtggctcacagtgccttcggagctggaggaatacattcagttatgcgcccgcatgcccatgtaaaccatacgcataacattgcaactcaccatcactggtttttcgccaaccggttggtggtgtgccttggcactcgcagcagggagtcagcctgccgcgcttgagcgcccgcactgccttgcccctgccgggatgttcaatcccgagatgatgcgcatggcgcaggagatgatgagccgtatgacgccagagcaggtgctcggggggtgtcgtgccagggtacgacctctcccatggaagtgcagttgggtgcccacaaatggagcacctggttcaaacgtaacctggcatcgcactgacccgcccacctctccctcttgtcgtcaagatggctgagatgcagcgtcaggccgccagcatgtccccagacatgatgcagcaggccatgcgggcggcgcagggggcatcccccgaggacattcgtcgtgcgcaggccgcggccgccgcacagacgcccgagagcctgctgcaacaggcacagaccgcgatcccccagctctccgcgcgcgagaagatggtgctgagcgcgtcggagaccctgaagcaggacggcaacgccctgcaccgagctgggaagtacgaagcggcggccgagaagtatgcccgcgcggtgaacaatctcactggtgagtacctgctgcggggatacttttgcgaagggtgtgagggcagggaaggggctgtcgtgcatagtatttttcgatgaccagcagtgcatgatgggtatgcggggtgctcacagtctggcaatcagtggtgggaagagcctttgggccaactgcccagcgctggccccacctgggggattgctgcaatcaacagtacgacaccaggcccctgcacccactgatgctgccctccatcctccacccattccannnnnnnnnnccagtggtgggaagagcctttgggacaactgcccagcgctggccccacctgggagattgctgcaatcaagagtccgacaccaggcccctgcacccacagatgctgccctccatcctccacccattccaaactttcctctcgcaggcaggaccgatgctgcggccgtcagcctgcgactggggtgccagaataatctgggcagctgccacctggcgctggggcgatggagcgaggcgcgcgccgactgcgacgccgtgctggccgccgaccccgccaaccgcaaggccctgtaccgccggggtcaagccctgctggccctggagctccccgagctggcggtgcgggacctggcggccgcgctgggccttgcggagggcgatgaccgggacgtgatcgccgccaagctggcggaggcgcggaagctggcggaggataaggcgccggcggcgcaggcgccgcgagggggggtggaggtggaggacgctcccccgaccgagctgcgcggcgtcgaggccgggcagccgcggaaggttggggacgtggtcattgaggaggtgacggcggaggatgtgccaggggttgatgagcccacagcagaagcacgagggccggccgcggcca

SEQ ID NO: 46354 - DNA, 6074 bp, Chlorella protothecoides
  modified_base (382)..(391): a, c, t, g, unknown or other
  modified_base (2832)..(2841): a, c, t, g, unknown or other
  modified_base (2975)..(2984): a, c, t, g, unknown or other
  modified_base (3147)..(3156): a, c, t, g, unknown or other
  modified_base (3861)..(3926): a, c, t, g, unknown or other
  modified_base (4452)..(4461): a, c, t, g, unknown or other
  modified_base (4653)..(4662): a, c, t, g, unknown or other
  modified_base (4915)..(4971): a, c, t, g, unknown or other
  modified_base (5916)..(5925): a, c, t, g, unknown or other
cacgcgcacgcgcagatggcggcgctggcctccgcgctgcgccgggagcagaagcagagcgcggcgctgcgccagcagctggccgcgctgcgcgccgaacgccggcgcagcgcgaccctggccccgcccgccggcccggaacccgaggaggcaggggagcagccggggacggcacggcgcctgtcgccgccctcccccgtccccatggtctcggcctttgcgagcaatgccgggcgggactgggaggccgcgtcctgaggggggaccagtctctagagccagccctccgtgcagtccagtcacttgctcgccatcacactccaccggcccccactcgcctcacaggcccacgcacagccctgctttccagctatgacaccgnnnnnnnnnnccttgctcgccatcacaccccacaggcccccactcgcctcacaggcccatgcacagccctgctttccagctatgacaccgcgactttgagacgcgcgggacatgggagtcccgcgcagcagccgcgccctcaccctcatcatgcccagatagcccccctcacacccaccaccgagcgaccgccatatttttgggataccgccccatccccactccttccgttgatatcgtcgtcaggctgttattcgtactgtgtatttcatgtgccctccaaataactcgtgtagcgccagtcccctctgtacagtcttcgatccactgccggacagggattaagcggggttggggttgagctgccggggggttggggttgagctgcaggggggtggcggcgagcagggggcccaggagtgagcaggggtgggagctctgccacaccccatcccccggtcacgatccaacggggacacctcgcgctttcctccgcaccaaaattcggaatggccatgtcccttccgcaagatgcacggggagcatgcctgcatccaggccacatcctgcctgcacgatctgatccccgaatcgcacaccctgtccgccaccctctgagcgcgcgaccctggagcgctcgtcccggcaggcctgtgggcaggtgggctgtggcttggtcgccccctgaccccgatgccccgcgcccggactgtgtagcgagccaccacctgctgtgagggcgaaggcatgctacggagtgtgctgggcacccctagatccgagtcggacggcaacctgctccagctggcggagaagagcaatggggaggagagcgggggggacgaaggccccctcgccgtcgctcccggggcaaggcgcacggcagactcatctgtggtggatgatgacggggaggagcccccccgggccctgcccaccggcgccgaggcggtaatcacccaggtgaacacccgacagggagcccctaccgggcctgccctgggccagatggtcaccctcccgtcgacaccagaggacacctcggacctgcgggcctcctggaggaacaaagtcaggtgtgccggggttgcaagtgcctcccttgtggaagggactccccggggattggtggttgttgggcgtggcagggtccctctggctggttttgcatccctcttgatgtgtttgaggaatcctgtggacatgccgagtgtgtgtaggctgcgtcccactgcctgcgtcttctggatcggcgccctgccttcctcatcggcgcaaggcctgaaatgggggcagtccatgggaccgcaggtggaggccccagcccatgcttcgaccacccgactccccctcacacctcctcacctctccaccccctcatctccctccggcccctcccaacccctttccccctcccatgattctacccaggaacatcttctgctgcctggtcccagggcccggcgaccagtacacgcggcaggaggagggccccgtggtcatccgccccgtggcccccccacccccctcctgggccgacccggtcatcggcccgccctcccccgccgacatcggcaagaagtgcctggtgctggacctggacgagacgctggtgcactcctccttccgccccgtggcctcccccgactacatcatccccgtggagatcgaggggcgggtggtggacgtgtacgtgctcaagcgcccccacgtcgacgccttcctggccgccgtgggggaccgcttcgaggtggtggtgttcaccgccagcctgggcaagtacgccgacccgctgctggacctgctggacccggcgggggtggtgcggtggcgcctcttccgcgaggcgtgctacccctatgaaggctcctacgtcaaggacctgcagtgcatggggcggcccatggagagcctgatcatcgtggacaactccccccactcctacgtgttccagcccgagaacgcgctgcccatcggcaccttcatcgacgacccagaagatcaggcgagcgggaggtatagttttcattgagggggttcccccgggggggggggggggaagaaggaggagtctcgcatcgggtgccggtggcgctgcgcggtcctcggcgccagcacccacagcacccctcccctctgcacacacagtcatccctcccgcccccttcccatctttcatcgcaggagctgctggactgcctggaggtgctgatggaggtggagaacgcgcgggatgtgcggcagggcctggccaccgagctatcgcggcgcaggaccggcctcttctccggcttctcccaggccgtggcgcgcgcatccacgcatctggcccgcccctccgtctgagcggcggtcggcggacgctcggaggtgacggtggtgccgccctgcgcaatgcaggcggcgtcaccgggaggagtgccgcggcgcacgcctccctggcggctgcgnnnnnnnnnncgttttcattgagggggtcctggggggggggcggggaaagaaggaggagtctcgcatcgggtgcctgtggcgctgcgcgatgctcggcgccagcacccacagtacccctcccctctgcacacacagtcatcccnnnnnnnnnntggtcggcggatgctcggaggtgacgggggtgccgcccggcgaaatgcaggcggcgccaccgggaggaacgccgcggcgcacgcctccctggcggctgcggtcgtgatgatccacggccccatgccgcccttccccccccgccgaatcccctgcatcccccannnnnnnnnnggtgatgacccatggccccatgccgccctgcccccccccgccgaatcccctgcatcccccacccaccccctgcgctgggtgtatgtgtgtggtaaactttttctctacaggagcaaagctcaggacaggcaatatgtaaggatctccatcactcggtccaggagggaaggggggaagggaagtgtacacgtgggggatccacccatggccgccgcagaccgtcaggccgcctcggcctgctccggcgcgccagccagcccccctgcggccacgaggtagtccagggtgcccagattgtgctccgccaggcccgccaggtcggcgtgcgtggctgacagcaggcgctgcacctcgcgcagcgcgggcccagcgccggaggaaagcgcggcgccgtgtgcgcgcgccagctcgcgcacccaggccaggcccagctccaggtgtggcgaggctgccagcagcccgcccagcgtggccagcaggcccggggcgagggcggggggcagcaggcgcacgaccccgggcacgtgctcccgcggcgtggacagcagcacgtgccgcgtcagctccgcctcgcccagacgcagcgccaggagcagggcgcggaggtgggcgccggaccgcagcgcgcgcagcgcggcctcgggcgtcacgccctcggccaggtcggtggggtcgaaggccgcggcccccgccgcgtccagcgannnnnnnnnnnnnnnnnnnnnnnnnnnnnnnnnnnnnnnnnnnnnnnnnnnnnnnnnnnnnnnnnngtagagcgccacgcccgacgtcgtggccgccgcccaggagcggccggaggggctcagcgccaccgcgcgcacgcgcgcgaccgccacgcgccgcgcgccgggcaggtcgtcgtcgcgccgggccagagtgtcggggagcaggtcgtcgtcgtccgagccgtcgttgatggcgtccagcgggcctgcgtctgcatgggtagcattgggggtacgtgtttaggagggggaggggggtagaaggggtagagtgagggtggggtcgggtgcagccatgccctttccatctccaagcatccccccacacagtgcggtcagtgcaattgtagggtgtaatcaaggacggggcacgcgctgtggcgccccggattcagcgattgttcaccgtttgctttgacatcaccccgcacgtttgttcggagcagggactgagaggcaatcacagtccgtctctggccccttgaactacaccctgcaatcacgccctccccatcaaacgcacacacatacacacatccagtctgatcgnnnnnnnnnngtggccccttgaactacaccatgcattcaagccagccctccccatcgaaagcacacacatacacacatccagtctgatcgagacccggggtcctttccacctccttcccccccctcactccttcccccccctcactcattccccaattgacccctccacccccacccccccaaacccaccccacccaccgcnnnnnnnnnntgggctcctttcccccctccttcccctccctcactccttcccccccctcactccttccccaatctaaaaccccacctccacccccccaaacccaccccacccaccgctcatgttcttgctgttgagcatgtcacgcacgccgtccaggctggcgttggcggtggtggcaaagcggcgcagcagcacgcgctccgcgacgtcgtacacgcagacgtagcggctggcgccgcccgcgaacagcagcgcgccttcnnnnnnnnnnnnnnnnnnnnnnnnnnnnnnnnnnnnnnnnnnnnnnnnnnnnnnnnnccggcgagtaggccagcgaggtgaaagcccggcccgagctggtgttgcccgcggtgcgcgcgtcggaggcgaggcggccgcccgcgacgtcgcgccggcccgagatggtgccctccaccaccgcgtcgtgcgggtcccacagcgtgaccccgccgtccagcgtggcggccgccagctggcgcgcgtcggggcgccaggccagggccaggacgtcgtgcgagtgctgcaggcgctccacgccgccgcggccggcaaacacgtcccaggtgcgcaccgagccgtcccaggaggcggaggcgagcaggggggcaccgggggcaaaggccaggccgaccacaggaccctcgtgccctgccagcacgtccagcaggcgccccgtcttcaggctccagacgtagacctggaagccgtcgcgcgtgccggcgcacgccacctcccccgccgggtccagggccaggctgacgaactgggcggggtcgggggtggtgagcgtgcggaagcagcggtaccgcaccaggtcccaggcgcggacggtgccgtccagcgaggcggacagcaggccgtgcccggtgggcagccaggccagggcggtgacgggcgcggcgtggtcgcggaaggtgacaaagcagaagcccgtggccggggtccagaccttgacccgcgcgtcgtcccccgcggtggccagcaggccgccgtctggggagaaggcggcggccgccacgtcggccgcgtgcccctgctgcttcagcgcgtgcgtctcgctgcgccactcccagaccagcagctggcccagctccgcgctgccggccgccacccagtcccccgccgcattccaggccagggagttgatggcctgggagccgatggacagcgtgtgtacgatcaccgcatcggggagctgcagcaggtcgaagacgccgttggagaagccggccgccagcaggnnnnnnnnnncacgaccaccgcgtcggggagctgcagcaggtcaaacacgccgttggagaagccggccgccagcaggccgacctcggggtggaaggccgccgccgtcagccgcgcgccgcgctgcgagattaatgggggggaggggtgggggggaaggg

SEQ ID NO: 46355 - DNA, 67 bp, Chlorella protothecoides
gagtcgtgggatgtgaagagtgggcatcatgctagttcccaacccctcttcctgccaaactgtgcag

SEQ ID NO: 46356 - DNA, 61 bp, Chlorella protothecoides
atgtcgcaggcagaggagctgcatggcaccaaagggaagctggagtcctacctgaggagca

SEQ ID NO: 46357 - DNA, 27018 bp, Chlorella protothecoides
  modified_base (2731)..(2740): a, c, t, g, unknown or other
  modified_base (2847)..(2856): a, c, t, g, unknown or other
  modified_base (2963)..(2972): a, c, t, g, unknown or other
  modified_base (3172)..(3225): a, c, t, g, unknown or other
  modified_base (5104)..(5113): a, c, t, g, unknown or other
  modified_base (7368)..(7377): a, c, t, g, unknown or other
  modified_base (8578)..(8587): a, c, t, g, unknown or other
  modified_base (9084)..(9093): a, c, t, g, unknown or other
  modified_base (9287)..(9296): a, c, t, g, unknown or other
  modified_base (10079)..(10088): a, c, t, g, unknown or other
  modified_base (10444)..(10453): a, c, t, g, unknown or other
  modified_base (10908)..(10917): a, c, t, g, unknown or other
  modified_base (11232)..(11241): a, c, t, g, unknown or other
  modified_base (11450)..(11476): a, c, t, g, unknown or other
  modified_base (11642)..(11651): a, c, t, g, unknown or other
  modified_base (11841)..(11850): a, c, t, g, unknown or other
  modified_base (12026)..(12035): a, c, t, g, unknown or other
  modified_base (12408)..(12417): a, c, t, g, unknown or other
  modified_base (12502)..(12588): a, c, t, g, unknown or other
  modified_base (12647)..(12656): a, c, t, g, unknown or other
  modified_base (12738)..(12747): a, c, t, g, unknown or other
  modified_base (13149)..(13158): a, c, t, g, unknown or other
  modified_base (13373)..(13382): a, c, t, g, unknown or other
  modified_base (13541)..(13550): a, c, t, g, unknown or other
  modified_base (14009)..(14018): a, c, t, g, unknown or other
  modified_base (15319)..(15406): a, c, t, g, unknown or other
  modified_base (16694)..(16703): a, c, t, g, unknown or other
  modified_base (17853)..(17862): a, c, t, g, unknown or other
  modified_base (18383)..(18392): a, c, t, g, unknown or other
  modified_base (18751)..(18760): a, c, t, g, unknown or other
  modified_base (19100)..(19109): a, c, t, g, unknown or other
  modified_base (21127)..(21136): a, c, t, g, unknown or other
  modified_base (21720)..(21729): a, c, t, g, unknown or other
  modified_base (23238)..(23247): a, c, t, g, unknown or other
  modified_base (23635)..(23644): a, c, t, g, unknown or other
  modified_base (25683)..(25692): a, c, t, g, unknown or other
ggcgccggctcgccgcgctcgtcgagggcgggcagcgccgcgcagcgcgccagccccgtcagcgtcacgcgcccctcgaaggtggcggcggcgaagaggccggcgttgcgccccggcgcccacgccacctcgaagttccagttggtggcggggccagcagcgcccagctccgcatgcggcgcgccgcagcccgccacgtcccacaccagcgtgcggttgtccttgcccgacgacaggatcaggcccgcatcctgggtgctccaggacaggcccagcacgccgcgcgaatggcccgtcagctcgcgcagcggcgcggcagggctgcgcaagtcccagagcagcagccccggctggccgtcgtcgtctgaggccaccagcacctgggtggcaatggccgggttccaggcagccaccgaaacgtggcgccgtcgcgcgccgccctccgccagctggaagatgggccgctgcttcttcaggtcccaccccaccacgccagacttgccggtgcaggtggccagcacgtggtggatgctggggttccaggccaggaacccgatctcgctggccacctcctccaccccgttcttcattgcggggtacagggagggtgcggagggcttgcccatgtcccagatgcacagctcgccgtcaccaccaccggaggccagcaggttggggctgtgagagttgaactgcaggccccgagcctgcggcgtatggagttgtcggtgggtgaaggtcgaggaggtaacggagcatgtgtgtcagtgtgtgtggatgggtgggtgggaagtgggaggggtattgtaggggcgatgcccagcgagcgcttgccccgcctcacggcaccaggcatcagcaggcggtcgatgtgatgtggttgaagcggcagggtgcacacccaccgtcccgcccacccgggacggatccctttcccagaaagaaacccacccacgaaaaccagccacgccccccgcaccgctcctcgatgcttctgcaggcgcgccagcggctgggcctccttggaccctgcgccacgggacatgatgcccgcgggattccacaggcagatgacgccatctgcgaggccgccggccagcagtcccttctgcaggtttggggagagaggagaggagtgtatgtagacgtgccccttttgggctgcgcagctcacccgatcaggccggctgccggcgacattcgcactgggatgaaaggcagcatgggagggtgctagagccccattcattgcaatttccccgaccctgccccgatgagtgtgaaaatcttgcgctgcacccctcctaagctcccaaacgtacggggtacttgtcgggatcgggccccttgccccacgtgaggcgtgagaaacgctcgggagcatgcaccgctccaccggcgggcttcagatccgtactggggttggctagatccaaatcaaaaatctgttttcgaaggggtggagggactagagctcgacggttgggcccaggactgcatcacccctgcaccagaccacgcaggatgaccgcacggcggcaatggtgtcctccgcgcacctccagcgtcgagctcgtgctgaagctgagatcaatggccccggcaacactgccggccgcaaggaacgacccagtcggatcgaagcatatcgttgcggagcgatccacgctcttgacaggtagcatcctggcgactgcctcgcggcgaatgtggcagtcaaccttccatcgattgaacctagacagaggtacgtgaggtggctgcgtggaccgggtggggtgaacgcgagtgccttgctcttctcgaggtcgtcctttccaagctgtcacctgaccgtcccctcgcccggcaccgcggtgtgcaaagttgcactcaggcacatgacaaaaggcgctgattgcggtagaatcctatattctgttgatattcatccttcaccagggcatgggatcgcctgtcaggtgacccgacatccagatcatggtggtccggcgagtacacacgacgtccaaatactccgtgctcctccccacctacaatgagcgccagaacatccccatcatcatctacctcctggtcgaaacttttgagctccagtgagataatattgcgaaggacgttgtgcgagttgattgtattgcatttattcatgtccttctcattttttactagtgtctctgctgagcccaacgtcccactgctcacagtaagatccgtttcgagatcatcgtcgtggacgacaacagccccgatggaactcaggacgtggtgaagcagctacagagggtctatggcgaagatcggtgcgtgcacgagctcaagtgtgctttgctgccccttcatatgcttgctgcatgcgatctggaaaaggccccgcacacctgaccccacgatgctgccacacctatttcaatattttcgatgcactggccactcctgcaggatacagctgcggccacgtgcggggaagctgggcctgggcaccgcatatgtgcatggtctgcagtacgcctctggcgactttgtcatcatcatggacgctgacctgagccaccaccccaagtacctgccggacttcattgccaagcaggcagctacaggcgccgacgtggtgacggggacccggtacggcccgggcgggggggtgtatgggtggaacttcaagcgcaagctcatcagtcggggcgccaacaccctcgcggccacactcctgcagccaggggtgagtgcnnnnnnnnnntccctgctgcgctccagtttgttgaagggttgctatgcaacggctctcagatttccccatccacctttccaccatacaggtttcagacctgacaggttcattcaggnnnnnnnnnnaccctgctgcgcgccagtttgttgaagggttgctgtgcaacggctctcaaatttccccatccacctctccaccatgcaggtttcagacctgacaggttcattcaggnnnnnnnnnnggcatggcttggggcacgggatgggtgcggagcatgggcatcctagagaacatcaggagactgcatctgcatattgagtggatcgaggtctgggcttgttgggccaaacgcggggctttgagactgccaaactggtctctgcgtcgtgcatgctacaatagtgagcatagtgcaccaacaccctggagatttactcgctnnnnnnnnnnnnnnnnnnnnnnnnnnnnnnnnnnnnnnnnnnnnnnnnnnnnnnctgtatcggacagcatgcttagagaagctcataagactcgccacatccaagggctacgccttccagatggagatcatggtcagggctcggtcgctcggctacacagtcgccgaagtgcccatcgtcttcgtggacagggtgtacggcgcctccaaactgggaggcgccgagatcttgctgtatgtcaaagggctcctcaagctgctggtcaccacgtgaggcagtgctgcagtgtcaggagtatgttgggatgttgcggtgaggaacagcacccttggtggaggtggtatgctaacctgtgacctcaacattgacatcttctgtaagctggagcaagaaaggctggccgacgcaccatgctagtggggcctgacagcccggacccagcatgcacgcagcagggtcagatgaaaccccggagtgctgtcgtgaagcaagcgacccgaagacactcacaatacatagctggcatcgagggtcctcaaggaggtgccacgccctccccccagccagtgcggaaggcaccaccggcctgtgaacccgcctctcaggccctgaccccggcagctggcagcacatgagcgtcatcgtgtctttggcacaatgcctacggctaggacgcacgggcatggctcgttgcgcgacaggctggaggagcttctccactcagattggggatgacctgccgtcccacggcaccgacttgcaagtcgcgggtggggcgcctcccatggctgcccagcgcaaggtcatcatcttctcgccatctcgggtggcgggccagcacgggctcgcacagaccatcgatgggggtgcgtggggaatgtcgtggtagctgggactcctaggccgatgctgggagacgggaggagccgatgccggggagtgcgcaagccaagcgaaatacatctgattggatctcctagagcctacctacactcacaggtggcccaagctggagggttctctttgcgccggagggtgagtagcccctcccagtgggcacacggctgggcagtcgcctttcaaaagtacagcaagcatccactcatgcaggcctactgcagctgacctggccagccaacacacgcacactctcacacacatcccgcaggcaagtggatgaaccccctcatgggctggacttccaccgccgaccccttggagaatgtgcaccgcccgctgtactttgacagcaaggaggcggcggttgcctttgcggagaagaatgggtgggggtatgagattgaggaccccaatccccgcactcacatccgtcccaagcgcttcatcggatgtgagttgggccagttctggcgtttttgctctcgacggggggttgttgggacgcaatggttcatgaatctctttccacccttggataccctgatgtttcaaggccttgggtggcagtcctgtgtcttgagaggcatgcctctgtgagaaggtgatgtatgagccttcctgctggcttcgaggataccaaggacctgtcccttcacccttccagacggtgacaacttttccgtgaagcgcaagggcctgccctctggcgggctgaggagcgagcttggcggcaagaagaagaagtgagggaggaccctcacaaggggctcccctgcatatcgtactctagcagtgaggaagccggccgtccgatggctggggctgccactgcagactccctgaagtttggatgtcctagctgtcacgccctggtgtgtgtgtaaaggagccctgtcttcgataggtgacaagggtgtgaggcccttccagtggcctcgaccaccaatgagggttacaaccgacttccaagtcggcaccaagaacacaatttcagcagggggcccatggtctggccatgcaaccgcccctgggnnnnnnnnnnaaaggagccctgtcttcaataggtgacaagggtgtgaggtccttccagtggcctcgaccactaatgagggttacaactgacttccaagtcggcaacaagatcacaatctcagcaggggggccatggtctggccatgcaaccgcccctgggagtgcaagctgactggcttggacggaatcaggccacactgcaatccagcgctacgagccgcttcactgcgctgcgccgttttgctgctgctgggcctccctcagcacctggatgacagacgcaaagctgaaccactcggggatgtcttcgcctgcgcaggaatgggaatgggacttgattgagatgatggggaggaggaactccctttgcgcccacagcccgcccaaccactccccacaccggacgccgacgacccaccgctgcgcagcatcttgcggaacttggtgcctgacaggttgagcttgtgcagcccctggctctctgcaacatcggccgttacaaagcccgcctcctgcacgggtggaatgggaatgagaagtcggagaagaagcaggggcagtgaagacagggagggagggaggcaagcaccccgcccatctgccccaggccagggcaaaccatgacgctgccgcccaccactcctgccccgcgacaccgcacctcggtgtacgtgatgttcagggatgggacggtctgcatgcccagggcgggcgcatgcttcgtcgcaaactcctgggcatcgtaaggacctggaggggaggaggtgcgccgcccaggtgagtgacacgcggggctacgtgactgtagtcaagggtcatagtgccctgcagggcctgggggccaggtgcatgcatgccaggggggacatggtgccaggtgctccccagtcaggttcaactcagagaactcaggcagagacggtgtgagtgtggcctctcctgatccttgggtattctgcccgatatccctgggccctctcgacactcccagcctcgtgtctgctgcaccctcaccccaacccacgcactcccaccaagcaagagcggaaggcagtccttcccctcccccgccgacgggtcccccagcgcaccgtaaaagtcctcccccgtgaggctggacttgcagccggccatatcgcggccgatgatgaagtgggtgcacccatagttcttgcggatgatcatgtgctggatggcctcccgcggccccgccatgtgcatggagtatggcaggtaggcccagcgcagcgcggggttggccacctccgcggccagtacctcataggtgcggtaccgcacgatgccggggatgtcgtcgtcctgggtgggcccgcaggtggggtgcaccagacacaccgcgccgggggagacgttgtccgcgtccagcgcgcggatgaagagctcgtagtgcgcgcggtggatggggttgcgacactggaaggccagcacgtccacgccgccgggcagcgtgctccgcacctccgcgggcgtcgcgcaggggaactcgcgggtgggcaggcccagcccctccacgccgccgcccaggtagtagcgcccgcgctcccccgcgatcatggacacggcggggtggtccagggcggtggtgccatagcactgccgcgcctccagcgccttgttggggcgccacttggagctgaccgtgaaggtggccagggactgcatgatgcgggagggggagttgatgaaaccgggggggaagggggggggtggaggaaggggggcaaagtcatagatcgtgtggaaagggaaactaggcagagaaggacatccacatgaggccctggcgccccgccaagcaacctggggcgcgcgtgggagcaaggggtgcaggcatgctggtcccctggcaaatgtccttttcctccactctgatgcccccgccctgggcccacctctcccttgtaggtcaggagcagcttgtcgccgacgatgatgccctcttcgctggtgtccatgaccaccggcagcccaaacagggtgccatcggggagcgtcatgttttcaaccacggaggtgtactcctcctccgtcatgaagcccctcagcggggagaaggccctgagataaggtattgggtgcgattcttgatgggtgtgagcgtgtcgcccaaggccggcccaggcagctatgcaccaaactcgggaggacgatgcatggctggaatttgcggggggcatcagcatgccgcccgtgggacagggaagggacgtgcctttgagaaacataaaacaggacacggcgggnnnnnnnnnnaggtgcatcatcatgccgcccgtgggacagggaaggggcgtgcctttgagaaaacataaaacaggacacggcgggtgggtttagacctgaggacataccctggcgcaacacagaagatcccagttgcccaaagccctcctcataaagacaagacaacccagctttgccagatggagcacaccattccgcatagaggtcaccaaaaccgcacttcctgccacacaaagcgaagcagctgctcgtcacattttggcacccagaatcccttcgaacaaccagcctcaccctacggtgagcagctctacatcgcatgcattacggtcagagagctcgacggtcttgttgcaggagctgatggcagtctctctctgggaactgggcagcatgaggtcgaccagagacccaccatggggagcaatggtgtcagcctgctcggcggtagcttcagcgctcgctctgcatagagttttggatcggaatatacaggtgtaacgagcttctcatacgctttgacgtatcgtcccttctcgtctgagccggcgccaagcgaggctctgcagggtttcctcggcagatctgcaccaccgccacccaccgagtcatgatgttacaggaagcgtgtcccgcaggcttctcactgcacaaggatccagacctcgcactcctgccaggcctcgcgacgaatagcggcacctgtgtgcggctggtgccgatgacccttgcggcgcagaggccctgtggccgtgacaccccgcacacgcgcagagctggagcggacatggctagatttcgaagtactcgaggccaccaagtgttttgagagggattgggcggcctccagggcataagtgcatggatcagcacgtgacgggttatccgcgccttagtcatttggcccgtcgacacctttcagcccagcctgccaatatttgaaacagctttcgacaaccttctcctcccagaagactaaaagctgcggtgttgcagatatgctgctgactacaaggctgaaatcgatacgtatcacaggcaaagtaggacattggcgtgatgaaagcaacagggtaggtgtgcatgggggttagggtatggtaatcattatgaataggtcgtggatactcctcgcaggcagcgggcgagcaagcccatgagatcgaccatgggtaaaacctgtgcccgtaagcccattcagggggagggnnnnnnnnnnaacaacctcctcctcccagaagattagaagctgcggtattgcagatatgctgctgactatatggctgaaatcgatacgtatcacaggcaaagtaggaaattggcgtgatgaaagcaacagggtaagtatgcatggggggtagggtatggtaatgattgtgaattggtcgtggatactccttgcaggcagcggatgagcaagcccatgagatcgaccatgggttaaaactgtgcccgtaagcccattcagggtgagggcaacgctttgcgagtggcatggggagacttctttgcagaggttgtggtggtggttgtgggggcgggagaggtgctctgggtgctgcggtttggaggaggggggagggtgaactgcaccacgggggttggaggagagttaatcttgttgccgtactcgtcaaagtagtaagcgtaggcgtagccctcgagtgtctccacggcggaggcaacgaagtggccgctgtgctcaagggagtcggnnnnnnnnnnggcgtagccctcaagcgtctccacggcggaggcaacgaactggccgctttgttcaagggtcgcaggagtgtatgctgtgccaaagtcgaagatgcccagcttgaagaccacgtggacctgagggaccttgtgcttaagcaggacatcgtactggaactgaaccgaatgcatgatacctgcccaggcacatctgnnnnnnnnnngaggacatcatactggaactgaacagaatgcatgatacctgcccaggcacatctggcagacaccacggagatggtggtgtatggcggcggtggtgcaaggggcgtggggggtgggctggggactggcggcgggggtggggatgacggtggcaggggtgtcacagcaatagaaggggatgtgatctgcttccctgtcgcatcgtagaagtaggcgtaggcagatcctttcgtaggcctggttccaaacacaatcttgcccacgtgggtcagatcgtggggaatgaagccttcgctgacttggccagaatccatgtcgaacaccacatccacgcttttagggatcaggtccgaagtggtcacgctgtatacgcaaactgtttcccgaggatcatgcatatcgcaccgtgcgaaatccactgtgattgagatatcgtcctgcgcagtgggcaaggggctcctgtggggcaactgcattggcatgcgagccggagtgaagacctcgggccatcatgcagacacctcccagacctcaccgctgaagtaggtgtggctgtgatcaccgcgagcaggaggcccataagggcgaggttcgagaatcgccccatcccggtgggcagaacagtcaaggagctgctgagtgtgaaaggagtctcgcttctatgctgcgacccaaggggtgcgtgtgccaggaatgtggcagaatataatttatttgaggtttctccgccaacttgtaggtgtcagcgccaagcgaatacagcgacttgcgtgtctgccaggaannnnnnnnnngtagaatataacttatttgaggtttctccgccaatttgtagttgtcagcgcccagtgaatacagcgacttgcgtgtctgccaggaagggacatagcagactccggctcgggcagcgcatccgggggccgcgcgctaacacgtggccgcgacgaccgcaaatcgaagcgattcgatcatgtgaagcacggcgaacgttgaggagtaagaagggcgtagatttgaggtgattcgttcatgcgctaagaaagagcgttgcctcgaccaggtgcaagactgagcgagccttgcaatgggcacttctggagagaagtgtcgcgacattggcccaactgcaaacaccaatgtcagcagtgtnnnnnnnnnnctgcctcgaccaggtgcaagacggagcgagccttgcaatggacacttctggagagaaatgtcgcgacattgccccaactgcaaacaccaatgtcaacagtcttccgcaattcctggcaagaggagtgggtgcgataaacgtagcaatcgacgcgttgattcatctgtgagcattactatagagccctgacgaccaagcaaagggtggctatgacaaggaacaccaggccccattggttcactggattgaaaactcacagagcattggcaaggggatgtgacggaaaccggatacttcgggctgaaattgtgaataacgggaatcgcgagtggatctcggtcccagtttgagatttgagaactccgacaaccctgtgtcagcccgtgcccaatagtgctccacccgggcgcatccccatcgaatgcatgcagccggacctcaggttgattgcatgnnnnnnnnnnaccagttttagatttgagaactccgacaaccctgtatcagcccattcccaatagtgctccacccaggcgcatccccatcgaatccatgcagccggacctcaggttgattgcatgccttccatccatccttccgtatcttaccccactcctctccttcagcccggacatttcatggtgttgcaagtatgctgtatactgcttcaaatgaaacgctatatatcacagacataaaggacattggctcgatgaggagaagacaataggataagtatgcatgggggagtatggcaatgattgtgaattggtcgtggaatnnnnnnnnnnaaaacgctatatatcacaggcataaaggacattagctcgatgaggagaagacaataagataagtatgcatgggggagcatggcaatgattgtgaattggtcgtggaattccttggagaccgcaaaggagcactcccatgagagtgaccatggattaccccccggctacttgccagcctattcagggtgagggcaacgctttgcgagtgnnnnnnnnnnnnnnnnnnnnnnnnnnngctggcgatgttgcgctttgaaggacggggaagggtgacttgcaccacgggggtggggggagagtcaattttgttgccgtactcgtcaaagtagtaggcatacgcgtagccctcgatcgtctctacgtccacagtaccgaagtggccgctgtgctcaagggagtcnnnnnnnnnntgcgtagccctcgagcgtctctacgtccacagcaccgaagtggccgctgtgctcaagggagtcgggggtgtatgctgtgccaaagtcaaagatgcccagcttgaagaccacgtggacctgagggaccttgtgcttcagcaggacatcatactggaagagaaccccttgcatgggaccggtccaggcacannnnnnnnnncagggaccttgtgctttagcaggacatcgtactggaagataaccccttgcatgggaccggtccaggcacagctggcagacaccacggagatggtggtgtatggcggcggtggtgcaaggggcatgggtggggaggtagggaccggcgacgggggcggggatgacggtggcaggggnnnnnnnnnntggggaggcagggaccggcggcgggggcggggatgacggtggcaggggtgtcacagcgacagaaggggacatgatctgcttcccagccgcgtcgtagtagaaagcgtaggcagatccttgcgcagtcttacttccataggtgaacctgcccacatgggtcagttcgtgagggatgaagcccatgccgacctcacccccagaatccagggccaccataacagtcacgccggtctggaccaggtctgaaagggtcacgctgtagacacattctgctccgttgccaccgcgcgaggtgcaccgagcataattcaccgtgagtgagatatcttcctgcgcagggtcaggggctcctgtggggcaactgcattggcannnnnnnnnngtgccgacctcacccccagaatccatgaccaccataacagttacgccggtctgaaccaggtctgaaagggtcacgctgtagacannnnnnnnnnnnnnnnnnnnnnnnnnnnnnnnnnnnnnnnnnnnnnnnnnnnnnnnnnnnnnnnnnnnnnnnnnnnnnnnnnnnnnnaattagcgtatatgttctcctttatagtcgtcagcgcctgatggtctcagccactccgnnnnnnnnnncattcacaattgagttatgaattaaaatatagggcatggtgatgtgggaccccctgtaatcacggatttggccatgtcctcnnnnnnnnnngattagcgtatctgttctccttcacagccgtcagcgcctgatggtctcagccactccgcgtgcctaccaaacgtggacttggcggaatccggctcgggtcgtggtccggagggcgcgcggcacgtggccgccgggatcgctgcgcacagccgtcgagttcgagcgtgtgggagccaatgttgcatcaaaaattcatgattgagttatgaattgaaatatttggcatggtgatgtgggacaccctgtaatcacggatttggccatgtcctcggtgatggcaatatcggccatttgtgctgtacgatgcaacgctcgctcagaacggaccctgtacccagtgctcgactaattgggaaagcaggatctcaagggtcgggggtggcctgtccctgcaaaggtgtnnnnnnnnnngtgtacccagtgctcgacgaattgggaaagcaggatctcaaagtgtcgggggtggcctgtccctgcaaaggtgtgaggacctggtgtacgtcctgttttggggtcggtccaggccggagactgataccgaaacgccagatgaaccccaacgtagacttttagcaggatcccagaaggtttgcgcgtttttttgccctggatgactttgatgagannnnnnnnnngacgtagactttcagcaggatcacataagatttgcgcggtttttttgccctggatgactttgatgagaccctgcgtgcatgaactgctgattgcccccccttgccataaattggccacaattctgatgagcatgggaagtgctgtggtgaattcgtttnnnnnnnnnnaatgaagtgctgattgcccgcccttgccataaattggccacaattctgatcagcatgggaagtgctgtggtgaattcgtttgcagaatgctgacatgtcggatctgctgtcgcttttagggaaggccatgtagcagtgttggtagcatcccctgaaagttgcagggcctactgcgcatcaaggaattattcggactgccttcggagaacaaagagatgccaacctcccaccgtgcacaggcggcaggtgcatgttgtcgtcggaaagagcaccgattggagcatgcacgcattgcgtaagctcgtagatacatcgatggaaccagggcggtatcgagcttacagggtgggtaccctggaacttgggagcgctagccggaggcgggcattggtatatggacgacaaagagattcagctacttgaggcatgcatcaaagtgaggttcatgagctgtgttannnnnnnnnnggacaaagagattcagctgcgcgaggcacgcatcaaagtgaggttcatgagctgtgttactccactggatcatggtgggtcgatggttggagtacatatctcccctggctaggcggggtttactgagtgcaaccacacgtcatagggatgatcatttgatgaactgcacaccaacgcccaacctatggggagaagttgaagcgtctaacccgactgggtttgcagaagcttcacagtagaaggtgtatgcaactcccagggattctccttggacaggaatcagtgccattgctgaagattggccccaaagtggtgcaaacatcatctcactgctcagccagccaagagctcatgttacattgggtactgagtgcatgagagacttgctacagccacgggattgtgcacgtttgagtcgaatgcatcccccaggccagccctgagggcttcaaattccgttgtggcaggcgtcaatatcgagagcaaccccacagcaagcctgaccactggcagcgtggcataatcacattgtgcagtgtggaggagggctttcatcggataatcaatgttgtccttgtgcatgttagcaatggaggtgcgatggtcgtcgtgacgagacggtcgcgtgccctcataattcccgacgacagcgggtctgaggctgaacgtcacggagctggagcccctccatctccgcccaggcaatccgcgccagcccagtgcccaacgacatcgcccccgagccctcaaggggcgacacctcatggatcggctgcacacacccagcctcccctcgctgaagaggacacctcaggcagcgaaggtgggagctttggtccacatccattctctcaacttcaggcccctgtctaccttgataaacccctcgcttgccaagtccagcaggtagcagaggctgcagggaatggagggtgaggcctaggccgaagcgtggagggtcgcctggtgtgagagagggcggacgccccgtcgtgagggcccgcctcctcgctgggggccccggagactacgaggacggcgatgactccggggcgggcggaggtgcgatgctggttggctcgcgggccatttgatgtctctccaaccctccacaccgcgaccacctcgccatctgccccacagacttgggtgacttcatcgtcgacgacgagattgagaggacttcctcctcctcatccatcgcggcagactctgagcgtcctggggatgaggacagcggcgtgcgtgctgcagtgcggcgtcagcgcatcctggctcggcgctccgtgttgtgctcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcaggggccagggccctgcaatccggcggccgtcccgggaggcgtggccaggcaggcgccgcggcactcgcgccttcgcctggcacacaggtgcggctgaggaggcgggtgcccaggctgtgtgtggcagaggtcctggagagggggggccggcgctggtacgaggcggtgcatgcgcaaggcagcgagcgcgaggatgagggggctgacgcggggcccccgacggatgagggagatcccagcgcttcgctgcgcaccagcaccagcgggtcagcgcgggaggagggcgtggaggcggtagcccgtcctctgcgcccaagcccggcgctgggcgtgcttcggtgagtgggtggtcggcagggttttggaggctgcgcaagaggattgtgcatgcgggtgctttgggatggcccacctctccctgccaccccaagcctcccactcctgggatactgtcccagggccactgccatgctgggcgtccagctctccagctacaccccacgtcagctctttgacatttattgcgagtaccgcctcctggtggacgtagaccccgggtgtgatgaagcgggcgggtgtgttgtgtcggatggtgctgcgctgctccggggcggagacggattctacgctggggctctaggagcacaggttgcacaccactcacactgtacctcaggtacgaggatcgggtcgccaccagccctcagcaccagcagtactaccgcaatgcagtgcaggcggtggaatggaagcttggacgagccaggtaccgaggggacaggcgaatgggcagctgcttggctttccagaggcttccacctgaacaggcgcagcctatctgaccgtctcacccgcgtacctgagcgtaggaccccccgctgtggctcgccgctgactccttgccctcgaatcacgttccgtgcagggatgcggcggccagctccttttggcgatcctcagccagaggcctggtcgaagccctggagacgctgccgggcatcgagtgctcctggagcatcgaccccctgcagccccgagcgggggatgctgaccaagacgatggccccatctgccaagcctgtcggcgctccaggtggatggagtggcagaccacatgcgtactcaggtttggaggaggtcgccccaccctggttgacaggatcccaggtcagtggcatcgggactcacccccggcaccccccctgcctgaagatcgcacgcggtccgggaacttgtcctgcgggggcgccccgtggagctgcggacgagcaggcgcgctcccnnnnnnnnnnacccatcctggttgacaggatcccaggtcagtggcgtcaggactcgcccccggcacccccccgcctgaaggtcgcacgcggttcgggaacttgtcctgcgggggcgccctgtggagctgcggacgagcaggcgcgctccccggaggctgagcgatcagtttgcggaggtttcgccggcattccagaggacccacaggcgcagacccctgagcgagagctcagggaccgactctgggggcccaggaaacagccaggacaacaacaatctcaccacgcgagaagcggagggcaggcgcagcgcgagtaggaggggagcggagcatgggcccgggagaattcttttagcgcatgggggtgcctcgatccgccctccccctggcgttcaccccgcagggttcctggtggggcgcttctgctgcgcgcgcctgttcctctaccacgccctgttccactgggagcggcgtctgcgagcgcggctgcgccaggaaaccaagagtgcctgggcacaggtgcatgtcgtgcttgggcgtcaaagcctgctgcgcatggctttgagggcttgtatctgctgggaagcctgcccgtgattcctcgagctttgctgaacaacaaggcctcacaccaacgtgcacgcccttgacctgccgcagatcaggggcgagagcagccgtggggaagttgctgcacgcgtgctggcaaagtcctccctcctggagaccctgtacgatatcttctcccgcctctgccagctggcgggtgagaatgtgcagcaggttggatgggccaagaagcagccatggacacatggcttcctcaatctgcccagaagtgacgttgccaatgtcacctgcccagtatgggccatgtgctctcatatctatctgggatgggatgtggcaactcacacacctttccacctttctttatccccccagaccagtacctgctgagtgggggagaggggggctaccgcggccgcttcggcgcgcccgacacctccgccggtgcgtcggcggggtgccgtggtggtggggccagtcctgcatgccgcggtgccctgggcccggcctggacttcacatgtcttgcggttgccagcgccctggcatccaccccgcgtcccccttgtcctccccacaaataccgcaccnnnnnnnnnntggggtgccgtgatggtcgggccagtcctgcatgccgcgttgccctgggcccggcctggacttcacatgccttgcgcttgccagcgccatggcatccaccccgcttccccccttgtcctccccacaaataccgcaccgcagagatccatgcgctcgtggagtccctgcacgacgacgtcgaggcggaggagagcagcgtgcgctgggtggggtcctccctcgaccagtcgggcgagagcggggggagtggggaggtcgtcagcagggcggcggcccggccggataatgggcccggcgaaccagggcgagcgccgcctggcggggcgggtgccggcgacatgagcgcgccttcctcctcgtctggcgggaacgccggctctgaagcccggcgccaagcatcttcgggtgccatcggccgcggcgccgaacccggcggcgaagctgttgacacggcaaggcccggcgctgcactcgccaggcaaggccgccgcgccgtcatcttgacctcgctcgacgacagnnnnnnnnnngcggcaaggcccggagctgcactcgccaggcgaggccgccacgccgtcatcttgacctcgctcgacgacagcgagtgacgtggggcagcacttattttggcattcgaccttgggctggtcatgtacactgatacgccggctgtgcattatgtctcacgctgtctttcctgaacctatgctgaacgcttgctgcacactcactggtactcgtgcccaatggggcagcacatcagactgcgggggtcaacgccatcaatgcgttgtaacaggaggcgcatgccatgcccagcagggtgaaaatgggcgcgatgcatcgctgctcgggcagggttggcgctcagacggcactggaccgcaannnnnnnnnntcatgcccagcagggtggaaatgggcgcgatgcgtcgctgctcgggcaaggttggcgctcagacggcaccggaccgcaagggaggaccctacttgccctgcagcccggccatctgcttttctgcggcggcagtaaattccccaaaccgcatgcccacgcgggcagagtgcttcatgaacttctcacagcacttttgcacgcactgcaagggacatcgggacgggaggctgctcagaaagatccgggatggtaaggcaagcagggggtggcagcaatactctcaaggacccgcaccttctcctctgttgcgtcgaggtccttgcgccggaaagagtccacnnnnnnnnnntgtactctcaatgacccgcaccttctcctctgttgagtcgaggtccttgcgccggaaagagtccacgcagtccgtgaagcacttttctaccagattgttgtacatgcgcatgctgtaagggtcgcgagaggcatgttgagcgcatatgaactcataatgcatgcagggacatggtcagacccgggctggtaccgaagctccgcgacagcaccgcaccactgacacaacaacttttattagcacctgtcgcgtgtctgcattgtctctatcgcctgcagcagctcctgctgctggccctccgagaagccgctggcgtcgggaccgctcatcgtggtcgaatccgacgaaaggctgccgacggctgaaacttcgaatggaatcttcctatatattaggatgaagaagatcgtttctgtgaaggcaggaagcagcactagaggggcagcgtaaatgcggggctgagcatttgagtgctgagcttgctgcggagaacaggtccacgcagaacttgttcggtctgcatgactgattccgttgtaaggggaattggggagttgacagtcgacccacctttgggttctcagcagagaatattgccctggtatcccaacaagacaccagtgctcttatactttcatacacgaggaagcatgcgaggggtcctgcatgcatctgagaggggatctgagcaacctgcagagcgcgtcaggcttggcgatgcacttcggagcaagcacctcgcggcaccgggtgctctggtcagaggcctggtggcaactattgcgtcgatgccaccagcatcccctagtgagcatgtctggcagtctgtcgctctcagcgcggcaggccaccccatgcgccggctttcttgggcttggatgcagcctccgccgcctgcttcttcttggcctcttcctccttctgcacccacatgaccatggcagtaaggcatgagttagagacgtgggggagtaaaggcgtcctctgcctcatagatatccgcaaaactctgagacaagatcccagtcacgtcctcatcctgaaccctgcgcagcccccacaagccccacccccctccaaaggccatacccagcacccacctccaccgcctttgggttcagcatgcggcgcagggccagggcgaccttgacgttgttgtccagggggtccaggggatccttgcgcagcctgcacgggcgttgcagattggatggaggctgcggtgtgagggcaccgaagaacacgggcccagccccgcttcgctggcgcctgacaccctgcaactgggccgacagcatactggccacagaggcgtcccccaacaaacccaccggtggctcagggccatggaggccaggggcacgacatcctcgaggaccacctccttgcggccctgcagggccaccgcggctctcaccgcccggttgagcacgatgtcgccccggatgccatcggtgtccagcagcgagcacagctcactgcagcgtcatgggcgagggagggtgtacttgtcagggaaggagcgtgcatgcttgtgagtgagagggtggggactcagcaatgcccgggcagggcctcccatcccctattgccgcaccccagctcgctcacttttgcacccacagctcaccacacccacctgatcttgagcttgatgtccctggacaccgtcacctcgggcagcagctgccgggcgcgctcgagctgctccaccaaggcctcctgctccgccgccaccgtcttcaagaaggccgctggattctgcatgaaagaaagggggtagtcgggccacgggctgcgtatctgggactgggcagaggctggtcgggggccgctcctcttcgcagagcctgcgcacggtctgcacggcgtgcaggacaaactggggcagacgcgggcagggcacgtggattctcgcaggccggcgtcagtgagggttgcagcgcacaggggcccttgcgagccacctccctgcacacccctccctctcgacactgcgcaccccctcaaaggcgagnnnnnnnnnnaacacactggggcaggcgcgggcagggtacgtggatcctcgcaggccggcgtcagcgagggttgcagcgcacaggggcccttgcgcgccacctccctgtacacccctcccactcgacactgcgcaccccctcaaaggcgagtcggtccaggaccatgcgtgttcgctgtgaggtctcctgcagggtgccgaccgagacggacagcccaaaccggtccaggagctggggccgcagctcgccctccgctgggttcccggagcctgggcggggtgcaagagggtggggagcggctgcattgctgggtccggaagagcaggcgcaggcggtcgtgccactgcatgcctgcctcgacctggagcgcacatccaattcacccctccccccaccaatcatgatgaacgacgccgggtggacgatggagatgccctccctctccacagtgttgcgtccgcttgcagctgcccaagggggtaaatcagggtgctgtgacaagccggctcaagggcaggaggggaccgccgagggtgatttcaaagcctggcttcagggcaagccctgtctcgagggaagtcctgatacaccannnnnnnnnnagctcaagggcaggggggacccgctgagggtgatttcagagcctggcttcagggcaagcccctgtctcgagggaagtcctgatacaccaccctcaacatcaccacccagctcccgtaatgcaccctcccttacacctggcccaggggcctcgccgtcccacagccaggcattgtacacgatctgcaccctccgctgcaccacgcaccagcatcgagcaccacgtccaccagcccatcgtcgagcaggttgacttcatcgacatacaggatgcccctattggcacgcgccagcagcccaggctcgtaggcctgaagaggtggggtgaggtggtggtctccttggcacaaggcagctgagactcagggggacacagaccggcgtgcaagttgatgtacggggtgcggctccaggtcgtttcaatcaaggtaacccagcccctctcagccccaccccgcggcctggtcaaccacaagcgcacccaccttgatcccctcggacagcgccttctcgacgtcgatggtgccgcagatgcggtcctccgtggctcccaggggcagctccacgagcggggtgggcttgcgcacggtctccagtgggatgcccgccctgagtgcggccaggggctcgggccccatcaggccggggtctagagggggggtgcaaagacaaggagggtggggactcgggtgtgcaggctgcacttcctttcgtgttccagtacctgttgtctacatggcacccgcccgcctggctccaggtccccattgttccaactatgatccccctctccatgccactcaccagtggggctagagttaaaggggtcatccttgaccacctggatctcaggcaggacatccaccaaagccctgacctgtgattgcatgaccgagtgtgtcttggggctgtgccacatggatgctgcgaccatggcatggcagcacatcatcatgccacaagagagggctcgacatggagcaccagacgcaccgcaacagattttcctgtgcctctgtcgcccatgatgagagcccctccaatggagggatccaccacgttgaggagcagggccagcttgagctcttcctgacccgcgatccttgtgaatggaaaggctaggcgtctggtgcgggtgccaggttccatgaccacagcaccttcggcagttgaactcaggtgtgaaatacggtgtggcttctggtgaccatgtccgcatcttgacagttgggggggttgactatgtgcggcccgcatgggcaagctgcgacatggggcctgtgtcatgatggggcatcgaagggcggataaagccgccatcctgagcctccgttacgcacactttggaggccaaattgcatacattcaaggtgcgactacatcgatcccagttgttttcgcatggagcgatgacgttccgcatgggcatcccggatttcggctgactttcttcctcctcccagagtccagctggtcgcgttgctgcttggtcattctacgagtgcttttgnnnnnnnnnngctttcttccttctcccaaaagtccagctggtcgcggtgctgcttggtcattctacgagtgcttttggaagtaggcattctctagactccttgcgacaagtttattttcatggggggatgaatttgctcacaaggtcaaggggtcagggctgacatggtctggaccatcaggattgctgacccctggagacctggccgtttgctgtccagccatggtgcactcactctcaatgtagtagaatttgtgggaatgaacccttcccttccttgaggattgcatgccttgagagcagtgcaggtgtgatatcagctccagtcaaagcccctgtctgctcatggtcgagcgattttgccctgctctgaatctggggtctgcggctgccgaggnnnnnnnnnnaagcagtgcaggtgtgatatcagcaccagtcatagcccctgtctgctcatggttgagcgattttgccctactctgaatctggggtctgcggctgccgaggatcctgcacctgcatgactctctcccaaaacgactgcgagaagttccctgctgcacctctttatcgagttcgaaaggcagcatcttaatcttttcattgcaaagcatgtgctctgacgaacatccctagatggacggccccgactccccctttgcggatgccaccctgccgggtgtgaccccctttgatcgcggggatgatggcaccaacactcgggacactcgcgagcatgttggaccagctacagtccccaggacctccccaagcccgggtctgcacatgcctctgcagctggggggtgctgccagcatcagcatcctgagccccttcatgcagtcccagcccgcctcctacgtgcgatctgccaatggagagtggaaggctctggacgcgctcggcgaggccagcgaggagaccctgtccccccgcacgtcggtgcagccccccgaatacccgtcgttgccctccgaggaagcctcccggcgcggccccagcaccgaagcctcccaggtgagagggcgttgctggtcgcactcaatgcccccagcttcactcaggcccggggtgcatgagcctggtgacggtgtgcagctgtccagaggcccctgacctgctcatcgtccatcgatcccgcgtgtccctgccgccaccccgcagaccatctgtgtgccggaggcgcgtccacgaggcgtgccggcccagtgccaggacacccccttcccacgcgacgctgctccctcacgggaggccagcatgcacggcgagtcaacccccagcgcggcgcccccccccgccatcacgacgcagccacgggaggtgccgcagaaagggagcggcaagcgcgaagccaagggctcctgggtcgcctcgccccgcgccaaccctgccagctccacctccccacgtcaccctggcaccactccccaagactcgcccagggggcccaccgctgccgcccctcacccgcccgccagcgtcccggccgcgagggtgcacgcagatccggccgccgccgcctacgcttcgcccgggcgatcccctcgtgccagcgtagacatggtggccgccgccgtcaccgccgcggctgcggtcatggctgcgggccccatcctggatcagcagcagcagttgctgcagcagcagtatggcgtggttctgcagccccagcagcaagcccagctccagcagcagcaactcgcacagctgcgcctgcctcagcagaaccagtttgcgcagctgcagctgcagcagcaggagcagcagcaacattcacagctcttcttgctgcagcagcagcaggcgcagcagcaggcgcagctgcagcagcaggcgcagctgcagcagcaggcgcagcagcagcagcaggtgcagctgcagcaacaacagcagctgcagcaacaggcgcagctgcagcaacaacagcagctgcagcagcagcagcagctggctgccgtcgcggcggccgcggcggctgtggctgccgcgagcgtctcggggcccagcctgccctccatgcagtccttccccagcgccgcgacctcgggggcggtgcagctggacgggccgcgcctggccccggcgaggacggtgagagctggtgccggctgattttggtgtgctgcacggggcaggggaagcacgtggcctgtgggaggagcgtgagagatgttttgccggtgaagtggctgtgggtgcggagaaggaggcgcacatgcgttcctcagactgtcttctccgtgtgtgtgtgtctctgagtcaacccagtgctttggccgcgggtcatacgttgcgtgaggtcatccacctcaacttccccccctctgatacttgcgcgccacctaaaggaacaccccgggcccatttgcaccccaccgccccactcctccccaggtccgagttctggtgacaaccagtccggcgatggccccggaccccggcnnnnnnnnnngtgtctgagtcaacccagtgctatgtccacgggtcatacgttgcgtgaggtcatccacctcaacttcccccccactctgatacttgcgcgccatctaaagaaacaccccgggcccattggcaccccaccgccccactccttcccaggtccgggttctggtgacgaccagtccggcgatggccccggaccccggcgcccctggggcggaggcctccctgagccgcgagttcacgcgcctggtggccctgcccttcaccacgtcgcgcgcagagctgctgcgcaactgcctggtgcgcacctgcccggccgcgctgcagggccggggggcgcccaccggcgggggctcgccgcgagtgcgcgtcctggccgaccgcgcctcgggcggcgccggtgcggcgcagcgggtgaggcgggggattccggtgacgcgtctgggatgtgcagggtttggtgggggccgtttctcgcacgccacaggggcttggcccccgtggctcgagtgttccccgcggggtgcttccgtcggcggggttgcggcgacatgtgccgcgcggcggcgagatggttgagcccccgaggaccacccccctcccctctcccatcacgcgcaggcggtgttcacgatgcggtaccgcctgccgcaggaccccgacacgctggtggatctggtggacgacgccgacgtggcggcgatgtgggacgagctggtggacaagaacgctggcctggcggacgcggggctggcccccaccaagctccacctcttcctgtcctcgcgctggggctgggtgcggccctccgagtcggagtcggacgaggttggcctctgcgtcccgcccaccctgggcagctccatgggctccgcggcggacaccgcggacgacgatgacgacctggcctccgggccggtgcatgccgctcacgccagcgcgcgcgacctgcgcgccgccgccgcgcgcggcgaccgcctggaggtggccgcgccgggggacgtgtggctgtccagcatgctgggcgccgggacctacggcgacatgtaccgcgggcgctggcgcgactgcgacgtgggcgtcaaggtcatcaaccccgcgctcatgggcatggagcgcgcggggcggcgcgactggctcgacttcctcgcggcgcgcgccgagatggtcagcctgcgccaccccaacctggccgaggtctacggcttcgtgctgccggagggggagggggccgccggcgccgcccccgccgcgccgccgccggccccgggcccgggtgggcccggggtcaacctcgcgcaggcccaccagcgcctgccggggcgcctggtgcgcg

SEQ ID NO: 46358 - DNA, 18732 bp, Chlorella protothecoides
  modified_base (130)..(314): a, c, t, g, unknown or other
  modified_base (911)..(948): a, c, t, g, unknown or other
  modified_base (1031)..(1040): a, c, t, g, unknown or other
  modified_base (1698)..(1707): a, c, t, g, unknown or other
  modified_base (2251)..(2260): a, c, t, g, unknown or other
  modified_base (3339)..(3348): a, c, t, g, unknown or other
  modified_base (3543)..(3552): a, c, t, g, unknown or other
  modified_base (4005)..(4014): a, c, t, g, unknown or other
  modified_base (4769)..(4778): a, c, t, g, unknown or other
  modified_base (5098)..(5107): a, c, t, g, unknown or other
  modified_base (5633)..(5642): a, c, t, g, unknown or other
  modified_base (6330)..(6339): a, c, t, g, unknown or other
  modified_base (7203)..(7212): a, c, t, g, unknown or other
  modified_base (7624)..(7633): a, c, t, g, unknown or other
  modified_base (9617)..(9626): a, c, t, g, unknown or other
  modified_base (10885)..(10894): a, c, t, g, unknown or other
  modified_base (11024)..(11033): a, c, t, g, unknown or other
  modified_base (11650)..(11659): a, c, t, g, unknown or other
  modified_base (12235)..(12244): a, c, t, g, unknown or other
  modified_base (13376)..(13385): a, c, t, g, unknown or other
  modified_base (15511)..(15520): a, c, t, g, unknown or other
  modified_base (16413)..(16422): a, c, t, g, unknown or other
  modified_base (16884)..(16893): a, c, t, g, unknown or other
  modified_base (17095)..(17104): a, c, t, g, unknown or other
  modified_base (18501)..(18510): a, c, t, g, unknown or other
gccctcgccgcggcctccgaggccagcgcctcgcgctcctccgccgcgcgccggtcctcggcgccttgcgccacggccgccgccaggtcggcgcccagcgccgcattggctgtcgccaggcagcgcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggccgcctcgctttcttccttcacgccccgcatcgccgcctcgagctcgtccagccgcgcccgcagccgggcggcctccccgcgcgcagcctccgcctcgccccgtgcctcgcgtccccgcgccgcctcgccctccagcctcgcctcggcctcggccagagcggcccgcgccgccgccaggcgctcgtcaaggcggctgccctctgtctcagcgtcgcccagtgcgcggcgcaggccggcctcggtctcctgggcgcgggctgcctcgcgccgcgccgcgcgcagctccagctccagagccttggcctcccagatctcgccctcggcccctcccccggggctgcaccccaggcgctgcgcgaccgctgccagcgcctggcccaggtcccctggctcagcgccggcgcaacctcctcgcgcgggcgggggcggtggggcggggatggcgctggggctcgccgccccccgcatcgcgtccaccaccttctccagggcggcgatcttcgtccccggctgcgccacgccgttccaggggctcagcggacgggcggggggggcgggggaagggcccgccgccctgccggcggggggccgnnnnnnnnnnnnnnnnnnnnnnnnnnnnnnnnnnnnnnacgggatcctgggtcgtgcaatgcccgctaggtgattgcaagcattgtgcaaagccccagagcccgcatgatgtggccctgcnnnnnnnnnngcctccagcgcctcctgctgctgctgcaccacgtgcttcagctcggccgccacctgcatcctgcagtgggagaggggaggggagggtaagggaggggtcccgagcgggatgctgggtcgtgcaatgcccgtgcggtggttgcaagcattgtgcagagccccagagcccgcatgatgtggccctgcgcagcgcaccagtcctccagctgggactgggcctccatgcgcccaagctccgagcggtacaggcgagacgacacagcgctcgccagctcgctggagtctgtgggtgggcgcggagagtatattggagggagcatggacaaggtgcaatgggaaacgagaaccagtcatgcacttccggacaccacaaacgggacatcaactcaccttgggcattcttgatggctgtgagggggagggaggacacaaaggcctggacctccttcctgatcttgcggctgtcgggcaggagcccgcctcccgggctggggttgccgggactggcctccccacgcccgtgacgaacgtccatgctgcaccattgttgcgtggaggtaccttgagaacaatcccatgagcccctgaagcatcgatgaagcccgtggtcgggcccgcgggtgggaacgctctaaccaactcttcccacccccaacccnnnnnnnnnnatgaagcatcgatgaagcccgtggtcgcgaccgcgggtgggaatgctctaaccaactcttcccacccccaacccccggcaacctcctggaccccagtcacgcccgatagccacacagaacgcccccaacgcacctcttatctatgtttcgggaggatttcttacgtgggatggggacttccgccccagtccggcccgctttgccaaacatggggacgaggcccacccctcgcaggcagtcgctgcccactgccctcagatcatcagctcatgaaggcgcgatttcacgcgaaggattccagtcattcaacccaacacgctgtttggcaaagtggtggggctgggcggacgtttgcaaacccgattcgcagggcgggtttcgtcaatgaaatcaaattttgtactgtagctgggcgtcgtttccatctccgacgcgttttccgagtgggatcccgtgcacttttgcttggaactgcactcgcagcacttgatacaaggtggtcttgagattaacgtttcaatattccataacaagttcattccannnnnnnnnntatctctgacgcgttttcccagtgggatcccgttcacttttgcttgaaactgcactcgcagcgcttgatacaaggtggtcttgagattaaggtttcaatattccataacaagttcattccattacaatgtgggtttgcaggagctgtaagtactgactggcaactacattgaggagatcctcacccagacaaacccaattcccctttctggcaagacatgaggcaatttgcaagggcctgaaaagagaatagacacagacatgccatgcatgtcttaagacatggaacgagctgggaaggaagctgttcaaaaccgtccgagtggtaaattttgagaaagccttccaggatgctcgtgtttgggatggatgcctaaagtctgggcggcctctacgggagcgtggcatgagcagcgtgtgagacacagaacggcccaaataactctgtgcgtagtggaacaggtaggctcgctcagatgcatcacagcagactgtataccactgagtacgccatccagacatgacagcctaccatgcaccgccccaggagcatgcgcgaaccggccatgggcctcccatatctcaccttcggaggagagctgatatcgtcgacacattcctcaggtctgcttccgcagcacttgtttgatgtatctagagaagaggacttcttgggactcggtgaccgctgcctccagctttccgcgcagttcggagtcgataatcttttgcagccgcttattaggattcttccatggagcaaagttctccgggggccacctttgtaggctcttggccaattgcttcatcaggggtccccgctgcgtggccatcgcgtgtgacaagtgcaggcccctcgtaagcactgaagagaagcttcttgatactcaaaatctctgagttaaaaaatctgtggaaagtgtgggggcgcatataaaaggctctgttccgaatgcaataatctgccgtccacggcgagcgcgcacaaggtgttggcgggatcagcccgtgacgaacgacctcctcggttttccacagcaagaagtcatgtatagcgtccattaagaaacgcccattggnnnnnnnnnntgtgagctttgaaaagagcggccccaccaatgatgcacacgacaattgtcaccatcagccgatgttatacatgacctgagagcatccaaattccacgttctaggagtaaagaatatatattgcatcttccaggccgccctgaattactggaccttggtcccagtcctcacgacatgtccacatgtctcgaaacannnnnnnnnncgtgagctttgaaaagagcgtccccaccagtgatgccaacgacaattgtcaccatcagctgctgttatacatgacctgagagcatcaaaattccacgttctaggagtaaagaatatccattgcatcttccaggccgccctgtattactggaccttggtcccagccctcacgacatgtccacatgtctcgaaacactcccggggtccgactccctggagagccagtccccgccttccggtgggtctatgagacctgagtcatttggtgatgtgttgaggtctgcgactcgtggcttggaagagcatcccgtggcgcccaacctccgttcggagaggctgggagcaggtggaggccgtccaaaatgccaggtactgggctcgagaatcaagatggcccgcaggagtgcttgagtgatccccgatgtcctcggaagaccggtctttttagcaattnnnnnnnnnncggtggaggccgtccaaaatgccaggtagtgggctcgagaatcaagatggcctgcaggagtgcttgagtgatccccgacgtcctcggaagaccggtctttttagcaattcactgtgtgaccaccccctgcaaccgctccacctccatgttgccccctgcccaacgttcaccgctgcaacaccctttcattccttctccatgccgcagatcgtgctgtctcacagtccggccaagctgcacgggattcgggatgagaatgcccgcctggtgagccacctcacgctcaagccattggcaagtgcctctgccttccaggccgacattgccacgcatgacagggtgggtcctggagctcaccagatgattggagaactatgggcactttccagttcacttacgtgcctgctccacctgcaagttactgtgtccatggcacttgcctcctagctgtagtctcttcccaatcttctgtcagtcccatgcctgcaccctgggccttgccgagcctcctcaaacccagctcgaccttgatccaggtcctggactgggcgcagaccaattgtaccctccggcggctgcgcaccgagcgggaggtgctcgccgccaacctgcgcatgcaccgcaggatacaggtggggatggggagggagtacggcaggtgctctttgccggtatgccagggtctaacacattaaaacagtcttcggcccgttctgcaagcagaatgatacatcagaaccctcacgctgcgcttnnnnnnnnnnccatagcggtcttcggcccgctctgcaagcagtatgatacatcagaaccctcacgctgcgcttctcttgccccactcaggcgatcgccccctccagggacgtggtcaggaagcagcacgccgccgcctttgaagccagccgggctctggtctcccaaatctcggcggccaagtggggccctgcatgcacagcgggcaccaaaccgccgcagccggccccaatgatcgaccgacggcgtccttggaacgaccgatttccccattcccattcgtgattacttcccagccacgtcgcaagcgcccctgccacccaacgccatnnnnnnnnnngcgtaattacttcccagccatgtcgcaagcgcccctgccacccaacgtcatgcgccgtgatgccgtggtccttgccctgtgtcttcacttccagccttgtacacatggaacacatgctaacatctgcatcctaacacacattccagtggggacttccaatcattgctgctgcctgcttcagggcctccgccggtccagagcagccaggctcgcctcaaaccccttctcctgggtcacatctgccggggctttcccgccggagggagatcccgccccgggccaccagcctgggggaggctggggcggcggcatgaggttggccttcttcgcccgagacaccatggccagcgcaaagagggtgccggcgctgagcagtcccagggcgatcattgaccctcggtctcccagtttgcgtgacatggggcctggagggtggagtctgtcagaaggaagggcgaggaccaaggagcctattggcttcctgacgctcgtgcgagtggtaccctcggcctggagactgccaagnnnnnnnnnncgtcggaaggaagggcgaggaccaaggagcctagtggcttcctgacgctcgtgcaagtggtaccctcggcctggagactgccaagttctaaggaggtcagccctgagagttgtagcctcaggcctgccggtcgactgcagagtcgaagccctagggtagagcgggatcagaagacgcgggctgctaggctgacgatcttgagcatctgcttggcgcgcagctcatgggtcacgaatcccaagacgcgggtgccgatggggatgcccttggggttgaccaggacgcacgcgttgcggtcaaacttgatggtactgcacggagcaagggttgtgggaggagggggcgggtgtgagtacatctgcctgaacgggaggaggcgagtcaatcatcagtgcaccctccgtcatccagctgtgcacacacgctaccagtagagcatctcaaaggacacccttcccttgtgggtacttgccacgcccattgccccatgaccctcccacctgccgtcgggtcggcgcagctccttcttggtctccacaaccactgccttcacgacttgaccctgagaaagtgcagtgtgaggtaaccactcattctaaaagcaaatacaagcatgaatgatctcatgtgctgcatgatgcgcccggcaaaggtttggcctccttcgccctcctgggtgcccacctcnnnnnnnnnnttgcagtgtgaggtaatcactcattctaaaagcaaatataagcatgaatgatctcatgtgttgcatgatgcgcccggcaaaggtgtcgcctccttcgccctcctgggtgcccacctcccagacctcccacactatcgtcactcaccgggctgactttgctgttgcgaacgcccttcttgattgcgcaggtgatgatgtcgccgatggccgcgtaccggcccttgtgcttgatgcactccacctccttggccccgctgttgtcgctcacaaccaggcgggtgccgtcgataatcatgtgggcgtgctagaccccggacctgcctgctacctggtgattgaaggatgatacaattgatgtgacgatgtcttgtacgggctggtgtgtcatatgcgcgcgccctgtattcacgcacttagggtacctgaaattggtaccgcacatcctcgcccaccctggctatccatgacattctgcgaaacctcttcagattatgctggtccaatgcacctcttcatgagctgctgacgcccatcaccgagtgcaccatgggatgacagcctctgtgtctggcacctgagacatcagcgcagcgccaccccagacccatcccccgcaaccgcctcagccctcctccatgtcggtcttctcctcggcggcagctgctgctgcggccctggccctccgctgctccgccagccacgccgcgatctgggcctgcagctccggcatgggctccatgtccttctcggacatgggcactcggctgaaagggtcccgctggtcggtgagcaggtgctgcatgatcgtggcccggtccaggacgttcccgctcggcagcttgaccgggtcgcgcatcagcgtgnnnnnnnnnnggtggctcggtccaggacattcccgctgggcagcttgaccgggtcgcgcatcagcgtgcccagcaccgggtcctcgaattccggggggatgtcgtccagggcctgctcctccgcctccgcctccagccgcgcctgcaaggggtggagggagggacgggacttggtgagtgtgtcgggttggcagccatcagagggtgggaagggcacatgtagagtcggtgcgaggtccccgaagccttgcacgcccaggcaagttacagagattatgccctcccaagtccctcgcacctgatccacccgcttcgccaggctcctgaggtcggcgaggtcggcggcgggcagcgtcccgagtcggaccaacacctgagggggaggtgggaatggggactgagtgcattgccctatgatttannnnnnnnnnaccccaggcaagttacagagattatgcgctcccaaagtccctcgcacctgatccacccgtttcgccaggctcctgaggtcggcgaggtcggcggcgggcaacgtcccgagtcggaccagcacctgagggggaggtgggactggggactgagtgcattgccctatgattcacggatgggaccttgggacggcagcgctgcctggcgactcactgcagtggctccaagctccactcaaacatcgagagacatcctccactaagctccccactccttcattcccccgccccacccacacccctccgaccaccgcaaggcacctggtcgaggtacttgaagatgtcgggggcgttgcccaggtagtcggtgtcggccacgcatgcatccacccaggcagctgcgtcccggcggaacaggctgacgtggaggctggccagctgggctaccaggcggccggggtgccagttgtaccattccggctcccgaagcttcagcttgcgccgctcggagggcagggtgaggtacttgaggaagaagttgaggatgcgggcctgccggtcgcgcacctgcaggtcgaagtagagggaccccaccgcctcgtcggcctaatcggaggggggggggggggggggggggggggggctacggtgaggagtggcaacctgggatcagctcctgtgtatctcaggatggagcatcatgcgacacagatgccatcaggcggccacacgttgctctttgtcttgacatgggagctgatcctatagccaagtgcatccacccatttctagaggcagtgcagggaacccccaggtgcactgtctctcccacgcaccgcagtgtactgcatggtctggatgcacacggatgccaggtagaagtcactctgcgcgtgcggcgtgggagacagtcggcaggtcacgcttgctcctccaggcttgtccctgccctcacctcgggcatggaagatagcacccagaaacacaggggggggagatccttgatatagactctttccatgcaagcccggctgggattcatgaccaaccgccaactggaggtggcatgataccagttgcgagcaacagcaccccaccttgagcctgccgcggtcggtccggagctgctcctcgcgttccgtgcgctctgcgtccggcagcgcggcccaggccgcctcgtcctccatcgcacgctcgacctcctggacctgcgctggcggggaggcggccgggtgcaaaaaggcagactgctcaggcgcgcaggagggcccacgcccagcattttgtgcaaggccccaccctccgagcacagcagccagcggaccatcagggagcactgccgtggagtgatccactcaccttgggcagcgtctccagggcttcctgcagcaggaactgcgagtcgttgatcatcatgttgatgaagcgtacgtagatgtaggggtgctccttggcgaccccgcgccacgatgcttggtgctggagggggggagagcggggggatgaatgggtactcctttggagagcttgcagttgccaaaaggcaggtgtcaggaccacagggagtcgcggaggaccagcaatgaggaagcaggtcctgtcgcagcacagccttgtccaggcatggtcaagacgactcgcatgtgattgatgcaaacccatggccccagatctcagcatcccatcgcagctgcccattgccccctcacctgcgggagctgccataggtacgccatgatctccccaatctggtatcgtgtggtgaacttttcgtaaaaggtgttgtgccggtctgtcatctcgatgtccacatacagctgcaccaggctgtcgggggtgagaagcgcagggtgagggtcatgtgtgcgcaggggagatgtcgctcgcaccgaacccagggcctttccaggcatggggtgtctggcaaaagtcagggcctcaggagccgggcacgatgtgcggtggcgctgcagggcactccatgacnnnnnnnnnntgcactgaacccagggcctttcaggcatggggtgtctggcaggggtcagggccgcagaagccgggcacgacgtgcggtggcgctgcagggcactccatgacatgctggtcagccacccctccctttaagtctgccttgcacaggaccctcgagcccttcgcctggccaacaatgacccttgccaatatgtcactcaccaggcagcctccacccatgcccctgccggagcggcagttcaaacccacacccatacctcttcaccatgttgtcgagcaccagggggtgggcctggaagagggccgcaatctcggcgtgtgaggcctgggtgcgggggggggcgttgaaccccgaccccgggtcctcgttgggaggcatgagggcatgcagcacctccaccagccgccccctcaggtacgggttccggacgtaggcgggggaggcgaggcagaaggtgatgaagaccatcaggtcctccatgtcgccctgggccaggctggcggagcgctgggtctgggcgaccagaatgaggatgtccgccagcgactcgacccacgcctcctgcgcagggcgccggatgggaggtgggcccattcgtgggacttgacggcggctggcgcggaggcaaccgtctcaagccacccctgagcatcagatcaatcaaagccaggcgggcccagccttgtcatgcgacgccgcggtcaagcatgcaggccagacccacgaccagacgctcacgggcagctgccggaactccatgggcgggccttctacgagcggcagcgcgagggctcccccggcggcgaaggccgggcttgccagccgcatcatgtatgttgtcatcagcctggaggaggtgggaacctcaccacacgcttaatccgtgtgccgctgccgtttagaactactgctgcaaaaagccggaaccctgctgcttgccgccgtaaggcacgctaggcccccccaccacaattgatctgctggcaccaaagaaaaccttcccccataccctcgcacctgcagaaggacaggatgttgcccagcagcccggggtctaacagcagtgcctggtaggcggcgtccgaccccttgatcagctggatgatgcgctggtactgggtgatccgggagcggaccaggggatgcccagggaacctggagtgagggaggtgtccatgtaggcagagggtctgtaatttcgaaggtgattagccatgacagctcagcacgtctgggtactgcgagggaggctgacgctcagnnnnnnnnnnaaatctcagcacacgtttaatccgtgtgccgctgccgttcagaactactgctgcacaaggcaggaatccttctgcttgccgccgtaaaggcacgctgggccccccaccacaattgatctgctggcaccannnnnnnnnntggaggtgattagccatgacagctccgcacgcctgggtactgcgagggaggctgacgctcaggctcccccctttccgctccatgtttggcactcaagccatctgaaagacgagtcagggtgcaacacagggctggcctgcaccccagaaacccatccgagccatcgctcactctgccaggtgagcctccagctcggtgagcgcattctcatagtcgctgacgcgccggccgagggacctcaggttctcaatgcacttggcgtaccccaggcccaggcagcgcgccatgaggaagaaggcgtcgcacatgaagtggtacttgggtgcggtggggcgttgggagggccccgcagcaccagccttgtccctggagtgggagacatcagcccactccgtcgcccaggcgcggacctcctcccccgtagccgccaccctcgtctcgtcgaaagaaagcgggagacgggcctccggatcagacaggtacctggagcaggggagggaggggaggcagacgggggattgggatacaccacggagattggaggagggcttgcagggtgcctcgcaggcggtgtcctgccatacgacatcccatctcgttgtgggggttcatggtgnnnnnnnnnngggagactggaggagggcttgcagggtgccttgcaggcggtgtcctgccctacggcatcccatctcgttgtgggggttcatggtgaccctcgtgcaggccagccaccctcactgcatgcctaccgggcattcagctttggccacgctttggcactgctggcacccatgaagggcaggcacaggcggaccagcgtctgcatgagggagagtggacgatggcatgcatggttgaggggttcgcaaggctctggactgtgagcgcctccgtgacatgcatgctttgcactctcctcaaacatccctgacttgcaatgcaggcaccagtacccgcctggcacccagctcttccgacccaaactatgaatcccttctgcctacccccgtcaggttgatcataaatccatcggtggacgccaccttaaggtccgggtgcatctttgctcgctcagcattcacttgcacggccacggtgagccactggagtgttccctctttggtatcctgcgggcagtgatgcaaggggcgtctggtcagcacgtgccaggccatgccaggctgacctcgtcagctgcaccnnnnnnnnnnttcctgcgggcagtgatgcaaggggcgtttggtcagcacgtgtcagaccatgccaggctgacctcgtcagctgcacctctgacgccaacccatcggagttcccctcaatggacaccctgcccccattcttgaacccagcaggagcagcacggcacacaaagcatgcctggccgcgcaggaggttgaggaccagggagtgcagggcggtgtggagctggtcggaggctgcctgcagagtctgcaccccgctacggatgtcggcggggcgggcatctgagcccagggggaacagctcatccaccacgtttggcatgcgctgcttgcctggcacaactgctcaggggcaaggtgggtggggtgcaatggcacgatactcagtttgcctgtggttgaacaagtggggaagcctccagcatgggatccccagaaccggcccaacagacgacgcattgtgacatcgagcaatgcatcaccctgcccgggaattatctacgaggccctggccccaggacccaccgatgtctggtatcccgctgattccaaaggcggcacccagcagcgtcttcgcctccagctcccgcccattctgtgtccgggtgcacagagaatgagctaagacattcagtcactttgcatgtggctttgggagattctcctgataaggcatcttcagcccagctactatgtcactgcggccattagcctccagatcaacaattccccaggaagcacaggggcatctgcaatgtaggggatgtcacatctcatgatggcgcctcgtcaccgcgccccagcaaccctgctcaagcgcccagcagtcccatcatcagcgtcgcccaccatggatgagccacccgccactccccacaggggcagcgagagcaggcctgtgaccactgcccggctggaaaggaaggcctgcagcagtaccaagggcccttggaagtcggccaagagagatacggtcgagagtcggtcgatcagctcattggctgagggggaagaggaggaagtagactgggttggtgagtacgaattggtgctggggcatggccaggtgcagcgctcgccctccgggcacccccacctcacgcagaggcactcccagccagccgaccccgaggctctcacnnnnnnnnnngagaggagggagtagactgggttggtgagtatgaattggtgctggggcacggccaggtgcagcgctcgccttccgggcacccccacctcacgcagaggccctcccagccagccgaccccgaggctctcacccatcagcgtcaggatctcggtccagctttcttcctgctcctgggacacgaggtgggcggccaggtcgtccaggaaggccggcgggagcggggatgccccgccccgcggctcgggggtggagggcatggcagggcctggggtgaaggcgccggtactactcgacccccgacccactcccgcctgcagcccgtccatgagctgcagcgcgcccatgctctgcgccgccgccggctgcgagggtggggatgagggcatggaggtggggcgcaggagcggtcagaggcaggggcggcgccgaggcagactcgacagggagactgacatgcagaatgacactcgcacggccctgcgcctacctgcgggaacatctgcagggtcaggatgagggctgtgtaggacaccgtcagctccttggctaattccagcagcttgaccagcgcctgatccttcccacgcagctcgtctgtggtgggtggggacgggagtgaatgtagcagtgtcgggatggggtgcagttccctagggggagagtgtgtcgcataccgcccagtgaaatccctcgcttttggccttgatgtggagtccatcaccagcccgtcacacacctgaggcacggacgtagcagccgaccaggtaatgcactggccactgggggtatgtgggagggggcgcagccaggcgcgccatcagggccctttcgagggtgaggtcattcagctctggcgccgagccctctgtcaccagctcctgcagcgtaccatgattattgagtgtgagggcatgcaagctttccgagaacaacagacccagtgagaggtggcgtgcgctgcgtgacatccacgcgcctgagcaaggtcgctgagatacaccacagggggctgcatccctgttccagcctcagcgtcttctgctatgagggtgacgcgcaggaccctctcgagcgcggagttttcgacgtagtttgccatcatgtgggtcttgatccctcgcgtggtagatacgagcggggtattggcaactagccctcctcgggcgatcactccagaacgtgagagcccggcatcattggcccaaggctgacacggcaataggcaagcaccaaatatacaagttctgacgtcaatattctattctgcggatccccataggtcaagtgtgggtgctactgaaaatcttgcacccccaaccaggacaatcgagcgacgaaaggaagccatgcacagcatgaccgaaaatccaaacctcggcgcgccaggtgtccactcgtttaaaaatacggaggtactagggccaactccgacgtccctcacagcgcgacgataattcctacagcacctgaattcagttcagggtgtttttctaggcggtcctagctgcgctcccggcggtgggcccattcccctcgagccgcgagaggtcgccgccctgaattgcactcgcaacctcccgggccggccatggcccgcaccgactacacccgcttcagtccacagctgacggactctgatggtgaccatctcctgcgctcgcgcaacacgatgcgaggcggccgcaagcccgtcgcgactcccaacggaaagccttccgcaacccgcgcgtccggcgtgctgggcgccctcctgcagtccgtcaagtcggtgggtcgtcgggtgacctctcgagccaacaattccgcgcccggctcccagatcaccccccggcgcagcagcaagaggctggcccggggctcagccccggattgcccggacccccagcccgtcgggaccgtcatcgcgacccgcgcctcctcactgcggccccggatcgtggagcaggtggcccacggcagcgtcaccaggagcggcaagcgccgcacccgctcgccgccagccgagcggggcgggaaggggctggccggagcggaggccaccctccccagcgccgccaagcgtcggtgccgggccgtgcccctcacggcacgcgagagcgtccctgctgcgggcagggtcgcggagnnnnnnnnnncggccggagcggaggccaccctccccagcgctgccaagcgtcagtgccgggccgtgcacctgacagcgcgcgatagcgtccctgctgcgggcagggtcgcggagacagagctcagtccctttgccgaagcagcgcgagtcgaggagcccgggactcgcttgtccccggcagcgctcacggagggcctcctggacctcggcgagagcgcgtcgccctccacccccccaggcgtggcagacggggacggcgtcgccggccaggccgccgtccagccgatccccacagagcccccgcccacgacgccgacgagggcgtcggctgcccccagcgccgaggcgcaggagacgccctggcggcagggcctgctgccgtccctggaccggctgacgagcatcgggcccaagccctcccagtcggtgcgggactccatcctgaagagccccacacccccgcgccgggccacgatggccagcgccggaccccggatccggggcgtggtgcgcatgctggtgccgccccccgacctcgcgggcatggagtcggggagggagcctgcggaggagagcggcgccgcggcggggcccgcgaccagcgcgccggcctccctgcccgccggacccgaccaggagctgccgggcgaccaccggccacgagtggccgaggtggccgcgccggagcggcccagcgacagccctgcggccaacgggccggagactgcagggctcgtggccggctcgtcgggggaggtccctgccgtccctgccgtccctgccgtccctaccgtccctgcctccgcacagcccttccccacgtgcgatgatcaggcctggtgggacccccttaaccccgccaaggtgaggcatggggggaggttgggaagcctggaccaggcnnnnnnnnnngccgccgcacagcccttccccacgtgcgacgatcaggcctggtgggaccccctcgaccccgccaaggtgaggcgtggggggaggttgggaagcctggaccaggcctctcacccctggccagagtctcaacgccacccccaccgcactcccacccaggtccgtgcagccaaggcggcgctgcacgcctcagcggacgcgacgagcatgctcccgctgtgccgcgagcgacaggccgccgcggtcaccgactggatccgggagtgcctggagtctggcaccggcggctcctgctacctttcaggccccccgggcacgggtgaggggtccgggcgcacagccgggttgcagcgggtgcctgcctctgcgacgagaccggcccgcccggcgaatggatcccaaacacatgcgcgctgccgcccctcgcaggcaaaacgctgacggcacaggcgctcctgcgtggcnnnnnnnnnntgcccggcaaatgaatctcaaaaacatgcgcgctgccgcccctcgcaggcaagacgctgacggcacaggcgctcctgcgtggcgtgcacggcgagatcgcggcgggcaccttcctctcccggcccgaggagcccaggacagccggcccccggccgcagccgcccgccctcgtctccatcaactgcatgcgcctgtcggcctnnnnnnnnnntcgggacatccggcccccggccgcagccgcccgccctcatctccatcaactgcatgcgcctgtcggcctcggggcaggtggcgggccgcatcctggacgggctggcagttgcgagcagtggcgagcatgtcgccagcgtgtcaggcaagccgctggtgtatggtgtggggctggtcatcgcatgccgcatggcgctccgtgccgaccaggttctggtgtcgcaagggtgacctcagaaggcatggccatgctcgcaacgggctcgcgattctcttcacacctccccggcagtttcgcccagcccaacccccccactccgctgcaggcggtggagaccccctggtgctaccctccgggacagggaggtggacgggcgaggccgccctggccgaactgcgccgcgccgtggtttcccgtgaggacaccgtgtcgcaggaaagcgctgcgggacccctgccccatgccgcccgccgccaggtctccatcgtcctgctggatgagctggacgggctcctgcagggtgagtagcgtggaggggttgcctgcgatttgagagtcagcagctgggtacagtgaacgctcgcagccccgccctcccctatccgtgctgcgctgactccccccccgcacatgctcaccactgactgccccagggtcgcgaggcgaggccatggttgaggacctgtttgccctggcgcatgcgccgggctcgcggctcttgatcctgggcatcgctaacaccgtcgacctggtgcagcagctcctgcgccccggcgccgccttccacgtgagttttgagaggggtgcgaggtggagggggggaagggagggtgcaggacgaatgtctgggggaggggcgtgggaggaccaaagaatcatggctggtggggtggacaggctcagccatggcagagggccgcagcagctgatacatttctgagcggcagggtcatgcagtgcgaaggggcccgcctcctcgatcctgatcacatccagtgctatgcgtggggatgccccgtgctgccgatccctacccctgcgctgcccaggacaccacgatgacctttcgtcacccccccccctccaccccctccctatccctgcagcgccggaacatctttccccggcacgaggtgttccccgcctactccccgtccgcgctgacgtcgctgctgacccagcgcgccgagcgcctgcccggcccagtcttcgagcccagggtcctggagctgtgtgcacggaaggtgagggatcaagggttgtcccctggtcgctcgtcgtccgagggcccatggctggcccctgtttcggccaggctcgcgatgccgcatccacacactcgcccccggtccgcggcacccccagcgccacccctcacaaccgcccaccagtccccnnnnnnnnnnatgtcccctggtcgctcgtcgtccaagggcccgtggctggcccctgtttcggccaggctcgtgatgcagcatccgcacactcgcccccggtccgcggaacccccggttgccacccctcacaaccgcccaccagtccccaacccaccgccccacgcagatgggcaacggctgcggcgacatgcggcgggcactggaggcggccgccgcggcgctggaggcctg

SEQ ID NO: 46359 - DNA, 86 bp, Chlorella protothecoides
aggagcaccggccgaacgagtggcgggtcgcccttggggcactgacagcacagcacgggaccgcggcccctagggtagcatctcat

SEQ ID NO: 46360 - DNA, 115 bp, Chlorella protothecoides
ccaagatcctgacagggaggaagtgatgtgtcacaggctgtgctcacactccatccccgagtgccttatagaattcgcacgctgcgcccgcgcaggacatgcggcagaccctctg

SEQ ID NO: 46361 - DNA, 61 bp, Chlorella protothecoides
ggtgatggcggggaccaccgcagcagcaccagcagctcggaagggtgaattcctcaggtgg

SEQ ID NO: 46362 - DNA, 79 bp, Chlorella protothecoides
cggagcccagatcctgcaggacgaggagagcgaagtgtacgacttggagcgtcccatggaggatgcagggaagttcatc

SEQ ID NO: 46363 - DNA, 418 bp, Chlorella protothecoides
  modified_base (112)..(271): a, c, t, g, unknown or other
gcggccagcgcctgcgggtcgccgctgggcgcgccggcggagccggacaggcgcggcgtgggcacgctgccggagccgtgcgtggaggggggcggcgtgccgtccagcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggcgggggccgactgggcgagcagcggcgcgctgagtcgcgcggagcgcggcgcggggccgcccggcagcccctggtgctccaggtatggcagcaggggcggggccccggcgccggcgccgtgcgcggcgccgtgcgcgcgccag

SEQ ID NO: 46364 - DNA, 59679 bp, Chlorella protothecoides
  modified_base (489)..(498): a, c, t, g, unknown or other
  modified_base (817)..(826): a, c, t, g, unknown or other
  modified_base (2337)..(2451): a, c, t, g, unknown or other
  modified_base (3426)..(3435): a, c, t, g, unknown or other
  modified_base (3682)..(3703): a, c, t, g, unknown or other
  modified_base (3883)..(3892): a, c, t, g, unknown or other
  modified_base (4741)..(4750): a, c, t, g, unknown or other
  modified_base (5011)..(5020): a, c, t, g, unknown or other
  modified_base (6847)..(6856): a, c, t, g, unknown or other
  modified_base (7956)..(7965): a, c, t, g, unknown or other
  modified_base (8416)..(8425): a, c, t, g, unknown or other
  modified_base (8695)..(8704): a, c, t, g, unknown or other
  modified_base (9483)..(9492): a, c, t, g, unknown or other
  modified_base (11498)..(11507): a, c, t, g, unknown or other
  modified_base (12550)..(12559): a, c, t, g, unknown or other
  modified_base (13199)..(13208): a, c, t, g, unknown or other
  modified_base (13568)..(13577): a, c, t, g, unknown or other
  modified_base (14247)..(14256): a, c, t, g, unknown or other
  modified_base (14408)..(14417): a, c, t, g, unknown or other
  modified_base (14640)..(14649): a, c, t, g, unknown or other
  modified_base (15121)..(15130): a, c, t, g, unknown or other
  modified_base (15968)..(15977): a, c, t, g, unknown or other
  modified_base (16604)..(16613): a, c, t, g, unknown or other
  modified_base (17064)..(17073): a, c, t, g, unknown or other
  modified_base (17127)..(17136): a, c, t, g, unknown or other
  modified_base (17213)..(17279): a, c, t, g, unknown or other
  modified_base (17503)..(17512): a, c, t, g, unknown or other
  modified_base (18483)..(18492): a, c, t, g, unknown or other
  modified_base (18963)..(18972): a, c, t, g, unknown or other
  modified_base (19511)..(19520): a, c, t, g, unknown or other
  modified_base (19807)..(19816): a, c, t, g, unknown or other
  modified_base (20551)..(20560): a, c, t, g, unknown or other
  modified_base (23215)..(23224): a, c, t, g, unknown or other
  modified_base (23742)..(23751): a, c, t, g, unknown or other
  modified_base (24848)..(24857): a, c, t, g, unknown or other
  modified_base (25695)..(25704): a, c, t, g, unknown or other
  modified_base (26360)..(26369): a, c, t, g, unknown or other
  modified_base (26437)..(26465): a, c, t, g, unknown or other
  modified_base (27055)..(27064): a, c, t, g, unknown or other
  modified_base (27275)..(27284): a, c, t, g, unknown or other
  modified_base (27764)..(27773): a, c, t, g, unknown or other
  modified_base (28983)..(28992): a, c, t, g, unknown or other
  modified_base (29553)..(29562): a, c, t, g, unknown or other
  modified_base (29837)..(29846): a, c, t, g, unknown or other
  modified_base (30609)..(30618): a, c, t, g, unknown or other
  modified_base (41081)..(41090): a, c, t, g, unknown or other
  modified_base (42047)..(42056): a, c, t, g, unknown or other
  modified_base (42276)..(42285): a, c, t, g, unknown or other
  modified_base (42743)..(42752): a, c, t, g, unknown or other
  modified_base (43181)..(43190): a, c, t, g, unknown or other
  modified_base (43877)..(43886): a, c, t, g, unknown or other
  modified_base (44352)..(44361): a, c, t, g, unknown or other
  modified_base (45028)..(45037): a, c, t, g, unknown or other
  modified_base (45530)..(45539): a, c, t, g, unknown or other
  modified_base (49091)..(49100): a, c, t, g, unknown or other
  modified_base (50276)..(50285): a, c, t, g, unknown or other
  modified_base (50556)..(50565): a, c, t, g, unknown or other
  modified_base (50983)..(50992): a, c, t, g, unknown or other
  modified_base (51400)..(51409): a, c, t, g, unknown or other
  modified_base (51525)..(51750): a, c, t, g, unknown or other
  modified_base (51853)..(51881): a, c, t, g, unknown or other
  modified_base (51974)..(51983): a, c, t, g, unknown or other
  modified_base (52495)..(52504): a, c, t, g, unknown or other
  modified_base (52726)..(52735): a, c, t, g, unknown or other
  modified_base (53020)..(53029): a, c, t, g, unknown or other
  modified_base (53213)..(53222): a, c, t, g, unknown or other
  modified_base (53953)..(53962): a, c, t, g, unknown or other
  modified_base (54305)..(54314): a, c, t, g, unknown or other
  modified_base (56030)..(56039): a, c, t, g, unknown or other
  modified_base (56765)..(56847): a, c, t, g, unknown or other
  modified_base (56975)..(56984): a, c, t, g, unknown or other
  modified_base (58106)..(58115): a, c, t, g, unknown or other
  modified_base (58679)..(58688): a, c, t, g, unknown or other
  modified_base (58801)..(58810): a, c, t, g, unknown or other
  modified_base (59189)..(59198): a, c, t, g, unknown or other
cgccgcgcggcctgcgccgaccgtggacggcgaccgcgccggcgcggcggcggccacgtcgggggccgccccaggcactgcgccgtcgccctttctggaggcggactcaccacggtgcatgacctcccgcgaccgcatctcctcccatgtgccccccgccgccggcgcggcggccatcactccggaggccacggggcacgcgggtgcggtgacggcgctggccgccagcggcgaggtgctcttctccgcctctgcagactccaccatccgggtctggcgcctgccgaacctgacccacgagcgcgtcctgcgcggccacaggtcggtggggtggttcttggaggggtatgttgcccggagggaggtgtgggggagaggctggaagtctgtgcgggaggagaaggagggtgttttactaggtatctgtttgggtgggacagaggatctgggatccaagcgaagagactggcgaaagaggggtggtcagannnnnnnnnnatgggttctagaggggtatgttgcccggcgggaggtgtgggggagaggcttgaagtctgtgcgggaggagaaggagggcgttttactaggtatctgtgtgggtgggatagaggatatgggatccaagtgaagagactggcgaaagaggggtggtcagagtgggagatcctgggacagaagcccaggccagggatcgctggtggcgaggttgggcccactcgcagaatcgctgagcttctggcttcgagaagtactgacgctgacggccctcctgagagtcctccatatccccctcttgacgagcctccgcacccagtcnnnnnnnnnntccgctcccagaatcgccgagcttctggcttggagaagtactgacgctgacggccctcgtgagagtcctccatcccccctcttgacgagcctccgcacccagtcatcatactccacctcttctgtcctttgctctctcgacgctcaggggctccgtgctggcgctgcacctggcgggcggcgtgctgctgagcggcgggcgggacgcggtgatccgcgtctgggattgcggcacgctggtctgccggcgcacgctgcccggccaccgcggcgacgtgctggcgctgaccagcgtgggcatcgccgtccccgccggcggggcgggggagtacgcagacctgctgtcccccggcctggcctcccccctggccagcgccgccgacatcagccccgccaactccctgtttctaggtgcggggggcgtcggggccggcaacggcatcggcaacgcagggagcaccacgtccaaccttcaccgccgccagccgctgctgtacgccagcgccagcgccgatggctgcgtccggctctgggacgcggccacctttgcctgcctgcgcgtgctggggggcggccccggcgcctcccctgtcatggcctgcgcgctgaccgagacacatgccgccgcggccctgccggacggcgtcattcgcctctatgcctgcgacgacctattcgtggccgccgccgggcgggcgctgggcgtgcccgtcgaggcggaggagccggggaggggcggggttgaggccaggactcggcgggggcagggcgccgcgcccaagcccgaggcgggggacgtggtcaccaagatggagagggagctggagcgcgcactgcgcaccttcatccggctcaggtgggaggaacggagggagaggaaggatctggcgtccaaaggaggaggttggctgtgagtggatggcccagggaccagcggccggctgctgcggccgcggccaccgctggtagtgacgtggaggcctagatgcctgggcatggctcgggtgttcaaacaccagtccacaccagtccccgtcatcaaagcccaccccaaacacacgccaccaggaccatctccgtcgaccccagcaagtcggaggactgcttccggggcgccaagttcctgcaccgcctgctggaggggctgggcgccgaggtcaaactggtgcagcccatggaggggaagaacccgctggtcatcgccaggctggggcgctgccccaccaagcccaccgtcaccttttatggtgggatgggggttgggggatgtgtggtgaaggtgcagcaagatgcaggctcactgtactgtgtacggcagcagcgttccgtgtgcccgtaaccccgacgccatcctggttcccattttgtatgtcgcaatccaaaggacaccccccgcgacccccttccaccaccactacaatcacccccgcaggtcactacgatgtgcagccggcgctggagccggagtggcagaccgacccctttgagctctcctccatcgatggccacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgagctgccggtcaacgtcgccttcctcattgagggtgggagtgaaggggggggagggtgttatcgtaggggggggagggtgttatcttggcgggggagcatggcccacgtggccatgtcccaacgtttggatctctgcaggccgcctcctgcagtcacctggctggtgtttcgggacacgaggtgccgggcgctgggcctcacctgtctccaccagcgccacgctgcgtgccaccacccggccccctgtccctctgctcactcctctgcccagcgccggctccacggacccccctccccccgacccaaaccccaggcgaggaggaaaacgggtccaccggcttccacgaggcggtgtccgcccacctgggctggttcgagggctcccagatcgtcatcatctccaacacgctgtgggtgggggaacgcgtgccgtgcctgacctacggcatgcgcggcatgatcagcgcgtccatcgaggtgcatggcccggcgcgtgacctgcactccggcaacgagggcggcgtgttcagcgagcccctggcggacctgaccaaggtcctggcctcgctggtggacgcgcgggccaacatcctggtcccaggcttctacgacgcggtgcgccccggcatgctagacgcggcgatgcgccgcctccctgcctcccacgagttcagcctggagggctaccgcgcccagatcggggtgcggcgcctgaccgcggggcgcagcgagtgggacctgctggccgcgcgctggtgcctgcccagcctgtcggtggtggacgtgcgggtggggtcgggggacgaccccgcgcgctccgcgcactaccgcttcggccccacccgcttctccgtcatcccccgcgccgccgtgggccaggtggccatccgcttcgtccccgcgcagcgacccgagagcctggtggagcacctgagggcccacgtcgcccacgagttcgccaagctgcggnnnnnnnnnnccccgagcgcctggtggagcatctgagggctcacgtcgcccacgagttcgccaagctgcggacagggaacgagattgcggtcaaggtgcactccatcggcgactggtgggaggcggacgaggcctcgccctacaccaagctggccgagcgagtggtgcaggaggagtggagtaccacccccctgctcgtcagagaaggtgaggcttgtggggtggttacgatgggaaaggggggggggggggggggnnnnnnnnnnnnnnnnnnnnnngatccttgttctccgtgtgtgctggggtcctcgagctgggggaggaacatctcctcccgaccagctgagcccggagtgcaccatcacaagcaaggatgggggaacagggactggggcaaggaatactttgttcccttcctcctctcctctggcccgccgcaagtgtgcgcgccagcgccnnnnnnnnnncgcaaggatgggggaacagggacaggggcaagggatactcctttcccttcctcctctcctttggcccgccgcaagtgtgcgcgccagcgccacctcacgagcgacgcccgccggtgctgaccaggtccctccaccctcgctcaccgctgtgcaggtgggaccatgcccgtggcgagaaagctggaaaaaatgctgggcgcgccggtgctcatgctgcccatgggccagtcctccgacaactgccacctggcgaacgagcgcatccagcgcgtcaacctgctgcgcgggaagaacgtggtcaagcgcctgctcatggaggcgccccgcgccaaggccgcgcagtgaagccggggcgcaaagtgccccaccgcccgcctcgactctgtgagaccccgcaagcacagtgtgccctgacatgcttgcagcgggagagtgggctgtcaagaggtattgtagacctgtggtaccccacacactaatcaagagcccgccaaggccccaaagagtcggcgatcttcttggtcaatggtccggacgagtgggggaaagggcgcgatgactctagtatacgtcatgcgcaaatccccggtgcccgcagggtagccgtgcttgcaccgcgagggaaaacagaaactgttatcgttatttgtgtgatttgtatccaggattagggcagcacccaggccgccgtcgtataggactgctttccaacctggggtttccctacgttcggcaagcgggcctcgctgtactctcccatgaccgcgtgcacagtcgaggtgtggcgtcgatgagatcaaagactcttacttcctctttacggggcctctcaccgcccgtatgccggcnnnnnnnnnntgtataggactcctttccaacctggggtttccccacgttcggcaagcgggcctcgctgtactcttccatgaccacgtgcacagtcgaggtggggcgtcgatgagatcaaagactcgtactccctctgtacggggcctctcaccgcccgtatgccggctgtgattccgctgtcggagcagggagccaggcagggcccacaccgggtggcatgggccgtgagcccagcagccgcgccctgcgcgagccccactccaccttcgnnnnnnnnnntggggccatgggccctgagcccagcagctgcgccctgcgcgagccccactccaccttcgagggtccggggcgggcggggagcaagtacgacttcgtgaaggtccgtgtctggctgggagaggaccaggcgcactggtacacgctctcccgcttcctcatcagcagaaccctgacagtgacacagatccccgccgacaaggtgagaggcatgtcttggcattgttgcagccaggaatagtctgtaggagtgcctatgccttcatcaggcctgcaggtgggagggaagtgccgtcccagagcaggcacgtgcatcgggggcgcttcccctcttctaaagctgcacctgcccactcccatgcaggccgtccggattgccctggccgtgaagaaggacctggtggaccgcgggaggctggaggtgtcgcaggaggagctggaaagcgcgctcacctccgccctggcaatccatggcgtgggcgcacaccacctgccccgctaccgcacggtctccgccttctttcagcgccgagcgccactcatcatcctgctctgcggcaccgcttgcactggtgagaaactgaaagggaaagcgtcgctacgcatgcatgtgggcatggccgccatcacactgtgttgcagactgctgtgcctcgtgtcagcctctcggctatgcattccccagaatatttctgaagtcgtccatcctatgctccactcttaccccattcatggccccttgcctccctcctttgttttatgatgcagggaagtccacaatcgcgcagctgcttgcttctcggctgaacctgcctaacgtgctgcagactgacctcctgatggaggtgggacatgctgttcgtttatctcggatccctgctgctcgatgcgcgccgatccggcctaaaagcaccattcatgccttcatgccacctattaaacgaatccctctgcacctcacccctgcccagttctttcggggcagcgaggtcgtccccgctcagccctctgtctggcacgccgaggacgaggaggcgttggtgtctaggttccaggcccagagccgccaagtgcggcgggggctgtccggcgacttgcacaaggtgggcaggagtgtgacgtgtggcaacctgctgtccccgcaggatggcccttggctgagtacatccgatgcatggccggcactcctgacacacgggcacctcccttcctctgcaagtgcattgaggagggcaagtcgatcatcatagaggggtgccaccttgaccccagcctgtatttgaacgagtttggggcggcggcggtgcttgaggacgcacaggtggggcaggtggaccttggtgacccagccacgactcggagatgagtgagcctgcttgctccaggtcacatcgtcggctcgcagagcgtgtcgccttccgcagtggcccatgccgctgcatgtgatgggagggctctccacctgcccacctcacacgttcccctttccactctctgcagatctgcctggcttcggggcgcacatccagagcagacagctccgactcagggtcctcgcagggaccgggccgcatgcaagcccgctcctccttcgagtccctggcagcagcggcccggtcctctccctctctcctcttcatccccgtgatcctctgggtcgatgagaaggagcaccacctgctcatgggtggagaggccggggtgccagggggaaccgttggcgccccaggcatcgcgctgcaggcggcgtggctccagcgctacctcctccgtttccaggcgaggggggttcccctgcaccgcgtcaggccgggtgccttccaggagacnnnnnnnnnncggcgccccaggcaccgcactgcaggcggcgtggctccagcgatacctcctccgcttccaggcgaggggggttcccctgctccgcgtcaggccgggtgccttccaggagactgtgcaggcactgcacagccacgtgctcgactccatagaagcagctggcaaggagtaggggttgcagggcacaggggccgctgccgtccagcgccctgcccctcgcatgcccaggagcagcgagagtgtgctgaatgtagagggatgagtggtcagtgagcataccaacccgatgtaggcccatagatgtaaaacgcaaggcagacactgcggcggtcagagcgccttcaccacaacaaggaccccgtacggacgctcccagctgacgtcagccccaccgaggaagttttgccgacgcgcttgacccccaaaaatggaagacatttcgtgtcggggcgagctgttgcattctttgcacatcccctatgcaaattcgcacatcatgggggacttcagtgagagcaaggcgagccgggaagaggccgagttgcgggccccgttcgtacgcaacgatcggttcggggaattcggcatgggcaacctccctacctgcctgaaggctgtgctggtgctggaatccatcttcatccttccattccgagctgtggggtccttcctgtgcctcttcctctactggctggtgtgtaggctgtccagcccactccctcctcagcaccgagccgctatcgtggtgcccatgggcaagctggcctgccgatcctgcctcttctgcatcggtttcttcaaggtcgagtgggtcctggatccagctgccggacaggggccgcgagccggaggcatagtgagcaatcactgcagctgggctgacatcctgctgcacatgtcccactccttccccgctttcgtggcccgggactcgaccgccaacctccccttcatcggcatcatcaggtgtggggggtgacgtggtgggtagcattgcaacctggccccggacaggagacatgatttgtttcaggaaattcatgcctcagtgttcatgatgatgagaatgcttttgccaatctgagcgccgtccccctctcccnnnnnnnnnntacatgatttgtttcaggatattcatgcctcagtgtccatgatgatgagaatgctcttgccaatctgagcgccgtccccctctcccgccctgcagccaaatgatgagctgtttgtacgtgaacaggaacaggactggacgcaaccaagctgtgagtttaggagttgaggctctgctggctgtgtgttccctcatgaagactgcagcccatacccttgctgtcacagcggcggcgctgactgtcctctcccacctccgtctgggctgcgcagggtgtagcagacctggtgaagcaaaggatggaggatgaagctgcgggaaggacgggcgtggagaagcgtccgctcctcctgttcccggaggtgtgaggggggggccttgactggaaatgggaatgctcaggcatcactacagcccgccgcatgaccaagggccgctggtggcgggcatannnnnnnnnntgtggggggggggttgactggaagtgggaatgctcaggcatcactacagccccccacatgaccaagggccgctggtggcgggcatagcctcatgcatggctggctctgcactgtcatgatctcacctcgcaccccatgctgccacatcattctgacattgctctcgacagggaacgacgagcaatggggaatacatgctgcccttcaagaccggggccttcctggctggagtgcccgtgcaacccgtcgttatcaagtaccacagggtgnnnnnnnnnncatgctgccacatcattccgacattgcgcttgacagggaacgacgagcaatggggagtacatgctgccctttaagaccggggccttcctggctggggtgcctgttcaacccgtcgttatcaagtaccacagggtgagccgggacctaggttcagggttccgtgatacagtgcaatcgtgggagcgagtgcttttgctggaaaggtcatctctgtgctttaaaattgatatcattcacccacaatggggtcattgcagggcacaatctggcccacatgggagactattccccccctccgccatctcttcctgcttttgtgccacccccggcactctgtgaccttcctcgaggtaagggagggctgtggggtggtggtgcggggtcctgaaacgagaaagggcagagtctgatgcttgtaggcaaccgtgccattcccggggctgctgctgagacctttgagtacttccaaaaggctcaaaggacacagaagtccaggatcattcaagatctctacaccttcctctttacactacagctgcctgtctatgtacctaacgaggcggagaaggccgaccccaagctgtatgctgacaatgtccgcaagatgatggtgaggagcagcagaggggtgtctaaatgtatgtgtctgttggagctgcaaatccatggacagtctgcatccctcctcgatggggtgttctcctgatgcctagtaagcttttacactcccaattcatgtcgccgctcctgcaccatgttacggttccacatccctttannnnnnnnnnctctcctgatgcctcgtaagctattacactcccagttcatggcgccgttcgtgcaccatgttacggttccacatccctttacgacaccccacccattgccccagatggagcactcagggactaaggacacccgcgcgacctttgaggacaagatgaggtacctgaccatgttgaaaaaacagtatggaaaggccttgcccaagaaatccgaatgatgctgcctcctccattcgcagcaggcaccctgctcctagcacccaatcgatgtacttgctgagctttacttgtacgtcctctccatccttatgccatcacacgcttctgagggcaccatgaattcccgctgtctgagcacttgccgcttgtgaacactgttcaaggatcttcgggaggttttgagatggcgcctagtcagtcgcagcaggtacagcatgaccatgtgcccgacacgacagatgcacggaggaacattgcactcggcgatcaatactccaccgcatgtcagccatcgcatggtgtgttgattcatacatccacgccagggaggagaggtggaggcctgtcgtcagagaatcggcccatcacacgccctccagcacccaccccgatgggtacgccatggattggacctcgaaagttggtatcgacacattgatgataaactatcacccctgatattcaagaccacatcatgcaggcgccacgaggtccaggacctcggccaggcctggtggaggggtttgggctggcttcctggcgccatcccccagcaagcgctggaccgagctcttcttcctcgcctacagccccgtgtggatcacatgggtgctcttcatactggtgcccttcaagctgtatgaggtgggtggacgacaggggccacggcgcatgccatggtccctgccgagcagcacatttgaggacggtgacccacctcgctctttccacctcgttctgtgcagggcctcggggagtggggctacatggcaattggcctggcggcagccctgcccgtcttcctgctgccgcccttgctccagcccaagcacgaggcgggcaagccctgggtccagcgctactgggtcaaggccaacatctggattgccatcttcagctttgtggggaactacgtctggacccactacttttaccaagtgctgggcgcagcctataccttcaaggcccacgaactgaatggggtgagatgatgggggggtcctccctgaggaagcagctctgacctgtagtaaagactgaaatgagaagatctcatgcctgcagatgtgggcatcaaagcgcaccaaagtccccagcctcagtgacccctcccccacccacctgcacacccgagcccaggtgcccatcacgctctacttcatgacgcatgcctactttgcgctctaccacgccctggccaacgtgctgataaggaaagcacggagcatggtgggcccgagaagtccaaacctgcgtatcctggccgaggcagtggtggtcttcgtgctcgcctactccaccgcctacgcggaaacgctgaccatatcacacttcccttactacacgcacaaggcaggagttgggaatgggaggggaagataagggccttggcaagactgtgtgaggttgacgcatgccagggagccactgcagacccatgctcccaccgcatgctgatcgaaacaaatctccctccctgcaggacaaggagcgcatgtacaccgtgggctccctcttctacgccatctactttttcgtctccttccccatgttcttccgcatggatgaagacccaaaggcaaggcacatgggtgtaggaggtgctgagtgctggacagtgggccttaggtaccaatctctgaagggatggtcagggtccgttgatgcttggcgtggtggactccctctttacactctctttccaatcatcccccgcgtgccccaaaccccccaggccaagccatacacgctgtggaaagtggttgtggattccctggctgcatgcatgnnnnnnnnnnacttggcacggtggactccttctttacactctctttccaatcatcccccacgtgccccacccaccccaggccaagccatacacgctgtggagggtggttgtggattccctggctgcatgcatgctggtcaccctcctcctcgacttctggaggctggccgtgacagcacagccgggccttccctggctggcctgagcaggctggcttgtcttagtttggtggcttacaatgaaacagatcatgttaaaccacaccttggatcagaagagggtagcaagtgacatgctgggccagggcggcagagcacactggtcccgggctgggggcggccttcatggcaagcattagaggcgcacggcccttcgcagctccccctcaacaacgctcttggctcagtggatgcccagcagcgtgcgcacgtgggcgggcgtgtgcttgaccgccgcggccacctctgccgggtagtagccgctggcaggcgagtgcaacgcctcatacacgctggcatgggcatcggccaccgtcacgttgacgcggtggatcagctcttcccgcgcccgcggcaactggaagggaggaaggaggggagcgcagtggctgggatgtatgattggcgcatgccatcgtagagagcggggacagacaggaggggcaggagatggagtaaaacgtaggcacctgtgatcttcgcgccgcctgccacccacaatccatcacctggagcttgaggaactctggcagcacgtctggcgcggacaggcggccaaagaagacccgcagcgcgtcggccacggccggcagcgacaggcccgtcgcctgggacaggggcgtcgcgtcggtgccatccccaccggccccggtctgtgtggggtgagaggcgtgttgactcttggatctcttacttgtgcggccgatctatccaggaacacgagcatacacggcagcagcatccgcttacgaatggcagtgcagcatacctggcctggtcttccagcgagcaaacacaagatccattccctgccttcctcaaagcagacggcccnnnnnnnnnnccctggcctggtcttccagtgagcaaacacaggatctattccctgccttcctcaaagcagacggcccctacctggtgcagtttgatgcgcgcggccacctctgccagcccgcaccgcgccagcacgcgcgctgactcagcctccaccagctccgacaggtggtccgccagctgcagcctgtcgggattgggagcggacgtggtatgcaacgaggccgacgcatcaccaggtgctgcagagcacattccctccctcaatcttcgtccatgcatccgatctgcacctccatccatctaaacccctcgtctgccccatcaactccccacctgattctggccgccaggccctcggcacatgccgccccttccagctgggacaggagtagggccaggcagttgatgaggtagatgccgcggtcagaggggtccaggtgggcaccctcgtccagcctgaggagcaaagggcgcgggtaagcagtgccacaagcgtcgctcaacattccgaggcatgtgaaaggctgggaggccgtgcacagtgaagcctgcacccatgctgaccctcaccggttcttccgggcaccctcacaatgactccccctgcctccaggagcccacaccccgccccacctggaggaggcgtnnnnnnnnnnttctgcacccatgctgaccctcaccggttctccctggcaccctcggactccccctgcctctagggacccacaccccgccccacctggaggaggcgttggggtccagggcctccgagctgcgctcgatgctgtccagcagcggctccgccgcggcggccagcagggcctcgaagtcggcgccggccgaggcactggccggatcgagggcggcgtcgtggcaggccaccagctctgccagcatggcggcacccttcaccagctgcagagggatggtggttttgacggcggggtgacatgggagggtccagcaatcaccatacccaccgcatgtacccccagcgcagccgcgaaagatctgcnnnnnnnnnnttgacatgggaggttccagcaatcaccgtacccaccgcaagtacccccagcgcagccgcgaaagatctgccccgcacctgctgtggtggcaggaggtccttgggcgggaccagcgggtaccgcgcggacttgtccttgcgctggcgcagctgctccctgaaggcacgcagggcgagggccctcaccgaagaaagcgtttctgaccagggacgggaagcgtgcaaggggaggggtccatggtcaggggcatcagcaagggcaggtctgggcacctctggcgctggccaggaacggcagccgggcatgcggagcgcaagagacgctcgcaacacagcaaccctcccaagacacccacctgccaggctgctttggggccccaggagcttggagaccgtggccaggtagaaggtgaggacctggcccacccagaagcacagcactggggcggggccggacaggaggcactgctccagtcggacctgtcgggacgggatggtcgaggcggcgaagtcgagggggtgtctcagcgcggtgcacgattttgcgatgtgagatctgcgacgttgtacgcaattgctcgtaggctccagaggatggtgccgcatgcgcggggcaggtgtgcacagcctcaggcgtcacgccttgccatcccctgggcatcctggcgatnnnnnnnnnnctgtctcagcgcggtgcccgattttgcgatatgaagtctgcgacgctgtacgcaattgctcgtaggctccagaggatggtgccgcatgcacagggcatctgtgcacagccccgggcgccatgccttgccatcccctgggcatcctggcgatnnnnnnnnnnagcccgcccaccttgagcgggcggcagatgctctcaaacaccttgtccagaacgcgctggagtgtgggcacggtgccatcagtcgtagtggcagcacctgtcgcctcgggtgccccgcctgccgcttccctggccccgctcgcctggccagccgcgcccgccgccgcatcactccctgcgccagccgcgtcccccgccgccgcctcgccgtcgccgaagagcnnnnnnnnnnggcttgcccaccttgagcgggcggcaggtgctcccaaacaccttgtccagaacacgtcggagtgtgggcaccgtgccatcggtcgtagcggcagcacctgtcgcctcaggtgccccgcctgccgcttccctgtccccgctcgcctggccagccgcgcccgccgccgcgtcgttccctgcgcccgccgcatttcccgccgccgcctcgccgtcgccgaagagcgagccgaggaactccgcctccagctcgagggccgcgtgcagccaggccagcatgtcccccacgtaccgccgcgtatcgccggcctgcatctcgatgggccgcggcccctgggtcagcgcctgtggtgtgggatgcagacgcagggtggggaaccgtgccgagggggggacggtcatgcagtcagcggcagatgtgcatgccgctccgcccgcgtcgccacacagtctgtcctggcagcgagaccctcgcnnnnnnnnnntgacgcagggtggggaaccgtgccgagggggttacggtcctgcagtcagcagcagatgtgcatgccgctccgcccgcgacgccgcacagtctgtcctggcagcgagaccctcgcacgctgcgcctgaacatgcatgaaccaacccctcttgcgtgcacccccgaccccagcaaccttgatgaagcgctggaagaggccggcgtgccgcgcgtgcgccacctcgtccatgcagtaggccaggagcacggggcggtcgcgcagcgcggccacggcgcgggccaggcccgggtccacctccagcgcgtcggcctcggccaggccggcggcgcggcgccgcacccagcggcacagccgctcgtaggccgcctcctgcagccccgccatgctttccatcagctccagtcccgcgcgctggtgctggccgcacatcagtgcgcggcagttgtcgtggatggcccgcacgtgctgcagggcgccgaagaagtcggggcctacgtcctcaccctgggggagcaaaagggtgggggagggtgttggttcccaagggtcgcagcaaagtgctgccctgccgcacagcggcgagggcagaggtcaggtgctgatggcgcagatgcgtctgcacaaaggacagcccccttcaaaccctccctcattctgatgttggcgctgcaggctgagtcagggcatgtgacgcgtcaaggcagaggccgccagggatcatgcatgacctcaggcgccacccccccacaccagcgcatcatcatctccttgttactcacgacaccaaccccaacccttcagtcgccaacctgggtgagcacggcctgctcggcggggnnnnnnnnnnaccagggatgatgcatgacctcaggcgccatgcccccacaccagcgcatcatcatctccttattactcacgacaccccacccccccctcagtcgccgacctgggtgagcacggcctgctcggcggggctcagctggtactcctgcaggaagagggccagggagacggagcgctgccgcgcagcctccagctggcgccgcaggccgcggtgctcggccagcaggcccgcgctggaggcgcgcgtggtggccagtgtgtcctgcgccgcgcggcaggccagccccaggccgtccaggccggcgtgcacggcgtccagcgcgcccagcaccccctccaggccggcgtggaaggcggtggcagcctccaggccggagttgtcgatggtggagcgcagtcctcgccgggctgcgggggtgttctcggggtacaggtcgctcagggactccaggcaggcgcgcaggtcgggggtgtccgtccgggtgtccaggatctggcggtagggggggcactcggcgttgcccggtgcacagcagatgcggtgatccaggagctaagatctcgagccagcaatgtgatgatctgtcataacccttgttaatcgaatgaaaagtcccaccgcacaccttcnnnnnnnnnntgttgcccggtgcacagcagatccggtgatccaggagctaaaatctcgagccagcaatgtgatgatctgtaatcacccttgttgatcgaatgaaaagtcccaccgcacaccttcttgaccttccggcttatgccgggtgccgtggccgggaccgccatgagtcggtgttgcagttcacacgattgcaaggagcggcatcaggattgatttgagagctcaggatactacagaatctaataagttgtatgcggagtgacgaggggctgaactgcctggatgtggccagggaatgctcgcggaagtttggagggacagatcagatgatgagaccagtcttgcttttgtgtttacatgtacagtcctcttcaaccccaagggtggataccacagcacctcccattgggaatacttctcgaagcagagattggattgcatggacgcccttgggccnnnnnnnnnnaattgggagtacttctcgacgctgagattggattgcatggacgcccttgggccnnnnnnnnnnttcgcggaagattgaaggacagaccagatgatgagaccagtcttggttttgtgtttacatgtacagtcctcttcaannnnnnnnnnnnnnnnnnnnnnnnnnnnnnnnnnnnnnnnnnnnnnnnnnnnnnnnnnnnnnnnnnnagtaggatacaggaggcagcgagtttttccttcagtgtctgacccatgaccaggaaatcttctggtacatgctgcgcgcacggaaaatgaaagcatgttgtgacggagaccctgatggcccgatgtcagcccataaagcatgccgtacctaagcaaacccccaaagtcctttgacgactgttatcggtttttccagagaccgctgcaattgccgtggaggtggnnnnnnnnnnttcctttgaagactggtatcgggtttttcagagaccgctgcaattgccgtggaggtggtcgcctactctttatacacattgtcggtgttacggaccctggacggcatggcgatcgcctagatcaccgaatgcgtgaccgggcagtctcatgacggtacaggatgcacggcaattgagccccgtcgcgagctacatcgcaggctgctccgccggctccgccggcattgtgaccgggttcccattcgacacggtgaaggtccgcctccagaaccagcagatcgggcatggcacttcctggggtaccttcaagggaatcctgcgccatcaaggggtgaggacctggctatggaatcgctgctgtgtccaggctgaaggctgtgaatgtgccagagcgtggatgcaacgaaggaggaaggggcgacgccctgtctcacagcccctagacgttggtaacgtgcgcaggtcaggggcctcttcacgggcttgagcccccagctcgttggtggcgcgctcgagtgtggcgtgaactatgcggtgcgggcggggagcaggaaactgggtcggagggtgaaccaatacatggtgcagatttcttggatggcaagcccaggttcctctgatggaaaaggtggcccggagggctccgcacgagtaagcgctgcttccggccactgtccctccctcccacaactttttgatcgccccgtgcaggtgtacaacgaatcgctctcctacttgtctcgtgagtggcacgccccatcggcgctcagtgtcccgctggcaggcggtgcggcgggcttctttctcagcatcatcctcagccccgctgagctagtcaaggtggtggtccagggtgtggacgcagagtgctggcagttgcgtacatcagccaccccgtgattgtctgcaaaacctcttgtaagcagctcaggaatggattctaaatatcagcccattccagcttcacaccnnnnnnnnnnggagtgctggcagttgcgtacatcagcctccccgtgattgtctgcagaacctcttgtaagcacctcaggaatggatactaaatatcagcccattccagcttcacaccgcccgacccccacctcccaccctgcacagtgccggatgcaggctgctgatgcccggctggccttcaagacaccccgggactgcctgcgccacctgttccagaccgagggactgcgtggcctcgcgcgtggcttcagcggtaccctcgctcgggagatccccggcaacgccatctacttctccacctacaccgtcagtctttctgtggggttggtgtgggagggagcgtcaatgggtccagtcctctgcagcttgttgcagccctgtccctcacaccgtcccgcacccgaccccggcaggcgctgcgcagctgcatccccggcaagcctccggtgacgcgttcaggggaggggtgctccagcgcnnnnnnnnnncccccaccccggcaggcgctgcgcagctgcatccctggcaagcctccggcgacgcgttcaggggaggggtgctccagcgcccccgcgtcagcccccaccctgctgcagcggctggccaatgccagctcgatggtcctggccgggggcgcggccggcacggtgatgtgggcgctggtcctgcccatggacgtcgccaagacgcggatgcaggtggcgctgccgggatcgaggcgcgatctgtccctgccggccacgctgcgcgcgctgcggcgcgagggcaagctgtacacgggcctggcgcccacgctggtccgcgccttcccggccaacgcggcccagtgggtggtctgggagctggtcgcggggctgctggagggccactgagagagagggattcggtggctggaggatgtagggtctgggcctcaaatgtgccgccatgcattcccagcattcctcgcgggagctcggacagggtgctgtgcttgggcttgcgtgacatacccctctttcgttgcctctgagttgtctgcctccgnnnnnnnnnnagggagcccagacagggtgctgcgcttgggcttgcgtgacataacccgctttcgttgcctctgagttgtctgcctccgcattgaccgtgtaatgatacctcgctgagtcgcggcaaacgtgaagtgaatgtgttcaacctcaggattacaccttgtggactctgggcactcagcctcacaccccgagtgatcgccttgtaccctgtcaggtatcagagaacctgaatggaccctcgggccagacgcatcgtgcggatcaacatgcgcggggtgctcagtcattgctnnnnnnnnnntgagcctgaatggaccctcgggccagatgcatcgtgcggctcaacatgcgcggggtgctcagtcattgctgggtgagctggtctgcaaggtagtcgacaaacatcctctgggcggtcacggcatctggcgcttttgtcagcgacagattcgtgaccaggcggaggaaggcgcgcttgtgtcttcgcaactcggccacatgcatctggagtggggttggttcaagatgccagggtgaacggaagtgtacccgacgatgaagcagggaaacaccccgcaagctgccggatctgccaagctggccgtgcatcagagactctaacagcagcctctcaccctcctcaccggcctgtccatgcgcagcgatgggatctcgccggagaattggactgtccctggggcaccacccggcctcagctcctgggccgcagagatggcgtccatcacctggtgcgcgcccctgtcgatctcgtgcaacaggttggtggctgcaggtgggggtgaacgtggggctggatgggctgagatgctggatgcagattgatgagaggtgagaccaacttccagcacagacattatcctttgtcctggcctgagcggtgatccttggcaccgcgccatcccaacagcacccccttgatcaacctgctgcgcccgtcccctttgcacagtcccccacttgctcagaacaaatgcaaatccctgggctcacaggacagtctggcgttagtggtggnnnnnnnnnntattatcctttgtcctagcctgagcggtgatccttggcaccgccccatcccaatagcacccccttgatcaacctgctgcgcccgtcccctttgctcagtcccccccttgctcagaataaatacaaatccctgagctcacaggacagtctggcgttagtggtggcgatggtgggcgccagcgctctgctggctggcgggaccggccgcccctccgaccccggctcccggtcagcatgctggacgaggtccagcgcgctgacgaggacggcgcgcagctgcgcctggacctccgcctcgccctccgcggcggcggggcggacggtgaacaggggtgcgtcccagcgctggcgagagtctgggcgctcgaagcggcccgccaggtcggcgaagacggctgtggcgtagcgagcgtcggctggacgagcctcgttccaggtcctgcaggtctctatgggcgtgtccacgtgcaccatgcagtagcgcaccgccgcgcctcgcgccaggcagtacagctcgtagcggtagcccttgatggcattcatggagtccaggatgaccacgtgctgccgcccgatgcagcgctcgacctcggccttgagctggcctcgcgcgaccttctcgctccgtgcatctgttggggttgagaaggagggtggtgcgatgggggttgggtcgaaggagggccaaatttctgtactgggagtgacacacggacatatgtagaagatgtgctggatggaagcccaagcatggcctgggtggtctaacaagggtgcccaccgctgtagcagccgtcgcgggtcaggcccagggactcctcgctgatcacgaggcatgcacggccttcctcttggaccatcttctgcaatctggcagccagcagcgacttcccgctgctggggtggcccgagaagacgatgaaggccatcgcaaaggatgggggtagctggtggaggaggagggcaactcgcagtgttaaaggccaagggtcacgacagactgctaagggaatcgtctcgagggtacaattcacccactattagaaacatttgctcccatttgtccatcgcgtctcgcaagcatcaaaaccgaggcccaaatcagaactgtcaccatgcataccccgagttccggcgctggcgccctggcggacccgagtcttctcggaaatgagcctgggcgtgtcgtcgcggatgatcacccaccagcgacccaagtgctcaccatcacacgcctcagctcctcccggcgtgagccgatgaattaggaacagccttcggcatgacgatgcgactcaggtgcggggtaccagtcaacgaccgtggttccgtctgggggcctcaccctgaacgtgctttgccggctttcattgcatattcattctcagtgctatcccagtgtcttctgtatgactaccgaggcaacggtccgctgtcctgcctggcagggatctgatcaagcacgtcagggcagcgaagacagctgcggaggaaaggaatgtgatcgccaaggagagcgctgctctgcgcaaggccttcaaggagcaggacagcacgtatcgccacaggtgccggagggttacaggcattgggccagttggtactctgacctctgaatgccgccacacctgcctggagtgacaggttagagacgaagtgcgcccatcagctcctttcaatcgcccacaatatgacacaggaatgtggcaaaactcatgtacatacacatgctgggctaccccacccactttggacagatggagacactgaagctgatcgcctccctcggcttccctgagaaggcaagctgcagcctgctttgttgcttggcacatgtgggatgggctttggcattcatggataccgcacgatgcacctgcaaagtagtgcgggatcaaactcccttttgcctgcctacagcatgtggctcccaaattccccccctcccacagcgactgggctacctgggcttgatgctgctgctggacgagcgccaggaggtgctgatgctggtgaccaatagtctgaagaacgacctgcacaacaggaacatgctgatccaggggctagcgctgtgcgctctgggcaacatctgctcggcggagatggcgagggatctggcgcctgaggttgagaagctgatggggtccatcaacccatacctgaggaagaaggccgccctgtgcgccagtcggtgagatagagcaagccaagggaaactcgatgggggaacgtggtacagagctggcatgtgcatcggcctcgtgcgcacactcccagtacctgcctcgcaaggcatgctcaggcccctcctctgccctgcatgttgccttccgtgcctcaccctgccgcccttgctcgccatcccagggtgctgcgaaaggtgccggagatgctggaaccctttgcggagcaggcggtcgccctgctctctgatcggaaccatggcgtcatgcttgcgggtgcgggaggcttgggtgggctaaatgatgggtcccctgcgattctgacccaggccgcgatgttacgtaccttgcacatgcacatggctgggctggctgctggctggctcccgcacttcaacccgggcatgtgcccgcacaggcggttttctcccctttataccccgttccctccctctgcgggttcttacccnnnnnnnnnngtcaacctgggcatgtgcccgcacaggccatttcctccctttatatcccgttccctccctctgcgggttcttacccacttctttttaccccgcccccccctttgctgccatcaggtgtcaccctgatgctggagatgtgccatgccgacccagctgtggtcgccctgttccggccccaggtgccgcgcctggcctccctgctgcgctcgctgctggggtcccagagctacgccccggacactgacgtcagcggcctcaccgaccccttcctccaagtcaaggtgagaggggggcggcggggaagggaggggttgaaggagtcagcggggaccgtgcggggtccgggagtcttttcagcgtgaacctttgctggaagctggctctgcgatgcagggttccactgacgaggacctggactgcgcggatgggccaacatctttaactgcattcaaagcacgacctccgcacacacacaccttctctcccctccacacacccagctgctgcgcctgctgcgnnnnnnnnnntttcctccaggtcaaggtgagaggggtccggcggggaagggaggggttgaaggggtcagcgcggaccgtgcggggtttcgggagtctttccagcgcgaacctttgctggaaactggctttgcgatgcagggtttcactgacgaggacctggactgcgcggatgggccaacatcttcaactgctttcaaagcacgacctccgcacacacagtccttccctccccttccacacacccagctgctgcgcctgctgcgggagctggggcgcggcgacgccgagagcagcgacgccatgggcgacgtgctggctgccgtggcatcgaacaccgagtcgacgcggaatgcggggaacgccatcctgtatgagtgcgtgcaggtgagagagctgggctgggaggggctggagtcgggttggtgtgggagggagacgggctcggcgctcccgcttcgccctgccctgcccgctctccccgctgtcgtcccccgcccccaacacctccaccaccacctccaggactgacacccccttcctccccccctggccccctttttccccccttcaagaccatcatggcggtggagtccatcggcggcctgcgggtgctggcggtgaacacgctgggccgcttcctggcccaccgcgacaacaacatccggtacgtggcgctgcacacgctggcgcgcgtcgcggcgcgagaccccggcgccgtccagcgccaccgcgccacggtggtggactgcgtgcgcgacgctgatgcgtccatccgccgtgccgcgctggagctggtctactcgctggtgaacgaaggcaacatccgggagctggccgccgagctgctggactacctggcggtctgcgacccggggttcaagcccgacctggccgccaaaatctgcgtgctggtgggacgccacgccccggacaagcgctggtacctcgactccatggccaaggtccgggggtgggcgagtgggggtgggaggggagcacgggatgaggtgctgagggccaggccaggacgagcgcgtgccagaatgttccggaagtctgaacccgacggcgctgggaagtggacccaagactttgacgagcccgcnnnnnnnnnncgagggccaggccaggacgggcgcgtgccagaatgttccggaggtctgaccccgacggcattgggaagtggacccaagaccttgacgagcccgcctccctccctcccctccaacccccaggtcttgcgccaggctggcgcgttcgtcaccgaggaggcggtggccgggctggtgcgcgcggtgaccgacgcgccggccctgcgcggctacgccgcgcgcgctttcttcgccgcgctgcgcgatgtgggccccggcgcggcgccggagccgctggcccgcgccgccgcctggtgcgtgggcgaggcgggggaccgcctggtggaggcgaggggcaggctggagggggaggacgcggcgcaggtctcggcccaggaggcctttgatgccctgcgcgccatcctcacgtgagcggggctcgagggggtgagggtttgtgtgtgtgttttttagggaggcaggggtggtggggggggtgaggagacatggcctggtgtgtttgagatcgatgccccggcgtggccgcatggaggtggcgcgaaggaccgggcagggagcgttgtctgtttgggggtcgcgtgcatgggggaacgcccctctgcccagccattgctttgcgcggagagtgaagcccatgcgtcagggagtcgacggccttggcagccgtcacggctctggcgactgcgtgctggccccgacccttgaacgtgtgaatggaggtgcacgtctcatcacgagcgctcaccgctctcgtcccccccccaaaaaacacacgcacacatacacacacacaggcgccccggccaagctgatgcggtgcgtgaagtgacgctgacggcgnnnnnnnnnnttggcgactgcgtgctggccccgaccattgaacgcgtgaatggaggtgcacgtcccatcatgagcgctcaccgctctcgtcccccccccaaaacacacacacacacatacacacacaggcgccccggccaagcggatgcggtgcgtgaagtgacgctgacggcgctggccaagctgggcgtgcggctgccggccctggccccccaggtggcggagctgctggaccgcttttcgcgcgcgcccgcgccggaggtccagacccgggcggtggagtatgcgcgcctggcggcggcgcgcggcggtctggccggcgccgtgctggagcccatcccggccgcggagggcggtgcgggggccgaggacctcgccctcgtcccggccgagggcgaggaggccgcggggaacggaggtgggacgggtggggcggggctcctgggcgccgacccggcggctgacctggccgcgttgctgggcctggacgccggggctcctgctgccaccaacctgccggcgctcgacgctgcgccggtggacccgctggccgcgctgggcatgctggacctcgccgcgcccgccgacccgctggcagaactcctgggcggcggcggggccggggggctgcgcgccccggcccaagcggcctccgggcacacaccnnnnnnnnnnggggggctgcgcaccccagcccaagcgacccccggacgcacacccggcgccggtgcggaccccacgcnnnnnnnnnnnnnnnnnnnnnnnnnnnnncccccctgcgcgcctacgaccgcgacggcgtgtgcgtgctgttggaggtggcacggggggcggcccccggcgcggcggagctgaccgcgcgcgtcacctccgcccaggcgctggccggctggtcgctgcaggccgccgtgccgcgcttcgccacgctgcgcctgtccccgcccagcggcacgagcctggccggcccggggcaggagctgacgcagcgcctgcacgtggtcaactccgcgccgggcaccaagcccctggtcctgcgactgcgcctcgccttccagcgcgacggcgccggcgtgaccgaccaggtggaggtgggcgggtttccgcccgggttctaggggcgccgaggcggccgagggacgcggcacgccgagcgcaggttcccaccctctgattgcttgtggcgacccttgggtcctcagcccctgggtcggccgggagtctgccagcccaccccccctgcgctcgatgtcgagacccgagcaacaaaaacaatcgaggacaaggcaggtgcatgtggatgaaacggggttgaatgggcgcatggaggactccacacgggccgcgagcctccacaagggggnnnnnnnnnnctagaagtcgatggcctcgtgcgccggcgcctcctcgtcggggaaatcaccgtactccttctgccgcacgtcctggtcctccccatactgcggggtcagcggggaaggcttttcctgagcaggcccccgctgcaagctcatcatcaccgtcgggcacatgcaagacatgaggtgtgcaagagcatgcacacaacatcctgctcagcagatnnnnnnnnnngcatgtttcagcggggaaggcttttcctgagcaggccgccgctgcaagctcataatcaccatcgggcacatgcgagacatgaggtgtgcaacagcatgcacacaacatcctgctcagcagattgctgtttccgcctggtcccatacgccacagtggcctccacaccccaaaggcacccccccctggtcccacctggatggcagagtcgacctggaagagcgccgtctcgatggactcctcatccccaatgtcgagcggggtgaagctgaccatggcaaactcgtccagcaggttcacgatgacatcgttcagggccgagaaccggggcccagtgctctcgcccaatgcatgccgcagctccagcgcatccgggaagaggtaggaatccagcgaatcctggagtggcagatggtacggggggttgaactggggccttggatgactcagcggcgctgtgcgcctcgatggaactggttcagnnnnnnnnnngtgcatgccgcagctccagcgcatctgggaagaggtaggactccagtgaatcctggagtggcagatggtgcgggggggtgaactggggccttggatggctcagccgcgctgtgcgcctcgatggaactggttcagggctcgggaagccagagggaggtccccagggaagaagatcgatgccacttcacgtgccagcgcctgccagggccccaaagccgaccgcggcatttcacatgcgcctgcaggggacccaacattaaaaggctgcagtgcctctcagccggaccacacagcgcaccttgtcctgaacgaggtcgaccttagtcagcatgttcacgtggggcagctccagctggaccatggcagagagcgccgacaggcagccggcaatgaacttggggggctctgctacaaactgagagtccatacaatacacctggggatcattttgtgtgcgtgggtgtgggtggggtgcagagggagccgtgagacacattgcatgggacatcaagagcaccacgagtgtgatgaactcatcccaaaccagcatggcagcgcacagggagcgcgtagaagagagggcaacacgcaccgcgcagatgttccagccgtcgcgtttgaggaactccgtgaaggtcctgaagacgctgacgtgggagtacagctcgatctggccagggcagtcgaacagcaggtagtcatcctcgccgtaaccctgtgggatgggtggggaaagtggtaacgagccggtaggcatcatgaggattgcaccggccctggctataggctggacattaacgtctgcccacctgcagctcctcctccagccagtcgctgaggttgtcctccaggaattccatgcagtacagcaggcctctgtaagagggggaacatgttgcatcaaggacggttgggttgtctgttggatactcaacacagtgcagtggagtgccggtgttactcggtgtatgattctttcgaggtgtgccctaccaagtagtgtgctcatttcctcctcgcttccagcaccctcttacccattgggccccaaatctagctcctctgcaacatcatctagggtgatgaggtccctcacatcgatggacacggggtagttgaagtgttcggcagcgggatctgtaggtatacatggaacagccagggggcagcatgaattgcagtgggggtggagacggcaaaggcttgatannnnnnnnnnatgctcggcagcgggatctgtaggtatacgtggaacagccagggggcagcatgaattgtagtgggggtggagacggcaaaggcttgataatcatggcaatactccaccatcctggacagcgtgcacatccccaaacagcctcaccgagatttacgacgtgcacagatctgccgatggtgtcgcagtgggctttaatggtctcgcagtaggtggactggcaggggagaatggggagatgagtcaagttgggtgtgcccagtctacgtggggatggtacaaggcatatacttgctccagtaatctaaaataggtatcaaagtcgtaccttgccacacccagcgggccctatcacgagctgtgcgaatttcatgcacctctcgccggcagccaattccactcgtcagccgcgcagctcaagaggagtcaatggtctcgctacgtcctacttctattcattcctcaatttctcatatattaacgtattcttagcatatggatggcatacagtgcaccaaagtgatgttacaatcgtgcctcaggtcctcggagtccgggcgcgannnnnnnnnngcgtcctacttctattcattcctaaatttctcatatatttacttattcttagcatatggatgtcatacagtgcaccaagatgatgttacaattgtgcctcaggtcctcggagtccgggcgcgacgccatgcaccttcacgcgcacgtgatgaggcagggcttgccaatgagagggatctgagtggttctggccacgacgcatatccaatttatgatttgaaacatatgagattgagtctcagcaggtgagactcgctgtcctgattggtgtcgannnnnnnnnnctgacgcatttccattttataatttgaaacgtatgagattgagtctcagctggtgagactcgctgtcctgattggtgtcgagcagctcgacgccgagccggaccatgtctggcctaccctgtacgtctggaaggctggaggggctgcgtcagccctcagcaagaggtggagcactctcgaggagcagtgcacctgtgcgacgcgccaaggctatcattgcacgtgcgagtgagaagagggaggtcaccctcctggattatggtgcaggcaacgtccgcagcgtgcggaacgcaatccacaagctgggctacaccatcaaggatgtacgtggggtctggtgtggggctacaggttgtgcctcggacaatgtacgggcagcacgccacggctttcctcgtgtagcaccacgctccatgctgatagatcctccacacatgctcaccacatcccgtctttgccaggtgtcatgtgtcaaggacatcgagaacgcttcacgtattattttccccggcgtcggtgcctgtggacaggcgacggaagctgtacagcgcatggggtatcgcgaagccctcattgactatctgaaggtttgctaatgttatgtggggagagaccctcacacatgttgccagtcgcattgttcctgacatatacactgtcgcgcaaccatcttgaggcagacgtaccagcttccctcacaccagccgccctgctcccatgcaacaggccgaccgtcccttcctcggcatatgcctgggcatgnnnnnnnnnncttgtcgcgcaaccatcttgaggcagacacaccagcttccctcacatcggccgccctgctcccatgcaacaggccgatcgtcccttcctcggcatatgcctgggcatgcaaatcctattcgacggctccactgagaatggcggcgtggagggcttgggcgtggtccccggcactatccggcaatttgacacctcactcggattgccggtgccccacattgggtggaacaacctcatacccaagtgagtgtgggggagcatgcttatcacaatggtttggtagtgtgtgtgttgtgtgtgggggggggagattaatgtgcatctatggtaaaaaattcaacaatggtatgcgcatcacaaagggctgccattctgaccaagccagcaagacaggagttttatcagcttgtcccacgggcataatctagatagtgcacaacccttgccgcacaggaaggagtcccccctactaaattgcgtcggggatcggcgggtgtactttgtgcactccttcgccgccttcccggacgaggagaacaaggactgggtcctggcgacgggaggtgcgctgcggaggggcgacgcaggatggagcgggaggtgtatgcttctgtgagcaatcggcgcatttcccagccagtcgactggtgcgcttgcatgtgtgcccgccaaacacagccccggccccgcccctgcagagtatgcgggtgagtttgtgagcacgctgcagaagggcaacgtctatgccacgcaatggcacccggagaagagtggcgctgctgggcttgattttatccatgggttcctggacccagaatgggccgccgctcagccgcgcctcgacccctccacatcccgtgcgtccaacggtgagcgggcgtaggttgtggggtgggcggtagggtgttgaacgcctgttggttgttgcgctttgctcaagactataaataaagcctgccgcatgccaagcttttccctgcagttctgtgcctgatcctggcggccaaagctggactggatctgacgagaccgggtggccttggtgcttgtttctgcgtggtgtgtccatcaccccacccctccaccccactcacctccatgctcccaggcgtgccgagaggcctggccaagcgcgtgatcgcctgcctggatgtgcgcgccaacgaccacggcgacctggtggtgaccaagggggatcagtatgacgtccgcgagagcgcaggtactgttttgagcggggttgaggggattcaaaaggggtgtgaaagtgtggctggggcgcaatcccactcgccctttccctggtgtgtctgattggcctgtctctgtcgacgttcacaatcctgtcatggcatgcctctagagagacatgatttcacacacctccatgctaagcccctgagcatgcccctgacccgtcctatcaccactcagatgcaagctccggcgccggctcctccaagggcgaggtgcgcaacctgggcaagcccgtggagcttgcggggcgctactttgaggacggcgcggacgaggtcaccttcctgaacatcaccggcttccgcgactcccccgtcgccgacctgcccatgctggaggtgctgcgccagacctcgcgcggcgttttcgtccccctcaccgtcggcggcggcatccgcagcttcaccgatgcggcgggggtgcaccaccccgcgctggaggtggccggcgcctacttccgctccggcgccgacaaggtgtccatcggcggcgacgccgtgctggcggcggaggcctactacgcgcgcggcggcgtgcccgacggctccaccgccatcgaggccatcagcacccactacggcgcgcaggcggtggtggtcagcatcgacccacgccgtgtgtatgtacgcgcgccggaggacacggagcacgtcaccgtagagactgcgacgccaggtgattgtgtttgtattcttttgggagggtgagaggggtgaatgcgtgagcgcccgtctcaacctcgtgcgggttgagcctcggtttctccctaccccacttcatgctcccccaaatcccaaccctgcccccgaaaaccacacaatcccaggccccaacggcgagcggtactgctggtggcagtgcacggtgcggggcggacgcgaggggcgagacgtggatgccgtgcagctggcgcgctgcgtggcccacctgggtgcgggcgagatcctgctcaactgcatcgaccgcgacggcgcgggcagcggcttcgacctggagctggtcaaggccgtgtccgacgcggtgacgatcccggtgatcgccagctcgggggcgggccgcccctcccacttctccgacgtcttccgcgagacgggggcggccgccgcgctggccgcaggcatcttccaccggcgggaggtggccatcgccgaggtcaaggccgacatggcgcgcgccggcatccccgtgcgccagtctgcctgaggactggcgggacgggcagaatggtagacggaagaagctgggcggcgggctagcagcgatgcctgtgggtgatggaggttgcttgctgtgtgcgttttttatgtgcaatgcgtcaggcacgccgaacgcaagtgcagccacaagaagctgctgtcgctgccggcctgctcgcttgtgccgcttcctgagtgtcctccgtgctggtgtgtacacactttgttgcagtcgcgccgtcgcttacatcccagaagagcgcggtggtggggctcgcattccctcctgggaccgccctctcagtgcagaattacacagcaactgcggccctggaggacaccggctgtttgactgcgtggttctgtactccagatcagcatcttggcactctaaaacacacacgtcaggaaggcttatcatgtcccggcgccccgccccacttgccatccagcctgcgcagccagcaggataccagaagcataaactgcgagcacggcgcgggcagtccagtcccccgcgcccagcgtgtccatgccccagttcaccgcgccggtggccagattggccgccaggaagacgggcagcatgcggccgctgagcgcggagagggccgcgggcaggacgttgtccgccagcgccgcgccgcccgcgaagccgagcaccgcctgagcgttgagggccagggtccaggcgacgtagggcgcgttgcaggcgcggcgggagacgggctgcaggcgtgccgccgagcagaggaaggcggcctggagggccaaggccagggccgcgccaacggccaggggcctcgcgttggcggccgtgcgcctcagtccggcgcccaggctcagggacaggaggtggagtgccaggtagccgggcagggagcccaggccctccttgttggcggagaggagggagcccagcgtgcgctgctcggcgtggatccaggccagccagcccaggcgctgcagtgcatactggtgcgctgccaggatgcccatgcccaccagacctgcttgcgcacatggccaatgcatgtggggattgaaggaaggacatgagagaggggaaccatgaatcctcggcccgtgggtcgcatggcaagcgtcaaagaagtgccaggaaaaccccccaaacccctctccacaatgaccacagcgcgcccccatcactcaccgggggccaggagccctcgcccggcgcccaggccctcggcgactgacaccgccagccgcagcgcgcccagcgtgaagaagaagttccagtgcacgccgtactcgctggcgtgggactggtagtccacgcccctcgtgctcagcaggcgcagcaggcccagcaggagcagcatggcggcgcgtgttgcttcacgtcgaaacctggaacacttgactgcacgagcgtcgcccgtccggctggcgcccctgaaacccctggtgatggctgaggtggcaacgaagctccccacccccacgtccatcaggcctggggaaagggggagtgtggggactgagaggagctggtgaggtctggacggtgcacatcgctcctcccgggtcaccggctgtgcatcgtgccagcgccacatgtccttgcattgaacaccacaaatcctcgccctctcgcccacctgtcccaaacgtctcggtcttcgcgaagcggcgcgggaaagcgtggaaatccaccgccaggatgcagatgcacgtcgtgagcatcaggctagctcggtacgccaggagaccgttcctgggccatgcggaggattgtgatgatcacattgaggctgcaaccttttcctcaagggttcttcactcgtgaccggaatgggctgcaccagggttcatgcctatttacatgccagacgccttacttgaagaccgcctcagtatcggtagaggtttttgacctagacccgcttctgcctgctggtctgcaccacctggagaggactgcggccagcacagctgccgccaaggttccatggctgggtggcacgatgccagtaagtgcagcgatcaggggaagaaccaagcagatcgtgtcaactagtaatctaggcgccctcaggcgtaaggcccaatactcgatagcgggacatgtcctgagccaggtcaggatgatgggaagggtgcagacagcctgcacctcccaccaactcgtccctgaatgacccgacacaaatgcctccttctgcaagcgcacgtcatgcgacatgctagatggagcgtcacgggtccatcagtggtgagcacaggtgagagatctctgattcgcttggctggtcatgtcgcagggtgctaccgtgactttgtattttcagatgcatgcgcgccaccatccatcctcccgcccaattcagtttcgaattgcgcagacccacttggaacaggattcagccttcaagtaaagtactataaaacctgggtttctacacttcccacacagctgtggaccccgatgaccaaggaaatgttgagatgtggctgcgcttaggagtggcgcagacaaggagaccgcacccgctaccaaaggctgtagaactgccctgattgcaatcccgcggaggagagggaatgttcgtataattctatggctctgcacctgcaagacaacggaaagcgcagggctcgtctaaccctccgtagaagcctcctgatggagagattccagaccagcgaagggcgccagtcagagtgccaattgcaaagcgcgcagcccagggcttgcacgaaattgggtcagcgattctggccctccgaagaaagcgagtcagcctgtcaaaagacatttggctcctgaaagatcctcgctgcgcgcattatcaaagccttactggtgcaggtggcttgtgccttgcataggggaggaggtcgtccccacccttgccgtgagggtggcgagggtatggatcgcaacaagggtctcaatcaaggtatcgacccccatccacggttcctgctccagcaacacgaaggagccaggagcgtcaggaagaggcccttaacatgggcatgcctgacccctatctcagagtaggtgcacagattcccggctgctggacatcctccaccgcctggagcaagacaggcaggcgagcgtgattgctcacaagcagctctgtgactgcggcacccaacggccccacatcaccagcctgagtgcttacatccctgtgcgtgcccataggaagaccagatggggatcgggaagggactgggaaataatgaggaatcaatcgcacctggtgtccgatgcaagtatcgggctccaggattagcgagctggcagggttgggtgctcctccagcgcaatctttggggctcgtaggttctttgccgagggccccaccgaatgctgccggcccagacgggccataccctgccggcaggagctgcccgggccgccagtgcggtacccccataccacccgattctaccgcacatagctcaggaaaaattgccgaagaagtcttcgtcggcagcctctgccgcgcccacatggtcccggaacagttgcgcctgctgggccgacaggcgctgctgcgtggcatggaacacgacccctgcgccccctggcgccgcccgcgtcgcgcccagcaggcccgccacggccagctggtccagcgcatggcgcgcagaccagtccggcgggacctcccccaggacaaggctgccgtgcgccgccagctcgccggcgccctccaggaggcccggcagggagccggcgccgcagccggggcgctgcagcagccaggccgacagccggtcgccgcggaacccggcggcgaccagcgccgcgtccagcgcgagggggccgtcggtgcgcacacgacgcagcaggcagccgcggggagcctgggcggcggcggccgccagcgcgctggcagccacgctgtgcgcctcggctgtgggtgcatggtaggggggggggagcgaattggatgggcagttggccaaccaacatcacaccgggactgctgggctcgtgacaagcgaggaacgaagcgttggcaggcagtatgagctgcatgcttttcgatagaccccgcgcagtatgcccagtcctgccgcccagccactcactgggggccaccaggtagaagacgatgccagagggccagtccaggcggaaggggcgggtgtccatggcgtcgcccagcaacaccacctggacgatatcctgcacagaatgcaggggagtggggttgcccaagaggcccttgccatgcacgggtggccatgatcttcatctcatgtggctccaggctccgcacctcctgtttgtcggggtgctcggtgagtgtggcatgcaatatgtactggtccaacatctgcacgactcccagcccagtatcatcgcgctgggtcccaatctcccactgcgtgtggcggggtgggcgccagcgtgggcgcggggttgcatgcagataaccttcatggtctctttcgtgagattcatggggcttgcccagcaccatgaagaatggtgtcacccattctgaccatgctgtagccactcatcccgcaaccgatgtcgcacatcttttccagccaagcagcgcgcgtacgggtcgcagatcagggcagaagggccacgcagcgtctcgcgggctctgagcccggccagtgctcgactcagaacggtgtcctcctcatcggacaaggcccagtcgcccttcgctgccgggattcgtgcggccacatgtctttgcacagcactggcacctgtccctcgatatgggtgatgtggtcgacagggatcctgcccggggcggagcgaggaccttgccctgcacgtcgccatcatccctgctcgacacacaaacctctgatccacacgcatgtactacaatgcatcataggaaaggatccagaaatacatcccacgttgtattccttgcatcgagccactccatgtgttgacctctactgcccatgcatggttgatcatcgcgcgctttccagcctgcaatgcgcggttcttacgaccctccacctccagctatctcgtgcttgcgcctcgttcacggctgtgatatcacagaaagaatcacatagcagagccatttgccctgcaacttgcattggtatccctcccccttgtcggtgcgtatcgctgtgggtcgccatggccgactcctgggaggatcagagcgaggaacagatcacatacgagcctcaaaagcccaagctgaaccccctggcgtccagcttcagcttcagccctggcgcgagctccttcacgcccgtggctcctgcacctgcgccgaatccagccccagccccggcagccgcacccgcccccgcgcctgagccagccgagttactggcagcagacccaccgtcagcagaggtggctccagctcctgagacctccgagccgccctccgagccagagcccaaggcagccccagctgagacccggccggcacccgcagctccctccaaaggtgctgctgtggtacagcgcatgccttgtgcctagcatatgcatgtgaaggtactgtaggcaggtgcacactggtctctgtctcagccattgccaccgcggtacccctgctgcagcgccagaggccatcgagacggtgacaaaggagctcaagaaagccacgattgcagcggaggaaagcgaggcgcagaaggctgcacggagggccgaggtcgacaaagtgctggccgatatcaccgcgaatgatgcacggtgcgtgcttgggaatgactgcgcggactgacgtggaggccgggagtctggcatgggtgtttggtgccctcaggccctcatccgcagtagatggatgtgtgcgctgagtggcgacgcgcaattttccattccttgcgcccttgggcattgcctcgcagctccatgatcctcaccggcctctctgcactcgccctccttccccagagatcacttgaacgtggtgttcatcggccatgtggatgccgggaagtccaccacagccggccagatcctggtgctgacggggggcgtggatgagcgcaccatggagaagtatgagaggtgagaggtggggcaatggtggtggaggtcaagaagaatgtgttgtgtttggaggcccactggtctcaaatgttctacagcctgcttatgctcggcgagcagatggtcgctccaactagccatgcaaccaagggggcctggcagcagccctcaaagggtgcagatagaagacttgtcctggctggggtgctgttctgtgcccctgtgcccagctgatcccctcggcaccctccttggcgcagggaggcaaaggacaagaagcatgactcatggtacatagcttacatcatggacaccaatgaggaggagcgagcgcgggtgagttgctttattactctcaagcggtagggttattctggagcaggcggcttgcgatgtacccttgctggtcctctccaacgcactgctcagcccctggccccacctgttcaagtataccttcacacacaccatccctcacccctcccccccaaaactccatttatcagggcaagaccgtggaggtggggcgcgccttcttcgagacccccaaaaagcggtacacgatcctggacgcccccgggcacaagtcctacgtgcccaacatgatcagcggcgcggcacaggccgacgtgggcgtgctggtcatatcggcgcgcaagggggagttcgagaccggattcgagcgcggcgggcagacacgggagcatgcgcagctggccaagacgctgggcgtgcagcggctggtggtggtggtgaacaagatggacgaccccaccactgtgggcgaggacggcgtgtggagccgtgagcgcttcgaggaggtggagaagaagctgacgctgttcctgaaggggtcagggtacaatcccaagaaggacctggccttcctccccatctcgggcctgtttgggcacaacatcaaggaccgggtggaccccaagctctgcccctggtacaaggtgtgcacgcatgggtgggtgggcgcggttggggggtgtttactctgtgcttccagtgtctggtgggcggggttgcaggacagcgctgcagccgggagtggcctggcctgttgtcccacgtcatctcgacgccgccctttccacccgcacccacagggcccctccctgttcgaggtgctggacaacgtggagccggcgctgcgcgacgtgtacgcccccttccgcatgcccatcatggacagctacaagtgggttgccatgctttgtgggcacggggggctggactgagggtgttcgtgacaaagcgtggtcatcatgaaaggggagacctgcaaagtgtgatggaaatggagggtgtaggcacaacctgcctcggccttgcctggcttgcgcctgcctcggatgtgagctgcacagtcaagcctcgccccccacactgtcgccttctatgcctccacctccgacacacacccgccgggcatctggcgcagggagatggggaccgtgctgatgggcaagagcgaggccggcatcgtcagggttggcgactcgctcctggtcatgcccaccaggtgcgagtgccagggagatgggcgcgcagtctgcgtcaagggggggtttgaaaggtcggcgtggggccgattgtctgtaggggaactttgcacctctgttgtcaaagcgccccctttgctcacctggcaaaccctgcgcacaacccctattcccctcccccaaataacaactgcaggacccagatcaaggtgacggccatttaccaggacgacaccgaggtgacggcggccagaccaggggagaacctgaagctgcgggtgacaggtgttgaggaggacgaggtgtcccccggctttgttctctgctccgtgcacaacccggtgccggaggtcacctactttgatgtccaggtgggcacgacagacatgtggtttgatggaccagttggcaggggttgtgcgagggactcacatatggagcgttggcatgagacgatactgtgtacgtcccgcctcaccagcttggggtggcaggtccaacnnnnnnnnnngcgacagacatgtgatttgatggaccagttggcaggggttgtgcaagggactcacatttggagcgtgggcgtgagacaatagtgtgtacgtcctgcctcaccagcttggggtggcaggtccaacaaggtctgtttggagtcacttggggtgtgtcttcacaaggcaggccagtccccaactggccttacatccaccacgtctcccttgttcccgctgtccagatccaagtggcggagctgctggagcacaagcccatcctgtcggggggttacaaggccatcctacatgtgcactcgggcaagtgcttggatggtagagagggggagaccgcgctcaggtggggatcagcacgcacctacaatccgcattcatcagcatgccaccctccccaacgcagtcactgaggagtgcgaggtgaagacattgttcttcaaggtcaatccccgcaccaaggagcgaacaaaggcgagtgcccagggcgttgttgcagggctcatgccattgctctgggtgtcttcatgcaagcactctaacaaatcatcgctgccgccccctcaccgcaccccctcgatgtcaagcacctgcactcagactcacccacaccacgcccaccctcttctgcagaccaagtttgtgaagagcggggacgtggccatcgcccggatcgcgacagagcgctccatctgcgtggagaaatttgacgtggtgcctcagatggggcgcttcaccctgcgagacgagggcaagacaatcgccatcggcaagatcgtcaagctgccaaaggccaggtctggcgaggcgggggaggcaggcgagggcgcctgaggatccccctggcgctccacgggcatggcccagatggtactaccatggtgcgaccttggcgggaggctgctgtgtgtcgtgtgtacaggcctcatgctcaaaggggttggcactgcagaggggcagagacnnnnnnnnnnaccctggcgctccacgggcatgagctagatggtactaccatggtgcgaccttcgcgggaggctgctgtgtgtcatgtgtacaggcctcatgctcgaaggggttggcactgcagaggggcagagacccttgcagggtcagacacaggcggcagggtgatggaaactggggtggcacgggtcagaatgcgggtgaactgcggggatgagtgggcagggtcannnnnnnnnnttggagtggcacgggtcagtttgcgagtgaactgcggggatgagtgggcagggtcactcacgaatcccggcgttattgctgggctcggagcacggcgagcgcggtgctccccggcagctgcgcccggcagtacgcctcccagggagttggggcgggggcgccctcctccgccgccttgggcacggcgacgcccgctgcctccgtctgctcgaaggcggcgcgcacgtgggcaagcagctttttggcggcttcgcgcgcctcgggggtgttgtcggtcagcaggcggccgctggccgccagcagggagggcacggggatgcctccgagggtgttatcctgcggcggcagtaggaaaggaggatggggtggagtggatggtgtgactgcctttggaatgagggctgcaaagagcatcatgacagagcaccagagcctgtaggagatggcctgccccaccnnnnnnnnnnagagggctgcacagagcatcacgacagagcgtcagagcctgtaggagatggcctgccccacctccaccagcaccacgtcactcccaacagacatcgacacaggcaccacccatcacgacatgcccgctctccggctgcacctgcaccctggcctgcgcgaggctcaggacgatggcggtgcggccccggaccttggggctcttgtgctcggtgtagggcagcagcagcgcagacagggcagcggggtccacgctgtctgccgccagctgcagcaaggaagggggagcgcgcgatgttgcgggcaggagaggggagagctgtcgactggcggatgccatcccccccgccagcaatctcacgcccatcagcagcgcatcaacaccactccctgccactcgcctcgagggtgcgctgcgcctccgtcacgannnnnnnnnncgtcgactggcggatgccatcccccgccagcaatctcacgcccaccagcagcgcatcgacacccctccctgccactcacctcgagggtgcgctgcgcctccgtcacgacaaactgcttctcgctggaggcggccttgagcaggagggagcccaggaggctggtggtggggcccgccgctccgcccacatcggccagcgccagcagggcatctcccagtgacaggaacaggtctcccacagccaggatggcggtctggtggtggtatggagagaactgggttgacggtgcaggaatgggtgtcaagggacccagtctggccgcgctcaagcacgtctccgcaggaccccatgctcggatctacattccggtcccatcgcctcccttgcaccttggtcacggagctgcgcaggctgcgcacagacttgagcaccaggggcaccagctgggacctggaggagtgcatggtgacgaagctgtgaatggtttgcccaagcatgcgcggggtcgcatgccgcatggatgagtggatgcagtgcgatgacagcaaacaccggatcagcccgtgagggcgacgacactcccatcgaagggctgacggcgccgtaatcaaaggtcaggccacctcaaacacgctaacccctgcccagacaggcccaccgatctcgaaactcacaggtgaggctccnnnnnnnnnntgtgagggcggcaacactcccatcgaagggctgacggtgccgtggtcaaaggtcaggtcacctcaaaaaccctaacccctgcccagacaggcctaccgatctcgaaactcacaggtgaggctccagcagggcggcgggctcgtgcacggtcagctggcgcagcgtgcccagcgcacggcacacctccacccagtccgccgaggcgagcgtcgtggagagcagggtggacagggcttgctccggcgagcccaccacgcgcgtcagctcctcccgggacgggtactccacctccactgccacgggctcgggcccgtctgggagcttgtcggtggcctggacggtgtccgggagccgcttcagaggtcggtcatcgccctgcatacaaatgggagggtactggaaggctcggtcaaggaggtgaagccgaagggggggatgaaggtgaggctgagcaggccgatccttnnnnnnnnnntatgggagggtactgcaaggctcggtcaaggaggtgaagccgaggggggaatgaaggtgaggctgagcaggccgatccttgaagcacagcgtgtcacatacccaggctggcgcgcccttggggccaacagtatgaggtgaaaagggtcccgcccctcacgagacgtacagtgagcttcttgggtggggcgacgggggtggggctccgcccaggcagagcctctcctgctgctttctgaggcccgctcatgggcagggtgttcagggatcgctccgccagaacaggcgttggggcttgtttcaggcgatctgattggtcttcggcggtgggactggggtcgggtctggtcggctgctcgactgcggctctctggagctgtccccttgtgcagaccatttgctgcccgccgttgccctttcaggaccctagagctgcatataagtgacattcaagtgtcacgagcttgtaatggaaggcatggaggcacagggcttgcgatggagcctcaagttgagatcatagggactgccggacatacccaccttttgagttgggagcagccagcgggatctccctgatatcgctaccgcagctttttaagcctccatccacgccagatactcaaattacactttattggaacgccttgtcaatccacgggcaggcnnnnnnnnnntctaccgcagctatttaagcctccatccacgccagatacttgaatcacactttttggaacgccttgtcaatccacgggcaggcacgacccacgaggcgagctcgggcaagtgttcctggagtcgcttttaggaaaataggaaattgtgcatgtgttcaaaatccggtagccgagaaatcctcgttgatcgggttggaaagcgcgtaccaactcaccagtcagggttgcagattgcgacgcagaacagtccaacgttcgatcacattttgatctgccgacgccatcacgcatcgcgaatcgaggatcatgacggcgcacattgagctgtggaaggtggcttcagatggcaccattgcggccgtgccgcaaccgacaaatgctctggactctggtaagtactccccgcgactcttgcgaatgctcagtattccctgctgcttgctgatccagctgcccccctttcaggtgcggcctacgtcctgctggggaaccnnnnnnnnnnttcttgcgaatgctaagtattccctgctgcttgctgatccagccgcccccctttgcaggtgcggcctacgtcctgctggggaaccaagatcctcgtcgggtgttcgcctggatcggctcctcggccactcaggtcggtgggattggagtgagtgcagagcagtcgtatcagcctttttgttaccaagcgcgacaccatgcggtctgcaggctgccaaggagggggcgcaaaggcacgctgctgagctggtggaagccatgcccagcattgcggccagcctcttgcacatggagggcggcgagagcgaagccttcagagcggtgaggtggagctgcaggcatgctgaggctgaggggctcagcgccgcgcacagcgccacattcgaccagccggtctccacccgcacaggcgctcgagaccctcccagacggtgagggcgagcagcccgatgagggcgggccccacgccgttgacctcggcctcgtgaacgatgtggagcccctgcatgtcagcaaatccagcaagaagcgtgaaaagaagaaaaagaagcagggcgcgactgggggcggcccggcgcccgccacccccgcccatgcctccctgagtgatcgcctggatgcagctgccacggatgccgggccagagggcaggcatgaggaggagaaggaggaggctgcgcaaccgtctgcgaatccagccgctgaaaagagagtggaggagccttctttggcctcgggagccccggccgaggtgtccaaggcagcagatgcggcgagctcccccagtgccaagagcccccccagggaggcgcctggtggagcacccaaagcagcgcccaaggaagctgaggtacctttgcccgagtccacggtgccagtttcggagacaacagagcccagcgattctgctcttccctgcgaccctgctgttgtgccggagccagagtccgtgcccagtcctgaggccccggtcctggaagggcagaggccgggatccaaggtggaggagccagaatcggtccccgtcccaacacccaaagtgccagaggtgcagtcaagcaagccagaagagcagtcgagcaagccagaggtgcagtcgggcaagccggcagctcctctgcaggagcacaagtccaacacacccaaggctgcacctgcctccaagaagaactcgttgctgcagcgctggcgggaggcgaccactgtcagcagtactcctgtggcaaaggtaagatgggatgctgtgtctcccatggatggaggattggagagcatgggcgcctggggtgggcaatgcagtggccattgcgtcgtcatgctccaaagaatctcatccgcaatcccagcagcaccccattcacaccttcccattccttcgcaacagctgggtccggctgcagatagcgccaaggcatgggacagcagcatcgctgtggcagctcgcattgcggtgaccctggcccccggcgagcaagtgttccctgtggaggaactcaagggtgaggaactcgtgctcgagggggcgtacaaatggagcagctgtcgcaaagctgggaggggctcgtatatctgacctatcctgagaggagcaaaacaatacagcgctccgatcctcttgccctgtcctgctgtcagggctgcgcgccgagagcgggatcgacatgacccgcaaggaggactacttgtcacctgccgactttgagaaggtgacccatgggctgttgagtccggttgagggctggtgggcggcagacctggttctcggtggagtgccaggtcttttactctgctctgttatcaatgaagcgagtcgttcctcgaaccctcacccggatgcaaagccacgtcgcgcaggtgtttggcaagacgcgggaggagttcaaggcccagcctgcctggcggcagaccctggccaagaagcaggtcggcctgtggtaggcaatggcacctcttcacgatctgcttcccgtcgcagagtctctggtaccgctattcccacgttccttcctgcaagcgtctctgcttcaatgccaagtctttgtggagcgatgtgagggactgcaccatacagcagcccaagtactgccttcccctctatgaatagagtaagtgtctatctgtaaagctccaccacaacgatatggcaagggaccaacaggacaagcagccggctgatggatcatggggaaagacgagggtggcctgccgtaatgcacgcccatcccatactggaggggaaatgtacacgctccacagtttcaaggaccgataaaggggctccatgccgctggcccctcaagtgtggcgctggaccttgtcatcggtcccgagggtgaacaaatgcaggccaccatgtcgctggagcaccggaagcagcggctgcccagctactaggaggggccacacactttctaggtcttgcacagtcagcgacttttcgccagcaggtgccacgacagccgcggcagtgccacctctgaggagagcagccacccaggcggggtttgccgtgcgtgtgaggaagacgacgctgcccgccagactcgccgccagcgcgccctcgcccacctgcagtgggagtgttcctgggtacgtatgacggaccctcagatggagccccgaaccctcaactcccatccctctcccatgtgcacttgcctcggcggtggacaggctgcggccgggggagacgtgctccatgaggcggagctccacggatctccccccgccgacgacctgcgcgtgctgactcagcagcgacaggcgctggtcgccgccaggcagcgtgcacgccggcaagggggagaagagggcggcgagcggttgtccgcacctggcctcccactctgcctcggcggggctgccgcccagcacggcgtggagctcgctgcgccagctcagcaccaggtccccggcgctgctcacaggcaggtccagcacgaccgccgccgtcctgccaggcggcagcgccgcggcgacggccgcggccagtggggccagggagaggccggcaccagatgcggcgccgggatgaagaacagctcgtcttgcgcgcttgcgcgagcgggccgactgcggcaggaaggaaggggcggggccgccgctgtcgccggccccgccctctgcccttgcggcatcagcgttccccgccccgcccttgctggggctgaaccaggaggtgaggtactcgctcagaccgccgccggcaccctggctggtgccttgcgtggcggccggcggatccttgctggttgacgcagtgggcggcgggttgaggggcgactctggctcctggccgttctcctcctggtcgctctcctgcgcttcttcctgctgagttggctcgccatcgtgggttggtccggatgccgccgacgtcctcggccctggcgcctctgcgccattgctgagcggcgtcggcgaggcaaagaagctgtctgtgcagagcacagtcaggttggcagtcggcaggggtgctgtcaactccgccttccgtgcacccagctctggggcatgcagcaccacaattcgagccccctgatcgagcctgagnnnnnnnnnnattggcagttggcaggggtgttgtcaactctgccttccatgcacccagctctggggcatgcagcaacacaattcgagccccctgatcgagcctgagatggcgcaggcttgaggaccctcggtttgggtcaccctgatcgttctttgtctccatgccaatgccctgcacacgccgaagaaatggggttcagcacgcatgtgccttgggattcacaccaagggacaaggatcttgcagcgatctgcatccccaagtatgaccgccacgcaaagcccaccttcatcaacgcggcggcggccgagtccagctgctgcccagagttctggatgcattcctccgtggccgcctccagcttggcccactcctcctgccggatctcgtccagcgccatctggcaccgagcgtccatgggtgagaacctggagaatgatattgggaggagggggcaatgcaggaagtggtagcagagggagagcagaatgcgtgtggattggagcatagttgcctaaattgcagcagaacctagcccgtgacggcagttgttcattgcggcgccgacggctgtctgcagatggacagtattcccaagccaggactcctctcctccctccttccaacccttcacacaacctgaagtactgcaggccggggatgaggtgcgcggtggcggccagggtctcagccacacgctccacgtccgtggcggactcgatgaggatgttgcccgtctccatgaaagaggagaccgcggcggggcgcggcacgcacggcaccgacccggtgccaatgctgacgaggacctccagcggcgtgccgggccagagtagctgggcctcctgcagcgccaccagggcggggttgttgatggtcaccgcaccgtcctggaagcgctcggcgccacactcaaaaccatcgaggtaataggtggcagctgtgacacgggggaggggggctagggttgggagcttgggagggagcttgattcgcggagggcagatgagatctgaggtgggaggagcaccgacaggacaagctctcacccgaggaggcgcgtgctgcttgccagatggcgtgcctggagctcccgccatgcgccgctagctgcaggggtttgaggctcggtgttgggtccgaggcacgggtgctcggagcgcccacgactccctgtgcgtccttnnnnnnnnnnatgcctggagctcccgccatgcgctgctagctgcaggggtttgaggctcggtgtcgggtccgaggctcgggggcacggagcgcccacgactccctgtgcgtccttgctggtgccatccagtgtcaatgcagactccctcgcagagacctaccccctcagaccaggcatcacgccggcctgctcaggaatactgcactgcagaaccccactcctcccctcttccgcacctcctgcatcctaccccgcagctcggggcccacttcatagtttnnnnnnnnnnggagacctcccccctcagaccaggcatcgtgccggcctgctcaggaatactgaactgcaaaaccccacccctcccctcttccgcacctcctgcatcctgccccgcagctcggggcccacttcatagtttcggaagacaaagggcgtggcgggcatgaccgaggccagggtggccacgagcgccaccctcgggcagtccagcggagcggaatctgggtgcacaaaggtggcggtgtctgggagactgttgagcagatccgggaatgtcctgccctactgcaggctccactcaatcaaggggctcagcagcaagtgcatgggactgggactgcacactgacgcccggtggccccactcatctctgcggatgcacaccataccagctccacacgaccctcgtgccaggtggcagcacgccnnnnnnnnnnttgggactgcacactgacgcccggtggccctgctcatctctgcggatgcacaccagaccagctccgcacgaccctcgtgccaggtggcagcacgccccggtcccacgcacctatcatggacttgcccagcacctctgggaaggcgctgaggtcgcagtagtctttcaggagctcctcgtacatggctgggaatgaggggggcatgggacaagtcattgcgggtgcagagtgtgaaatcaatgcggtgcaaatcgcaaaccagtgccatgaaggaatccctcaaagtggaatccagtgcgcgagacttctccaaatcagcccagaccacagggatgggtcgctctccatccccagctcccccctcctcagtcataggcctccttcctgccctaccccagtgtctcgccnnnnnnnnnntgggcagtccagcggagcggaatctgggagcacaaagatggtggtgtctgggagattgttgaggagatccggggatgccctgccttactgcaggctccactcaatcaaggggctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcggacaggtcattacgggtgcagagtgtgaaatcaacgcggtgcaactcgcaaaccagtgccatgaagcaatccctcaaagtggaatccagtgcgcgagnnnnnnnnnnnnnnnnnnnnnnnnnnnnnacctactagcctcctccacaaaatcatcattgtagaagcctgcccctatccgcacaccactcccccctcccaaccaaccaatccctcacccgnnnnnnnnnnccctactagcctcctccacgaaatcatcattgtagaagcctccccctatccgcacaccacttccccctcccaaccaaccaatccctcacccgagtcgtgcttgtagccgaccaccacggcacgcacatgctgggtgcgggagtgaaaattgcggtagaagctgtccatccacccctcctcccggtcctgggcgccgccgcgggagaagacgcgctggcccagcaccttgtagatggcctcgcactcgtccagggtcatgcggcgcagggccagggccaccgccaataatccccccgtggaggtgcccacgatgaggtcaaacagctcgtgcacacgccgaccggtccgcgcctccagctctcgcagcatgcggaccgtggccatgccctgtttgggggggcggggtggggggttgagttcccaggcgggcatcgaggatgggcggcaggcgcttgttcctttctggcatttggtgcggggacgtccagagaacccctgcccgcctggctgcnnnnnnnnnncgaggatgggcggcaggcggttgttcctttgtggcattcggtgcgggggcgtccagagaacccctgcccgcctggctgcgaatatttactcgcaatcccaacaaaagggagtgccataggcaggaaggggttccgccctagcacctgccgcccgccagattccaccccttccgcccaccttcatgcccccaccgtccatggagaggatgcgcacgccgcgcnnnnnnnnnnaccttctgcccaccttcatacccccgccgtccatggagaggatgcgcacgccgcgcccctgcatgggcgcccgacccacggcccgctgcaccgtcgcgttctcccctgcaagtggaggtgtgggaagtgttggtgaagcggaggctgagtatctgggcgcaggcgaggcctgattcgacgaaaatgccattggcgtgtctacctctcacccgcatcaggcgctgtcatttgccccaagctgctgcgattgccaacacgaccccacgacaagccgcgcagcaagcnnnnnnnnnncgccatgggcgtgtctacctcttaaccgcatcaggcattgtcatttgccccaagctgctgcaattgccaccacgaccccacgacaagccgcgcagcaagcctgcgccctcacgcgacaccctaccatccccccggcctccaaattccctcccaagctccccccacccaggatggccagcacgcnnnnnnnnnnaccctcatgcgacacccgaccatcccccccggcctccaaattccctccctagctccccccacccaggatggccagcacgcggatggcggcggcccgcaccgggcccccgcccgcaccccccgcctcccccgccaggccgtccacggcgtccatgagggggcgccggcgccgcagcgcggcgcgcacccgctcgccaaagcacaggttccccacggcttccagggccgcggccagcacccctgtctccaccccgggccgcgtgcacagtccctccagtgcgtccagcacctcctcccccgccacgcgcgcgccggcggccgtggaggtcaacgccagcgcgcacagcacgcgcagcgcggccagcgtgacggcgggcgaggcctcagagcgcagcaggcccagcacgggggacacatcgcgcgccgccaccgcctcggccagctcggggccgtgcgaggcgagcagcgccagcgtggcgcaggtctcgcaggccacctgctccgagtcggacagagccatgagcaggagctgctggagggcgccctcctgcgccaccatctgggtgcggtgcttggggtcggaggccgccaggtggcctgcgggtgagagtggcgggagggggggtgtcgtgggcgctgacagggcggcttcccaccttgagggggggggagtgatgggggtggggcacatgcaagcggtggcaggaggtcggggaagggcagtgctgtcannnnnnnnnntgggtgctgacatggcggcttcccaccttgaggaggggggagtgatgggggtggggcacatgcgagcggtagcaggaggtcggggaagggcagtgctgtcagtggctgtgagcagcgtcgtgctgagcccacttctgctcgttgcacactgggaggtggaaccaaacaaggaagctccagctggagtcaaggagctgagggtgtacacgcagcttttacaaggccattgtgatgagaccatcacgccgttccggtcctccagctctccactttgcacccccccccacccactgcagtgactcacgcagggagcgggagaggatggggtggtgccccgcgctgnnnnnnnnnnacgtcgtgctgagcccacttctgctcattgcacactgggaggtggaaccgaacaagggagctccagctggagtcaaggagctgagggcgtacacgcagcttttacaaggccattgtgacgagaccatcacgccgttcccgtcctccagctctccactttgcaccccctcacacacccactgcagtgactcacgcagggaccgggagaggatggggtggtgccccgcgctgcgtcgcagcatgagctcgaagatggggcgaagcctgtctgccgcgcgccgtgactccccccacaggccgtacccctggccagacaggggcaggagctgcacggagagatcggagccgtccagcgagctcgtcaccctgaagcagatggagggcagggaaggtgggcttggcactggtatgagcagcgtgcgaccatgcacggcgtcggtgcagatgcccacgccgcccagcaccggccccaccctgttcgagagccgccccgttcacccctgcaaacccagcgacctgaggttggcgacggacaggttggtcagcgcggcgcagggcccgatctccggcagcacctccagcgggttgcccagcaggctcagcgtgcgtagctggcgcagcgctgcaaagttcaggggcacgtgggtcagcctgttgccctccaggctcagcgtgcgcagcgaggcgcaccgcgccagctcccccgggatgaggctgatgtcgttgccatccgcgtgcaggctgcgcagagcggtcagcgaccccagcgcgggcggcagcagcttgaggccgcagcccgtcaggtccagcgtgcgcagctcgcgcagggccccgaccgacgcagggagcgcgcccagagcgctccccgccaggtccaggcgcgtgagcctggcacccagggcgcgcaagacgtcctggtcggcccagagcgcggcggcgccggggccgcgccagcgcagggaccccagcgaggccaggggcagcgcgcgcagcgcggcgctcagcgtcgccacctccggcgccgaggcgggggcgcccacctccacggagtgcagaaccagcttgtcgcgctggacggtgaggtcagcgcgcacacgctctgagtggaaggaggaggcgtggaccaggcggcggggggagggggcctcggcggtgtgcagcgtgaggcgcgcaaactcctgccagagggagggggcctccagggcctcccgcacccgcgccaggacctggtccctgggctctgccgccggccaggacagggtggtggagtgaagggaggctggcgacctgtttattttgtgtgaggggggaaggaacaacgtcctgaggtgcgcggtgagcctcggcaagtgaggtcgtgccgtgggccaaagccgtgctcgccgctagggaggaataagcgcatgcatgcaattgctcgacgtactcttcatcatctaggtcacgcgcatgagctccatccacgaagtcgagcttgaggctgaccagctcgacctgggtcttgaaactgatcttgccaaacatggtcagacctcgaggcacgaagaacgctagccatgcatggcggaagttaaagtttaaagtattaagatcaacaaaatggagcaacgagatgtggggactgaagctcgacgtgtaatgtcgatgggggttgccgtctcccaaagatcgtccccgtccttggttggagagggcaagtggatacgtggcacgcctnnnnnnnnnngaagtttaaagtactaagatcaacaacatggagcaacgagatgtgggggctgaagctcgacgtgtaatatcgatgggggttgccgtcccccaaagatcgtccccgtccttggtgggagagggcaagtggatacgtggcacgcctggacactgatcaatttcgtgccagcgacaaccttccacagcatatcccgaaacagctgatcccctggtttccatgacctggaaactcataccatggcatgcataggctgaccagctgaggcgtagctgcctcgcctcatccacccatctctgcttaaaccagccactcactccctggcagcgaacagacattgtaaagagtgtttaaattatgcaaaacgtatcatggcatccaggacgctcgcatgacgcaccggcaagcagagcatccagggtcgaggaacacaggaccaccagatgctccacatctgggaccccagggatggggattttgtaagtttcaggggacgagatgaattgtgcaacggagagcgtaggttgggaaggtttgggcttggccatacccccgtgggcgagcaggtgagtcctgccgtcgcggacccggggggggcagaaaacggtattcgaaggtatagtaagggattcaattgcaccgcggcttaccccgtcccacgtatatcaggctctcttcaggcggcagggttggcctagggagctgcggggtcctcgacactgcatcgtnnnnnnnnnnnnnnnnnnnnnnnnnnnnnnnnnnnnnnnnnnnnnnnnnnnnnnnnnnnnnnnnnnnnnnnnnnnnnnnnnnngaaggaggggcggtcgttggggtctgtggccaggcacgacgccatcagctcctgcggaggaggagggtggggttggtgggagagggagggacatccttgtctgaacctgctgccttctgtactcaagnnnnnnnnnnaacgagatgaaatgttcgacggaaagcgtatggtggggaaggttgggcttggccatacccccgtgggcgagcaggtgagtcctgccgtcgcggacttgggggagcagaaaacggtattcgaaggtatagtaagggattcaattgcaccgcggcttaacccgccccatgtatatcaggctttcttcaggcggcagggttggcctaaggagctgcggggtcctcgacactgcatcgtagggcttctgcccagctgcagcataccagggggctgctgagtcactgcgaggatcttggcctctgggcacgcgccatctggccgagcttctgcccgatcctggcaaaggaggggcggtcgttggggtctgtggctaggcacgacgccatcagctcctgcggaagaggagggtggggttggtgagagagggagggacatccatgtctgaacctgctgccttctgtactcaagaggatcgtggttgtcgatcgtgttgcccggggtcaccgccatcggtccatccctcgtggagcgttctcctgtcccttggcaaacgtcatctgcctcacaggatgcacttcgtgatcccccccccggccaagcctcacgattgcgcccctgccatcaagaaccaaagccgtatcaagggaacaaccccccaaaaaataaagcccacctgcagcagcggcggcacgcccgacaggctcttgaccggcagcgtctggccctcgctgaccaaggcatggaggacctggtggtaggaaagcgtgtcccaggcccgcttcccggcgcacatctcccagagcagggtgccgaagctccagacgtccacctcgtgggtcatcggcccgccgcgcagcagctccgggggctgcagggaggaaaggatggagggagttttcgggggtgtaatgggaggagctagaggctcccacctgggaacactcctcgagactgtcgctttactccatgcaaaagtcgaagcaggcattccctcggcaatccctcggtcatgtcctccccatactgcacacctggcttccaaacactgccaagaacccttgaccccaagcatcaactccacagcacctcccctccccctcccttcccttcgcaccatgtgggtnnnnnnnnnngggtcatatcctccccatacttcacacctggcttcccaacactgccaagaactcttgaccccaggcttcaactccacagcacctcccccccccctcccttcccttcgcaccatgtgggtgacggtgccatgcggcgcggagtgcaccgactgcatgccgcggatgcgggacagcccgaagtcggagaccatggccacccagcgccgcgcatcgttgggctgcgcagtgagcagcacgttgttgcccgacaggtcgccgtggatgatgccgcaggagtgcaggtaggccagcgcccccgcgatctttgggaggaaagggaggagtgggaggggtgggcgacggcggcggcggtggagctgcctgttggcctcgagctgcgggtcctcacctcgcaaggcgcatccgcacacgctgccccgcaaaacccgatgccttccaagcgccgcacgatgtcatcacccacatccactccagggcacagcacccacctgcccttccgcttcacaccatctcgatgggccttcccacccacacgcattcgtcaaacccccccccccccccccnnnnnnnnnncccaagcgccgcacgatgtcatcgcccacatccaccccagggcacagcccccacctgcccttctgcttcacaccatctcgatgggccttctcacctacacgcattcgtacccnnnnnnnnnngactaatccccgcccacctcccccgcagtgctcaggatggcccgcaggttgggctggccgtcctgcgccaggtcgccgcgctgcacggcctcgatcagcgacccacggctgcagaaggcctgcacgatccaggtggcggagtgcaccaggccgcgcgcgtccacctggagggtttcaattttgtgcggaaagggggggttggtgaatgaatgtgtgcatggtagggtggggggcgtggtgatgggacgatgggcaccctgcagtacccacacactcccgccctccaccctggtgctccgcggcccccgccaaggcacacacacccaagcacagacccccctcgcctcttcacctcgccctgggtgccggcgtaggcgtnnnnnnnnnncgcccccgccaaggcacacacccccaagcacaggcccccctcgcctcatcacctcgccctgggtgccggcgtaggcgtaggtgggcacgatgtgggggtgggccagggcgcggcccagcgcggcctccaccacggccgcgtgcgtgtcctgctcggcgcggacctccacggagcgctggcgcaggagggcccccgcgcccgggtctgcccagcactcgacgatcttgacggccacgcggccgccatgccacatgccgcggtaggtgcgccccgagctgcccacgccgatgaggcagcccagcgtgacctcgcgcatcagccccgggcgctgcgcgaagaggtgcgcgggcagggccaggcggcgcgaggcggccagcccgcccacgggcgtctccgccaccagggccgcgtccatgcccgacgcaatggccgccaccatggacccggccaggcgctcgcgcgccgcgccgctgggcgcgcg

SEQ ID NO: 46365 - DNA, 65 bp, Chlorella protothecoides
cgccctgcctctctgtgcactcgcccccgatgccccccccccaatcgcgtgcgctggcgcaggag

SEQ ID NO: 46366 - DNA, 61 bp, Chlorella protothecoides
cacctgtatctgttcgtggacctggcgcagggcgttgaaccccccgggcatgctctccagg

SEQ ID NO: 46367 - DNA, 61 bp, Chlorella protothecoides
aggggccgcacagggcagaatttgtgcgggagccaagagtcctggtgatcgaggcccaacc

SEQ ID NO: 46368 - DNA, 17661 bp, Chlorella protothecoides
  modified_base (186)..(195): a, c, t, g, unknown or other
  modified_base (259)..(268): a, c, t, g, unknown or other
  modified_base (1481)..(1490): a, c, t, g, unknown or other
  modified_base (1753)..(1762): a, c, t, g, unknown or other
  modified_base (2935)..(2944): a, c, t, g, unknown or other
  modified_base (4026)..(4035): a, c, t, g, unknown or other
  modified_base (4109)..(4118): a, c, t, g, unknown or other
  modified_base (4183)..(4192): a, c, t, g, unknown or other
  modified_base (4312)..(4321): a, c, t, g, unknown or other
  modified_base (5028)..(5037): a, c, t, g, unknown or other
  modified_base (5145)..(5393): a, c, t, g, unknown or other
  modified_base (5653)..(5662): a, c, t, g, unknown or other
  modified_base (7446)..(7455): a, c, t, g, unknown or other
  modified_base (7622)..(7631): a, c, t, g, unknown or other
  modified_base (8204)..(8213): a, c, t, g, unknown or other
  modified_base (8787)..(8796): a, c, t, g, unknown or other
  modified_base (9317)..(9326): a, c, t, g, unknown or other
  modified_base (10338)..(10347): a, c, t, g, unknown or other
  modified_base (10913)..(10922): a, c, t, g, unknown or other
  modified_base (11157)..(11166): a, c, t, g, unknown or other
  modified_base (11535)..(11544): a, c, t, g, unknown or other
  modified_base (11610)..(11679): a, c, t, g, unknown or other
  modified_base (12219)..(12228): a, c, t, g, unknown or other
  modified_base (12686)..(12854): a, c, t, g, unknown or other
  modified_base (12957)..(12966): a, c, t, g, unknown or other
  modified_base (13069)..(13078): a, c, t, g, unknown or other
  modified_base (13311)..(13350): a, c, t, g, unknown or other
  modified_base (14150)..(14159): a, c, t, g, unknown or other
  modified_base (14969)..(14978): a, c, t, g, unknown or other
  modified_base (15605)..(15799): a, c, t, g, unknown or other
  modified_base (15913)..(15922): a, c, t, g, unknown or other
  modified_base (16554)..(16646): a, c, t, g, unknown or other
gcagaaggggtccaccttctcggagatggtaaagctgtatgggggggttgtggagggagggtttgaacatgaactgagtgaggtatggcaggagcacggtttggcagatcatccttgtcaagacacctccccgtgtataactcacgtgaagttcttgcagaacttggcgagtgtggactcgaacannnnnnnnnnatgggggaggttgtggagggaagggtttgaacatgaactgggtgaagtatggcaggagcacggnnnnnnnnnnagggatggtgtgaggcctagtaagctcatcgaggtcggtcctgttcaggaagtcgcccaggctgctcttcaggtcgaagggcagcagcttctcccagctgaagtccttgtgcttccatgcctcaggcacgtgctcggtccagttctggccaaagaagttctcgaaaaaaccatggaagtcctgcagggaagggggaggacaatgtagtcatgagcacagggcaagatcggtggagccgcgatggtgcatttcgaagaacacatcaacaaccaacactcacgtcagtgaagctcagcaggctgcggccgcgggtctgctgctggctggcgatggccgtctcgagctcgctggtgaaccctttgaacactgcagggggcacatggtgggaaggtgaatcaggtgtcgcaccagggtttcccctgctcgagcatcgcggcaatcccgaatccaaaggcataatcatggccgcttaccctcgccgatggactcagcggtgagtgggagcttgtctgcggtgacaaagctggtagcgcaaagggccaccagcacaagcattagtgcgcgcgccatggtggtgaggtgtccgtgccaaacttagcaagcagaggcagggagatgagattatgccggcccaggcacattggcgagcattatatttcgctcgagcagattgatcttaaacgaactcttgcctcgagatgcgtgccagctgcgggcgacggcgacccggacggctgggttggggcatctcggagttcgtcagctttcatgcaaattgcgacacgcagtcgtcgcagcactgataccggatgcccctcgatgatgtgtgtgtgcgatcattccgcatctcgagtccgactctggatgtgtttgccgtgtctctagcgcccaaggggacagggacccatcatcaacacgtaaaggtttttgctctgccagggcgcgcacaccatacattcaccagctcaccccgtgcaagcaagatgcgacactttgtgcctgctttgttccttcatgctgtgaacctcaatatccataacgatcgggaggcccagggactccagcttgcaggctttcgcccatggcatccctgtcagcatgccgcaaactcctgcctgcgttgctggcaagctgccgcacgggaccctttgctgccactgtacgccacagtgaaaggagctatgccgatgccgtggcctccacgctgactccnnnnnnnnnnagcgagctgccgcacgggaccctttgctgccattgtactccacagtgaaaggagctgtgccgatgccgtggcctccacgctgactccgcccggtagtttggccctgcgacccttttcctcgtctcggccacggtgcagcgacgacaagtgagccggcatatggatcggcgacactaggatcagtcaatgcggcagggagtgtataggcgggtcgtcggatcacctgcctccacctcccattgagcagggtctcagtcaccttnnnnnnnnnntggcgggtcgtcggatcacctgcctccccctcccattgagcagggtctctgtcacctttgctgacgagaaggatgggtcagaggtgaccattcaggcacctctaggcaagtccctcatggagattgcgcacgacaacgacgtggacctagaatgtgagcctggatgtgcactgtagggcgagcgcttggcacagggacccttgccactgcccgcgtcgaggagggtacacatcctattccaggacacttgtgacgtgctgaaaccctcaccccccttccctctacatcccaggtgcatgcgagggctccctggcatgctccacatgccacgtaatcgtggagtcccaagaacagtttgacagcctgccagaggcgacggacgacgagaacgacatgctggacctggcctttgggctcactgaaacgtatggttgggctggtggtgcgtgacatggtggagaagggggttggattttcacgagtgagcaggagattggggccctgcggaccacttcaaggtgcattccgtctcagggcagtgggtcggctggagacagctgtgtgcggctgatgacgttccaatgtctcatgcctgtaacatggggcaggccctgccaccctcccctctgtgcagctcgcgcctgggctgccagatcatcaccaccccagagctggacgggttgcgggtccgcatccccagctccacccggaactttgcggtggacggctacgtacccaagccccactgacggcgcgcatggcgcttgcccttgggagcaggcgctggggaggcccgagttgcgcaccctcccagtgggtcgccagccagaacagcttgctgcctaggcatcacccccctccctgccctgcctgcaccccccccatgaaactgggcccgctcactcgtcgcttgcaaagagcacgcatgacgtttccaggtcgcattcggtgggcacacggtgccgttactggggtggcaggccatgggctcaactgggcatggccctgcgggatggggtcaaagactcgggcgcacatgccggggcgcaggcaggctcgcgcctgcctcgaatctcaggggtccctctgtcgcgtggtgcaccctccccctgccgccaccccccgtccatccagccagcccgcgcccctaggtggcgatggacacgtcctcgnnnnnnnnnnacctgcctcgaatctcaggggtccccctgtcgcgctgcgcaccctccccctgccgccaccccccgtcaatccagccagcccacgcccctaggtggcgatggacacgtcctcggcctgctggtgcagcaggcggatggcctgctcacgcgtgcccagcaggcccaccttctcctccagcacgacgaagagcgggatgtgcttgagcaccttgtcatggaagcgcgagtcgcgccagaggaaggcctcggccaccccccctgcgcgcacgcggtccaggaccttggggaagatgccgccgcagatgtagacgccgccggtggtgaggccgcggagggccatgtgccccgcctcggcccccacgatgctgaggaagatgtccagcgcctcggccgcgcgcgggtcggagccgtccagcgcggcggcggagatggcggcggggtcgagcttggcgcccaggtcgcggccggggtactggctgggctcgtcgctgcccaggaagtcgtagatgcggcgcaggccgtcgccgcagcccacgcgctccacggagcagtgcccccgctcggcctggaccgcggcctgcagcgcgcgctgcttccagccgcgcggcgcgaaggtggcgtgcgacccctcgctggcgcacacgcggtagttgcccaccgcctcgtcccagaacagctgggcctcgcccagccccgtgccggggcccagcaccgctttgggcgcgcggtcctggacgggggcatggtgcagcgtcagcagcgccgactcgggcaggacgggcacgccgtagcccaccgcctcgaagtcgttcagcacggtggcgcgcaggccgtgccgggccgccacctccgcctcgtcgatggtccagcccaggttggtcatggtgcaggcgccgcgcgccaccgggcctgcacaggcgaaggccgcggactgaggggcgtggccggccagcgccgggtcggccaggaaggcggacagcgcgtcgtcaaaggtagggtagtccttggtgggcaggaactggtttgagaggggagggttgttggcttttttattgggaggggggggggggggggggggggggnnnnnnnnnngaccgggcccgcgcaggcaaaggccgcggactggggggcgtgcccggccagcgccgggtcggccaggaaggcgnnnnnnnnnncccctccctaactcaagtgcaggaggggggggcagccaggatcagccccaagccctcccgatgcnnnnnnnnnngttgggctaggcctcggggtggcaacatgctggatactcacgtcaccaaggatgtggggcacgacacaatgcatgccgtgattcaagagcatccaactgagtgatatccttgcggccagnnnnnnnnnnttgggccaggctgcatggctcggggtggcaacatgctggatacacacgtcaccaagaacttggggcacgacaccgtgcatgcagtgattcaagatcatccaactgagtgatatccttgcggccagtggtgcaactcgggtacgacggacccctcagtgccccaccctccctgactcaaatgcaggaggggggggggggccaggatcagccccaagccctcccgatgcaccatgcacggtctcaggggggggttccgaatcccgtgcatcacccactcgacacctcctcaacacaaaacacacagcgcccaccttctccaggatcaggcggctggggcgcaggacatcgtcgagctgccacacctggaagcgggcgttggtgccgccgatgtcggccaccaggacgctgggggaggaggatctgcgggacatggatgcggttatggtaccgtaaatcgagcggcgagcggcgagcctggtccgagaggcggggggtgctgcagccgagagctgcgggaagtgggcggagcaccgccgaggtgcgggggtttgagggtggggtgacgggacacacagcacagatgtggggtgtagacccggcacgcagacaagcatgtcctctggagtgttgggtttggggcctgacgccctgtccgacaccgatgtaggctgggtgcccggtgccgctccccgaaatcggtgatcgannnnnnnnnntagcgagtctttccagatgagcagcacctttaaacggtgctgaggtgcaggattagagcggagtcattggaacttaatgaagtggcgaagaagcgtcccagtcagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggaaggacctggtgggagtgcgacggtgtttaagggttggggttgccaacatcaggcgccagggtgaggggggacagcagggtgttaagctttgaatcgcccgccctcctcgcgattgccatcttcaatactgcgcgtcacaacctctcttggaatcgatcctcccaccctccgcatcgcatcaccgcgatgctccaaccgacatgcctggagaccctggggtcgcagctggggcacagcagggtcaggtgctgcttnnnnnnnnnnaggcctgacgccctgtccgacaccgatgtatgctgggtgcaccggtgccgctccccgaaatcggtgatcgacggggggcgctgcccgccgaaccagcagtacgggggtgcgccagcgcagggcaggcacgtgcttgcacagccatttgaccatgacccagaccatgcagatgctgcaagcacagagcgagtctttccagatgagcagcaccttgaaacggtgctgaggtgcagggttagagtggagtcattgggacttattgaagtggcgaagaagcgtcccagtcagggtcaagggaggagccagacggcatcaggacaatggtacattcaaggtgcgacaggccacgatgcacgctggcggtgcctttgatgccgcgacgttgtgcagcgccgccgcctactcctcgggtctgttcagccggcggctgcgctggtagcgtgccgcggccatgtggctgcggtggggcgccttccgctccgagtcctcgtggtccgtccgttccaggacgcacccgctgtcctccagctccttgatgaagcgagacggcagcaggaaggacctggtgggagtgcgacgggggttcaggggtggagttgccaacatcaggcgccagggcgaggggggacagcagcgtgctaagcttcaaatcacccgccctcctcgcgcttgccatcttcaaaaatgcgcgtcacaacctcttttggaatcgatcctccacccccccgcatcccatcatcgcgatgccccaaccgacgtgcctggagaccctggggtcgctgctggggcacagcagggtcaggtgctgcttcgccctggtcagggacacgtacatgaggcggcgctcctcccgcagcgccgccccgccatcgctctcccgcggcggggaggggatctggccctcgacacacccggggacgaacacggcggcgtactcgaggcccttggcggcgtgcatggtgctcacacgcacactgtccctccgcgccgcggcctcgcccccgtcgggcgcggcgtccagcgcgcagctgtccaggaaggcgcggacgccctccaggcgctcgtcccgcccgctctccacctccagccccaggtcggcgacgggcaggcctggggccccggcctcgcccgccaggcgggccacctccaccagctggcccagccggcggcgcagggtcccggccgtctcctcctccttttcttctcctgtagagctcgcggagggcaggtcctccgccgtggcaccgaccgctctgccgtccttcgaatcagcgaccgcctcgtcgttgtcctctgccgccgcgtccttcgcgccgtccaggtaccccgtggcttccactatgtgcgccagcgcgtcgtgcagcggcatggagcgcagcgcggccgccagacccagcgccagcgcgcggaaggcctcgaccttcttcgcggtggcggcgctcaggcccagcgcgcagggatccagcagcggcagtgtcggcgccatggtgccctccacgcccccctccaagggccaggcgggggggaagagggcgcgcgatatgctgcccccaccggcggcctccagcttggccagggtcgcggggcccagcccgcgcttgggcacgttgatgatgcggcgcagggccacgccgtcccacggcgccagcgccaggcgcaggtacgccagcacgtcctgcacctccttgcgctgccagaaggtgcgtcctcccaggacgatgtagcggatgcggtgccggacctgaggtaggcaacgggcggttgcatgtgggtgttgaaggggnnnnnnnnnngcccaggacgatataggggatgcggtgccggacctgaggagggagacgggcggttgcatgtgggtgttgaagggggagattgaggaggttcctgtgccggttgagggggcggcaggggttgcatgagcatgcgacggggcacctcaaggctgctgggcatcctgtgnnnnnnnnnntttgaaggggcggcaagggttgcatgagcatgcgacagggcacctcaaggctgctgggcatcctgtgatctcacgcacactcaatccttccatccattcccacacaatccatctttccccccaagtagaaataaggaacaaatactcccagggcatttgcctttcccctcagaactcaccagggcctcctcaatggcccgcgtctgggcgtgggtgcggaccagcaccgccacctccgacagcggcacgccgtgtcgcgcctgcaggcgccggatctgccgcgccaccagctcgccctcctcggtcgggccgaggacgctgtgcaggcgcagggcggggccgtggggtagcatgggccgcaggcgcctggactggggacccagcaccgcccgggcggccgccaggatcgtgctggagctgcggtagttgtcgcgcagggtcaggacctgcagtgggttgactgattgggaggtcaggggggaaaagggagatactagatgggatgcaagggtgagcatgcctgatcgccgacagccttgctgttgtcaatcgcataccacgaccccattcccnnnnnnnnnnttgattggggggtcagaggggaaaagggatatactagatggggtgcaggggtgagcatgcctgatcgcagacagccttgctattgtcaatcgcataccacgaccccattccctgccagcacaggcgggcatgcgagcggctgcccatggcagagaaacaacaaaccttcagatcggggtagtctgttctcaggcgctctcccagctgctccgggatggcgccccgccacccatagatggcctggtctgggtcgcccacgaggaacagcgaccggcgaccctgcaccaggcttgcaaccggcccgctgatcgagcagcggcggccaggctggctgccgtgtacaggcacctcctgtcccctctcaaccgacaattaccagacccattccctccagaccataccttctgcagggagtccacgggcgccagaagcttgaccagctcatactgagtggcattggtgtcctggcacacagaggtgcagaaaattgagcttggcacggtggcgtggtgctaaagagccttgacaaaaacaatggaaaagctggcagacccattgcttcacttcgccccannnnnnnnnngttgagcttggcacggtggcgtggtgctgaagaaccttgacaaacacgatggagaacctggcagacccattgcttcacttcgccccacggcaagctcccatccccggacctggaactcgtccacgagtatgtggtggaagcggcggctgagagcatagcgtgcggcctcgctctcctgcaggagggtcaccgtcagggacagcaggtcgtcaaagtccgcagcattgctctgtgccaggctgtcgcgatacctgcgcatgaagtggagggagtggtgggaggttgtggtgcggacagccgtgcatcgcctgaatcaagggcacagcgcaacgagacacccgcatcgatgcccatctggtcctgccctggcttttgacaacagcgcattgggtgagtcaggatgctctcaggaatgagtcccaacatggcagcatcccaccacctacatcccactccctgcagcctctcctctcttaaaaactagcccctaagccccgcagccacctcctcaaccactctcnnnnnnnnnntccaccacctacatcccactccctccagcctctcctctcttaaaacctagccccctcagccccgcagccacctcctcaaccactctcaacagactccgactcacatttcgtaccactggcccatctcccgcgccataatcttgttctgcatcgtcagctcggtgccccgacgctgcatcagctcccgcagcatggcctgctcccccttcagcgctgcgtacccaggcacggagttcttcatcctggagatggcactcagaatgatgcgggcttgcttggcgacggtgcgcttctgctccgccgacgtcctcgcgcccgactgcctgatgtcaatccccgccttgctcttcaccaatcgctgcatcatcgcggtggcggcgtcgccgtcggccaccgagaagccggggcgcacccggcagccagcgggcagctgagagctggcctggcgcagcatgctcaggcccaagccgtggaaggtgcctatgaagggctgggcggcggcttcagggcctagggcgcgctccagtcgctcccgcatctcccgtgccgcctggggagaaggtccaggggattgtgggtgggggagtgtcgctgccatccagggagcgtgtcaacggatggcgttcactcagtcagtcagggacccgaggcgtggtcacttgcacaaggtccagtctggggtgcattccccacatcgcccaggcacagttctggccgcacaacaggctccgccctcgccccaccttgttggtgaaagtgatggctgcgatggagtgcggggcgacgtcatgggcttggaccaggtgcaggatgcgcgagatcagcacacgggtcttcccgctcccaggccccgccaccaccaaggaagtgcccaagggcgctgcaactgaagcctgctgctctccgctcagaccctggaggtgctctttggtgtcacttcctccttcgacggcaaaggagggtgagggtgccgctatggcactgaggccaagttgggcccggggcctgggcnnnnnnnnnnccctccttcgacggcaagggagggggagggtgccgctatggcgctgaggccaagttgggcccggggcctgggcgctcctggtagaggaggacccggcctacctgagccgaggggcgccacagacccatggatgggcctcacacttccctggtacgccctgcaacctcccaggagctgcatggggatcccatgcatgcgcatgctgagctgcatttcaccatgcgaaggaggtctgaccaaggctccgcggtcaagcctcagaccccgtcccaggtgcaatgacatatttgggacatcgtctgcccacttctgatatcggtagggatttttgttgacatgtggatgtgtacatccatgcgcatcccagcactgtgtcctcatccgtttcgaggtgcagcgcgcccaaacaagtgttttcgaatgccggcgtcgttaagatttgcaatgctacggccagtactcgtgcatcaccgcctcacttgcccagccagtacagggtcttaacgcactgcctgctcgcatcatgttgaaaattattggttctggtgatcgccgggacatggagnnnnnnnnnnttgcccagccaatacagggtgtaaacatactgcctgctcgcatcatgttgaaaaccattggttctggtgatcgccgggacatggagtgacggagtcggaggtcgtaccctccctcgttccgaggccgggagcgggcatggcgccgcggctcctcgcaccgctggtcctatgctgcctagtgagtggattggaggtcctgcatgttacgtggctgcattgcgctccccttccctgnnnnnnnnnngccgctggtcctatgctgcgtagtgagtagattggaggtcttgcatggtacgtggctgcattgcgctccccttccctgcgccagatgctcactgtcagtgccgagggatgtcgggcccgcgccgggtctccaccggcagtctccaccgagcaaccctcccccccattcccccgcgcagctgatcccattccacctcggcagctgccaggacatcctggccacccccctggcccccccaccccctgctgctgccacgctgctggaggcggcagcgacgcacaccgcggccaccacggccgcggccgctgagcacctggaggtggccaagcggcaggagtctgtggccacagcggccgcggtggccacagnnnnnnnnnntccccccatccccccgcgcagctgatctcattccgcctcggcagctgccaggacatcctggccacnnnnnnnnnnnnnnnnnnnnnnnnnnnnnnnnnnnnnnnnnnnnnnnnnnnnnnnnnnnnnnnnnnnnnnccgcgctgctggagacggcgcagaatgcggcgcacacggcggccggcactgggctggcggccggcgcggccgccgcgggaggcgccatcaccaccggcgccgtcacgggcggcgcccagacgctggccaacgccgggctgggcagcggcgggctgcagcaggccgcggggcaccagagtgaggccgggcaggcgctcgcagagctagcggctgccaaccaggcctccagcatcctggccgccatcgccgcggcctccccgcccccgcccgacgcgcagcgcacacccgcgccgcgcctgccccgcttctacgacaagccgctgtacaccgacaagctgcgctacgaccccaacccgccaaaggtcgaccgcaaggccctggagcacaagtgaggagggaggggttgattctgtcagggaggaggggtttggggtggccagcacaggagccccatgatgtaggggtgggaagaactgatgaatgcatcacatggcgtgcgctactgggtcggaatcgatcgttctgagcctggactggccnnnnnnnnnngtggggtggccagcacaggagcgtcatgatgtagggtgctaagaactgatgaatgcatcgcatggcgtgcgctgctgaattggaatcgatcgttctgagcctggactggcctggcaagcatgcgttgtttctctcaagagtggcgcccaccccctcagcctcgtccggcctggtgagccccttcctattccatcggatcccgtcaggctgactcgcgagcaggcgtacaaccgcacggagttcatgggccaccggatataccagggcgccgaggaaccagaggagccactgcagctcaagtactcctcgcacgaggtgctggctgagggatcaggggtggggagggaggttgggagggatgtggtgccaaagagtggcacctgggaacgcggagggcttgtcccacttccttgtaaggcgtgcagggttgccaaccttgtctgccaatgctgcgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaatttcacctcagagtaacactgcacaccggctctctgcccctcgttcccacgaacacagtgcataggggtggtgtacgagcaccgcgtctgcacctttnnnnnnnnnngcaaatttcacctcagagcaacactgcacaccggctctctgcccctcgtccccacgaacacagtgcattggagtggtgtacgagcaccgcgtctgcacctttnnnnnnnnnnggggagggatgtggtgccaaggagtggcacctgggaacgcggagggtttgttccactcccttgtaaggcatgcaagcttgccaaccttgtctgccaatgctgcgatgctgtgggatttttgacctgtgcatctgctgcccatcccctccaccactacatggattcgccgaccacgactacgttcgtctaatgcctctggtcgtgtgaagtcatcttctaacaagtcacagctnnnnnnnnnnnnnnnnnnnnnnnnnnnnnnnnnnnnnnnntacgacctggtgctatgggctggccgcatgcactacatctcgccggaccctggtgagtctggggggaggcggggggtggggaggatggagggacctggccttgtgagtaaacctccctcccaagtgggggtcgcagcaattggacttgcccagccatgtgtctggagcattgtgttgatggcagctgcggcacgactgctgccccgagagtgtacagcatgctcgggtgtgccccgcactgcactccccgccttgcaccccctgggaccctgaaggcccactcatccacccgcacgcgcgcccaccccttcacttcccactcctgccttgcgccagaggctgcccgcgcctccatccccgacgtccagctcacctacatcgccagcgaccccttccgtctgggcaccaacctcacctcccgcctgctggtgaccagccccgacaacctgactgccctgctggcggcggacggcggggacgagtggggcaccgtgccaaagatggaggtggagcagagcctgcttataaacctggcgtactggaacaactatggacacctgctgggcgagctgggacccgtggtgcacaacaccatgtgcacctacatgggtctttgcacccaccagcaagtggcaggtggggcgaatgaggagaggttcctttttccggggattttttgggggggaggggcggcggaggggcgggggaggtgatagtggaagtgaaaaaggcaagaaggggctgtgctactgcccacaacaccaatttccccctcctttcagtcatcaaccctcccgatnnnnnnnnnncctttgcacccaccagcaagtggcaggtgggccgaatgagaagagagggttccttttttcgggttttgagggggggagaggggcggcggcggggcgggggaggtgatactggaattgaaaaaggcaagaaggggctgtgctactgtccacaacaccagttttcccctcctttcagtcatcaaccctcccgatctccaaacaataacccccaaaatcaggcacggacctgcagctgtggctgtacaacgagctgccgacggtggagactacgatgccggccgcggcgcagcaggagctgtggccctgcttctcgcgctacccgctcctgcgtctgctggacgggcggcttaatcacaccgcggtggtcctgcgccgtgcggtggcgggggtggggtccacctgccgcgccttcccctggtgccggccgcggtacaaccgcatgccgcccctccccggcatcgtgcgcgggtggaaggagaggatgcaccgctgcctgggcctgcccctggacctcgtgagcaaccacacccacccccgcatcgtcttcatcaaccgcccgctgggccatggccgtgccttcatcaacatggaggagacggtgcagcgcctgcaggtctcgagggtggcggtgggttgtgtgtgtgtgtgcacgcgtgtgtattatagagggtgggcgtaagtgtgtgtgtttgaagagggaaccggagctcaccacatcgacccacgagcaccgcacctcacgcccaccccccaccctccactccactccccgattcccaaaccccacccccccacagagggacttccccnnnnnnnnnntcaccccactccctccaccccactccccgattccccaaccccacccccccacagagggacttccccaccgccagcatcgtagtggagacgctggaggacgagtcgctgcgaagccaggcggccaagtacgcggccagcgacatcgtggtgcagatgcacggcgctgcgctgggcaacgtcttcttcatgccacgcggcgcggtgtacgtggacgtcgtgccggagctgaacgaggacaagcacgcctgggcctacttcatgctcaaggactacgcggcgctgggcatcaaccccatcgcgctgccgccgcagcgggtggagctcatggagtacaccatcaacaagaccatgcgcgggcacctcaacactctgaccaagacgcagaggtaagaggtgtgaggggaggggggtgggttgggggtgattaggcaggggggtggaggagggatgaggaagaaaggggcgagagggttgaggggattggaagtcggagggttcagtacggaccaggccctgaggtggagcaccgctcggttcagtggtcccatcctccactgccccataccgacggagtccatgccccctttcctccctccccccacaaacaggagggcgctcttcgaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctggcttcttgcgagaggttgtcatccaacccgcctgcctgcctgaccaccccctcttcacccctgcacccgccgcagattgaccaggcggtgaaccacatgcagctgtggnnnnnnnnnncacggagtccctggccccctttcctccctcgccccacaaacaggagggcgctcttcgaggaccacaggtgccccgagccgggcacggtgttctgggacgtctactccatctgtgtcatcgagtggttcatgaagcgcagcaactgctacctggactatgccgacctcaagcctgcggtgggtggggctggccggacgagctgtgctcacacttccgccaggatcgacatagctggcttcttgcgagaggttgtcctccaacccgcccgcctgcctgagcaccccctcctcacccctgcacccgccgcagatcgaccaggcggtgaaccacatgcagctgtggcggcacaagctggactcggcctacaccatcaacgcctacgacctaacggatctgcagccggatagggacctgctggacctcatctgaggctggaccctcaactgagggaatggactggaggaggaggaggtggctggccttgggcctggaaccccttgaaagggcaagacgaggagctcctgagcaggggcaatgcaacacacacgcctcggtactctcacaggccagccggccttcacgaggagtgtgcacctgtggtctgcccctcggcgtcacatgccgcgacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccccctccccgtccccgtcgttctgctgcgtcgcgatgttttggaggtttcaaagatttgcacagcctataacatcgatcagaactcatgtttgatacttgggaggggggcaagggaggaaaggacgaagcgtgcgcggtgttatccacacgtcacaaagtgcatatgagcataaagcattggatgatgggggggggggaggggaagtgtggggaggtccggcgccagcctgcatggccagccgattcgcccccttcccttgttggaccccccccccacacgccgcgtgtgggttgggggcagccacccactggctgggttgcggggaaagaaagggttgggcgcaacgcggggacggggggggcatgaccccccgtctggagcattccaggctatgtctgtcgaggggtgcccggggcgggcggctacactgctactaggtctgcgcgagggaatggtacaagggtctgggcgcggtgggtgccccgcccccgcccgcctcagtcgctgtgctggtcctctgcgcccggccgccgcccggcgcggagcgaggcggggagcgggatgccgcggcgcgcggcggccgcgccctgctgcaccgccaccagcgtggaggagggggagggccacatgtcgcccagcttgcccatgagcccgggcatgggccccggcgtggcaaacccacgctccgcctcggccttgacggagtccggcgtgcgcgagccgtcggaggagggggaggcggaggaggtgcccgacacgtaggcgcccaccgtgtccagcacggagatggcctggatggtgttgaggcggttcaggcgcggcgcctccatcttgcggaacaccatgccggtgccctcctcgcgctcgtcgtcgcccagcgcgcccagcgcgcccggcgcgtccaactggatgacggggatggtggcggtgcgccccacggcagcggggtgggggcgggccagcccgccgccgcccacgctggccgcggagcgcggcacgcgccgcgcgtc

SEQ ID NO: 46369 - DNA, 74 bp, Chlorella protothecoides
cggaagaagaaggaccagcacaaggcggcggtggggaaccaccaccgcaaggaccgggcggcgcagaagcagaa

SEQ ID NO: 46370 - DNA, 80 bp, Chlorella protothecoides
cccgacatgatcgagtacagggtgtgagagctttagtctaaaagttcatatccaatcactgatcgattgcatacccttca

SEQ ID NO: 46371 - DNA, 61 bp, Chlorella protothecoides
gccacgtgcctcgaagatcctgcggcggggggccccgcagtgacatgggcaggctgcgagc

SEQ ID NO: 46372 - DNA, 239 bp, Chlorella protothecoides
ccggtggtcgaagtatgtttggcccaaggtgtgtggatgggcgggcgaggcataacaattcctgagcaggaacgtgcttcaggaaggattgcgacaagcatcgaagtatggtgtcctcgagaggtatatggaacacaggttcaatactaagcatgcattagttgacgcagctttatggagcgccgggagttgcacgcagcacagctgtgtcagaggaaagctcgtcgttccgacacgac

SEQ ID NO: 46373 - DNA, 71 bp, Chlorella protothecoides
cgtcgtcggtcacgagctggccctttggggccacataatagcgtcgccgatcgggcgcgagagaggtagcg

SEQ ID NO: 46374 - DNA, 62 bp, Chlorella protothecoides
cctgtccatatcccaagtgaggcgggggggttgctgctggaggttgtccttcgagtttgggg

SEQ ID NO: 46375 - DNA, 61 bp, Chlorella protothecoides
gcatgacggctcgcgggcattgattcggggtgttgtgaaagcagtaccacgtttacgagcc

SEQ ID NO: 46376 - DNA, 71 bp, Chlorella protothecoides
cctcatgccttggcacccaactgagtgccatatgccaaacgccctgggcgtgcaggctgggtggaagctgc

SEQ ID NO: 46377 - DNA, 61 bp, Chlorella protothecoides
ggggtactcctcccccaggttctcgtacagaaccacgcccaggtgggccagcaggccctcc

SEQ ID NO: 46378 - DNA, 79 bp, Chlorella protothecoides
aagtgaccccttgcaccatgatttggtgatgaaacacgagaccttggcgagcagccgattctttgtctgtacagcaggt

SEQ ID NO: 46379 - DNA, 124 bp, Chlorella protothecoides
tggccataaggtgcggctggctcgcagcggtgtgtatctttgggcgatcataggcacccactgctgctctggaggcagccagccctggcaaagtagggccctgtgcatcgagggagagcatgcc

SEQ ID NO: 46380 - DNA, 61 bp, Chlorella protothecoides
taataatgtgatcgtcgattcatgcaatggacccgacgctgaggaagctgcgtctgttgga

SEQ ID NO: 46381 - DNA, 66 bp, Chlorella protothecoides
cgcgcctgctgcgccccaggcggccgaggcggccccgccggctgctgcgccggcccccgccgccgc

SEQ ID NO: 46382 - DNA, 67 bp, Chlorella protothecoides
attcgtggtgaatgcctgcactcgcacatttggcggcggcacgagcctttccctgggctgtatgtga

SEQ ID NO: 46383 - DNA, 132 bp, Chlorella protothecoides
gcatgggggtgctatggcatagcccccccccggccccaggcgtcgtgtgcagaaccctatggctgccgcagcggcaatgtaggtttgggagcacgggcaggaagttgtggcgcactgagcccgatgcagggg

SEQ ID NO: 46384 - DNA, 69 bp, Chlorella protothecoides
gaagtgtcgcgcttcacgctttcacggcggatacaagtcctcgaggtacgtacagcacacatgtataca

SEQ ID NO: 46385 - DNA, 60604 bp, Chlorella protothecoides
  modified_base (1034)..(1043): a, c, t, g, unknown or other
  modified_base (1298)..(1307): a, c, t, g, unknown or other
  modified_base (1776)..(1785): a, c, t, g, unknown or other
  modified_base (3308)..(3317): a, c, t, g, unknown or other
  modified_base (3790)..(3799): a, c, t, g, unknown or other
  modified_base (5118)..(5127): a, c, t, g, unknown or other
  modified_base (5894)..(5903): a, c, t, g, unknown or other
  modified_base (5963)..(5972): a, c, t, g, unknown or other
  modified_base (6035)..(6044): a, c, t, g, unknown or other
  modified_base (7223)..(7232): a, c, t, g, unknown or other
  modified_base (8089)..(8098): a, c, t, g, unknown or other
  modified_base (9042)..(9051): a, c, t, g, unknown or other
  modified_base (9340)..(9349): a, c, t, g, unknown or other
  modified_base (9772)..(9781): a, c, t, g, unknown or other
  modified_base (10270)..(10285): a, c, t, g, unknown or other
  modified_base (10420)..(10429): a, c, t, g, unknown or other
  modified_base (10950)..(10959): a, c, t, g, unknown or other
  modified_base (11740)..(11749): a, c, t, g, unknown or other
  modified_base (11994)..(12003): a, c, t, g, unknown or other
  modified_base (12471)..(12480): a, c, t, g, unknown or other
  modified_base (13020)..(13029): a, c, t, g, unknown or other
  modified_base (13691)..(13700): a, c, t, g, unknown or other
  modified_base (14408)..(14417): a, c, t, g, unknown or other
  modified_base (14975)..(14984): a, c, t, g, unknown or other
  modified_base (15439)..(15448): a, c, t, g, unknown or other
  modified_base (16199)..(16208): a, c, t, g, unknown or other
  modified_base (16572)..(16581): a, c, t, g, unknown or other
  modified_base (16761)..(16770): a, c, t, g, unknown or other
  modified_base (16872)..(16881): a, c, t, g, unknown or other
  modified_base (16953)..(16962): a, c, t, g, unknown or other
  modified_base (17831)..(17840): a, c, t, g, unknown or other
  modified_base (18713)..(18722): a, c, t, g, unknown or other
  modified_base (19451)..(19460): a, c, t, g, unknown or other
  modified_base (20068)..(20077): a, c, t, g, unknown or other
  modified_base (20447)..(20456): a, c, t, g, unknown or other
  modified_base (20960)..(20969): a, c, t, g, unknown or other
  modified_base (22196)..(22205): a, c, t, g, unknown or other
  modified_base (22410)..(22419): a, c, t, g, unknown or other
  modified_base (23002)..(23011): a, c, t, g, unknown or other
  modified_base (23445)..(23454): a, c, t, g, unknown or other
  modified_base (23998)..(24007): a, c, t, g, unknown or other
  modified_base (24420)..(24429): a, c, t, g, unknown or other
  modified_base (28825)..(28834): a, c, t, g, unknown or other
  modified_base (29378)..(29387): a, c, t, g, unknown or other
  modified_base (29454)..(29466): a, c, t, g, unknown or other
  modified_base (31194)..(31203): a, c, t, g, unknown or other
  modified_base (32343)..(32352): a, c, t, g, unknown or other
  modified_base (33085)..(33094): a, c, t, g, unknown or other
  modified_base (33283)..(33292): a, c, t, g, unknown or other
  modified_base (33550)..(33559): a, c, t, g, unknown or other
  modified_base (39264)..(39280): a, c, t, g, unknown or other
  modified_base (39474)..(39483): a, c, t, g, unknown or other
  modified_base (39710)..(39719): a, c, t, g, unknown or other
  modified_base (40097)..(40106): a, c, t, g, unknown or other
  modified_base (40519)..(40528): a, c, t, g, unknown or other
  modified_base (41487)..(41496): a, c, t, g, unknown or other
  modified_base (41906)..(41915): a, c, t, g, unknown or other
  modified_base (42000)..(42009): a, c, t, g, unknown or other
  modified_base (42536)..(42545): a, c, t, g, unknown or other
  modified_base (43586)..(43595): a, c, t, g, unknown or other
  modified_base (43977)..(43986): a, c, t, g, unknown or other
  modified_base (44290)..(44299): a, c, t, g, unknown or other
  modified_base (44431)..(44440): a, c, t, g, unknown or other
  modified_base (44599)..(44608): a, c, t, g, unknown or other
  modified_base (44839)..(44907): a, c, t, g, unknown or other
  modified_base (47335)..(47344): a, c, t, g, unknown or other
  modified_base (47404)..(47413): a, c, t, g, unknown or other
  modified_base (47495)..(47504): a, c, t, g, unknown or other
  modified_base (48027)..(48036): a, c, t, g, unknown or other
  modified_base (48277)..(48286): a, c, t, g, unknown or other
  modified_base (50166)..(50175): a, c, t, g, unknown or other
  modified_base (50414)..(50423): a, c, t, g, unknown or other
  modified_base (50476)..(50485): a, c, t, g, unknown or other
  modified_base (50573)..(50582): a, c, t, g, unknown or other
  modified_base (50671)..(50680): a, c, t, g, unknown or other
  modified_base (50830)..(50887): a, c, t, g, unknown or other
  modified_base (51512)..(51521): a, c, t, g, unknown or other
  modified_base (51589)..(51598): a, c, t, g, unknown or other
  modified_base (51818)..(51827): a, c, t, g, unknown or other
  modified_base (51980)..(51989): a, c, t, g, unknown or other
  modified_base (52377)..(52386): a, c, t, g, unknown or other
  modified_base (52666)..(52675): a, c, t, g, unknown or other
  modified_base (53740)..(53754): a, c, t, g, unknown or other
  modified_base (53974)..(53983): a, c, t, g, unknown or other
  modified_base (55154)..(55163): a, c, t, g, unknown or other
  modified_base (55257)..(55266): a, c, t, g, unknown or other
  modified_base (55380)..(55615): a, c, t, g, unknown or other
  modified_base (57767)..(57776): a, c, t, g, unknown or other
  modified_base (58342)..(58351): a, c, t, g, unknown or other
cccccacccaccctcttgcagatcatggcggcggcctgcctcttcctggccagcaagatcagcgacgagccgcgcagccaccagcagatcgcagcggagctgctcaaggagtggtacggccgccccctcgcgcgcgcgcgcctgcaggccgaccccgactggactgcgcgcctgtttgccaccgtgctggacggtgagtgcctgctcctgcacaccgtcggcttcgacttcgacgtcgacctggtgcacagccggctggtgggcctgctgcgctcgccgcgcttccgccacctgctggcggtgcccgcgctgcaccagcagatgctgtcctcctgcaacgacatcttggtgcacgactccggcctgctcctggagtacagcgcaggggaggtggcgctgaccatcctctactttttcctgaagctgcaccgccagcagggcggcgaggcggtcgcggtgctggagggcaaggaggacgcggaggggcggccctggttcgtgcaggacggactcgccccggagcgctgccaggccatcgtcaaccgcttcatggagaagctgtacagcagggtggggggcgggggggcggccgagcagggcggggccgccggcgccgacagcgccgcctcctcccaggcggacgcgaccccggggatggcgggccacgactctcgcggcagcgccgcggcctggccagggcctgaagcccgcgagggcgacggcggggatggggcggccgccccggggcaggcggccacgggcctcaagcggggcggtggggcgccgggcggcgaggagcagccccccaagctccgacggacgggcgactcgccgcagcaccgcccaggcgtcccgccgcgaataccgccggggcccctcccacacccagggccgcagcctgacccggagagcagccccgaggagggggagctgccctgctgatgccacacgttgccactgactgggttgcgctgttgtgctttgtttgaaacacgtcgggctcatccccttgtgctgggaaggtacaggggatnnnnnnnnnngtgctgatgtcacacgttgccactgacttggttgcgctgttgtgctttgtttgaaccacgtcgggcttatccccttgtgctgggaaggtacaggggattctgttgtgatgcacaggtgagctcatgcagggctttgagcaggccctggagccagccagtgccctgtccagatgagagggacaggtatggcgagggggcaatggccaggctgtcccgcgaagatccttgcctgacaccccatcgtccacaccaacnnnnnnnnnnttgtccagatgagagggacaggtatggccagggggcaatggccgggccgtcccgcgaagattcttgcctgacaccccatcgtccacaccaacctgctaccgctggggccaggggaggcttgcctcctccacgcttgccccggcctgtatcagggccagtcggtcggtgagcagctgccgcacggcctccacgtcgaccaccacgtccactgtggtgtgcgcctccacgcactcctccgtgtcgcactgtgcatgaacgcaggcggaggagggtgggggttgggtgggatgcctcgaggtgggtgcaccggaccaaggcaaccacatggtttccacacatgcggggcggaagcagcaatgtcaagcttccaggcacgccaggcctggaggcatgcagcttctttacgggtcgccgcagcacccacacgaggccccaaacccacaccgagtccagcaaggtcctggaatcnnnnnnnnnntacacatgcagggcggaaataacaatgtcaagcttccaggcacgccaggcctggaggcatgcacctgctttacaggtcgccacagcacccccacgaggccccaaaaccacaccgagtccagcaaggtcctggaatcaccgcgtaccatctccgtggtccagtccccgaagcggaccgcgtccctgggattgaggtacaccgtctggttgggctgcgtggcgcgccaggcaaagtggtggatgtcccccatcacctccgtctgtgcctgttgaggcttggagggggatgggctggaggttcttgggacaggagtgcatgcaggcgaggcgccgaatgcactgccagtgactcgtggagaaacctgggaagcggtgggcacactgaacgcaggtaaacacagccaggcaccgcaccatggatggaactgcggcctccaaggcacagcgtttccacgcaagcccccgcatgcagtgcatcctatcaaagcctgttgtagagcaggacaagatccacccacactcggtgcgcctctctccagccaaccccccacctctcccataacccccactaaaccacccaccacgcgcaccttgaagctctcgtccaggtgctggtagcgccagttgcgctgcaggagctccaccacgatcgaccccggacgcagcatgggggcgatggccagggccgaggtgtgcacgctgacgaggacggaggtggaggccacggatcgcatctgctctgccatgggcgtgtcgttgctgtgttcgaccatgttcacctgagtggggaggagggttgaggggtccaggaggctagcggagtgccaacccagtccctggcagctgcgcaatgcacattttcatcctagatggaccagaactcaggtaccctcctttctcgactctccacccttgaaccaagccgcctcacggacatgccccagcgtgcgcagcatggcgacgagctcctccagattcaggattcggcgattggaggtctttcggtgcagggtgatgttgggcaccgcatgccgactgtgcggggtgggaggcttcaacccaaactgcacaggaatttgatggatgaagaagtgccccaaatctatgccatgacaagcgtaccacagccatgcctaggcatgtggaggcatggttgagcgctgaccgcaggctgggcgataaccccctacccacaatgtgttctcccctttccgacgcacctgtgcataaaggcgctggcggaaaaggtgtccgtctgcctggctgaagaaggtgcggcggccgtcgaggtccatctccaggggaaccaggagcttgctgatgcagagccactctgactcctccagtccctccaggctcgacacttgcgaccaggggcagacaggcaaggctgtgaatggcctgtccaccgggctggccaccagtctgacaagctccgcagtgcaaggcccctgctgtccccccctgcatgggtggtagccgcaatgaacaccccccacaacctcttcctgacgcacgtatctnnnnnnnnnncgacaagctccgcagtgcaagggccctgctgtcccccccttgcatgggtggtagccgcaatgaacactccccacaacctcttcctgacgcacgtatctggtgccaaaccgagtcagactcggactgaaacacgatgggggccaggtcatctgtcggctgtgtccccgacaaggctacgcccatgaatgtcctggcccaggccatcaagtgggtccgcttcagggacatgagcagcacccgggccggccggaagccgggctgaagctggagcgaggagaaggcagggaacaagacctccggccagtgtccgatggccatctgggacaaggggtgcgctgaggaattgattgcggagacttccaagggcaagacacccggtgggcatgcaggcttgccttgtgcaaaggcagagtgtgctgccagtgagtgcatgtctgccttaccaccatcaaatcagaagcttactgggtggnnnnnnnnnncccattgagtgcatgtctgcctcgccaccatcaaatcagaagcttactgggtggaggaaataggggaagtccatgaacagggtgttgcccgggagcacccgtgcctgcaccgattgcacaaatgccagggcgtctagcacatgcagggtctgcaggtggtggttcttgctcatcttccatgggtcctggggaagtgaaggaatgtggaatgtgtgtctctctgaggcagcaggggcgcaggatggcagcaggatcatcacagtgccttggaaagaggagtagcattcaaagcaggctattgcaggcagcctgtgcgtctttcaggcagtccaaccgcctgcaggccggtctgggcgctgaccactgtgtttggtccatcgaccaatatatagaaacggccgttgttgtacctgaacgatgcggggcagggtttgtataggatattggggttgcaagggttgggaagagatttgctatggcatcaacctatgcatcgccagcatcaggtctcatgtcaaatgccaggtatcccaccgtgcagaatagcagcacagtccacccatccgtttcgcagcgaccctgatcccccttcaccagaggttttggtaggtgcactgcatgtcctggcaggagacctctgtgcgtggagtcccgcccggccagctccagtctgctgcatcgacgcccctctcaaggcatgccttgggcatgtcaggggtccaggctttgccgtcccaccattcataccgccggacgtcccagaatctcagacccgcgtcctgggaagggagtgatgggtgtactgccttgcctcctattggggggataataatgacgcaaggttagcaagtcccacacacatatacacctgctgtgactgggcgtctctccagcggcatccgatggggaaggggccgtccatgcctggggctcccgaatgtgacaaatgcgaaggcaggccaagcctgacacccagaatcgcgagcatggctagccccgcgctgacgcgatacgtctttggaatcgacgccaaggtgctgagcatcacactgagcgcccatcgtagagctcgagcaagccatgccattttcggtgcttccggaggtgtggaaggcatggctagtcgttgatactttcagatacgagagtccattctagtattcaatgagcggaccgttgtcgagggacccactgcatcccacatgcgcgccatgtagatgtccgcaagccagagtgtagaggtatctgagctcaggcaatttgaagctgatgcggggtgtcccaccttgcgcgcgcgagggttgagtcactgtgagtgnnnnnnnnnnagcaagccagagtgtagaggcatctgagctcaggcattttgaagctgatgcggggggtcccaccgggcgcgcgcgagggttgagtcactgtgagtgagcaaaacttgcagcaccaaactctttatgggtctgttcgaatcgacgcctctgcatctgagcgatctaacggaagtttcttgtttgcccagagagtgcaaacgaaggagcaccctgcctttcgcatagaaccctgctacctgtcggcggcgtgccaggaggcaatgctggcctccgcgtcgaccagggcctccgcaccgcagcgcagctgctttgggtgcggctttgaccgccatggaccgaggcatgccgctccctgccccgccccagcgcgcaacggcgcacgtgcctgcttggtggcccctgcccgcgtcatggacggtgctcgcccgctggtccccgagacggtgcgccccaccgtcaggctggacgccccggtcgccgaccagggcctccaggcaccaggccagcacctcgatcaggtgggagtctgcccgttgggaggggggtggtactcgctggcctagcgctggcggtattgctggctggctggtgctgggtgtggcactggggatgcaggtcgtctccttccttggtcttgtgcgctcatcgacaccaggtcatgtcagtcccacgtgttgctgttctgtcggctcttgcccagccgccagctcttgatcgggatgctggaagggctcccttccctgtggctggagcctggcctggccacnnnnnnnnnnagtcatgccagtcccacgtgttgctattttgtcggctcttgcccagccgccagctcttgnnnnnnnnnnaaacaattccctccccatccccgagccccctcaccctgcccagcatcatcctcaacccccccnnnnnnnnnngaacaagcccctccccattcccgagccccctcgccctgcccagcatcaccctcaaaccccctccttccccccttccccctcccgtccaacattcaggtgtcggtggtgatgaagttcggcggctcctcggtggccaacgcggagcggctgcgcgaggtggcctccatcgtgtgcagcttccctgaccacctgccctgcgtggtgctgtctgccatgggcaagaccaccaacctgctgctgcaggcgggggaggaggcgctgcacacgccggcgggggaggtcggggcgctggcccccctggccgccatccgcgacctgcacctggccaccgccgccgagctgggcgtggacgcgcaggccgtgcggggcgtggagacgctgctgacccagctggagcagctgctggtgggcatctccatcatgcaggacctgacccaccgcgcgcgcgactcgctcgtctccttcggcgagcgcctctccacgcgcctcttcgccgcctacctgcgcgcccagggcgtccccgcgcgtcagcacgacgcctttgacatcggcgtcatcaccaccgacgtcttcacctcggcggaggtggactacgaggcctcgctgcccgcgctgcgagaggcgctgcgcctgcccgggtcggggggtccccgcccgctgcccatcgtcacggggttcctgggtcgcgggcgggggtcgggggccatcaccacgctgggccgcggcggctccgatctcacctgcaccctgctgggcgcggcgctgggcctgccggaggtccaggtctggaaggacgtggacggcgtgctcacctcagatccgcgcatcatccccgccgcgcgccccgtggcccagctcaccttcgaggaggccaccgagctcgctttcttcggggccaccgtgctgcacccgcaagcaatgcagcccgcccaggaggtgggcggcatgggcgtacgcgtgaagaacagctacaacaggtggcgctgggattgttgtgggtgctgggtgctgggtggtaggttgtgtggcaatgggggaaaatgaggggggagggggcatcagtaatgggtgggtgggctagaaaggaaggggtggctcccatctcgttctgactggaaccctggcggtgagggtggcaccgccagggttcctcccctccatcgcaaccagagactctgnnnnnnnnnngttctgactggagctctggcggtgccaccctcaccgccagggctcctcccctccatcgcaaccagagactctgctctccttcccgcctgcgcccttttctcgggtacacctgtctccacccttcctgcaccccacgttccattcccccaatgaacaaccctctcccaccaccatcaccaacggaaaggctggcccctggcacgctgatcagcgcggaacgcgacatggccgacgcgctgtgtacggccatcgtactcaagtccaacgtgaccatggtggacatctcctccacccgcatgctgggccagtacggcttcctggcccgtgtgtttgatgtgttcgcgcgccagaagctgtcggtggacgtggtggccaccagcgagatctcggtgtccctcaccctggacccggcacgaacgctgtgggagcgcgacctgattgaggacgagctggagggcctgatggcggcctttgccggcatcgccaaggccagctaccgccgcggcatgtccatcatctgcctcatctgcaacgtgcagcgcacctccaccatcctggagcgcgtcttcaacgtgctgggccgggaggcggtgaacgtgcagatgatgtcgcagggcgcctccaagaccaacattagcctgatcgtgagggatggggaggcgccgcgcgccgtcgccgccctccacgccgagttcttcgagtaggggcgatggtggacgtgggttggagggaggagccgacggcgaatgaccgcgcctttgccgggccagggcgggagcggctaccggcccagccgccgggtgtgccgaggaacagggagcaggccgccgcgtgcacagtgcgcgcatgcggcgagnnnnnnnnnnggccgaggaacaggaagccggctgccgcgtgcacagtgcgcgcatgcggcgagggcgagccggccagccagccagcctgagagttccctgggcgcatagaacggggcattgctcccctgacctgtaatctgcatccctgccccagcggggatgcaaggctacatgtaactgacgagtagaacaaggagggggggccttgcggccaacacattcggtgcaatgacgaggctaaggaagaggggatgtacaaagaagaagaggctacggtgcaaactctatgagagggagggcatggtgggtgcacgtcccacccagggggaatatacaatgcagttgcaagtggcttgagaaggcaagtcctgcccctggtcctgcagggcggggtgttcttggcgtggaggttcatgcatactacgcaaggttgaaatcccaaatgtgcaagtgcctggcggagtgtgaagctcatgtgcctgggtatgttgggtgtgtgggtggcggtggggccatcacgggtcggcttgttctggtgccttctcctccacatcagccgcggagtccccgccgtcgacaggcgcccaggtgcggcgcacgcaggagctcaggctctccagatacagctcctccaggtgctgggagaaggaggcgcggtccagcatggccgaccatgccgccacctcctcgccccacagcttctgcgcggcttccagctcgtcgcgggtggccgagacatcgtccgggtccgtcgtcgcggccacggccgccgaggcgccatccgccgcgcgcttggccagcgcgggaatggccgccatcaccatcgccgtctgcagcgggggatgcggagggggtgggtgggaggtggaggggagcaggaagtcaggatggatcggtgctccccctggtgcccatgccggcgaagatgccagggattccatcccatgtagccnnnnnnnnnntgtgctccccctggtccccatgcccgcaaagatgccagggattccatcccatgtagccctgggttggtgacaaaagtgtggcccggaaagcgtacacctccatcgcggacatcgccagctgatccactcagacgccaccctcatcttccttccatctctttgggcgactcacgaccggaaatcctcctcacaatgaccttgtgtacccatcctccccgccggaccccactcaccgccttggaggtgaactgaggcacgacggccgtgatcatgccagcgacggcgggcnnnnnnnnnnctccatctctttgggagactcacgaccagaaaccctcctcacaatgaccttgtgtacccatcctccccgccaatccccactcactgccttggaggtgaactgaggcactacggccgtgatcatgccagcgacggcgggcatgatgtcgggcatggccgtgccctctcccagcgccaggctggtgtcccgctgcacctccacccggccgtcgcccagcaggcgcacggcgtggcccacgtggcagtacctgcggaccggggtatgtatttcggcggcggttggcgcaaggccggggggggtcgaggagcattcagaacaaccattcttcggtatcctgagctcatcgattcggacgaaggatagctcaagatggtgcaggaagacgcatgcacgcaatggcatggtcatgcccacacccagacnnnnnnnnnnagtaccggggtatgtatttctgcggtggctggtgcaaggcgggggggtcggggagcattcagaacagccattcttcggtatcctgagctcatcgattcgggacgagcgatggctcaggatggtgtaggaagacgcatgcatgcaatggcatggtcatgcccacacccagaccttcccgctcccgacagcctaccccatgaggcgagggaccgagcacactgcatcctggttgttgacgatgcgccagctgttggggacgaggtcgttgtactcctggagaaaggagggaagggagtgcactcgtgcaggaactgtttcagagagcggggcatatgcgcgcccgagaactgaaacttcggaccctcgtttgcaggctaggaagctcaggacagcgggtgggagattcttgagagaaggccgtgtggcatgctcggcgatactcttgcagagccaaccctccacccccccccccaacaacccctcagcacnnnnnnnnnnnnnnnntgggcccgagaactgaaaattcgaacctcgtttgcaggcaaggaagctcaggacagcgggtgggagattcttaagagaaggccgtgtggcatgctcggcgagactcttgcacagccaaccctccaaccccccccnnnnnnnnnnccctcagcacaccccacccgtgcgaagcggcggttgccgacgcgcgggctgccaaagttgtacatggtgaggtggggcgccggccccccgccccagtcgtgcagcgccaggtcataggagcacagcgtgcccagcgcgccccccagcgagtgccccgtgaccagcacgcgcacggggcccgcgccggcgcgggcggcgcgctgcactgctcggcgcaccccgcgcgccagccgcacgtccagctcgccagacctgtagcagtgcaggaagccggtgtgcaccttgggccgggagcgccaggtgccggctgctgggggccagggagtgcgccagatatgcaaggagaaagaggaggagaggggaaggttgcgctgcatctggaggctgaagaggtgtgcaggaggggggatgtggggcagaggacagggcgcgtcgaggtcggtgctcagggcccccaccggacttcggtcggcgaacgtcgggccacatagagccacagagtcagactcaaggcgagggtnnnnnnnnnnggggccgggagcgccaggagccggccgccgggggccagggagtgcgccagacatgcaaggagaaggaggggcggaggggaaggttgcgctgcatctggaggctgaagtggtgtgcagaaggggggatgtctggcagaggacagaccgcgtcaaggttggtgctcagggctaccaccggacttcagtcggcgggcatcgggccacatggagccacagagtcagactcaaggcgagggtggaggtagcagcgctgacgcatcgccccagcagcaggccccatgtatggcgagtatgccactccgcagatccctcccagtgcctaccttcatgtcggcgatgaggccagccatgctggcggtgccgcggaaggcgaccaccacggtgcccgggccccacgccagcaggcacaaagtgtcctgggagccggagggaggtgattcattggtggtctaaatgaccccaggccagggctgggaactccctggtgactccaaagacccagtgctggagtgcaacaagtggagggggggagacacgcatataacgcctcgccatcacggccccaacccatgagctcaccactctctcttcccatatcatttcgtactcctccaagtggtacagctccatggcggtttttaaggcaaccgacgtgtcggccttgtcaaaggctgccatggggtgtgtgtggggtgtgggttgtgaggaggaagccaggaaggcgcctcagcactgtgcagtctcctgccgtccctgtgccaagcctcaccataacacagcnnnnnnnnnngatgtgtggggtgtgggctgtaagggggaagccagtaaggcgccccagcactgtgcagtctcctgccatccctgtgccaagcctcaccataacacagcgaacaccagtgcatgagcttcacagcagtctgcagtacgtaggcatgctggtgtgaggacttggtggatgtgtgccctgtattcatatgatgcatgatcgccatccacacatggtaacaggtgtatacttgtaaaggatgatgacgnnnnnnnnnnttggtgtgaggacttggtgaatgtgtgccctgtcttcatatgatgcatgatcaccatccacacataatgacaggtgtatacttgtaaaggatgatgacgtcgggtgctccagtcacgaggagtgtcccgccacccctcacctcgaagcaccacatcggctccttgtcgattccctctgcctggcctgtggttctcttgagggatgcagatcgtgcggacctctttgccggctggctggcctcggtccaggcaaattcttgcaggaaggcctgtgggtgttgcgcaaccaggccgcaggatggactgaggagtcactgaggtggcaggcaggcggagaagggaaactcaggccaaggcgccacgcagaaccacgaagatcccattccctgtgctgccacgcatttcagcaggcacacaccaggagggtctccttgtcagatggctgcttgggcgagtccaggaagcacnnnnnnnnnntcaaacatcccattccctgtgctgccacgcattccaccaggcacacaccagcagggtctccttgtcggatggctgcttgggcgagtccaggaagcactgccctgcgacgattgctgtggtgatgacctgtagggcgtgaggggatggcgtgggtgtccaggtcacacgcagcgttggtcatgccctcatctgttacaggcttgaggagaaggatgagaggcaggcaaagactgcagcggggtccgctgacctgcattggcaggaatccgagccaggagacccagtacgacacacacgagctgaactgcagcagcctgcgccggccggggaggggttgtgtgtggcgtgaggcatccaggggtgtcaggggccaaagggacaccggctggatcagaagctgaaagggggagggttgggacccatcaaagcagctgctgcaggcgccaggccctggcagcctccaaagcacagggcagacagtcgccaggaaaacaagagtccctgcattattcccctggcttccactcacgcgtacaagannnnnnnnnnacagcctccaaagcacagggcagactgccgccaggaaaacaagagtccctgcattgttcccctggcttccactcacgcgtacaagatgcagcagagcaggaagacgcacactgccaggacacgcagccggatctactcgaggggaggggaggggagggccatgaggccatgggcatggggattctataagcattgttttcgcaggggtgagtgcccagcagcaattgatcaacgatatggcataacacatgcatctgggcggtttgcaggtcacgggatggggcggcatggccccctcaacctcacggccgagatccgaggcccgctctgccctgctcacctggatcctgatcaggcggttgccgacgcggaagcggttgtaggagaagcgggagagctgctggaggctgcggcgggtggcatacaggtagagcagcaggtagaggatgatgaggacgatgctgatggcctggccgacgagcaggccggctgcgcggtgtgatgcaggggggaagggggaatgggtgagacccaacgtgcgaggatcaggcgtcgctgtgcaagctccgtacggacgccactgcagggcaggctcaggcgccgcagcatcccacggggatgcggcatccatgcacagtgccccagggtcgggacagcggatnnnnnnnnnntggtgagacccaacgtgcgtggatcaggcgttgcggtgcaagctccgcagagacgccactgcagggcaggctcaggcgccacagcatcccacggggatgcggcatccaggcacagtgccccagggtcgggacagcggatgcacctgtctgacggcagtccagcaagctggcgtcgcactgggagagccccgacgcccggtcggcgggtccgtcggccagcttcacgttggttgccacggtggtccccaggaaagccagccacagggccagcttgcgccagtgggaggtgaggggcaggtctgtcgccaggggcacctcgttcgcgccgggccgtgccagggtcgaatctgcaggggatgtggtgggacgggcagggtggggtgatggcgctgaagactttggaagcagcgggactggggtatcccatggtggctgcccggcgccggctctgaacccaggccgcgcgccacctttctcgttcgggaccggtctaaaccggtcggcgtggacccaggagatgagacacagggtgttccagcacagccacctgcagccgaggtggagggggggccgggacgggctgagagattgggaatgcgacacgccatgcgcatcgaactcctcctccggccccgtccaggaagcgtcctacagcccagacgcccatcacccctacaccccaaggcgtgcagaaacacacccagacannnnnnnnnnagtggagggggggggagcggacaggctgagagattgggaatgcaacacgctatgcgcatcgaactcctcctccggccccgtccaggaagcatcctgcagcccagacgcccgtccaccccactccccaaggcgtgcagaaacacacccagacaactcctgctgcagccttgagcgcagacctggtccagcaggcccacctgacctcccagcaccctcccacccctcttcgcggctcactggaccagtccaagccagacgatggagcgagggaagaatgtacacctgtctgccagctggatcgcatttgtcgtcaggaaggcggccatgttgagggtctgcgtccccagctcaatctcagtgaggaccaccgctcgccgccgtttggggtccctgcatgcaagtgtggcgggctgcatcggttcagaacccttcaaggtggctcacaaagagagcaagcttgcagggaacctgcacgcaacacagagtccagcccaaggaacggcaccacaccctcccaccctcgccaatctgcacccaccagcgcttcccggagcgatnnnnnnnnnnagtggcgggctgcatcggttcaaaacccttcaaggtggctcacaaagagagcgagcttgcagggaacctgcacgcaacgcagagtccagcccaagcaatggcaccacaccctcccaccctccccagtctgcacccaccagcgcttcccggagcgattggcgatcaccactcgcgcgtagaatatcgcgcaagtgaacagcagctccagcatgcacccagtcccaaacaccaggttcatggtagggatggtgggcatgaagaccaagtcattcccctgcagtgacgcatgagcgcaggggtcctgatatggatggatgggcgcactgcaggtgatcagtccacacacaggcaggtcaacaatgttttgcagcaagcatgccctgcagtacatgtggtctggaatgagtacacatgaagcacacaggtatattaccagcactccgcaccttgacttnnnnnnnnnnggcgcaggggtcctgacatggatggatgggcgcactgcaggtgatctgtccacacacaggcatgtcaacaatgtttggcagcaagcatgtcctgcagtacatgtgttcttgaatgagtacacatgaagcacacatgtatattaccagcactccgcaccttgacttctttgagggcaacgactgcagccagcaggacagcgcccgtcaagacgaggatctgcacagtgaccgtcaggttctggggggaagcgggccagtggtgttagatgactccaggtaagctgaataggggggaatatagctcgtctacacggctgaatggcggatcccacctgcatggcctgatctgtgatccattccacgcgcaggatgacgtctctgtgcggatcatagtgcctgagtcccggattcttgtcaagtggcgcttccgcctcgccattccctccgggcagcaccgtctctgctaccgctggaagggcctccatgatggggactatcgctccctccacgctaccccgtggttgtgatgcatgatggagccctttgtcggcctctgaattcctgaaggcctagtctgcagagtgttctggtaacaccaaggacctgtgtcgtgggcgccgattaccaaagcgttcgtctaaattctggcgtagagacggaattgacttaaatacttaaactctaggcaaccacctcctgcgccgtgatggcgctggagtgggaggtcagatggcaaaccctcctctcactnnnnnnnnnnagtgttttggtagcaccaaggacctgcgtcgtgggcgccgatcaccaaagcgttcgtctaaaactctagcgtagagacggacttgtcgtaagtatttaaaattcaggcaaacacctcctgcgccgtgatggcgctgcagtaggaggtcagatggcaaaccctcctctcactcagcagcccacagccctggtactctgtgcaattatatacagaggtttaatggccagcgatactcgatttgcatctatctgagacttcgagattgtgcagggccctgcagacctactcttcattgtcgttgtggaatttgcatgaacgctgggtcaggcccccaaagcaatcttaaacagggcgcacaaaatcnnnnnnnnnnatggtactctgtgcaattatatacagaggattagtggccagcgatactcgatgtgcatctatctgagacttcgagattgtgcagggccctgcagaccacctctttcattgtcgttgtggaatttgcatgaacactgggtcaggcccccgaaagcaatcttaaacagggcgcacaaaatcnnnnnnnnnncctctaatccatcaaccttgtagactgctagccatctcttaagtgatttgctgctgcttggcgggctcgccagctaaaacttgggaaatgctgcaagcacgnnnnnnnnnntcaatgtgcaatgggagggaagagggggtcccgtgtgacctctggcctgaccccatgcgacagccctcgcannnnnnnnnnggtaagtgggtgtagggcaaaaccccacacccgcatgcagcagactcacgggctcactttacgaccacccagatggccatatgctctaatccatcaaccttatagactgctagccatctcttaagtgattcgctgctgcttggcgggctcgtaagctaaaacttgggaaatgctgcaagcacgattaagcagtccgtcaccgaggagcctcacaaaacatcagagggcaccaaatgcgtacagcttgagtcgatgcttttccttgggggcaagccgagggcttgggtgagtcagtcaacgtggaatgggagggaagagggggttccgtgtgacccctggcctgaccccatgcgacagccctcgcaggaggacgggccgtgcggagccgggacctctgcgcgagatgaaggtgctacgcagcgcaacaagaatatcggcactcgaaggtgggcttgcacaggtgctggacaggctaccccatgtgcacttgcaagcacgacatcgctctggcctgattggggccgcccagggctgttcagggctgagggctgcatcagaggccctgcagcccccacactcacgcatgaagtccagcctacgccatgaatccctcacaggaggggcaggcggtccaggatcggggggcattggcggggtgccaggtggcggtggcgggggtggccttccagagcccgaggggaacgggccccgccccatgaccacgctgacttgcgtttttggcgcctttgtcctgggtgagtggcctggtgtcacacgcatgctgcacttgtcgccggagaaatgccatgcatgcctgtgttccaggctcggcccctgtccccggcggggcccagcacagctccagtgannnnnnnnnncgccatgcatgcctgtgttccaggcccagcccctgcccccggcggggcccagcacagctccagtgatgatgcgcttggccgtgcaggtggcggactcatgggctacatcaagaaggggagcacgacctccctcgtggcatccaccgctgtgtcactcctcctcttcgtgtcagcttcactcatggggcggcccgaccagcgcatcggcagtcttttggctctcggtgaggagagggatattggcacgcctccctatgatgggtgcatgcaggaccaaccggcaaggccgagcgggtccagctgatgacgctccgtcgcgccccgcatgcccgcaggaacatgcctggcgctcggcgccctcatgggaaagcgctacaaggactcgaggaaggtgtttcctgcaggcgttctgaccgtcctgtccagtgccatggccatcgggcacctgaagaccctgttgtgaacacattgtggccacctcccattttttgctctgttgagttcatctcccccttccgggacacttccttccattgccgacacgcactcatgtcgtccgctcgggggatacagcgtgcccagaccgagcttcctcttgtgtactgataaagttaagttgtcgacgagattgcgatttattttaagatttcccgtccttgcttgccttcaaatcaagcaggtctcggcggggtgcgggtcattgtgccttgcccatatcaggatccccctattcgcaccgttacaccatcaagacaactaagaggttccgtgaaaatattgcacctcgccgcttggactgagccccggaggaccatccacgaggtcgctctgcaatggacgcggcggagtggtacaaagaactccctgtcatcnnnnnnnnnntagttgtcgacgagattgcgatttattttgagatttcccgtcctcgcttgcctttaaatcaagcaggtctcggcggggtccgggtcgttgtgccttgcccatatcaggatccccctattcgcaccgttacatcatcaagacatttaggagaatccgtgaaaatactgtaccttgccgcttggactgagccccggaggaccagccacgaggtcgctctgcaatggacgctgcggagtggtacaaagaactccctgtcatcacaaggggctacgtctccctctgtgttgcgaccacagcggcatgtgccctcgaggtgattctggcatgtttgcactcgcctctgtgccgtgctgcctcaggccagggttgggcccttcctcctcaggcagcctcatcgaccccaagccttccttccacaggtcatcacccccttcaacatatactacaacacacggctcatataccagaatcatgagtactggaggctggtcaccaactttttctactacggcaatctgagtgcgtgcagggtcggtggtgttatgcagggtaatcttcttagtgcatgtgcttcgggtgtctgtggcggacggtggatggtgggtgcagagtcccgaggccctaccagtattcatttctcgggcggaagtcgtctcggccgccaggcgcgtctctatacatgaggcggtgcccttccacatgctgcgcccccttgtcccatggcctgtnnnnnnnnnntgcggaagttgtctcggtcgccaggcgcttctctatgcatgaggcggtgccctaccgcatgctgcgcccccttgtcccatggcctgtttcacagtctggctgcccaccactgttgagtcttcaccattcaaccccccttttcttctgcaggcttggatttcttcttccacatgttcttcctgaccaagtacagcaagtccctggaggaggactcgttccgccggcgctctgccgacttcctctggatgctgctcttcggtgccggcgtcctggtcacggtggcccccttggtcaacctccagttcttgggctccagcctcaccttcatgatggtgtatgtttggggccggcgccaccagtacgtccagctgagcatgatgggcctgttcaacttcacggcgccctacctgccctgggtgctgctggcattctccgtgatgctgggcaactcgccgctggtggacctgctgggcatgatggcaggtggggaaagagggcaggaaaggaggaggggaggggcacggctgtgtcgaggtgattcccttgaaagccaaggtgacccctgcgatgttcgttacgctatgcgccctgtggcatggtcctctccnnnnnnnnnntggttcccttgaaaaccaaggtgacccctgccatgttcgttgcgctatgcgccctgtggcatggtcctctcctcctacacacccgtgctccaagacctcttgtccacgctggtgcagggcacgcctactacttcctggaggacgtgtaccctcggatgtccggcggacggcggccacttcgcacgccagggatcctgcgtgccctgttccctgccaaccaggtcatccctgctgcagcggtgcaacagcctccagctgcggccggaccagagggctagctctggacaaggcgtagcgtgactgtaatcgcacacagttttttgtcagagaatgatgacagggcctccgacacatccggggccgcgctctnnnnnnnnnnacgtggcgtgactgtaattgcacacaatttgttgtcagagaatcgtgactgggcctccgacacatccggggccgcgctctcggagcgcggttccgtgatcaggcacattctctttcatcgaggctcattggcacagctaggttaccggcattgttttcaacacctttaacggattagttttccctaaaagagcgtgggagaaggtgccctgacatccacaccggtcgtgtggagatgaggcgaagccttgccaggctattctctactccggccgcgggcccagtgagtgagggactgtataaattaattaacagatgaaatgctcgtgcgatgcgtatgacgatccatggtcgctcctccggcgccacaggtattcctcggccggcccctccccgcttctgtgacgattgtagaggtgtgggcatccctctttgcgggtcttggtcgctatggcgtggaaggacatcctccaccttgcatcccattcattggcgccccaaaacnnnnnnnnnncccctctttgcgggtcttgatcgctatggcgtggaaggacaccctccaacttgcatcccattcattggcgccccaaaaccctgcaggtagggccgcgcgatggcctgcagaacgaggccacccccatccccacggcaacaaaggtcgaactcatagagcggctggccgctgctggcctgcccgtggtggaggcgacgtccttcgtgtcccctaaatgggtgccccagctggcggacgcggcccaggtgctagcacaggtccggccccgccccggggtcaggtacccagtgctcacccccaacatgaaggtgcgcggttgttgtgtaaaccgggctttgtattgcgggtgtcctgccgccaacctccagcctgcagcgcttgggcgggagactgccagtctcccgcctgctgcgttctctagggatcaaagggcgaaaaacggtggtccacccgcttgcagcacgcacaggatccctgcgcccaccctcaccccctgccccgcattctatctattctacaccccgcagggtctggagaatgcgctggcggcgggcgcccaggaggttgccatcttcacggcggcctcggaggctttcaaccgcgccaacaccaacgtgggcatcgatgacagcctgcggcgcctggccgacgtcgcggccgccgcccaggcggagggcgtaacggtgcgaggctacgtctcctgcgtggtcggctgtccctaccaggtgactcagaggggcagatttcggtttgtaggggtttccgcaggccgtccgtctggtaatgcctgcgtgtggcgcggtggttgtgcggcgagggcccaacgcaggccccccctccctgaagctcctgatgccgggcgggcctgccctctgttgcagccgaccggtagtcgaaaagatgcccgccttgctgctcgacaccaacccccatcttttacaaccctgcgcccaccccctcgacctgccccctcctcccaggggcatgtgcctccccaggaggccgcgcgcgtcgcccaggccctggatcaaatgggctgctaccaggtgtccatgggcgacaccacgggcgtgggcacgccagcctccgtggccgccatgtttgaggtggggcgcggtgcctggggcgtcaggccagggtgggtactgcggacggctccgattccccctttcatcctcaccgtcatggggagtctcgctcgcctcgcatgctcccacccaagcgctnnnnnnnnnntctgcggacagctccgattccccctttcatcgccaccgtcatggggagtcttgctcgcctcgcatgctcccacccaagcgctcacctctgagttcctccctcaagctcacccccacccccacccctcctcccctttcctcccccgctttccaggcatgcaccaaggtggtgcctgtctcccgcctggccgcgcacatgcacgacnnnnnnnnnnaccgccccccctcctcctcccctttcctcccttgctgtccaggcatgcaccaaggtggtgcccgtctcccgcctggccgcgcacatgcacgacaccttcggccagggtctggccaacatcctggcagcgctgcagctgggcgtggccaccctggacgcctcggtggcggggctggggggctgcccctacgcgcggggcgccacggggaacgtagccaccgaggatgtggtgtacatgctggaggggatgggcgtggcgcacggcgtggacctgcccgcgctgctcggcgccgccgactttgtgtgcggcgccctgggcagggccagcggcagccgggcgggcaccgcgctggcgaggcggcgggacaaggaagcgggggcgcctgccaccgcagcggcctgagaaaggggggaaatgtggggtgtggagtaggaagcggatgtgagagagccaggcgggttgccgtgccactcacggatctctaaaggcatcgcttgccaggtgttttctccgctgaggaaagggacaccgccattctcaggtgtcacagtctccgtcggcggagctctgagagactgcttcnnnnnnnnnnccagcggcctgagaaaggggggaaacgtggggtcttgagtaggaagcggatgtgagagagccaggcgggtttccgtgccactcacggatccctgaaggcattgcttgccaggtcttctctgcgctgaggaaagggacaccgctgttctcgagtgtcacagcgtccgtcggcggagctctgagagactgcttctgtgaattttagagcgggaccggctcttgacacctgagctccagccaggctgacatttaatgagcaattactgtcaagtctcaactgaggcaaagacaggagaggcagtcctccaaatgttggtgagatccagcttttgagcacaagaaaaaccttttgcgaatagtctgtatgtcgacatgcaaccagaaaagcatgactcacgacggcagtcaccggaatgttcatgacgaacgcctcannnnnnnnnntctgacatttaatgagcaattactgtcgagtctcaaactgaggcaaagacaagagaggcagtcctcaaaatcctggtgagatccagcttttgagcacaagaaaacccttttgcgaatagcctgtatgtcgacacgcaaccagaaaagcatgactcacgacggcggtcaccggaatgttcatgacgaacgcctcatgcactcactcgcactcgtccgggcgacttcatgcagctgccaatcgacgggccgactaacattggtgcggcaccctcggattactctggaaaggtggatttctaatgttgaaagttgaacaagattctcttgtgggcttctgaagaccctcggcgacttaaaccgggcttctgtgggacatgcgacggcgtcctcggcgcagcctcttgatttcaatcgtgaccgtgtacattctggtgccatgcgccttcgcgcgttacctccagcaggtatgtagactgcgctcatgcatgaagtcatattactggggaaagctgaaagacgtgaggctcacccatcctgtgtgtgnnnnnnnnnnagatcatgcatgaagtcatattacgggggaaagatgcaagacgtgaggctcacccatcctgtgtgtgccaccacagcgggtgccggacacaggcgcctgcctgcaggcctctacttgggatctcctccagatggccggggaacgccacaacatatccttgtggcgattcgctctgaactccactggcctagatcgagtgctgaaagcgaggcaggggccgtcgacgctcttcattcccgaagacgcatccatgctaacatgcgatgacgcaggtgtggcctgacatctcacccagcgacccacctcgcacccctgaggtatgtcgaccaatcgtccacccatctcccttcgccaccccctgtgtgcagtggattgcggcgttgctgatacctattggcgaggccagctcacgnnnnnnnnnnatccacccgtctcccttcgccacccccggtgtgcagtggattgcggcgtcgctgatacctattggcgaggccagctcacgcggcccacatctgaaggcctgctgctcctgcactgggccatctcaggatttggtacgacgaccagcggaggcctgccaggggactacaggggcaagaccatgctgtctgaattgcataatgcatccgagttgggccagtggtatctcctggtccgacacatctaccgagatcggctccaggtgggagctgacctcgccaagtattcctgggtgcaatgccgctgcgctcatcactctccgtgaagggggcacacaggcgtgtgataacgctgaaagcatcgcctgccatccaggcttgtggggctggatactgcagatccatgggagctcaccgtccccaccgcctcatcccctgctgcaggcacagatcatgatctatgtgatgagccccagtgggcagctggagcaggtgtttgcaaaggcgaccgccagttacgtctcatgcagcggcaatgcggtccacgtgatcgacaggcccattgtcccaacagattttccactggtagataccaccgctctgcctgagcttcaggtaggtcggaggacctcgaccggcaaggtacatgctcgagttgatgtgcagcccacggccggtggtcgccgacgatgtgatacaaacctcctgggcccatacccgcctcatgggaaatgccacacccccatgtccccggccgcagggctactgcacccagagcatctggtcagcaggtttccagaactcgttactgacggcgtcaagcccctctgggccctactacgcctactttgccgttcagggcctgatcacgggacgttttcctcgactcttcaccaacctcgactttgcacagccaacaacaaacatcagcatctttacgccagacgccaataccatcacagggatgacccaattcttgagtgagttcatgctttgaggggcaggaccccggcaagacatgccagcggaactgtcgctccttcaccagatcaccatcatggcctgctgggcacttcaagagttgactgcgaaagactgcctcctctgcaatgtgcaggtcgaattcctgtcggcgaagatggccggacattcacatacttgagtcactacgtcataccaggtgcagatgcgaggggtgcttgagccacccacaccagctgcatgctcaggcactcatctccccatgcaggcggacactgcctggacgggtttcgcccgggagagtggtacaacaccctggcgggaataaatctgggccaaaacctctcccttcaattcatggccggggaggagaaggcatgggtaagtcggggctggtgtgtcacatgctgcacaggacacctccccccggttgccagaacaatgagtcgtccctgtgcctgtgcctcctcagccgtgtcttgtctccattgcacccgaggtaaaccctcggcccatctttccactgctgcacaggtcaacgtgaggacttccctgcagcccaacaggaccctgagagccagctacctggcgaatgcatgtttcagcacgctcttcttggtcgacaccctgctccccctctgggagaggtggcaggacatccccccttccaccatcacccactaccctcaagtcggcactgaggtgctctttggtgtcgacccggagtgcagggctgggcagactctggttcaggtattgagctagctagcacaaggatgctgacgagcaagacagggaggcggtggccctgccagtgctgtacaggagctgcatgtgaagcatgcttggttctccttcccatcaacgggccacactcaacctccttgactccatgcagcatctccaagaccagcctgcaaccgtcccgccggctcgagagggcgcagggggtctcagcggcccagccattgccgccatcgtgctgggctgcgtggcctttgctgtgctggccgcagtcgccgtgatgctgctcaagctgaacagaaggcgctccaaggcaagcaggggcgcaaaggggtgctcccgatgtggcctgcaggggtgcacagagtccatgggacccccttcctatctaccaacatcattcctcgcagggagtcgaggagcgggaacatgacgagtcccagccggcgtcagccctgagcgacctggaaacccatcgtgaaggtgggctgtgctgtggagcgagcacagggtcagaaagctctggacaggatgagggggcgctgcctggtgcggagtcacgtctggagctgcgccgtcgctcacggaggcagcccctcccctcccacaggcaggtcagcccttggatcctgcggcaatagggttcccatgcaggtggacccggatgctgaccttgtcaacggcatcctccacgcctccagcttcacattcgacctggaccccgagacgaagcagcgcatagtcctgggggcgggaaggtttgggcaggtaggacggttccgctcggacccaggtcgggccttccttcctcagtgctcgctgtcagcggcccctgcctgcttccctgctgagaacacaccagcatcgacagactcccttgcttccacctgtgcaggtggtggcggggcgcctccagaacagggagcccatcgccatcaagtgtattgaggcccccccgtccgggcccagcctggccctggagcctgggtccctgctggcgcgggaggtgcagatcctgcgtcattgccgctccgcctacgtggtcaagttcatgggcatcgcgattgaccccggcgcgcaggaggtgcagctcatcaccgagcggatggcggggggggacctgatgcggctgctgagcgggaggcgcattccctggaggagccgggggtggaagctcgccctggacgtcgcccgtgggctcgtgtacctcgcctccaagaggtgggttcggtcgaggccctcccgacagggccgggcatgggtcagtccgaggggaactccagggttggggctcgttggaagctgggtgtgtcgtcctcgccttgcatggtgacgtgcctgctgagtcaccaaaacgccatccttgtcaggatcgtgcacaacgacctgaagagctccaacattctgctggacgatgaagggagggccaagatcagcgatgttggccttgcacagatgctgccgggaacgtgtttacatcctggtgccgctgctggtgagcccagacgtggtcatgcgggggaagggagggggtcgttgaattaatgctcgggttgttgggagggatttggtgaccatttcatcaggcaggggggattcgacctccgctcctgtgccaggcccctctgccagagttgcagatgctgctgccatttgtaccaccatcaatatcccgcccatgctcaccaccaccaccctcgctgactatgcagctgggggcggctcctttcactggtgtgcccctgaagcaatcctgggcctgccctgttcggttcagtccgacatcttcagtatgggtgagcagcaggaggggaggggactgggggatgtgggtatcgtgcagagcctgatacagactggaattatcattggcatcgcaaactcgagagtaaacgcagtatcgcctcttcgacagcattagcagcatatcctcatggcacgacccgcccgcaggagttgtgatgtggcagatcatcacgggcgaggtcccagtccgtgggaacatgcgccccatcaggcaagtcggtgcatgatgaggccatgtgcatcgttccagattggcttgccggactgaggtatccttcaccaccgcaccttaccccatcctggccttgctaccaatccatggttgtgcagggcgccagaggattgtccccaaagcatcgtggaactggtggagtcgtgctgggaacgcaaccctgaggatcgcccgacagccatgcgagtggtggacgtcatcttgaaggagcatcagccctctgtggaacaggatgaccttggatgcagtgtgcggacatccccagggggttaattcctggaacttcttcacgaatttgctgctcaaagggtggggtaggcatcgagggtcattgcctcaacattcttgcccccgacttgtaaacccttgacgattgcgcctgctgatgaaggcattgcattcacttgaagtgacgcacttatatgtaatgctctttgacaagcttgagcgacacaggttcccccgccggttccgagtatttcaaaatacgtagataatccgggactcaatatgtgagggtgcacgcagcaatgcaagagtgtggaacgtatccttgactgtggttaacaccctggcccgagtgttttggaaaatggagccgatcttgtgcacgtgatcttccgggagcttgggttnnnnnnnnnnattccgagtatttaaatatacgtagataatcggggactcaataagtgatggtgcacgcagcaatgcaagagtgtggaatgtatccttgactgtggttaacaccccggcccgagttttttggagaatggagccgatcctgtgcacgtgatcttccgggagcttgggttcccgcagtttcatcttcctcccgtaccatggagcggaagactccacaccgctgaatagctttactgaatgtcgttctggccttccggcaggaagccgtgcgttggagtgatcacgttgatgcgtttctcggcgctgccgtgcatggtggtgggcttgatatgcatctcccagcttactcatgctcgatctttaagtcaggtaggtgaaacggccatagcatgtgtacacacccatcagtactttctctgagaagtcgtcgcgtgctttaacgcaggcggaggccgcgcgtagtgcggcatgtgtgcctgggtcgacatgggacgccgtccggtatgttggcacccggcactccatcaccatgtgggaatacgccctnnnnnnnnnnagtatacacccatctatactttctctgagaagtcgacgcgtgctttaacgcaggcggaggccgcgcnnnnnnnnnnnnnagagaataccgcgccgtcgacgattctcattcccctggacgactccatgctggcgtgccaaagcgcgggtgagggggtagggttttggtcgggacatgcttacagggctgttggggaatgggaaaagtaccagaatgaagcagtctacgagggctccgtaccgattgcaccgtatcatggcctccttattcagatgaatgcgggcaagtggatacatactggaggggccagctgacatcagccacctactttggcctcctccttctacactggaccgtgggagactttgcggccgagaagaaagtcgtcgtgccttacaacggctcgtatgtggcggacacgctgcttgctgccgtgctggggaacagctccaccaacaacaattggaagctagcagcccggatggtggacaacaaagtggtgagcaggggttcaagctgttgagctccgtgtcctccaaagggcatcagaatgcacggttgcacagctaaaacagggagtctggccaaacactgggcttgaaatcagtgttgcatcttgggtttatctcttagtactggcagtcactcattgtctcaatagcggccgctaagatttgccatgtgagcgtgacattcctgtctgacaatgcctctgcaggcgacggtctcggtgatcgacgtccagggcaacgcagtgagccttccatcaggcgtggtggccagctacatcacctgtggcgggacccgcatctatgtcattgagcagcccatcactcctccggacttccccaatgtcaatgccaccagtgttccggggctccaggtgtgttgttgtctggagtacagatgaagtgcccagggtgggggcacatacccggtaggacaagcatgtcgggagggggttttaggaagggaagggggcggcggggtgagtacttgtgcccctgtgttcatacaaaacctcttcagcagcctcatcgtacacgatccaagccatcactcccattgccttcccccccttcctcctccttgctccctggcaggactactgttggaagaacatctggagtgctgggttcagggtgcctggcaaagtttctgccaacaacccaaatgggccctacttcaaatacttctcctacatgtccttcttcatgagcaagtaccctgagctgtacgtgaacctagacctcgcccatcccatgaccaacgtcaccttcctgatcccagatgcgcatgtcctgtcccggctgcacgcgtactttggtgagtgaggaggctcagcgccgcactgccccccctccatcgcccgcgggtgagagaggggcgcaccgtgaagctgacgcaccagggacctgtcctcccgctgacacatgcagatgcgatccccccggaggagtaccggaaggcaaacacggccaccgcgcactacttcatcgatggtgggtctgcgggccccctgctcccttcactccccaatgcatgccgagacttgctggtgggagagtacctcgccgccgccaaaccccgcaggtggtcgatgtccggacagtatcgagaaggggcgctggatccccacccttgcggcgacgtacctgaatcaaaacctgtcggtcctcgtcacgcccggcagcgagcccaacaaggtgcgctctgattgcctaagatgaggccccctgggcagtttgtgggaggggtttacagtagcctgagtcttgtagggtttctgactgcaaagctgggaggnnnnnnnnnngagatgaagccccctgggcagtttgtgggagggggtcacaggagctcgagtcctgtagggtttctgactgcaaagctgggaggaagctatcaggccagggcggtcggtttgactctcaatgttttgcctttctgcacgcttgcattagaggtgggtctccatcccaaagcacttctaattacctcttaaacgtaaatgctgtctgcccgcagatcgaggtccgcacgtcgctgcaaccagacaaggtggtcctcggcaagtttctcaccacttcttgctatgggacgatctatgcgctggatgatctgctgcccatgtgggacaggtggcaggacatccccccagcagagcctgctcgctacccgcaagtggatcaggacctccttttcagcgtgaatccaacctgcggggcaggggatgccatagtgggggtgagaggcatgggagtcgacagtttctggcatgcgtgtctggcatgcgggagtcgggatggctgcatcgccgaggcacctcggtgaactcgccaatggaccacaaaacacgatgtgccgtcgatgcaacccgctcttgcacagaggttcagcgccctggaggagctcgagcaaggcagcgcgacttcggggagcggcggcctgagtgctggcgccatcgtgggcatcgttctggggagccttgccctggcccttgccttggctgctggactggtcttggcgggaaggagtgagaaggctcgacaggtgagcgactcttattgaacacatgtggtccaaagtggccgtttcccggcttgtgcttgcctgtcgctgcaagggttttccctgtccgcacgcctcttgcagtggttgcccaagggtccctggctgacgccaccccccagcgagaaagaagggatgtctcctgctgacactggaagcaaaggtgtgactggggaatggtgtgagttatggcagcgaggaatctgatatggggagcatctggggcgttcaggagaggtgcggtggcaacattgtcatctcacagacccttccactctgcggtgctgcaggcgacaccagccagcaggtttgcatcagtctgcccgattcccacaggcgtgtcttgagctacacagactttgagaatgggatcatgcagcccagnnnnnnnnnnacatttgagctccaccctgtcaccaatgagagactggttttgggtgctggtcgattcgggcaggtgggtgacatcatatgttcagtatggactcgagggttatggttccctttgcacaagcggggcataggtctcaccacgtgcacctgccccacccagccactatgcagctgatgggatgggatgacgtgtcaggtttccagccactatcgttgcctgattccttcttcacccccaatctgttccatgctcgccaggtgtttgctggtcacctcatgaacggcgagcctgtggccatcaagtgtgtgcggggtccttacccggggaccccgctgcagctggcctccgagggctgcttggcagaggaggccagcatcctgaagcgctgccggtcggcgtatgtggtgtcctttgtgggcatcgccgtgaaccctggtgctggggagctgtacctcctgacccaccgcatggccggcggcgacctgtatgccctcatccagaagaggcatgtcacctggaactctggaggctggagaatagccctggacatcgcacgaggcctggtgtacctggcatccaaacggtgagctcctgcttgcggcggaggtgccactcagggtgcatccgattcatggaggcgatcgtcctgtaggtctgtggtgactgctcacgactgaccgttatctgaaggccattcgccaagtcaagagctgcaatcattcaggcaagcacnnnnnnnnnncgcggaggggccactcagggtgcatccaattcatggaggcaaacgtcctgtaggtctgtggtgactgctcacaaccgaccgttatctgaaggccgttcgccacgtcaagagctgcaatcattcaggcaagcacctcacaaactctcgcaattccttctcagcattgtgcacaatgacctgaagagctcnnnnnnnnnnctgccagggtcaaaggcataccctggggtgatgataggtgagtctagctctgatgctgtccatgcctgggccttgggtacagtggttgaagaattggttgcagtcgaaagtctccacattggtttccatattcctgtactgcatcacttgcgcaaacgccagtgcaatttgtcctgaatattgtgacggtgacgggtaagtccagagtgactgtaagcctgtctatgatgatctgagtgccccatctccaacacaatnnnnnnnnnncctgtccatgcctgggccttgggtatagcagttgaagaattggttgcagtcgaaagtttccacattggtttccatattcctgtaccgcatcacttgcgcaaacgccagtgcaatttgtcctgaatgttgtgatggtgacgggtaagtccagcgtgactggaagcctgtctataatgatctgagtgccccatctccaacacaatctcccaaacagccggtggaggctcgttccattggtgtgctcccgagattatccttgggctggcttgctcacctcaagccgacatcttcagtctgggtgagttctctggaatttcgctcggattgtgagaacctgcttcgatgctgtgcaaagagcatcaatgccatccacatcctcattcccctgcctgtgcaggggtggtcttctggcagataatcacaggcgacacgcccatccgtgggagcatgcgccagattcggtgagggagtacatgagtgctcacatcagagtgttgcctagcatgccagccggaccaagctctggattgcatcattatgccaacaagcgggctctcagtgctgatcaacctcattgcagggcgcctgaggaatgtcccctgggcattgcaaacctagtggaggcttgctgggagcccgagccagatgaccggccaacagccatggaggtggtggaagtcattcttaaggagcacgcaccttcccaggaaccatgactttctgagaatccctttacagaaaccagccgtgcagtggcattcaagtggcgctgcagcacgttttgccagatccaagatctggaaggttgccaagacatatctttctttttcattactatcgaagggcactgcttctcaccttattgacgtttactgctttatctacttatctatgataggtattgtcatctttcaaacccatctttgaaattgtctttcctgtacacaccgaccctttctccaccacaacagcatttggcatagtagtgtgttggaccatcgcttgaaaagggcctgcaggaaagagcctgcagaacaattcatgggaaatccacaccagttatatcccaaggtattcagtcaatcatcatctcatgcgcgaaatgagtgatatgaccattcgcccacctcatcctcgatgtgggaagctgacgggaaccggaatgtatacaatgaaagttccacgtgggagagccgatctccaaggatacccgacccactaccgtaccatggaaagtaccagtggcaaccgcatcgtcggcagatttcggccaacaactgtacccctgcggtccggcgggactccgcgggccaagtcgaggatcgtgatgcggttccccatgtcgaccgccgagattatgatcgtgtgcctgatgtgtgcctccccgctcatactcggtcgatccctccagcaggtgggttgaaggagctttgtttctgatattgagtctttgaataaaacctagaacactggtgcttctttgcagagtgagcccgcgaggagcgctgcatgtgtgcctgggtcgacgtgggaggccgtgcagtacatcggcacccagcattccgtcagcatgtgggagtacgccttgggcaccaccggtctcaacctgaagctgaaagaggacgctcgacccttttccctcttccttcccttggacgagtccatgctagcctgccaaaacgcgggtgggtgtgttagggttgttttcgtgacccatcagtgtgctgcatggtgctgtgggagacctgaggggcggggaggggtgctggataaacatgagggtttcttggcgcattttccgtactattatcttcaaatgcagacgaatgtggacaagtagacacgtactggaggggtcagctgaccacggcgacctactttggtcttctcctcttgcactggagcgtcggggcttttgagccaggattgaatgatgtgttatcttccaacgactcctatgtggcggaagcactgctcacaaccgtgctgggagatgcctcccccaccaagaattggaagctggaagctcggatggaagatggacaagtggtaggcagggtgtcaggctgtcggagtgagaaggatggcagccttcacgtggtgttgggggctagggatcgtacagaatggtctgccctctgctcagaagtccaaggtcgaagcaccagtgcttggaagcagccttttcattcaacattatgctaagcctgtcagcacacgcttgcaagctttgtcaccagccccgcaaattcactgcaggcatcggtgtcggtcatcgacaaagaggggaccgcagtaacccttccatcgcgcgtggtggcaagctatgccacctgtgatggcacaaccgtccatgtcatacagcagccgatggtgccctccggaatccctagcgtcaatgcaaccagtgttcctggactcgaggtttaggtggatgcaaatcttattttgttcccggagggtggctcgttccccgcattctggaggatgatagcccagggcgggttcaatggagccctggtggtctgatgaccaggagcagttggtggagtcgctgacattatggaatccagcgatgccagcaaattcttaaaacccctgtgcagaactactgctggaaaaacatctggagtgcaggcttccaggtgccgggccaggtgactgtcaacaatctaaatggtccatacttccagtactttgcctttcagtcattcatgactggtcggttcccgaaattgtacttgaatagggatcttgcacagcccacaacaaatgtcacctttctggttccggatgccgacatcctctcccagatcctggcagcctttggtgagtgtgtacgtctgtcagcggcacttcatgcgtgactgcgttctattcgctgtgtttgtggtcttactgaagaccgtccctctcccccaccgccgtccaaaaaaaccttcacgcagaggagatcccctctgaggaatatatgagggcgcaaatcctcaccgcgcactatttccttgatggtgggtctaccctgcatgtacgtgagccatcgctcagatcctgaaaaattatccgacctttcgatggatacatttccatgcaggtggatactgcatggagagcttcaaggagccccgctggatcccgaccctggctgcgtcctacctgggtcaaaacctttctctgctcgtcacacctggaactgaatccaacaaggtgccctgtgcctgctgcactggggccccttgctgcatgatcttgtgtctggcaaatcgtggaggggatgatgagggggtgcggatggcccaacatggcccctaggccagcatcacccgctcacacaataatgaatgcacgtagttcccacattcgggtatggtggagcgctctcttcatccttttgttctcagtcagcagcctcatcctcgggcaagcatccctcccaggttgagtttcggacttccttgcaaccagaaaagatagtttccgccaaattccttgcatctggctgctatggcacgatctttgccctggacggtattttctccctgtgggagaggtggcaggacatacctccatcggagccagtgcattttgcacgtgtgaaccaagacctcctctttggcgtaaacccaacctgcagggcaggggacgccgtagtggaggtgaggggcctgagctggttggtcttcaaatttgcactagttgcaggtttgcacacgtctccaccatttgcttggggcagcaggagtatcagcatgttgaccagtatatgtcgggtcatcatcagcagtatgttggtgctttctcactgcccagagggctgctggctttgggcggtctgccgaaggaggagctgctgctggaggcagcagcctgagcgcccccctaatcgctggcttggcgcttggaagtctggctgcagtcctctttctcgcgactgggcttgtatgggcgatcaggagaatccgctctcgacaggtgaggcaaggtttgggggtgaggatcaggtctcaaaagactccaaggtgggagcctggtttgaaccaatctcaccctgatcacccgtcatcacagatgctagagaaagtcggcccagtcagggcagctcccagagcactgaagggaaaggattcctcagacactagtagtactggtgaggctgtagagcggaggtctttcagcgagcgtgtagaggttgattgatcaggggcctgccaggcatgcagcttgttgggtggctcatctttgatcttgtcacacgatgctgcaacaggcgacaccagccggcaggcttgcatcagcctaccagacccccagcagcgtgtcttcagctacacagatttcaacaatggaatcatgcagccgagcgacttcacattcgatgctgcccatgacaccagggaaagagtgatgttgggttctggcagatttgggcaggtaggctggtattgacttggaggtatttgaatcaggaagggaggggtatcgcttttgcacagatggagacagcatggccacagatacatctcgttgtatgccctgcgacactgccaccagctgttgcaagaagtggcaatgcaacggttgttacctcaccatatcctcgccactccatccacaatcgccttccaggtgtttgctggccggctgttgaatggcgagcctgtggccatcaagtgtgtgcgaggcccttcgccaggtgcaccgctgcaactggtttccgaggggtgtttggcagaggaggcccgcatcctgaagcactgccgctcagcctacgtggtatcattcgtcgggatggcggtggatcacaccgccggagagctctacctcctcacgcaacgcatggtcggtggcgacctccatggcgcaattcgaaaacggcgtgttgcctggaaggatggaggctggcgcatagctctggacattgcacgaggcctggtgtacctggcatccaaacggtgagtggctggcagggcagcgccacctggtccgtgtgatgtagaggtgtgacctttggtgtcagtggtatatcccaacaccacctgcaaaaatggagtcgcgcatcgtactgctggccaatcccagcgtgacaaccaacctacatgcctcgcttgccgctccctctgaagcatcgtgcacaatgacctgaagagctcgaatgtgctgctggacggcgaggggagggccaagatcagtgacgtgggcctggccaagatgttgcccggatccaaatcatacccgggtgtaataacaggtgagtggaagcctgatgcaagacatgctggaagtcctgggcagggaattgcaaacattcaaaagtggttacagagccaggtcgtgcgccttggatcctgcacaagagctgcatcccagcttccaaatggggtcccccctcacacccaacagccggcggaggttccttccattggtgtgctcccgagacaattctagggctgccatgcactccacaggccgacatatttagcctgggtgagtcgggccgaccaaggcagggccagcagccgctctgcctttgtgctgcagagcttggtccgtccagcacagttacgctcaattcccgtccacggtgcaggggtggtcatgtgggagctcgccactggggagtcaccgatccgtggaggcatgcgtcttctccggtgaggcgttctgcgctgatgcgactcgctgctctctgccaaagcccgtctggnnnnnnnnnnnnnnnnntgacaggtcaccagatgaatgtccccccaacattgcacatttggtggagtcttgctgggagcgcaagcctgatgacagacccacagccacgcaagtggtggaatccatcctcaaggagcatgggtctgatcaatatgctctcggggcttgaagtaaatatgcagacatcttccgggggggggggggggggcccnnnnnnnnnnctcctcaaggagcatgggtctgatcaatatgatctcggggcttgaagtaaatacgcagacatctttcggtggggcaccaaatgcgcagtctgttcgtgaatgtgctgctcaaatgtgaccccggcagcggcggtatgtccagcctatatcctgccaactccacgccaagactcagtcctcacctcccaaatgatgaattcaacctgtaatgtccatctcactgacannnnnnnnnngggccaccgcagcggcggcatgtccagcctatatcctgccaactccaggccaagactcagtcctcacctccctaatgatgcattcaacctgtaatgtccatctcactgacaccctatgcatgtgctctcgacctctaccacatgatcttcctgcaggtctcctcctccggcgacgagtatcgagcaagcgcacacagcgtataagaacaataatcactgctcgaatactcgaaaacaagattcaagaagagaattaatgggtatgagaggagcccacgctctctttataatttgatcctccatacctgtgcttgaagcggcaggcgccattgctcaatgtatccattagggggggtagcttcatgcagattcccctcnnnnnnnnnnataatgggtatgagaggagcccccaggccctctttgaaatttgatcctccatacctgtgcttaaagcggcaggcgccgttgctcaatgtatccacaagggggggtagcttcatgcagattcccctcccactgtatagtcccaactccgattacgatatacttcatgactggagatttcctcagaggactctgtgtaaaccttttggccaaaggcctcgccgaaattcaggagaccggatgcggtttcccatgttgctcagcggattggcgatcgtggggctcgcttgcggcgtgccgctcgttcacgcccgatcactccagcaggcaagtggaatggatggtgaatggaagcgggagacagtgtttcttcgtaactcataagtactgctccctgcccgcagggtatggccgcnnnnnnnnnnatgccgctcgttcacgcccgatctctccagcaggcaagtggaatggatgttgaatggaagtgggagacagtgtttcttcgtaactcataaatactgctccctgcccgcagggtatggccgcgcgtagtgcgccctgtgtgcctgggtcgacatgggaggctgtccgacacgttggcaccctgcactccatcaccatgtgggaatacgcccttcacgcgactggactgaatataaatatggagggaaacaccgcaccgtctacgattctcatccccctggacgactccatgctggcgtgcaagagcgcgggtgagggggtagggtttttggtgtgggactcctgcccgcagctgcgtgagctactcgatcgaagagatgaaaagtactgagacgcagcattcgaatggggacttcacgacgagtgaagtacaaattctggcctttcaattcagacgaatgtggacaggtagatacatactggagggggcagctgacgtcggccacctactttggtcttctccttctgcactggaccgtcggggagtttgcacccgacatgaactcgacaacgtccaatggagacacgcatgtggcaaacaccttgctcgcggccgtgttggggaacacctccgctgataacggctggaaattggcggctcagatctcgaacagcagtgtggtgagcgaggtttcatggtttcgggtgggagtccggttcatgttgggcaagtactgctacacgagtctcatggactcatgaaggtgtggcctgggtgagtaaggcatggatacatttggggcgctcaccatggggcaccttgatagaatgcagtggcacaagagtaaagttacaacgtgcaaatttcatccatgttgccatctcacaatgcctgtgcaggcatcagtgtcggtgatcgatgtccagggtaacgcagtcaccctcccatcaggcgtggtgnnnnnnnnnngcaatgtgcaagttttatccacgccgccatctcacaatgcctgtgcaggcatcggtgtcggtgatcgatgtccagggcaacgcagtcaccctcccatcaggcgtggtggccagctatgccacctgcggtggcactacaattcatgtcatagaacaacctattgtacccccagacttcccccatgtcaatgccaccagtgtcccggggcttcaggtatcaaacatggaacaaattgatgctgtggagtgcaactctggcacactcttgtcatgagtcgggcatccaaggagattgggtcctggagcacctttaagcgtgtctcttcagtcagcagcattgccttggagttgttgaccgctgtaattccttttacccctttttgcaggatttctgctggaggaatatttggnnnnnnnnnnaggcactaccattcatgtcataagacaacctattgtaccccctgacttccccagtgtcaatgccaccagtgtcccggggcttcannnnnnnnnnggttgttgaccgctgcaattccttttaccccctattgcaggatttctgctggaggaatatttggagcgctgggtttcagctgcccggccaagtctctgttaacaaccccaatggtctatacttcaagtacttttccttcatgtctttcttcactggcaaatatccagggctgtacgtcaacctagacctggcacagccctcgacaaacgtcaccttttttattccagatgcgcatgtcctcgcccagctccaaggcgtctttggtgagtcggagcggtggggagatataaggggggtttcaccttgggccaccttgcgtgggaaaaaatgcactgattgatagggcaagtttacgggccctccctcccccactctggtacatgcagagcagataccgtgtgaagattatgggagggcccataccttcctggcgcattacatcatcccaggtggatccctggactcgccctcaggatgttgtgtggatcaggtgggatgtgtgctgatgtctgacggaacccttcccnnnnnnnnnnaacaaacgtcaccttctttatcccagatgcacacgtcctcgcccagctccaaggcgcctttggtgagtcgaaggggtggggagatacaagggggggttcccttgggccaccttgcctgggagaacatgcactgattgaaagggcaagtttacgggacccccctccccccctctggtatatgcagaggagataccgtctggagattatgggagggcccataccctcctggcacattacatcatcccaggtggatccccagactcgccctcaggatgttgtgtgtatcaggtggggtgtgtgctgatgtctgacggaacccttccctctctgtaggaggatactgtatggagagcttgaggaagccgcgctggataccgaccctggctgcgtcatacctgggtcaaaacctttctctgctcatacaacctgggagagggccgaatgaggtacgctgcgagggcaccaggagggggagctggcatgcccatgaacatgcatggtggaatggtgttacactgtgtgtatttgcaatgtctttacttatccctcaggccgtggagggctgcgcttgaccgtcgaatgagcactctcattgccagtgcagctgcttgctgtcagagtctgtggtgatgaagttcttcacgaagcttccatgtcctcaccatgtccaatttgcaggtggagatccgcacatcgatgcatccagacagagtggtccctgccaagttcctcacgacctcctgctacagcaccatgtatgcgctggatggcctgctccccctgtgggacaggtggcaagacattccaccgtcggagcccgcccatttcccacgtgtaaatgaggacctcctcttcagcgtcgatccgacttgcggggccggcgatgccatcgtgggggtgagtggcttggggttgggatgggtggtgctgtgcatgccagtacctgatctgatgtgccgcgtaaggctgccttgcaatctctgcgtgagttcttccttggcacctcgcattaacctgtttgatgcctcttgtatagaggtnnnnnnnnnncggttgggatgagtggtgctgtgcatgccagtacctgatctaatgtgccgcgtgaggctgccttgcaacctctgcgtgagttcttcattggcacctcacactaacctgtttgatgcctcttgtatagaggtacagtggcctggaggagctcgctggggacagcgccttgacggggagcggcggcctgagtgccggagccattgtgggcattgtcctcgccagcgttgccctgtcgcttgccctggctgcggggctggtcttggctgggaggagtgacaaggctcgacgggtgagcatttgacattcctggacagtcctccagggctgcctgccagcttattcccctggccttgcctcaacaggtccatgccaccctgcgccnnnnnnnnnnacctgctactttattcccctggccgtgcctcaacaggtccatgccaccctgcgcctcccctgcagtgggtccccgtggggtggtgggcatcactgacatccaggggtcggcaaggagaccacactgcagattctggcagtaaaggtgggggctgtgtggctttgagccctcagtgcttactgtcactgtgcacatgaggatatgggcgctcatttggaaaggggttactgctgacacacctgctcatctaggccctcccggtacactcttctacaggtgacaccagccagcaggtttgcatcannnnnnnnnncccgccagactcccagaggcgtgttttcagctgcaccgactttgagaatgggatcatgcagcccagtgactttacatttgacctcgacaatattaccaacgaaaggctgatgcttggtgctggccgattcgnnnnnnnnnntgcgactttacatttgacctcgacaacgttaccaacaaaaggctgatgcttggtgctggccgattcggagaggtgattgtgaatataagttcagtgtgcattcaaggcttgatgcagcctgtcccccttttgcaagtgggagcacacggttttactgcnnnnnnnnnncgttcagtgtgcattcaaggctcgatgcagccagtcccccgtttgcaagtgggagcacacggttttactgctccaaatcatctcactcagctgcggtgcagcatacaatggatgaaatgtcaggaagatagccatggccgtcggtaaattggtcacgatgcacacccgacgccctcaccacccaaaattctcatcgttgtccaggtgtttgctggccacctcatgaacggnnnnnnnnnnnnnnnnnnnnnnnnnnnnnnnnnnnnnnnnnnnnnnnnnnnnnnnnnnnnnnnnnnnnnccctttgcaggcgccccgctgcagctggcatccgaggagagtctggcagaggaggcacgcatcctcaagcactgccggtcggcgtatgtggtgtcctttgtgggcatcgctgtcgactccggtgctggggagctgtacctcctcacacaacgcatggctggcggcaacctctttggcatcatccgaaggcaacgcatcacctggaacgacggtggctgggagattgcactcaacatcgcgcaaggcctggtatacctggcatccaaacggtatgttgctgaccagggtacaggccttctctttgtggatgtggagcgtgaatctggtatgttcttcctgcttgttggttgtgtagattgcgagcgtggcatcagccaggcggtgaaattatctgtactgcgcttttgcgatgtcaagcacaattccagaatcacagcatccccacaccctcgacataacattcccgcagcatcgtgcacaatgacctgaagagctccaacgtgctgctggacggcgaggggcgggccaagatcagtgacgtgggcctggccaaaatgttgtacggatcgaaatcatatcaaggtgttataataggtgagtggcgtgacagaccttgagatttctgagggaaggagggttgagcagttgttcgcccagtgtgtgagccgaaggtattgttgtgggttgcttcaccgtgtcggaatggcctgcacccggttgcaatgccagtccttgcctgtggtgtgactgggtagaggggccctgatctggagttgggattgtcggaaagatgatgagctgctctccgccatccatctcactttgtatcaaccaatctcctacctacgaacagcgggcggaggttcgttccactggtgtgctcctgaaacgattctgggactgccgtgcacgccacaagccgacatattcagcttgggtgagggaggcgatgaggggcgttcgggccgcagctctactctaatctcccagaaagatgagacttttggtagcttgatcctgattctatgcttgcaacacaggagtggtgatgtgggagctcatcactggggccacacctatccggggagccatgagagccgtgaggtaaaaccctaggagtgagggtcggtacggattggtctcgcactgggcatccagacatcctcagttacaatttgatcagctccatcctcctatagaacccccgaggagtgccccgaggagattgctgacctgctggaccactgctgggagcgccacccggaggaaagacccactgcggcgcaggtggtctccattatatcctccattcatggtgggcactgacgtcggggcgaccaactggagaaattcaaggatgtgagccaattgaatctcaaggtatttttcactggaaacatactgtttctgtaagcatggagttcgggatcctttcccccgatctcgacgtgtcgtacatgcgcgcacgggcgttctccagaggggatcttgagcgctagtgcaattggccgccaggtgagagacgcaagggtctatcagggtccaatgctcgcatgggtcgtccattcagggctcgcgcatgcagtggtacggaggtgcgtgatcgggtccatgggtcttgggaaacggcccctagcatggtgatttcttcccgtagcagattcgccccataagccgcagtatgaagctcgtccttccgtaccatctttcgcagacccgggtcccagtggagttgtaattgctgaggagtgcacacggaaggtcgtacatgcccccctgaatcggcgtggagagatcatgggcgtcccgcagggccgacagggactcaccgcgctgctggtgaccctccacctgtttcaccacctcccggtctgcgccgtggtaggtcctgattctgtttggcggatataggtgataaacgcataattccctgattgtactgcgtccacccccccccttatccggacgcacccctgtgcaggcccaggagagccccaacggggcccagcccgaggatggcccggcgtgcactccgggctccccctgggccacgctgctcgctgctgcggaggttcacaacatcacggtgtggagaatggcgctgcagggcgtgggcctgaacacgctgctggagcgcgaggatctggcggtcaccctctacgtccccctggacgagtcgctcctcagctgcagcagtgagtcgggggggcaagcagccccggaaatcaccgatttccactccattgggttcattttgaccaaaatatcgcatataaacagggaaacgtgcccctcccggaccccacctatccgcgggctacgggctggtggtctcgcagcccctgcagggcgcactcaccccacacgccaccccccattccttctcctcctctgctccggtgcagatgcgatcgagtgtgggcaggannnnnnnnnncccccccctttccttctcctcctctgcttcggtgcagatgcgatcgagtgtgggcaggannnnnnnnnnaatcgcggggagtgggtgctggagaccgcgctgaacggcagcgagcccaccgtcacgctcccggcctcggtggacgtgggcnnnnnnnnnnggacacatactggcgcggcagcctgacctcccccgagtacgtcggcctgctgctgctgcactggacgctgcgggcgcagcccaacgcgacagaggacgggcgggaggtgtgggacacggccctcggcctcgcccaggccgagcgcggggagtgggtgctggagactgcgctgaacggcagcgagcccactgtcacgctcccggcctcggtggacgtgggcggggagcaggcaatgccggtgctggaaacctttgagagctgctccggcgcgcgcatccgcatcatcccgggccccatggtgccggacaagacccccatcaccaacctgaacgacctgcttcccctcaaggttggggaaggtggatcagggttagggtgggagagggggcacgtctcctgcgctgccctgtggggatggactccggagcgcacccggatgtgcacttggcgtgtccaggggcggtttggttggtttggaaaggacaatgcttactgctgaggctctgcacagccagcaccctgnnnnnnnnnnggggttagggtgggagagggggcacatctcctgcgctgccctggggggatggattccggagcgcacctggatgtccacgtggcgtgtccaggggcagtttggttggtttgaaacggacagtgctttctgctgaggctctgcacagccagcaccctgcaaagctgggcaatcgcctcaattccagtgtagcctgccctcacacccccctctgtcgtaccctctcctcagaacctgtgctggnnnnnnnnnnttccagtacaggctgccctcacatccccctcggtcgtaccctctcctcagaacctgtgctggtccaacatctggtcggcgatgtaccacaccccgggggagctgtcgctgaccgatcccaggggcgcctacctgctatacttcctcttccaggccttctactccggcacctggcccagcctgcccagcaagttcttctactccagcgccatgtccaacatcaccttcctcatcccggggccggacggcatgggcaagctgacctcccagttcggggagattgcggcagacgagccccgcaaggtgtacacccttgccggctcctacacgctgccaggtgggcctggggtggggtgcattgggggtgttggacaggcgctgcgtcaccatcagttgcagcttggggcaggaagtgggctcagtggagcgctgatgagaactaaatcgaggatgacagtgggcggtcttggaccggagtaagaagggactgcccccaggattcagtcagccacacacatactcctgacaccattgcaggcggttattgcccggagggtttggtagaggccggccgtgtgaacacccaggcgggcatgctgctgggcgaggacctctccctagactttgagccgggccccggcgacgaccaggtgggtgtctgaactcttaatcagccgtggatggatggcacgaggggggagcaaatagccagagtgtgtggcactggcgccagcttccttctagattcctgtgtaatcccccctcgggatatcaagtgttgtgcaggtcaatgctgtcgccctccccgaaccattaccattccaccacaaaacaacccctccaggtgctgatcagcatcccggccaggccagacctgccccccgtcgccggcaccttcctcaccaccgcctgcttcagcaccgtcatcctgctgaacgacacgctgcgcatgtgggaaagcgcggcagacatcccccccagccccaccctggaccctgtgccggcggtggaccaggccgccctgttcaacgtcgggcccggctgcggcggcggggcccccacggtcgccgtgctgagctcccaccgaggcgagccggaggggacgctggtggagcagagcgtgcaaatgccggcagacgactcttcctccggcggctcctcgctcagcgcgggcgccatcgccggcatcgtgatcggcagcgtggcgggcgcggccgccctcgcgctccttgctgtcttcctgatccgacgccgcggacgggggagggcgcccgccgcgcgtgatgaggcatggggcgatgccgcctctgcaaagggcggcctgaccgaccacagcgatgccttgagtgagcagtgggcttgggggaggtggaaagggcggactgggggctttcgtgggccgccttgggatcaggtccacgctcactggagcgcaggcagtgcctcgcgcccctcgttgtgcgcgagcggggccatggtacgcggaggggctctgccgcctgtgtgcgccgcagaccgttgcgacctccgctccccacccacgaggcccttgcctctcacaccagttctaccctccgttgtccccactcgcagcctcctgcgacaagcagtcgctgtccagctcggggacgctgctgagcaccccctctggggcctccgccttcagcctgggtttgctgccggcgtccagcctaacgttcgaccgcgcctccggggagctggtgaccctgggggagggacgattcggcaaggtgtatgctgggcggaccgcgcaacacgagcaggtggccatcaagtgcgttgaggctctgaacggcggctcagacctccagatgagcctggtaggttttgtgagagagggtgctgagtgcgcgaggctcnnnnnnnnnntgtgggccgccttggggatcaggtccacgctcacttgagcgcaggcagtgcccagcgcctctcattgtgcgcgagcagggccatggcacgcggaggggctctgccgcctgtgtgcaccgcagaccgttgcgacctctgctccccacccacgaggcccttgcctcttgcacctgttttaccctccgctgtccccactcgcagcctccttcgacaagcagtcgctgtccagctcggggacnnnnnnnnnnagcagactggaggcagtttgaacactgtggtgttgtgaagggagcgcaggcannnnnnnnnnctcgtggccgaaccccgatccaatccagcgacgaccttctttgctccaaccatgccttcctcccccaccccatctgccaagaagcacnnnnnnnnnnatcgtgggccgaaccccgatccaatccagcggcgaccttctttgctccaaccatgccctcctcccccaccccatctgccaagaagcacnnnnnnnnnnggcagactggaggcggtttgagcactgtggtgttgtgaagggagcgcaggcagggccgagggtgcacaggatccctgggctgcagaccaggcagcgaatacactcactgtactgttgccaagggtggcattcgaatgcctgccccgccgnnnnnnnnnnnnnnnnnnnnnnnnnnnnnnnnnnnnnnnnnnnnnnnnnnnnnnnnnnctcgatgacccccgcttccacccaccccttcgcgtgcagacccggctggaggaggaggtggcggtgctgcggcgctgccgctcgcgcttcatcgtcaacttcatcggcgtggtcagcgacccaccccggggtcagatcatggtcgtcactgagcgcatgatgggtggggacctgtggcacgctctgcgtcgcggcgaggtggcctgggcggagcgcggctggcgcctggccatggacatcgcctcgggcctggcatacctctccacccgccgcatcgtgcacaacgacctgaagagctccaacatcctgctggacggggaggggcgggccaagatcagcgatgtcggcctggcccgcatcatccccgactcccggtcctacctgccctctagatctggtgagtccgggatgtgaggggggggttgggaggagtggacgcattccgtgatgatcatgatacagagacgtgttggagagggtggcagcgcatgctcatggcttacctcggaatggaatgcaggggccggggagtgtgtttaccctgcagcaagtctgggtcatgggccagcgcttgagctggttgctagcaggccgcgcccatcgccacctctccattcaccttcannnnnnnnnntgcagtcctggacactgaacaaggggcgcagcatctcgtatcaaacgtcaaccaccctccacatgccnnnnnnnnnntcagcgcttgagctggtttccaccaggccacgcccatcgccacctctccattcaccttcaaaccctgcacaccatactgcagcggagggaggctccttccagtggtgtgcgccggaggccatcctgggcgagcccagcacggtccagtccgacatgtacagctacggtgagcagcgatggtctgcgtggataaccagggtagtgtgcaagcaaggtggcnnnnnnnnnntacccgcgaagtcaggtaaggcacgggtatctgatacccccgctgctgccgcgctgtcaagtgtgctggctgtgtgcacccttcttgtgcgagcctttacacgcgactcgagcagacgcggatgtttagcatgtccttcaaatctagcgacgnnnnnnnnnncgcactcctggactttgaacaaggggcgcagcatcttgtatcaaacgtcaaccaccctccacatgccaggcgtcgtgctgtgggagctgatcacgggggaggtgcctgtcaggggacacacccgcgaagtcaggtaaggcacgggcatctgataccccgctgctgccgcgctgtcaagtgtgccggctgtgtgcaccctttttgtgcgagcctttacacccgactcgagcagacgcggctgtttagcatgtccttcaaatctagcgacgcctattcttgccgtatgctttaacgggcgcccgcatgatcactgcactaaaaccaagtttgcaactggcgctcccctgcaggaccccagaggagtgccctgctgaggttgcagcattcnnnnnnnnnnccttgacgtatgcttcaacgagcgcccgcatgatcaccgcactaagaacaagtttgcaactcgcgctcccctgcaggaccccggaggagtgccctgctgaggttgcagcattcatggagcagtgctgggagaggaagccatcggatcggcctctcgcccaggaggcagtggccctcctccgccgcctctactgcccggatcaggagtgatccgatcacaggaccttggattggagagtgaagcacctttgccactgtacacctctttgtagccggatttnnnnnnnnnntgatcaggagtgatccgatgacatgaccttggattggagagtgaagcatctcagccactgtacacctctttgtagccggatttctatcatcatctgacgggtcgcgccccaccatggaccccccttgtcgaggatgccacactgattgacctccttgctctaaccaccatttttcaagcttttcgtatccccagggcccccccaaacccaaggccaattttacaacccccctcaccggactctgatgtcgttaccgtacttcatttttgccctccgcaggtatacccttgcacattcctcttgatcaaggtccctggatcgttacttttcctccttgtggagctggcctgtgccatgccatgcaagatcatggacaaaaccctatagttgcaaaaaggcaagggttgaagggaaatgatgctatcgagtgtaattgatgcattcatgtttcgcatgccacacattaagtcatcgctttgtgtgggtggtgtgtgggctgctgagcagccatcgatgtatgacgccctgcacccccgcaggtgggtgatcagttctgaatcttggatatccactcgaaaaaagtaggatctctcccgcccctgctgtttccgccatgtcaggggtgttgatcgtcggggccggcttcgcggggctcgcggcggcccagacgctgaggcgggcagggatgtcccccgtcatcctgctcgaggccgggtcgcacgtcgggggcagggcgcgcaccctccgcctggatcggggcctggcgctggagatgggggccacctggatccacgggctggagctgggcggcggcgagggccccaacccagtgctgcgcgccgcgcagcgtgctcagctgctgggggcccggccccggttgtcggtgtgggaggactcccacttcctcgtgcagggggccagcgggctgctgacccaggagcaggcggcctgtatcatgcacagcatcgccgcctttgaagagggcttagatgcggctgggggagccgaggagggtgcgaccctgggtgatgtcctgcaggctgcctgggataaggtgaccctttnnnnnnnnnnnnnnncacatccgttctttgtgagtgtctggaccccttgattgccgatgcctggagacatggtcaggcctggcgtcgagaagccagggagcagcctagcatcacagctgtaatggacgtcccccgtctcccaggtatagcttccccgtgtccatccacccccaccactgcacctccgcgccctctcctgcagctgtcatcaggacagaaggtggcccagcacgcnnnnnnnnnncataagccagggagcagcctagcatcgcagctgtaatgtacgtcccccgtctcccaggtatagctgccccgtgtccatccacccccaccgctgcacctccgcgccctctcctgcagcggtcatcaggacagaaggtggcccagcacgctgacctggcgcgcagggtttgggcgtggcgggagtccctgcagcgcgccatcgacggcacagactgcagcggggatctctcggcgacggccgccgccaggtacgccgctgcagttcagaacaccaacgcccccatccccggcggcttccaggcggtggccgaggcgatggcggagggcctcgacgtgcgcctgcaccggcgggtgactggcctggactggggcgcggagggtggggcctgtgccacctgcgaggacggatcgcgccacgctgccgccgccgccatcgtcaccgtctccctgggcgtactcaaggtgctcgagggggagggggggggatgaaggcaactggaaagtggtggctgcagcgcggccgagcggattcacgctgcacccgaccgtgctgtacatcaatggccctgggtcagaaccggcctacacagcctgaatcaccaccacaggtgtcttgggaaggcatgttcagcctgagtgaccgtgtgtcagcacaccctgcagtactcatcaatgccccactcctgctcaggcacagcatgagaccctgttccagccggggctgccggccagaacccgcgaagccatggcccagctcaggatggggacggtggacaagctgttcctggagttctatggtgcagaggacagcgctcttgaccaggaagatggcgccgcacccgcagcagcccccgactcgggcgacggcgcagacgtggtcacctacgccctgctctgggacccggcctcgacggcttcagccgactccgccctcccggactgggcgcagggggtcttctccatcggtttcggaggcgcggaggtcaagcagggggcccaggagcctggcgcgtcgccccgacccgtgggcgtggtgtggctggcgggcgaggcggcccgcgccgtcgaggccgcctccgacgaggaagtgttgggcacgctgcgtgccaccttccgcgccttccccggcgcggtgctccccgctggcgccagctggcggcgtgtgcgcctgnnnnnnnnnntactccagccgactccgccctcccggactgggcgcggggggtcttctccatcggtttcggagacgcggaggtcaagcagggggcccaggagccnnnnnnnnnnaaagccatggcccagctcaggatggggactgtggacaagctgttcctggagttctatgatgcagaggacagcgctcttgaccgggaagatggcgccgcacccgcagcagccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcttccgcgctttccccggcgcagtgctccctgctggcgccagctggcggcgtgtgcgcctgcaccggtccgcctggggctctgaccccctcttccgcggcagctacagctacccgggccccagcgcggcggccgatgccggggcggtgctgggcgaggcgctgacgccgccgggcgctgcccgccccaccctggttctggcgggggaggcctgcgccgtggagtactttgggaccacgcacggcgccatgcggtctggggaggcagccgccgcgaagctgctgtccagcctgtgaccccaggatgcgctggacgttcgtgttttcctgttcaagtcgcttgcacacgtgacggccgggggctctacttgcctgcagaccgcaactccatcctgcccctccacgggccccatgcagcacccaatgctatattacgtacagacaagtcgggccgactcgaggcagcgcggtcacatgtgagatgggggtgctgagaggggaggaacaaagaattgggcattgccctcagggcgcgctgagactcagccggtccatggcgccggccagcccctcgcccggtcgctccagcttgtcatccagccgcagcaggggcggcagtggcggcggctgcgtcctgccctgcagcatgtccagccacttggacctgtgcatttgtggttggagtgggaaggcgggcgggtgagtgtcggtgtgcgtatttttacttgctcaaggtactcccggcctcggtgccgctgcctgtcgatcagcacagatccaccgtcgctgtgccccgtgccggcaggcgtcagacccctccaggcaacaactctccacggcgaacaacagtggccccttccacactgcgaggcgacagcagccatgcgtcacctcagcagccttgttgcaagaccccccctctcccccccccaccccctcacacatcacctccctcacccctccggcgacagtgcccagccctccacagccgcgtccagctgcgcttggctgatgcccagcttcttgcagaagacggcgtcggcgggccccagctccgacagcgtgatggcgcggcccttgacgctgcgcatgacggcggcgcgggggccgatgcgccgctccaggctgtaggacaggtactgagggtagtgcaccagcgcggcgcggctacgccccagcccctccgccgactccaggaaggccagcttggtgcgggtgtggggtccgcgtggggagagcctcaggaagttggtgtagcgcgtgaggatgaggcagagctcggggcgggtgtagcccagctcctcccacccccgcacgcacgcgtccaggtgcgagacggagaagtgcgccagccggccgcgcgccagcaccgtcagcatcacctcaggggtgcaccccaggtcctcctgcagaaacttggccaggggggccagcttggattctaccccggccagcagggtcatgggggccagggacaccaggtgcccgatctccaccgaggtcaggcccaacctagaaggaggtgggggagggttgggcatggggccaataggaaggcaaggtgaagccatgagagggtagtggtggcggcggcggtggtggactccggatgtcgacggccaagcccggcatcctatcagtcagccgccacctccacccatgtcccccctcatcagcctcaccatctccctccatacaaccccaccccccacaacacacacacacacacccctcgctcacccgcgtaggtactcgatccggccctgcatgtactccggctccacgcccaggatggtgggcgcgcgcacgatgccctgcaccgcgcggtcgtgcgacacttccaaggaaagcagggcggcgaagcgtggcttcagcacctcctccacgtccagcttgagcacgttggggaagcgcatgacgatcttcacgatgctgggcgcgtcgcagcccagcgagcgcagccaccggaacaggcagcgcgccgcgtcggggttgcgcaccgtgtgcgccagcagcttgggcttgccgtgcaccagcttctcaatctgtggggttggccgtagttgggtgtggttgggtgtggtcggaggtttggggatcgggcgcagggggcctgcggtagcatggtccgacgcctccagacagacttccnnnnnnnnnnacttctcaatctgtggggtggggtagggttgggtgtggtggggtgtggttgggcatggttgggagtggtcggaggtttggggatcgcgcgcagggggcctgtggtggcatggtccgacgcctccagacagacttcctgacttgcatgccagcggccctgatcaatcgactccggagttggtgggaggcagggcaggccatggcaggcacggagcggagggagggcccacaagtcggccaaaacagaggcagagagggatgcatggcgactgcaggccctgctcaccatggcgggcgagaagttgagggagtgtagaaaggcgaggaagacgtgccaggtgtccattgcgtcggggtggaagaactcgcgagggtagcgagacagcacggccaccgccaggccgtcgtgaatcgagtccaggagctgcgaaatttggagagggcggggccatggaggacatgcaccaggaaggggggcacaggagggacaactgtccagcggacaacaaacgaccctccccacccaccggcagccaacgcacctccttctgggggtagatgtgctgnnnnnnnnnncgcaccaggaaggggggcacgggagggacaactgtccagcgaacaacagacgaccctccccacccaccggcagccgacgcacctccttctgggggtagatgtgctgctccattgtaaagggctccgatagccccatctccttcatgagggccactatcgccctggccttggtccgcacgttgtggatggaggccaggctgtacttggtgcccaggtacttcacgagctgcacggtgaaggtcggggccgcaggcgcccccacatccgactgcccgtgggaaatgctttctgcgacttgagctcgtacagagctcacgcgtcggaatgccagcctggaggcggcatgcgggacgaagggagcccgtggtcgcggtgctcgagaccacagcgactgtgtgggggcccaacctgggctcgcagacacggcgatcgaagccatctcaggtcactgtagcagtggctcaactcattatcttggaatcaacctcctcaatgatgtcgcaagcagcccccgccggggctcaaaaggcagatgttatcggagacatgtggtgtgggtaccgtggcgaagactggtactaccctcgtcaagcaatttggcatagcacagggaccctccaacccctgctaaaaggtacagacacctgctccacctcttttgcatcagtggattggctgattcaggggcgatcggcattcggtgctcaattccagccgagggcccagtcttggcctgagcgccgaaggtcgcgttctgcaggtcccggttccgattcccgcacaacctggccatgctgcggcagttgggaagccgattggtcccaagggccgctcctgcatgcgcatcagggtgcgggggcgccttccatagcgccagcgcttcatgtggtgtggggttgcctgccacccccaaccccgagcgcttggacgagagcggtgaggcgcgattggtggagggattgatgatacatcttccgcatcctggctcgggggcatggaccctgagtatggatccaggtgcctgcggttcgaccccatgcccacacctcttccaactctggacaggcattggagggactgccggcctgagctccaaagagttcgcgaccagccagcgcgaggccccccgtgacctggcaggcgtgctggacgagagctcccagaccctgttcctcacggagctgtggcgtgggctggccatgaccctcaaggtcttcttcgagcccaaggtgaccatcaactaccccttcgagaagacgaccatcagcccccgcttccgcggcgagcacgcgctgcgccgctaccccaccggcgaggagcgctgcatcgcctgcaagctgtgcgaggccatctgccccgcccaggccatcaccatcgagacggaggagcgggaggacggctctcgccggaccacgcgctacgacatcgacatgaccaagtgtatctactgcggcttctgccaggaggcatgccccgtggacgccatcgtggaggggcccaactttgagtacaccaccgagagccacgaggtgggcggggttggaagttgggggttgtatagggggtagcgcagaaggagggttggacgggaaagggagcgaggagatagagcgcggcgtcgctgtccatggccacaatcgagcgtcggctgcagggctgtggtctatccttgcgcgtcagcatcaccgctcccccgtccccttgccaattctgtacaggagttgctgtacgacaagcagaagctgctggccaacggtgaccgctgggaggtggagatcgccaacaaccttcgcaacgagagccagtatcgctgagccgcgccggctgccctcctgaagaagaagcagacaaaggaaccaggaagcatgtccacgactgtacggcatttcctggagctcaaccgcccgttgaatctcgcatacactgtcaaagctctgtttgcccggccctggctcacgccgctgtagggaaggcagccaacatcaacatgagtagttatggagggaggaaaggggttgtcaagggcgggagggttgagaatggagcatgggccacccatcaaaaattcagccgggggcctggcaggtgaggtcgatgacgggtctccgcaggggcgaggtgaagaaggccgcgatgctcgcttggcgcgcccgtttcctccccgtggccccgctccccgccgcgccgctccgccccgccagcgcgccgccgggggtggcgtagtcggccagccgccacgcgggcggcgggctg

SEQ ID NO: 46386 - DNA, 78 bp, Chlorella protothecoides
aggtgagatggggttggggtcaaggtccattttgggggttgggggatcgggtgagtgacacagcagccttctcatacc

SEQ ID NO: 46387 - DNA, 61 bp, Chlorella protothecoides
tgacgctaccaagacatcaaaccctccataacgacaggtcaactgcaggggagctctcagc

SEQ ID NO: 46388 - DNA, 61 bp, Chlorella protothecoides
tgcgtgagaacctcttcatccacgttgaacaccctgccgacaaactccagttggggttaca

SEQ ID NO: 46389 - DNA, 61 bp, Chlorella protothecoides
ctgtgtccgtgcacagcaccctgacagattatgccaagtacttcttgccaagcaaatggtt

SEQ ID NO: 46390 - DNA, 82 bp, Chlorella protothecoides
cggtgcgcgcgccaggtggggctgccgacgccatgcggtgcgacggtttgtcctgcatcaacatcacatccacccgagcgcc

SEQ ID NO: 46391 - DNA, 30145 bp, Chlorella protothecoides
  modified_base (113)..(122): a, c, t, g, unknown or other
  modified_base (1407)..(1416): a, c, t, g, unknown or other
  modified_base (1911)..(1920): a, c, t, g, unknown or other
  modified_base (1973)..(1982): a, c, t, g, unknown or other
  modified_base (2069)..(2078): a, c, t, g, unknown or other
  modified_base (4012)..(4021): a, c, t, g, unknown or other
  modified_base (5672)..(5681): a, c, t, g, unknown or other
  modified_base (6859)..(6868): a, c, t, g, unknown or other
  modified_base (8288)..(8297): a, c, t, g, unknown or other
  modified_base (9405)..(9414): a, c, t, g, unknown or other
  modified_base (10223)..(10232): a, c, t, g, unknown or other
  modified_base (10291)..(10300): a, c, t, g, unknown or other
  modified_base (10534)..(10543): a, c, t, g, unknown or other
  modified_base (10688)..(10697): a, c, t, g, unknown or other
  modified_base (11232)..(11241): a, c, t, g, unknown or other
  modified_base (12428)..(12437): a, c, t, g, unknown or other
  modified_base (12797)..(12806): a, c, t, g, unknown or other
  modified_base (13388)..(13397): a, c, t, g, unknown or other
  modified_base (13745)..(13754): a, c, t, g, unknown or other
  modified_base (14464)..(14473): a, c, t, g, unknown or other
  modified_base (14892)..(14901): a, c, t, g, unknown or other
  modified_base (14993)..(15143): a, c, t, g, unknown or other
  modified_base (15966)..(15975): a, c, t, g, unknown or other
  modified_base (16949)..(16958): a, c, t, g, unknown or other
  modified_base (17725)..(17734): a, c, t, g, unknown or other
  modified_base (18033)..(18042): a, c, t, g, unknown or other
  modified_base (18828)..(18837): a, c, t, g, unknown or other
  modified_base (20050)..(20059): a, c, t, g, unknown or other
  modified_base (20187)..(20196): a, c, t, g, unknown or other
  modified_base (21460)..(21469): a, c, t, g, unknown or other
  modified_base (22028)..(22037): a, c, t, g, unknown or other
  modified_base (22212)..(22221): a, c, t, g, unknown or other
  modified_base (23411)..(23420): a, c, t, g, unknown or other
  modified_base (24169)..(24178): a, c, t, g, unknown or other
  modified_base (24420)..(24429): a, c, t, g, unknown or other
  modified_base (24672)..(24681): a, c, t, g, unknown or other
  modified_base (25147)..(25156): a, c, t, g, unknown or other
  modified_base (25338)..(25347): a, c, t, g, unknown or other
  modified_base (25640)..(25649): a, c, t, g, unknown or other
  modified_base (25738)..(25747): a, c, t, g, unknown or other
  modified_base (25939)..(25985): a, c, t, g, unknown or other
  modified_base (27041)..(27050): a, c, t, g, unknown or other
  modified_base (27536)..(27545): a, c, t, g, unknown or other
  modified_base (27668)..(27678): a, c, t, g, unknown or other
  modified_base (27734)..(27743): a, c, t, g, unknown or other
  modified_base (28070)..(28079): a, c, t, g, unknown or other
  modified_base (28270)..(28279): a, c, t, g, unknown or other
  modified_base (28350)..(28359): a, c, t, g, unknown or other
  modified_base (28468)..(28477): a, c, t, g, unknown or other
  modified_base (29196)..(29205): a, c, t, g, unknown or other
  modified_base (29286)..(29295): a, c, t, g, unknown or other
ctcaccccacattgcctcctgacgcccttcccgcttccctgcagcttcagggagccaggcagcaggcgcctccactcccgcctttggcgtggctgccagtggatttggcggannnnnnnnnnaggcctcctcaaatcatgcatacaggggtgttgctaggatgggaggatgcttgcgagcctcctggggataatcttgaggcaagttaatgctgggaatactgcataacttcccctcaccccacattgcctcctgacgcccttcacgctcccctgcagcttcagggagccagacagcaggcgcctccactcccgcttttggcgtggctgccagtggatttggcggatttgggacgccaagcgcgacgcccgccagctcagcggcagcagcagccccgacagtcgcctccaccccgtcgtttggcaccgcgccggcccccagcgctggtgccggcgcgagcaagcccgcattcagcttcgggggtgccgccgccagtgcggcaggcgtggctgccagcgctgcggcagcatctagcgccgcgtcaacgcccgctttctccttcggaggctccgcgcctgccgcctcgggttcccaatccggcgccacaccgcccgccggcgcacccgccatttcctttggtgcgacgcctggcgcacccgcgcaaggcacggccgctgccagcacccccgcgctatctttcggcgccgcgccggccgccgccagcaccccagctgccggcaccggcccggccgccggcgccaccactgtggctgcgagcggggctgggttctcttttggtgccacgcccgttgcgggaggtgcgagaggggaaaagtccagggttggcatgttgtcggtgaagcatcctgcgtcgctgcaatttatctgggcccctcctttgtgccgcatgctcctccgtcccgccgctccctgatccattcccatttgcgccctcctccgcagtcgctcccatcgcgacgggcaccgcccccgccagctccacagcgccctccagcgccgccacggcgggcgctgtggctgcgacgggtgccgccgcggcggacactggcgccgctgcggtctcctccctggctgcgcccagcgagatccggggcaagatggtggatgacatcatcgccggctgggcaagcgagctggaggcgcgctccgcgtccttcaccaagcacgccgccgcgctggcggagtgggacgccgttatcctctcaaaccgccgctccctgctcgctctggagcaggaggtccgcaaggtgaggggagaggggggagggggcaaagaattgtgagcctggatgggggttctgggtgggggacatgcataaggcgcaaagggaggcgcgatgatgccgcgaggccccacccacttggtcaagggagtctgagatgttnnnnnnnnnnaagggggcgaagaattgtgacccgggatgggggttctgggtgggggacatgcatgtggcgcagagggaggcgcgatgatgccgcgaggcccgacccacttggtcaagggagtctgagatgtttactcgccggcttggttcccccggggccagacgcccacgcgcatggattggcctgtgccactctattcactcacaccccatgcccctgccatggcatatcatcacttatcggccgaatgtatcctcccacccttgttcctcttcctgcaggtcctgcatgcccaggaggcgctggagcggaagctggccatgctggacacacatcagcgcggcatccatgagacgctgacggggatggagcacgaggccgccaggctggcgctggaggaggccggcctccaggacgaagggacgcggtgcgaggctggggaggggattttgtggaaaggaggatgagtttttgggaagggaagtttctcggttctgggaaggnnnnnnnnnngtagaaaggaggatgcgttttggggaagggaagtttctcggttctgggaaggnnnnnnnnnncacctggcgcaagaggaagatgaagaatcatggggagatgggagactgaaccacactaggatgtggccactcgtggatcagaggcannnnnnnnnnaacctggcgcaagaggaagatgaaggatcatggggagatggtagactgaaccatattaggatgtggccactcgtggatcagaggcacagggccctggccgtgttttcagcacaatctcacgcccagctcgcctgacccagcgcagggaccgggatgtgctctacgcccgggcagagcgggtgggggcccagctggcggacctgggggcgctcctgcatcgcaccgtggccgatatcaacgccaacaccggtaagaaagaaagaattagggggcgtcgggagtggaggaaggggggcagtgccccctgttgttggttaccgatggtcgaagcatgcccctggtctgcatgcattgtcgccacgcggccatgcggctcccctcctcacccctctcgcccgaccaattcctgccccgcagctgcgagcctgggcgacaccgactcgccgctgggcaaggtggtgcgcatcctgaacaacaacctgcaggccctggcgctcatagacgcgcggaccgaggaggcgcgcgtgcgtctcaacagcctgcgcgccagccgctgacctgggccagggctgtgccgtccttctgcgtgggctgcccctcctgcgccagagggtgtgcctggcagcttgatgcactctcccgcacgcgtcccaccttggtaagttctcaaccttcaagttcaagagccatcgggcttgcaggctggtgaggtggttgggtgttaggccccaggcggatgatcaatccctccgatctcaggggaatccaaagtcccacacacctgcgcgcgcggaaattatccgacagaaccagccccgatgcccgcctcgccacggccacatggtggcctgcgctccagaacatccccaaaatcgacgtctcaattcgtgcatggcccagtgcccagctgctcagatggctgtcggactctcctttggcccacacacgaaacctctcgcctggctcccctctagatacccgcgtggagtccgtctgcgccccaccaccgctcaaagtgcggcgcaaatggatctgggcgccatgcactttcgatccatgtcctggtgcatgtgcgttacaaattgctacacccctttacgcactacaggaacagggagcgagactggggagagcacgccacatcccttgcacagacagcccgttcggcgacgagagcccgggcccgcgcccaaggaggtccctgtagagcattcttccgcctttttgcttcaaaagaggcatggcaacctgacacagagtctgtctgtgtcagatggggggcggggagagaatgggacagaggccagcgccacctctggctcctcatcgactacataccagaggaggaggaccccctccaaccccgctgacgagacccccttcgaggagctggtgcgccgcatggacgaggggctggacgagatggaacgcaacccccctgcttacgctcgggcgtggcacagcatctccactgggccactgggtgagacctcgaggagtgagggatgggggctggtcgaggcacatacacaatccacagctcggcaacatctctagtgctttgaccacctgtatcctccagtcctgtgtgagagctcgaagggcaaaccttcctggacccagctgcgggctccctccactgcctcccctgctcctcctgctatggcaggagcggccactggtgccggcgtgatgaaggctgccaaagtgacggctgtggtggggggggaagcagtacgattggcggtgccagccaccaagtgggctctgggagtgggcctgcgaatggccctgggagctgtgagcgccgtggagaagcaagagcggcggcgaaaggatgggccgcccagtgagctgtgaggaattaaagatcgtgcccctgcaagcgcagcgctctcccacgaaagccacaggatgggctggttggcgacggnnnnnnnnnncaaagatcgtgcccctgcaagcgcggcgctttcccacaaaagccacaggatgggctggttggcgacggatgtgccctgaggcaccctcgcgaatttcacgccactccgttgtcccccacatgcttgtgcactgccgtttgattctgtgaggggcgcttgacagacagccgtgacgcaggagggaaagggcaagcacacacttgagccccagtgtctgtcaagcaggggtgcatgcagctcactcgtcctcctggctgcgcaggcgagagccagcgttcaggacgttcacgttgagctggaatgggggtgaagagttggcagtgagagacaaaacaacaggtaatctgctgggtatagcatatcttgcaagtattgacccaggcattctgagggagtacttcagcctcccaccctgaggctcctgaaactgcaaatgccagccttatggtcccaaactgatggacctttgcacaccgcccacttctgcaccactcgacgccccgaccacctccaacagaaaccaaacccacctcggccgcgcgctccacgatcgccttgcgcttgagggtggacacgttgtgtgcgatctcagcggcgtacttgcggttgtgcagcagcagcagctcaaggtccttcacgttggacacgatgaacttgaggaaacctgcatggggggcggaagctggagcgtcaggcaccaggggcacatgctgatctgaccctcgctcttggaggggcacagtctccagtccgaccgggtccagcatattatttggtcgacaatcatgctgcaagcaaagccttgtgctttgtcacaccgtttggcaggacgtggcgggtcttcttgttggtgccgtagccgatgttgggcatggtcacaccgcatcccttgaacttccggcgaacgcgggagtcaataccctttggccgcctccagctctcctgcgacattcgaaggcgggggaacgggcatagagcgtgcactcccgcattcaggcgggcgcgcacagccttcctccacggggcccggggcatgctcgccggcactccgcggcgttggcccatgctcctcttaccttgacggagatcttccggtcgctctggtggcgcttgaagcgcgcggtgtgcttgtgcacgctcttcaccttcacgagtggggccaccatcgtaccgcctgcgaggggacaccgtggttcagcggcgcgcttggaatgcctggaaggtacacatattccttctctcctcacctgtcttgattccgaggaactgaaagagggagcttccgggccaggcacggccctgttctcccaagccgcccggtatgctagagggtccgtggtagaaagggaggaaactcgagcggtaggggccacccctacttgcctgatggtgggaagcaaccggcatatcagttccgcattgtaaatcccaaaaacactgatcaacggatatattcaccgttaatacaacatacatggtattctgtgagcgtgtcatatagtattgagggaacttgcatggccctgcccaaagctatttactgccatacatctcaaataatcgcgtgcacggctgttgtagcaagatggctagacatcggctggtaaggctgtgtaagtgattctttgctgcttgcaccttctctctgtcnnnnnnnnnnagcaacatacatgttattctgtgagcgtgtcatacagtgttgagggaatttgcatggccctgcccaaagctatttactgccctacatcttaaattatcgggcgcacggctgttataccaagatggcgagacatcgattggtaaggctgtgtaagtaattctttgctgcttgcaccttctctctgtcgtgaacacacctcatgagtcagcaccaaggacccgaattaatatctgcccatttgccatgctaccgagggataagcactaacaaccgtgggtggggatatccagggccctgaagaagctaagatgtatattcgatatggaatgtctttgccgtccacgtcgcacctgccaactgtagaccatgagcagtggagcaacgaaagtgctggcacatccaacatccataagaaccagaaatccactgaattagcttcaagcaacagagatgattactttaatcactggaaaggggccccttgttgtgcagcaggtggggctcccacttcccagctcatgcacagcacacaagctgccgggtgtatgaattctcgcggggctggtcctggtggccgagccggagcagagaggaaccaattttagacgaccagctgatgtggttaagctgccgattgtctcaagaagcagctccgcggaatcgacagaccggggaaaaggggaggggatgccgggtcttgagcgactaaaagggtgctgagagcctggccaatggcagcggatcaggtcatataccttgagaagttcatcgagagtgagtggggcgctgttagataaggttggagcggccagtgaagcgagcacctgccgacagtggctgggttcacccacccatgttacttttccccatggtggaccaggcacggtacacgtacctcccgagctccagcgcctcctgaacaccatcaaggacctggatgagcgatcagagggtgagacatgtcggatcagagcctgtttgcctcttttattggtgtgattgtgcgagggacggagctgtgtgggggggagttcctcgccacctagatgacgcagggatggattgtcgggctattccgtgccatggagtggcctaggtaagatatcacaatacactgtactagtctccatgcgcgcctgatcttccgactctcaccacctgcgcagacttgggtgccnnnnnnnnnnagaatggcctgggtaagatatcacaatacaccgtactagtttccatgcgggcctgatcttccaactctcaccacctgcgcagacttgggtgcccagatccaggataatgtggaggtgggcctgcagggcaagctgagcaaggagcaggtagagggggggggcaggagaggctcagattgggtgtgcgggacagattgaggtaccgcgggcctgccatgcctggttggttaatatctctgcgaagacaggggaccctcatgctgtgctcaagggccctgcgggggtgccatgcgctccggcgccggctcctccactccctccccgccgcactctctggcccctccataatccaacgatccttgtgactggcggagtgccctggctccccgacctcccagcctggtgtccctcgttcaggctcctaaccctcacacggactcgccgcgccccttccctcccccccgccacccctgcgccttcccatcaggcccccaactatgaccccgcctttgtcccaggcgcgggagctgctggagcgcatcgaggcagaccagaagctgctggtccagtttgcggaggagaaggtccagctggcgatgcagggctacgacctactggacactcaccttctgtccctggatgccgacgccgccgctctggccgaggagctccaggccaacgccagcctgaacgacgcctttggccccgacgccggttttggcgggaatggtggcgcgtttgacgacccggggacggcgccgcggaccgcccgcctgcgggacctgtcctcctacgactccctggaggccgtcaccgatgtcaagccaggtgaaggggggagtgggcacagtggttgacagggggcaattacctagggtttggggccagagtgtgagtgtgacagccccgctggaacaaggagcaggctggactgatacaagcccaggcccggtgccaggctcacagggcgtggtggaatggaaacgctggcatctgtcgaggctcagcagggcccagtctcatcgcctctcaatccctaatggacccttccaccgctggcctctctgtgcacaggccggaggtcgacgctgggcctctcccgccagccgtcggaggacgccatgacgccgctggcctacgacggtggcgctggcatggcgggtggccggcggccgctgtcctcggccggacgtgcgtgtggaggggaggggtggaggtgctgaggaagcggggtggcgagaggacaggagggaagacctactgctggcagggggctcggcagacagaccgggtcgggtgcaaagtctgcggccgcaccgctgcgtgcatgtctcttcgccctacgttggatgcctaccctggcatgcccgcaccctgaatctccttgttgtaggcaccctccagcagcccctcccgcccnnnnnnnnnnagtcctcagccggacgtgcgtgcggaggggaggggtggaggtgctgaggaggcggggtggcgagaggacatgagggaagacccactgctggcagggggctcggcaggcacaccgggccgggtgccaagtctgcggccgcaccgctgcgtgcatgcctcttcgccctacgttgcatgcctaccccggcatgcccgcaccctgaatctccttgtcgtaggcaccctccagcagcccctcccgccccacccccacacaacaacagggcggacgccgctgacctccatgctgggcccgctgcccggcggcgagacgggggggagctcccacattcccaagcgccgggcggcttccgccgcagtgcacgccgcggcggccgctgttgcggccatggacgaggacgaggggatggagggcaccccccccgcgatcccgggcgtggtgccggtcatgccctttgccacgcccctcatcccgggcttcgagcacgccgcggagcagccacaggtgtgtgtgtgtggattgggggaggggagaatggctgttttatcacctgggtttacccctgcccgccgcctgacgaccctgggcagcccgccgcccagctctgcctcatcacctcctccttccctacccactccgcgcttctctcaggcgcccgggcgcctgctcatggccagcgacatcgggccgggcctggtggggcgacgtgcggagctgtactggcccgacaacaacctgtggtacctgatcgagatccgggcggtgaacctgggctccaggaccgcctccatcctgtacaccacgggggaggtggaggagctggacctggacgagattgtgaaggagggccacctctccctcatcaccccaatccgggcggggccggggcggtagctgggcacgtggggtggtatgcccctgtggcgccgcagggaaaggggcaggaggcttccccgcacgcgagctggcgggggcgcgcaggctcttggctcgcccgaggggagtctccagggccctgccatatcctgtgcccgtccgttcatcccagtgcgcaagcctgcatgagcttaccgctgttggtattgctgtcctgcctgacctccccttnnnnnnnnnngcgccccggtgcgcaagcctgcatgagcttgccgctgctggtattgctgtcctgcctgacctcccctttggaacacggctaccctgcttaccgcaactgtgtgcaatacttccactgcaacagcaaagcacagacactcaatgggctgtgatgaccaggtcggcggaggaagggctgtgacagcaaggtagggatccagcagcctttcagcaccatgttgccgtcgaccggcatcaggcttccagcgaatcagcctcgctggatccctccctgccgccagcgctgtgtgatgtgtgggatccatgagctctgcttgggcctgcctctccgctcccctcatcgtcagacgaggatcctggggtcatggggacgtggaaggcagcgcgccgccctctgggcagggccgccgaggcggctggtggcgccggcggtcgcctgggatcctgggagggtccaggctggccctccgtccaggacaccgggggtgcatgcgcatcacttgggctgccgccgcgttcggccctccctcggcaaaccttggttcctgttttgtgcacagcgggtatcaggtcggctccgcccttgatgctctctggcgctgacggagtcgcctccggcacagccttcttgggccttgcggtggcactgacaggccccacctcacgagcagcctcgaagggatcaccgctcatggggctcgactctggtccctctgcaggccctgccactcctctgacctcagccaccccctcgtttggaggcatatgtagcatggtaagggggctcctggtgggtacgccatggcgctnnnnnnnnnnctgcctcgattggaaggattgggaaactagcggagaggagcagggcggctgaatacgcnnnnnnnnnntcctctgcaggccctgccactcccctgacctcggcaacccccccgtttggaggcatgtgtagcacggtaggggggctcctggtgggtacgccatggcgctcggccagtgcattgtgtgacgatggcctgggtgatgccgccgccggtctcctcctcacaggtgtgcgcgttgttgtgggaagcatgcatggcgaggggggaacctcctccacccacaccctcctgcaggggtgnnnnnnnnnnaaagtctgcgtccatctggttctgaccagtgtgaggggagggttgtatgcgtcagctggtggcaagaaaccgagtaggcgcagggtttgggaggccctggggcatgtgaacaggggatggatgcatgcatcactgcaagaaaggnnnnnnnnnnaaatgagcacgtccagccaggcagtccttggctcatgccaaaatcccaatgacatgtatctgctctgcctccagcacttgcctcttgacctcggtctggatccagggccatggctgccctcgcgcataggagacgtagggcgagggctctccctcaccaaccaggccggcaagcccatgcaggaggggcctgtagaagtctgcgtccatctggttctcaccagtgtgaggggagggttgtatgggtcagctggtggtaagaaaccaagtagtcgcagggttttggaggccctggggcatgtgaacagtggatggatgcatgcatcactgcaagaaaggtcgggttgcctccaaactaggacctgccacggcccaccaagcaacacaccagctcatcgactctgggctggggtgtagcttctcgcagggccggcatgcggttggaaattcctgggcggtgcagcgcatgagggtcatgcagtataggaatgagcaagcttgaggtggtccaggacgaccattccatgcatgagaannnnnnnnnncctcctgggcggtgcagtgcatgagggtcatgcagaataggaatgagcaagcttgagggggtccaggacgaccattccatgcatgagaatgctttcagcaggcatcccaggcgacctaatgacaggatactcaccgctcaggcctggggagggagcctctgaatggggaggcggcgcggcccatggatgcctagctttcctgctcagcgcctggagccccagggcttgcaccggcccaggagacatcgacctggtcatggtctccacaaccgtcgtccgccgcgtggagcccggtcgtccgcctgttgccgagcactccctgcccgcacctcgctgcagctcccggctgtcgcgctcaatcccagaaattgcctcgcccaccacatccccatggagcagggcagcctgcgcggcggcatgccgctgggccagccgccagcccgccccgctttcctcccggcgcgcggcggcgtgcgccgccgcctccagccaggcgcgccgattccgggcgcgctcgtgccgcgcggcctccaaatgctccatcagcagccccacccgctcccgcagcgcgcgctcggtgcgcgcggcgcgcgcggcgcggcgcgccgcctctgccgcctctgcgtccagcctctcgagctcagcgcggcgtcggcgctcggccgcctccgcctcggccaggcgcagtctcaggtcctcggcctcggcccgtcgcgccgcgcaggccgtgcagggggccgccaggtcggccgtgagggcgcagacctggtgccgcagccgctgcacctcggcgtgcatggcgtgctccaagcccgagtgcgggtcgggcagggccgccagcgcccgcgaggcagcgcaggcggcagcggtcactgccgcgctcgcctccctgtgacggaggggccacggggggtgcgtttcggctacctttcagcatcagcgggggctctggggaggaggcagtcgcagcacgcgacagggccatgctatgcaatcggcatggcactccaggaccgcatcccaggggtgtctctgcggtcacccatacgacactgcagcgcccccctctccagggtagccaactgactcggccatcgcgcggagctccgcgtccagcccgccggcactcggctccacctgagaaggttccagtgagtgcagggctctgagcaggccctcctggcccnnnnnnnnnntggcactcggctccacctgagaagggtccagcgattgcagggctctgagcaggccctcctggcccctcgcaagcctctccagcgcgacgcagagcccctgctcgtccccgcgcactgcaccgaggttccagccctcaggatccagggcgtcccagtgggtggtgaggtgcccgctctccctggcactgcgatccagcgtgcatccagaccatgcctcacgtagccgggcctgtggtgtgaggagaggggtagacttcttgtcggtgaacagcgtcgctatgggtgtggggccaggcagtgtaacccagcacaggaatcacatcactgcgtcgacccgctcgtgctgcactaagcccatgnnnnnnnnnnagtgaacagcgtccctgtgggtgtgggaccaggcagtgtaacccagcacaggaatctcatcactgcatcgacccgctcgtgctgcactaagcccatgccaccgacaccaggcagcagcagaccttcaggtcccggttctggcggagcaggtcctcttggacatgggcgaggtactgcagcgccagctggcacaggctgaaggtgtggcggaaggtgtcaggaccgaggtctcggtcatcctcgccctccaacccgccagtcaagaggctggggagcaccgaattcaagctggtgatgtcggacgcatggaactttgggaaggaagacgggggaggggaggaggtggcggtggtgttgtgaaggagatcccttgaggatatgacaacatgcagcacatactcctatggtgtgcagcacagctggctgcacgcagatccattatataacgtaaacccttacaatggcatcagggctgacgctgaagagggaggaccagttcatgcatggtgcgggggcctcaaaggcgaagtgtggcgggccatgatcacccatgccacgagggaccactcggcgtacaaaacnnnnnnnnnntgaaggcgaagtgtggcaggccatgatcacccgtgccacgagggaccactcggcgtacaaaacacgtccccatggacaccacagggcccgccagatcacgagagatacatctgagttccagaaatcaatacagatgtggaaggggtgaacttcgcatgtgggcttggcattgaaggtacgtcggagacagggcattcgcttgaccaagcattgcccgtcatgcgcgcctccactccacttctcccaggctgatttgtggattttgctggtgttacgaagcttcagcgacttgctggcattcatcgcacagacgtaacgatgaatggcggttccgggccgggagtgggnnnnnnnnnnggttacgaagcttcagcgacttgctggcggtcatcgcacaggagtaatgatgaatggcggttccgggccgggagggggggcggatccaggtgacggttccaaatcctgcgagacgcagcatgcatgcagcatggggggaaggtgaggaattaaagtctcgtcgatcagatgcctgatcgacagccaggaaaggtgaaattctgtcggccaagaatggatttccatcgctgagctttaagcattcaggatgactctcgagtgcagggacccctgaatgagggaccagggcgagagagtttgggccgacgcgcctcaacttctccgggaccttggcgactacatcgcagcactgcatgccagtcatgcggacgcaaggtcaggtggagagctgaatggagttgccaggaggctgtgcagagctactggtcggagaccgagaatgtccagactcatctttcgcagatccactccacctggaaactccgagccggtggtcttgcatcacgagacgggacacgacgggagcaatgcctgggatcatcaggtcgccacgcatctctctggagaggacgccgagtacttgaaaggactcatcgaacgaggcagagtacaggaactgagggcagtagacatttctggtcctgcagtgacaccctcccttcacacttcctgcggcctgtctgcagctctgctggcatgctgtcgaagcnnnnnnnnnngtttctggtcctgcggtgacaccctcccttcacagttctggcggcctctctgcagctctgctggcatgctgtcgaagcatggaagcggaggcggcacgtctggctgtgagcatcacagctctgaaagaggtgtgcctgctactcagtgcgagagggttcctgtgtgtcgggcatcgaggagtgttgaacaggtgatttgagtccgctcctcccagtccacactcctcatgcaacccctcaccgcacccacaagcagaagtgcagacggtacaagtcccaggcagctcaggcaggggaccaatacaggctgctgcgaagtgcctactgccgactccgggacgagggcacggtcgctccttcacgccacaccggcgcaccactcgagcctcctggcggcagagcaacgcctgtaccagagnnnnnnnnnnccaatgcgagatggttcctgtgtgtcggacatcgataagtgttgaacaggtggttcgagtgcgctcctcccagtccacactcctcatgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcccgaccgctccttcatgtggcaccggcgcaccactcgagccccctggcggcagagcaacgcctgtaccagagctgtcccagccggacgctgcaggggagcctgcctctcccccaccccccttcagcctgctgcccgccactgaggcacaagctcggcgcgacccgctgcgtggcggggagcgggccgcctggagggggcgggaggcagaccctcccaccacatgcccctcgacccaggaggtgactgcgcctgggtgtgcggtggtgatgagcacgcccccggaccgaggcatgcctggggagcgagctgcgcccagagccctcctggctgcgagtcccccacggccccagccggggtcaatgctcgcccgggggcggcatggggccacccctgcgcggaggcctgtgctgcaggagcggctggctgggaacgtggtgcagcctgacggagtgcctggcgcggcaccaggcaccgcgtcccacgacccgccgaggtgcggagggattgccgtggcgccggtagccctcgcggcatgccggggctcagagggcgagcccgccagggacgccgaggctccggctgcctccccgggtgcggacgccgcaagagcgcggcctggcttcaagtatcaggaagtggtccgaggcaaacgggcgcgggaggagctccaggtgggtcatggggagctgccggtgcctgtctgaagatggagaggagggggccttcccatgcggattgctgcgatcttttctaggtgcccctgcccgctcagtgctcgaagagtccgttgcatgctgcaggcggtggagtgcgaggannnnnnnnnntgatctattctaggtgaccctgcccgctcaatgctcgaagagtcctttgcatgctgcaggcggtggagtgcgaggactgccgccgtttttaccaggcgctggagacctgggggagcgtcgctccgggggggcagccgagctgtggccatgtgcccgggggcgggccccagccgctgagcaggacaggcttgcgggacctctcctcgcggcaccgttaccagtttgtcccgccagccacccccccggacttctgggacatgggcctctcccccgaggccaagtctggcggccagagggcactgccccggcagagtccatgaggagtatgctgggcacctgcccgtagtgctggtcgcagcattgcagccatgcgcactgagggggtatcatgtgggaggcccctggcatttctgcatcgtcacaacttttcagcctcggctcagtaagcaagggaatcggtgggtatccgatgtctggatggctcgaacactgtgacctatatctatgcatcacatcaaacagaaacgtcagtacccttcagatggcacccaccacagcagggatggcttcccccacgctctcaagcgtgccatacagcagcctcctccccaaagcctcagtgaacactgcagcagcctcctccacgcctacattcgcccgacccagctcggcggcaatgctggtgacgcccttgtctcgaaagccacagggcacaatgtgccggaaccaggagaggtctgtgcagacgttcagggcgatgccatgcgaggcgacgcctctagagatgcggacccccactgcagcgatcttccggtcgcccacccagacaccggttccaccgggcacccgaccctgttgttgggtggcatgggagagggcattgcgttgttgagacttggagagggaagcagtcattcagatctatgcaatgcatttcaccactcagtggacaccggtgatccaacacgtctccnnnnnnnnnntttggagagggaaacagtcattcagatctatgcaatgcactttacccagcagtggacaccggtgatccaacacgtctccacctggaaaaatgtcgcgcagtatgcccgacccatcctgaaaggcacgacctctcccacgctaccacatgcagcgccatttgcacccaccctggctttgatgccgtactctctcaggctgtctatgagggcatcctccagactttccacatacgcacgggccccgagttgccggtctctcaggtgcacgatcgggtaggcaaccagctgcccagggccatggaacgtgacctcaccgccgcgtggcgagctgtggatgatggcgcccaggtcccgaatctgatccggtgtcgagcggaagtccctgctgcttcccctcttgccaatggtgtacactggtgcatgctgggcgttggtggtggggcaggatgtaagcatgacggagattctgagatacgcttgacaatgaacgatttacgtggggctccaacaggtgaatccttgtcttaagatcttcgccagcatgctctccccattaccacactgatcatgcacctgcacaaggagcagctggtcaggtgtggctcgacgtgctacggcctcggcgagggcatcctgaagctccaggccacgagaataaggagtcaatgtgctcagaaggaggcgaacttgcagcaagccgcgcgctacagcggcagtcatgccgacgctttccaaaactgcagaggcctactgccgacatgcacgannnnnnnnnnaaatgtgctcagaaggaggcgaacttggagcaagccgcgcgctacagcggcactcatgccaacgctttccaagactgcagaggcctactgccgacatgcacgacacaacgacatctcggatgtcagattcctgggagcgtgccaatgatcatcacccctaacaactgacggaatatgcaagtatcgagtattgtctagagggatggatggaaaggtgtaaagctcagagtgagcctgtggaggaggaacaggtttccgggcgcgcgagtccgcgcgccaggacgagctccgaaagctcnnnnnnnnnnaagtgagcctgtagaggaggaacagggttccgggcgcgcgactccgcgcgccaggacgagctccgaaagctcagcaactctcgccagtaacatcagaaacaccttcgcatgcatacattactgctttacatttgcgcggcatccatgctgccatacgacgcgacgtcagccacgcgcttctgaaggccgagctgctgtggtttacaatggcacccccccttgaggcagcattgctaggccgcccaggggcaatggtggaggacaactactccacagatgcatactctacgttcatgggtggcgtggataggcccttgcctggggtccaggtgaccgccaccaccagttcctcgcccagtacgcctgagacactgttttgccaggtgctgcttggcgctggacacagacacgcacgatattgcaacagctctgagcctttaaagggtacagagctagtttgtagatgtaagcgcttcagactatccccacacaggtgtacgcccctctgaccgttgctcaagctggcagagctgtgacggagcgacaactcctgctcttctgttgccttgaagagaattctggaggtcctcatggaacctggagggcacttcggtgtcagagcatcccggagcagcatggagctggtggatctgggacaatctcggtgcgacagactggccctcccatgcccgccgccgcagtaccagcagccattgattggggtgcagcgtcgacagcgggacacggagaagccaatgaggaggacgaccccttcaactttgacgnnnnnnnnnncctcggtgcgacagactagtcctcccatgcccgcagctgcagtaccagcagccatcgattggggtacagcgtcgacagcaggacacggagaagccgatgaggaggacgaccccttcaactttgacgacctggatgcgtccctggatgctctggaggccgagaggaaggcgagagccccatctgacatgtcacacgggccgccccacgaaaagagtagcgctgccctcgactcccgcgaggaagcgccagcgggtgcttctgctgctcgtgctgaccgggtcgctgctccgctcccgagaccgggccaccctgacgcagagcctgccaccccgggcaccgtatgtggcgttcagcccagagcccagcttccttgtttctacctggtgtgcgaggaggacggcgcggcagggcaggcgaggcagcaagggcatggcaactcggtgcccggcccccagtctgacagcgaggagggaccggcggcatgggagggtgaggcctgggaggcggacgcggtgctccggccgggaggcccagacgccgcttacctgcgcttcaccaaggtcctggggcgctgcggcgaccagtgcatacgatatgggtacgtgggagggcatggagggaaccggctgggctggcctgtctcaagggggtgtgggaatggtggcttcacacaacagtggatgagcacgcatgggcttgcagtcgagccatttgggggtcgtgtatgtggatggatggtaatgacagtgcctcctatctgtgtctgcccacatccacatgtttgggtgctgcacaaacttcatcccaggttcaacggccagctggagtggccagaggacgcccggccccagccaccgccctgtcccctctgcggggcggagcgagtgtttgagttccaggtgatgacgccggctctcgtggccctggacgaggcagcgtcctggtcgggtgtggcgtccaccattcccatcagctggagctggatgacagtggcggtcttcacctgcagcgcagcctgtcagccttccggtggcgaccagcaaggctgctgcgaggagtggactgccgtcgccctggaatagacattgaaaaaacgatttaatggatatgaatatgactgagaatggaaatcagggtgcgcgcagcgggcgcaatttcacagacagattcatgcgtgggtctactccggggtcgcatatccgacgccccaggnnnnnnnnnntattgacaatacgatttaatggatgtgaatatgaatgagagtggagattagggtggatcagtgcgcgaagcaggcagacagatggtccaaggattcatgcgacatatgcgagtcgaagatatgtcgcnnnnnnnnnnaatcgttcccaaatccactctccatcgagtttccggctgaggcagggcatggggtcgtcttgccctgcctcgctgcccacttgccatcctaaccctgacatcatgcagctcgcttgctccagcagtgtgcggctgacggggcctcggcccttcagtgccaccccttcccgtcatgggaggtctcgtgccccatgcccccggatctacgccgaggatggcgctgccgccaagaaggtcgcggagaagaagccagagtcgaagaagccctttagcccgcccaccctcgaccccgacacgccgtctcccactttcgggggaagcacgggtgcgcgtcgtggttggccgtgacgccggcagcacgaggacgcggggttcggtctcgcatggctcctccgctcctctccgcctgatctcatcgcaatcgggagagagacgcggtgacttaggtttcacgatctcgccacctctcctgccaggtggcctgctccgcaaggctcaggtggaggagttccatgtgatcacctggaactccaagaaggagcaggtgttcgagatgcccacagcaggcgcggccatcatgcgtgagggccccaaccttctgaagctgtcccgtaaggagcagtgcctggcgctcctcacccagctgcgcaccaagttcaagatcgacggtgccatctaccgtgtcttccccaacggcgagacccagtacctgcaccccaaggtgcattgggctgtgcagaggttggctgtgggtgccgggcttgcaacgatggcaggcgatcatgggggggaggcattgcctgtgatgtggtggcgggcatgcgcacgtgagctctgcacttgagttgcatggactgccacaccggcattgtctgtgaggtcagcatgccgtactttgcgacactggtctgggtggctggtctcctgctcaacccggctcctcggtaccctcttcccaaggatggcgtgtaccccgagaaggtcaaccctggccgcaaggaggtgaacgccgtcttcaggcgaattgggtccaacaccaaccccgcaaaggtcaagttcaccggcaaggtaggattatgcatgcccccgggagcgactgttctgggtggccgggtgtgctcgtggggatcgctcgctgtgggtttgtggggaaggacgggagggcgggcagctgaccttgttcggggagcgctcttcctgtggagcaatcattctggtcgagtctgttctggaatgcacggccccccagggctgtcttttgtcnnnnnnnnnngacgccccggggatcgactgttctgggtggccgggtgtgctcatggggatcgctcgctttgggtatgtgtggaaggacgggagggcgcgcagctgaccttgttcggggagtgctcttcctgtagagcaatcatcctggtccagtctgtactggcatgcacggccccccagggctgtcttttgtcgtgctttatgttgaccttcccgctttcttgcagccgacgtacgaggtggaggcatgggggcagtgagtcatcaggaacagggtggagcctgtgaggggatgcatctcagcggctcaagccgaggacatctgaggccggaacctccacagtttctgctctcccccctgtatgatgagcagctgcacgaccctttgtcgagaagaatatgtgtaccgaggatgtggtgctgtcaacaacacaacaccgcgaggaagggggccaggggcatgtttgtacaggggcgtgcaccgccaggcatctgcatggtgccgagtcaccagcatgtcagaggcagctgctattggggaaagggcttgggatacccggggtttgttnnnnnnnnnntttgcagccgacgtacgaggtggaggcataggggcagtgagttatcaggaacagggtggagcctgtaaggggatgcatctcagcggctcaagccgaggacatctgaggccggaccctccacagtttctgctctctccctgtataatgagcagctgcacgaccctttgtcgagaannnnnnnnnngcagcaagccgggtctggtcagggaaggcttcctagggtccttgagatgggctttgccacatccagtcccctgcacgcctcgaccccgggccctggggcccgtccacctacccctcttccccaaactcggtcgtgaacttcttgtacgtctccaggtcgtcctgagacactgtcggccgcgccctgagcagcaccttttcgaaatcccggaacgtgatcttgggagggtgcacctggcgggggaggagagcagcggaggtgcctgggtgtcctgaggcaggtgcgtcggtgccgtcaggccactgatgtcagccggtgggacctttcgtgacggccgatgaagtgcaaaccgagcaggtcctgctgcaagacctgcaaggacacccctgcaaggcccagccccaatttcaccatagtctcaccagctgcgcctggcccttgtctgccaagctctggagcgtggccgggaaggcgccgggctcacccgcagagcagggctccagcatcaccttgcccccttcttgtacctttttgaagtgcgtcgcgtcctggaacacgggtgtgggaaggggatggagtggcgatgggaggggcagacttgcagggaaccccagcgatgcattgctggcaacaccggtgctgcaggctggtcgcagaagtagacgcttcacttcatcccctttgacactcctgtgcactgcacaagtccaggacctctcaagcctcccacccgcctcaaccccaactctgtcaccacaaacctgcgtcttgcggacgggctgcatgagcacatccttgaccacgatggcgacgtcggagccggagaagccctttgtccgctcccccaggtcgtcaaactcgcgctgagtcagcgcattgggcgtgtcccccaggtggatgcggaacatggaggcccgggccggcgcctcggggagcgggatgtggatgcgcttgtcgaagcggcgccgcactgcctggtccagggagtagggcaggttggtggcgcccagcatcagtacctgcgggtggaaaggagggggggggggttgagggtggaaaggccgaccttggattttgtataaatttgaaagggagcaaggaggtcgagcaggctaagaaatgtgggtggatgaacactgtgaggcagggcagggggcccccgcaaagccctctccaatccactccccccnnnnnnnnnngctccggggcagggcagggggccaccgcaaagccctctccaatccactcccccctcagcagacaggctactcctgtcgtccccaaagcttaccacgagaccacatcagaaccctctccattgtccagtacatttccatccccaccccgacgcacaacacgatcacagcgccgtccccgccccgcatccccgcacccgcttcttgtcgtcgccgtggcccacgccctgcatctgcaccaggaactcggtcttgatgcggcgcgcggcctcgctctctccctcgccccgcgagctgcacagcgcatcgatctcgtcgatgaagatgatggcgggcgccttctcgcgcgccagcgcaaacaagctggacaccagcttctccgactcgcccatccacttggacaccaggtcggaggaggagacggagaagaaggtggagtcggcctccgtggccaccgccttggccaggtaggacttgccggtaccggggggaccgtacagcaggatgccgctccagggcttgcgcttgccggtgaagaactgggggaacttgacggggaggatgaccgcctccttcagcgcatccttggcggactccagccccgccacgtcgtcccactgtggggcgtgatgcggaagggtgtgtgtgagatggagggagggagatgaaaagcaccctagccggagggctggtcaggaggcaggtccagcatcctcaccccaccctaaagaccactgattgcatggtcttcnnnnnnnnnntagggggtgtgtgcgatggagggggggaagataaaaagcaccctagccagagggctggtcaggaggcaggtccagcagcctcacccgaccctaaagaccactgattgcatggtcttcaccaactgacaacataccagatggcatggccagacctcgggtatccctgcatgcctactctgcaccctaacgactccgccacctcaccttgacgttgggtttctcctccaggatcgcgttaccgnnnnnnnnnntaggcatccctgcatgcctactatgcaccgtaacgactccgccaccccaccttgacattgggtttctcctccaggatcgcgttaccgagggagctcttcagcttctccaagtcgtcctattggtgggagcatttggagagagggaagttctgtacagctccaccttgatgaaaatgctctggtgccatgttcattgctccagtggcggcacaagggctgcctgcgacttcacagcggcagtgnnnnnnnnnncaggtgagagcatttggagagagggaagttctatacagctccaccttgatgataatgctctggtgccatgttcactgctccagtggcggcacgagggctgcctgcgacttcacagcggcagtgtacacgacgcgtacctctttgccggcagccgcaccgggtttcttcaccccagcggcagcttgggagcctcccactccggcatcgccagatgggtcctccggggtttgcccatccagcacagccctcaggtactcagcacgcgcaatgtagtcccgaacctactcggagaagatcggtagaaatgttaatccgtcaatgatgtgctggcaggtgctaacgctgatggacatgtcttgacattaggtctggttatggtgagccctgaaatctcataaagtctccaaatagagggctgactggttatcgcatgcttcctgagagcgatggcctggacagctgcttnnnnnnnnnngtagtagaagataggcagaattcttaatctgtcaatgatgtgctggcaggtgctagcgctgatcgacatgttttgacattaggtctggttgtggtgagccttgaagtctcataatgacttcaaatagagggctgactgcctatcgcatgcctcctgagagcgatggcctggacagctgcttnnnnnnnnnncgcacatcccgcatgccgtgtcaccaccaaggagagcttaccttcactgtgatggcactctttgcactgggattcttctcgtatttcagatgggtggtgaagtagtccagggaggccatgtacaactggaaggccttctgatagtttccggcattgtcctcctctgtcgcctgtttgaccagctctgtgggagcagtggggcatgtctgagatgtgcataatgccaagcgcagaatcacagggacaacgacgggcaaccccgggggtcaagcccttttcccgttcccaccctnnnnnnnnnnaactgaaggtgacagcgaaaccgtgctggatggggacaagtggccgaggacccacgccgttcgtaggggagtgatcccgtagtcagtgnnnnnnnnnngctaagatgtgcataatgccaagagtagaatcacagggacaacgacggtcaaccccaggggtcaagcccttttcccgttcccaccctcacacctacctattgccttctccttgaagttgctgtacatgcctgagacgcaaggggcgattactcgagcagatccttccgcgagcacctactggagtaccattnnnnnnnnnnnnnnnnnnnnnnnnnnnnnnnnnnnnnnnnnnnnnnnggtgcaaggtttgggcagtcggttgcgggtgaatgccacaagaccgcgccccagattggttttacgcgacttgtgagggatgcatggtgccgaatgaccttgtcaggccattgacgtggcgaacgcgtcgggacctgcggtcggagggtgagccgagcgcgccctggaattcaggtctgtgatatgacacctgcatcaattgtaaaagtctacttccactgttccctcagtggctgggcttgggttttgaatgttcctggttcatgaacatggaggattatacgccattcgtgctgagagcagagcttcgaggtcacaccgaggacgtaagtgatcgcaggacgaatgctgcatgcccctgtcctatgctcatctgaacctttgctcccatgcagatacgagtgatatgcgtgtgcgatctgggaatcctcaccggctccagggacaagaccatcaagctttgggtggagggcgacgatggggagtacacagaggcatcaatgtttgtgagtctccagggcttgtcggaaggtcatgggagccggctgcggcgcatgacaagctattctgtctgaagtgtgcggttgcattcctggcagcacgagcaacatcccctgattcctcccgaatgcaggtgggacacaccgactttgtgtctgcactggcctttgctcctgcctcctcgatccaccccgacggccttttggtgtccggagctcgggatgccactgtgcgcctgtggaatccggttcgtttcactgagctgcagatcctggagggacacaagtaccaggtgggaggggggaagatgggtgtgcaggccgggcagctggggacgcctgcactcgcatcgcagctgtctcattcttcgcattacagctgttattttgcagacctgcgtcctcatcttcttctccctcagcctctgctcttgcctcggctctgactgatcctgcgccctcacactctcacaccactccctcctgctgcgggtgactggcgttgtcatcctggacgaggcgactatcgtgtcgtcctccctggactccaccctgnnnnnnnnnnttctccctcctgttgcgggtgactggcgtggtcatcctggacgaggcgacaatcgtgtcgtcctccctggactccaccctgcgcatctggcgcgcaggggtctgccagcaggtgctgaccggccacaccggccccgtgctctgcacgctgcgagtgccccgtggggatgtgtggtccgggtcgggggacgacagcatccgagtctggcgggagggaacgtgcgtggacgtgatccccgcccacgccgacaccgtcaggtggggtcgtgctcatggaggctcgggcgggggattcgcatgtgacatccccattgggtctgtggatggtgtcgtgcgctcccatgctcgggctgaggttgcccaccctgtggagctcgtgcgaatcaaatgccacccgactccccctccctcacatccccctgcaccaggcacctcgccttcgtccccggcagcggtcaggccgtctccgcgtcccacgacaccaccnnnnnnnnnngctgtggagctcgtgccaaccaaatgccacccgcctccccctccctcgcttccccctgcaccaggcacctggcccttgtccccggcagcggccaggccgtctccgcgtcccacgacaccaccnnnnnnnnnnntgccgcggcgacgcccgggggcctgctggcctccggctccgaggacaacacctcgnnnnnnnnnnctcaaggtgtgggacgtggaggccagggcctgcacgtcccagctctggggccactcctccctggtgtacgccgccgcggccacgcccaggggcctactggcctccggctccgaggacaacacctcgcgcctgtggcacctggggggcggccccagcctccaggtgggctgggggggggtggggtggcaggcatgggcagggcatgggtgcacgtctgggttctgtgaaaacccctcacccggagccccggcgagcccagtctgacacatgccctcggctcgccacatgggcgcagaccctgccacaccctggctgtgtgtggacggnnnnnnnnnntgcatgtctgggttttgtgaacacccctcaccccgagccccggcgagcccagtcagacacacgccctcggctcgccacatgggcgcaggccctgccacaccctggctgtgtgtggacggtcgagttcctgccggacggcgacctggtcacggggtgcgcagacggcgtggcgcgcctgttcacgcaggacnnnnnnnnnntgatttcctgccggacagcgacctggtcacggggtgcgcggacggcgtggcgcgcctgttcacgcaggacnnnnnnnnnngtcccccgtggaaatggggcgcccatcgtgtggcccagtcaggggtgctgcatgcaggcgtcagcatctctgggcattccaccgtcggcgcttccttctcacacggcgnnnnnnnnnntcctcacgggcggcgggggccgaggcggtgcaggtgcgccgctcggtctggaggtgggggagggcgggtcctgggagaagcctgcgtgctgcagtgcccgtggaaatggggtgccatcgtgtggcccagtcaggggtgctgcgtggaggcgtcagcatctctgggcatcccaccgtcggcgcttccttctcacacggcgcatgccatcgcccccctgattccctcattctcccattgccaggtgtttgaggccacgctggccgctgcagccgaggcggcggcagccaaggagggcgccggggagggcggcgccgctgcgggcctcaagctggaggacccctctgtgctgcgggagccggggacgcacccgggtcaaacgagggtggtgcgtgaggggggcaccggcatggcatacagctggaatgcggccaggtgcggcggtggggtggtggaggggggaggtgggtcggagggggtgagcatgggtggtgaagaggacatgtgctgggtggaccatcggagtgtggggagagccaggcgaggggcaggctgggggagtcggggtgtggagtggcgctggcggcctgcaggcgctgccccgacttgcaaggctcgacgggccgaggggtgaaccagtgctcttcccttcccttgccgtcaccgagccttgtgcctgtgcaaccctccatccccccagccaaagctgggacgtggtgggnnnnnnnnnnggaggacatgtgccgggtggaccatcggggtgtggggagagccaggcgaagggcaggctgggggagtcggggtgtggagtnnnnnnnnnntgtgctctccccttcccttgccgtcaccgagcattgtgcctgtgcaaccctccgtccccccagccaaagctgggacgtggtgggcgaagtggtgggcgggcctgggggcggcgaggacacgctggcgccggcgggaagccgcgtcgtgggcggccgcacctgggactacgtcttcgacgtggacgtggaggacggctcgccgccccgccggctgccggtggacgcgggcgagaacccgtacgtcgcggccgaccgcttcctggctgccgaggacctgcccaccagctaccggtgggtggattgtgttggcatgtgcctgcatgtcgtagggatcaccccaaagtggcctctgcggatcctcctgctccccatcttccttctgccagtggtgtcgaggtgctgagcgcagagtggctgtcgcctggcgtcccgtgactgagtggaccctgctccaccaacctcgcccatgcagggagcagatcgtgtccttcatcctccaaaacacgccatcggggcaacccttacctggagcgtcgtcggggcacgcgggcgatccgttcacgggggcaaacgcgtacgtccccggtgccccctccgctgcacccccgatgcgcccctcaccgggccttaccagcgtggtgggcgggggccccgatcccttcactggctccgccgcgacccccggcctcatccccgcagcacgctacctggtcttcgatgccctgcccgacccggcggccgtcgcgcgcaagctgggccagctggcgccgggggtccccgcgcccgtcgacgccgcgcgtgtcgaggcactggcggccgccctctgcgcccccaccgcggccgcgcccag

SEQ ID NO: 46392 - DNA, 79 bp, Chlorella protothecoides
gcctgatttcagattttagtaggagtggactggtaccactaaaaatgcgcaggtcgtcgactggctgtcttgcggctgg

SEQ ID NO: 46393 - DNA, 7703 bp, Chlorella protothecoides
  modified_base (170)..(179): a, c, t, g, unknown or other
  modified_base (602)..(611): a, c, t, g, unknown or other
  modified_base (923)..(932): a, c, t, g, unknown or other
  modified_base (1819)..(1828): a, c, t, g, unknown or other
  modified_base (2040)..(2049): a, c, t, g, unknown or other
  modified_base (2347)..(2356): a, c, t, g, unknown or other
  modified_base (2849)..(2858): a, c, t, g, unknown or other
  modified_base (3149)..(3158): a, c, t, g, unknown or other
  modified_base (3445)..(3454): a, c, t, g, unknown or other
  modified_base (5979)..(5988): a, c, t, g, unknown or other
  modified_base (6548)..(6557): a, c, t, g, unknown or other
  modified_base (6835)..(6844): a, c, t, g, unknown or other
  modified_base (7357)..(7366): a, c, t, g, unknown or other
  modified_base (7619)..(7628): a, c, t, g, unknown or other
cggggctggcccgggagtcggagcggtggcgcgcccccgcgccgcccccgcgcgacgcggcaggcggcggcgccgtggcgcacgcggtggatgcggggtttgcaccgcctcgcccgctcctggtatgatggtgcaccctgagaaggtcggcccttgcggcggcgcggctnnnnnnnnnncggtggacgcggggctcgcaccgcctcgcccgctcctggcgtgacggtgcaccccgagaaggtcggcccttgcggcggcgcggctcgcgcgttatttgggatggaccgcatcgtgtgaggtcctttggcacccgcacccacatgggctgcttgctggatttccatccccggtgttcatcaggccagttgcagcgacgacacccaagtgtgagggacgcattgcgcctcctgtcgtcggcccctttcccccacactacccttgagactccccttcactcaccaacacagttgcaactttttgcctcgcccatgctcaggggcccccaccttgcaaggagcccctcccctttgcacaaactgctccccaacgatagcgccatccacaaatgaacattgtctcatgatgtgctgtgccccgccccnnnnnnnnnntgatagcgccatcaataaacgaatattgtctcatgatgtgctgtgccccgccccatgtttctctgagggcacatcatgcgcgggccgaaccccgtcgcccgccctcaattttgtacttgtccccgacccttgttccaacctgcactgccaccccacgcctgctcatgtctgctgccttgtgacatgacatgacggacagatttgcagtttgtgcgagaaggggtgggagatgatcctcgggaatctaaagagggaggagtacagcctcccaagccgccctcgggtcaccccacccatcccaggatggaggcnnnnnnnnnnttttgtctgagggcacatcatgcgcgggccaaaccccgtcgcccgccttcggttttgtacttgtccccggtccttgttccaacccgcactgccaccccatgcctgctcgtgtctgctgccgtatgatatggcatgacgcacagatttgcagttggtgcgagatggggtgggggatgatcctcgggagtctgaagagggaggagtacagcctcccgagccgccctggggtcaccccacccatcccaggatggaggcgcactcgaacaggcccaccaccacctccaccacgatgagccagatgacgatccactccaggcgcgcgccgtggccgttgttctgatggtcccgcagcatgtccagcatctcctgcagcacctggaagcgcgcgttcagcacctccacccgcgcgtcgtactcgacgtagtcgcacacgcgcttgtacagcgactgcatggcatcgggcgcggaccagaagaactcgggcgtgtccaagacggtggacagcaggttgaccgcgctcttctgcaggaacacgcggccaatgagctgtgcgatctcgcgccggcccagccgcaccgaccccgtggtggcaaggatgacgggcagctcgcgggtggactccacgatctccaccacccgctcctcgtacacggtgagcttggtggactgcgccagcgcgtggctgatggacagcttcagcaggtggtctttggccaggcggtagttgactgcggggttgtgtgtgtgtgggggaggggggtagtgttggggtgctgagggcagttgaattgagcaagggaagggggcgaggggtattgtgtgtggggtgaggtacagaagaagagcaggttgagactgaggaggaggtgatggtgcggatgggaggnnnnnnnnnnagcgaggggtgttgtgtgtggggtggggtacagaagaagagcaggttgagcttgaggaggaggtgatggtgcggatgggaggcgagacaaacagcttcagaaatggggaggcggtccgaatcagagaacctgggcacccagcaacagagaaacatgcccagcccacgctcaccacccccatcacccactcactcgtgaaggtgtcgttctgnnnnnnnnnngtggggaggcggtccgaatcagagatcctgggcacccagcagcacggaaacatacccaccccacggtcaccaccccaaccacccactcactcgtgaaggtgtcgttctggatgtggggcttctcgtgcacggtgtaatgaaagttgaactcatcaacctcgatctgggtggagggatggggggagagacagtaggacagtgtgacaacacttgagagattccctctacagccacacggtgccgctcttcaataagaaaatccaagctgaaacccacctcctgggtggacagggggtcnnnnnnnnnncacctcgatctgggtggagggatgggaggagcgacagtaggacagtgtgacaacacctgagaggttccctctaaagccacacggtgccgctcttccataagaaaatccaagccgaaacccacctcctgggtggacagggggtcgaccagggctggcccggccaagctccgaatcacatccctctccgcagcctgggacaggccccagcagacgatgacgccgtagtcaaagtagaagacgtcgcccgtcaccagttcgtcgccctttgtgattcggcggggtggaggtactgggtgagtttccaagagacagtgggtcggagcaagaatgactaaacctggcccacacatgccaatggccccctgcctcccagccatgcagaccaccagatgcaggaaagccatagctcaatacaagccaggaggtgatgcttccataatcacgatccacatgccggcccacccctcacctcatagtcctcatactggccatnnnnnnnnnnaggaaccgatgcctccatcatcacgatccccatgccggccgaaccctcacctcatagtcctcatactggccatataagacgtctggaaaggtgtgcagcagagccacacccccacgctccctcagccgcagctccagcgatttcctgtccagggactcggcaatacagtagatggtgatgcgtcctcgcatgcctggccgcccatccacgtcgggcagatcctgcgcgcagattaaaagagggtgggtttggggaggctagccgcagggtcgaaggggagcttgcatgtcnnnnnnnnnnacaaaaaagggtgggtttggggaggctggccgcagggtcgaaggggagcttgcatgtcggcgagagggcacaggttctgtacaaagagctgtacgggcaggttgaaagcaacatgtcaacgtgatctacagcactcgacaacctgtcccacagaagaggctggagctcattacggctggctcctggcccccagcgccacttcgggcctccacagtctctcccgctcacctcaaaaatggttgggtgctcggcaggaaggctccgcgacaggtcatcaggtgtttgcnnnnnnnnnntgcacaggttctgtgaaaagagctgtgcgggcaggttgaaagcaacatgtcaaagtgatctacagcactcgacaacctgtctcaaagaagaggctggagctcattatggctggctcctggcccccagcgccactgctggcctccacagcctctcccgctcacctcaaaaatggtggggtgctcggcaggtaggctccgcgacaggtcatcaggtgtttgcagctcctctggcagagagatgaagcgctctctactccgcccagggggtgccggctactcatggatcagaggggtggggacaagggggggtaggttaaccctggttcactccaccctgccttggcatccttggtctctgatccccttgccgcctacacgtacctggccaggcgcgatgggttttatggacccaacatttgcgagcctctgtggccgacggggctccgccccggatgcagctggctggggtggcgctgggcgtctatttagggcaggggcagccgcagcccctggacggtccagaggagatgcagggcgattcgggatgggctgataccccaacgccggtgcgttctttttcatcgaggctccagctcgtgcagggagcctagggtgtgcttctcgggaagagcagtggtgcgagaaccgatctcgaaggagtcctccaaatgcttcaagtaatatgtatgacgcgatctttcatcagcaggttgcaaggtatgcgtttcggggtttgcacgcagcccactgctatattctgcttaaagacatgttggggttttggcccagcacgcccggctcggattcatattgagccgttcgacccggggcacgctacaatctacgagacagctgcacctccgggctccttttccccgagctcgacatcgcccagcgacacgatccctgctgcgcatcgagggatgcaaaaactactcgagcgctcgggaacacaaccacgttgcgatggagcatcctgaccaggaatccgtcgaccccaacgaggcgggacggccccgccccgctgctgcaaaacggagaatgtctgccatcgatggcacccccacccgtctccagcccaagcgcaaggcgaaagacagacggcgcgtcagcttcgccccctccctgacctctgtccaattcttcaacaaggtgcgggcgggcagtcagattttcgaacctccaccgccacctccgccagatgcgacagcgttgacatcaaattgccccctggcttccgaaatgacctcaaatccaccaccacaggatgaggacaacagcggcgagctcgcccccggccggagcaggtttggggtgccagacatcccgcagggtccctgggaggaccaggagccctccgccacggtgactgcggaggtcccgcccccgagccccatggacgtcagcatggagctgacagagccctggcagagggagacacagcccgcagatgaggtgacggcgagcgtgccctctctgggcgatctgctctcctccgagccggatgccacggagagcatcaccgccgccgtcccgggcctgtcctccctcgtcgatgagtcccgcgaggaggtcgcgctgacccaagccccggaagctgggccggtgcccgacggcgcagacatggatgtcacgctgctcgacggtgagcttgcgggctgccggcgggcaggggggatctttgcagggttggaccttctggtgggtgcaccagcgtgcctacatcaccatcttgtgcaccctgcctgcaactgtcgagacttggggatgcgccccctgctcttgacgggatcccattgccccttcccaggcctggcaggcggatccggggcccagggccaggaagaggagagcgtgcagccctctcccggcctgagcgaggatgggaacgagcagggccccgccctggcctccaagtggggcttcaaccctgggtgcgaggacaccatggatctcaacctggagctgcatgggcgcatgatcatgggcgaccacacctacggccgcctctacggcgacgtcacggggagcgccgccagcctggaagagggggaggccggggcagaggaggaggatggcgaggaggaggaagagcggctcggcgagcaggacggcggggcaaggctcggtgagcagggcggcctctcaccggagcggaacactggactgccggccccggatcgtgacctcgatgccggcgccgggcgggcagaggaaagtgatctggacagcatcgagcctgcatgctccccgcccccggagcacccccggtccctggaggtctccccgaccgccgaggagcgcagggcccttgggcccatgcaggacgaccaggtgcccgccagcgagcccgtgtggacggccccggccttcctgccgccctacatgatggcctccggctcccaggtgcggaggacaggtggcatgcaggcgctgggactggtgtggaaatgtggttggggcacatcgcactcctcctccgacgtgcacccatgactgactcacactttgcccgattcacacannnnnnnnnngctgggactggtgtggaaatctggttggggcacatcgcattcctcctccgatgtgcacccaggactgactcacactttgcccgattcacacacaggaaggagagcgtgcgcaggctcacccggccctggtgaccagccccgagctgactgggagcacgctgcagtcactggacacgcggcgcagctccctggcgggacagcgccgcctgagcatcacctcgcgcaggaccagcgtggggcaggtgagcgggccaggtgtggagggcggggctttgctattctcacagggaagggaggagttgttgggttgttcctttggagtatgaaaggccagtgaggaccagggacgtggtgatggagaggctttggtgcgtgcaggatcactgacccgctctgacctctgcaaccctcctccccccccacacacacaaagggcgacatgaccggggcgctgctgctcgacgacgagaccgccgacggcgggcgggacgacacgtcccgtagtctgtcgcacgctgcgctgcggcgccgcagcgatgcctccggtgcgcgtgagaggnnnnnnnnnngctgacccgctctgacctctgccaccctcctcccccccaaagggcgacatgaccggggcgctgctgcttgacgacgagaccgccaacggcgggcgggacgacacgtcccgtagcctgtcgcacgctgcgctgcggcgacgcagcgatgcctccggtgcgcgtgagagggcgggctgaggggaagggggggctgttcctgtcgaggggttgcaggcctgtgcatgcatggcaccgggcggggcatccaccgcccagccgccgcagccacccgaccccgnnnnnnnnnngggggtggcaggcctgtgcatgcatggcgccgggcggggcatccgccgcccagccgccgcagccacccgaccccggggcacctcacacggacccgagcctccctcccaccctccacagccctggcgcgagagatgactgaaggtctgctggcggatgacgcgctttccagcccggggccggcggccgacctggcggggctgaacgaccgcctggcccggctggcccgcgctccccgggacgcgagtggcgttggagcaccggaggccgcggtcgggggcttcgcctccccgctgcccggtgtgaggggcggtgacgaggacgcgcgggggccggtgtccgacagcccgggggcgtcggccggcttgtccccgggcgtcgccacggccacggccgcgctgctccaggcgggggggaccacgcgcctgctgctgggagcggtgaccccggggagggggctccacgcccccggcaccgggaccgccggcctgggcgccacggcggccctgctgcgnnnnnnnnnncaaccccggggagggggctccccgcccccggcaccgggaccgacggcctgggcgccacggcggccctgctgcgggacgactctgctgccttgctgcgggacgactctgctgccctgctggacgaccaggagcccagcctgtccggcttcgacccccccccagacctgccccccggctcggtcacacgccactggcaggccgcgcgcggcctggagtccgcggggcgaggcgcggtgccgggcagcgaggcgcnnnnnnnnnncggtcacgcgccactggcaggccgcgcgcggcctggaggccgcgaggcgaggcgcggtgccgggcagcgaggcgc

SEQ ID NO: 46394 - DNA, 76 bp, Chlorella protothecoides
tgccgtctgcatgctgtggcacactggccagctggctcggccctgccgtcaacacctcgaccccacagtccctccc

SEQ ID NO: 46395 - DNA, 17834 bp, Chlorella protothecoides
  modified_base (1087)..(1096): a, c, t, g, unknown or other
  modified_base (1537)..(1546): a, c, t, g, unknown or other
  modified_base (2511)..(2520): a, c, t, g, unknown or other
  modified_base (3557)..(3566): a, c, t, g, unknown or other
  modified_base (3845)..(3854): a, c, t, g, unknown or other
  modified_base (4346)..(4355): a, c, t, g, unknown or other
  modified_base (4724)..(4733): a, c, t, g, unknown or other
  modified_base (4879)..(4888): a, c, t, g, unknown or other
  modified_base (4953)..(4962): a, c, t, g, unknown or other
  modified_base (5779)..(5788): a, c, t, g, unknown or other
  modified_base (7827)..(7836): a, c, t, g, unknown or other
  modified_base (8442)..(8451): a, c, t, g, unknown or other
  modified_base (9179)..(9188): a, c, t, g, unknown or other
  modified_base (9642)..(9651): a, c, t, g, unknown or other
  modified_base (9874)..(9883): a, c, t, g, unknown or other
  modified_base (9953)..(9962): a, c, t, g, unknown or other
  modified_base (10572)..(10605): a, c, t, g, unknown or other
  modified_base (10700)..(10709): a, c, t, g, unknown or other
  modified_base (10897)..(10949): a, c, t, g, unknown or other
  modified_base (11827)..(11836): a, c, t, g, unknown or other
  modified_base (12340)..(12349): a, c, t, g, unknown or other
  modified_base (13284)..(13293): a, c, t, g, unknown or other
  modified_base (13473)..(13482): a, c, t, g, unknown or other
  modified_base (13942)..(13951): a, c, t, g, unknown or other
  modified_base (14298)..(14307): a, c, t, g, unknown or other
  modified_base (14376)..(14385): a, c, t, g, unknown or other
  modified_base (14508)..(14517): a, c, t, g, unknown or other
  modified_base (14934)..(14943): a, c, t, g, unknown or other
  modified_base (15879)..(15888): a, c, t, g, unknown or other
  modified_base (16476)..(16485): a, c, t, g, unknown or other
  modified_base (17146)..(17155): a, c, t, g, unknown or other
  modified_base (17371)..(17464): a, c, t, g, unknown or other
gaaggtggtggagtcgggtatgggagggagccagtgagcacccccctcatctgattgccgcctgcaagtcctgcctttccccccatcagctacccgccagcgcacagaacgtcagatgcagcagcgccgtcttcgggtaacccgtctgcacagttcctcgcaccctccctcgcacctccagcatgcttgaagatgaccatggacccgtgctggttgcaggtctgctccatgggggtgagcgccgagggcgggatgctgcgagacaccgccagcagcttctgctcgtcgatgaaggggatgaggacgacgccctcccactccgcctctgtggaagggcccgagggatatttgaggtgaggccatgggcctgttcagccagtgcaccgagcgaccgtacccagtcatgactctggggttgggaggcctgtgccgccaggccagcctcgcagcacagcgctcactcatccagtggccctcctaccggcagcctaggacgcggcacacctgcgcccccactcccttccctcgactccctgcactctctgcccgagccccgctcactcttgccctctaggtccaccacaaaatctttggggtagaagaagttgatgggcgagtctgggtccagcatgaatctctgcaatgtgagtgggggaggtagctgagttgcgtggccatgtgcccgagtgcccagaggagccatccctgcccgcctgcctggtctctgacagcagagtaagggcaaccccgcgcaggcatagccagaggattgacgcctctgtcccacaagcggtggaagcacgcggtcctcccgtccacccaacccctgccctgcctcccaacacatgtcgacctggtagggggcggggagcagctggcaggaagctgccggctgcaccgccagcagctgttcgtagggtaggaacggctcgccgtgggtgaagctgatgcgcacctgctccagatccacctgcgtgcggggggcgtccttgcgagtgttcggcagggctgagaacgtcggagcaccgcttgcttgccctggctcggccaggcacacaggctccttcactccccccactggggctgnnnnnnnnnnagggggccgtacttgcgagggttcagcagggctgagaacgttggggcaccgcttgcttgccctggctcagccaggcacgcaggctccttcactccccccactggggctgcgccgatgtgctgccctcctcatgctgcaatcaacatggcacacaggtggacaaatgcctcctcgcccaccgcgcaaccccaacactcgagcagctggcctgcacgccccgagtccagcgccctcccggacccctcccgtgtcgaatgaggcaagcaccagccatgagcactccacctccacccactcatgggaaagaacaaccatgaagcccccctccacacccctccaagcccgcccaatcctcaccagtggccccttccactctcttgcatcccattgtcccccccccgccctcaaacctccccccgctcaccagatcggaggccatgnnnnnnnnnnccccactcatgggaaaggacaaccatgaagcacccctccacagccccccaagccctcgcaatcctcaccagtggccctttccactcccttacatcccactgtccccccccgcacaaactccccccgctcaccagatcggaggccatgggtgcgtagtggtaagggtagtaccaattccaggaggccacgccgcggtagtagtactccagcacccagtgcaggccgtgcatgtaagcatccaccaccgcccaccgcgccgcggggtccgtgcccacgcccagcttggtgacatagagccgctccttccacgccagcgcggcctcctccgcgctggcgctcttcaggaacaggtcccgcgcttcctgactcatcatcgtgggcttggcagggggccgcggggtggggtgggggatggccgcctccccggcgccaggggcgggctccggcgcgggctccgcgtccgccgcgggcggcgcggggaggggggccaggatcacctcctcctccacctcctcctcctccagcccctccaccgcagccagcagctccaggccacgcccaggggccagcgccgcgaaacggccgccgtggcccaggccgagctcgggcacttcgtccccggccgggggggcattgggaccggcggcgcgctcctcccgccgccggtccgccacgcgctccgaggcccaggcgggagtctcgccgggccccttcttccgcttcttgtcgtcgaggctctgtgcttcctgtgatgcagcaggcaggtggggggtgcactgataactggtatggtcgctggaaggggatgggggcaggagagcgcagcaacgccttcggtcctcgtcgatcgaagggtttgtgggttgagcataatcaagggcgactcaagtgtaaaggggctcctcccacgtaggaacagctacgaccggcatgtgcctccccttccacctcgcttgccccaggcnnnnnnnnnnatccaggctctgtgcttcctgtgatacagcaggcgggtggggggggcactggtaactggtatggtcgctggaaggggatggggccaggagagcgcagcagtgcctttggtcctcgtcgatcgaagaatttgtgggttgagcacaatcaagggcgactccagtgtaaagaggctcctcccacgtaggcacaactacgactggcatgggcctccccttccacctcgcttgccccaggcagcgcggcctcactactcacaagtgcgcgctcctgcaggaccttggcctccaggttggcgagcttgtgcaggaacacctccagcctgcccctgtgcagcttcccggcatgggtcaggtacccacccaactcaggcaggagctccttgtacaggtcaaacatggtttccagggagcctgtgcggattgggtggcaggatttgggggtgtgatcagcgagtgggaggatcctgccactctgcatggaacgtttgcagcacagatggtgccccgtaacatgcacagcggagtgcacatggagcaggtggctcatttggaaacaaggcgagaacccacgagggggcacacgatgtcgcagagaataggagtgttacagcctacgcaggccacgtatcaaacagtacgatatttcagtggcacccagcagccacacactccattaccttctgctatgtcgacggtgggcagggggggcaggaaatcgttcccgatcagcatgcagaagagcacaaagtcgtccacgacccgctcgacgctgaatgggaagggcatcttctgcgcaggcttaaactccagctcaaagtattcgcgaaggagcctgtaggaggaaagaaggtatgtcgtgccagggtgagaacaagaaaggtactcgatggggcggttgcccagcgccaggccaacattctgcgtgccgtatgcacagcaccgagcatgggcatggtagcatggcaaatagtcggcgatctctttgccaatgctggactctgcacggccccatcagggttgagggcaagagactcccnnnnnnnnnnggggggcggttgcccggcgccaggcctacattctgcatgccgtatgcacagcaccgagcatgggcatggtagcatggcatatagttgacgatctctttgccattgctgggctctgcacggcccccatcagggttgagggcaagagactcccgtcgccttcaatgtgcccaaccagacacaaagcccagtaccacacagcaataattgcagcccccctgcgcccacaagcacttgacgggaatgggaatgtccttccatgcatcctcctctccctccctnnnnnnnnnngaccacacagcaataattgcagcctccctgcacacacaagcattcgacgggaatgggagggtccttccatgcatcctcctctccctccctccctgtctcacaccagctaacccgatctgcagcaggacaaacgtgctttctcccgggttctccagggcttccctggcgggctggcccttgccgccgcccgtgtagctcaccacctcccgcaggaggcagaagtggggctcgtgggtgaccagggagagcatgatgaggtcggcgtccagcccgtagaggcagtgccgggtgttgggcgggtagccgggcgcctgtttcgcccagcggatgtgctccatgatcttgtgctctccctctcccgggacgtcgtgccctggaaggcagggaggggtgggatgcagcctcgctgctcacagacagcacttcatgcctgtgccgtgccgcccaggccacagccggcgcgccctctcccagcctggcactgccgctgannnnnnnnnnactcacagacagcacttcctgcctgtgccgtgacgcccaggccacagccagcacgccctctcccagcctggcactgccgctgacactgagacaccatgggcccacctgagaagatgatggtgggtcgccgccatgccacgtcctcggcgatcttcttgcggacaaagaagcggaagtgggcgcccagccgcaccatgaaggctgggcggagaggggaggcgattgcgttatgatggtgagcacgaccgggcaatgagtcaggcacagagctgaacaggcctcgggcctggagttttgtaggcccgtgcagcatgcaccacgctggcaaggtagccggccaacttcacatcagactgatggctcatggcnnnnnnnnnnacgtgttgatggtgagcacgaccgggcaatgagtcgggcacagagctggacaggcctcgggcctggagttttgtagggcccgtgcagcgtgcaccacgcgggcaaggtagccggtcaacttcacatcagactgatggctcatggcnnnnnnnnnntgcggcggccttctcagccttctcggcagcggcggcggcttccttggcagccttgaatcgccgcnnnnnnnnnntcgcataaaggtgtgctctgctgccttgccctgtgcgggcctcagcgacgagcgcctcatgcctggaccctcccccaacccgctcccctgtcccctttacgtgtgccgggcgtgatgcagttggagtcaaaaacgggcggcttgctgtcctctgcgacgtcagaggtcttcgcggcggccttctcggccttcttggcagcggcagcggcttccttggcagccttgaatcgccgcgatcgctgctggttcatcttggcacggggcgccacgcctggagggttgaatatcatgtgaatttcaccgtgtgctcaagcattggacatgtgagaggcatttcccctcagggagcctgaggccatgtgccgcatggcgtcacatggcctgatcagtggttgcagggcaaggaccccttggggaacaacctccctccctcgaaaactttccctcccgacacctcaccatcgatagccatgaacagcagcttctggggtttgacgatgtggaaaatcttgtcaaggtacgtgaagatgcgcaggatcatttcgtcctctgtcagtctgacgtccgggttgttcccatgcgtgcagttgtgaatgatgccgttcatgtcaaggtaaaggttgtcgatgatggggaccaccgtggcaccacctggctggtttatcaaggggtaccgctcgctgagccagcggtagaacttggggatgcctgcaggatgtgaaggtgggagggtgggggcaggggtgcaggaatgcctcccacctgccagtccgaacagcgatgcgcacgccggttcccccgaacgcacccattccgnnnnnnnnnnggcaggactgcctcccacctgccagtccaaacagcgatgcgtacgccggttcccccgaacgcacccattccgatggaatcctgtgcagtcgaatgccgtggtgcaccgaagtgatggccggtggcctgccgatcccgcggccgttgggagggaaggttttgccctgcggcccctcaaacctgctgggcgttccttcccacgatggacagctctggttgtccttgttgtgacaaaagtatgttgcaggaacacagtatatgtcttgggatccgatcgtgtgtgcactgttgatcgctgtgcctttccgggtcactgagtctgtgatccgagccagcgggatgtcttgcaatgggcaggcctcgtagttgtactgctcttcacattaccttcctgcttcctcggggatgttacattacagagaggatacatgaagacagcaccaaaaaaatcccgactggaaggctggcaaagtacagagggctccgccgctgtaccttggaaaaccaggaaaattccaacaggtggggtcgactggcagaatgtcgcccgggtgcgagaaaaattagagggcatgtgtcaggcgggcgcctgaaaattgacacatgggagagtgctgttagtgtcattaaaaatcgttggcaggagcggctgccgagcaaaggcaccgtccaggtttgagctggcagtattggagccaggccttgtggagagagatggagcatggggatgctgctggagagcagacccagcatctgttcgcagaaaggaggcgatggcggggcgggcggcgacgcagcctcggctgcccaggcgcccgcctcactgggccttggcaaagggtgtgtagtatttgaggtcggccagcagcccctgagtgaaccagccgcgcggcaccatggtgtcatcagggtggtaccacgacagccgcgctttcttcctggtggccttgtcgtccacgaaggtggcgcggatgcgctcgttgttggccgcccagcgcgtgatggggaggaggtgcggtaccgcaggtaccatgacctccgcggcctccgccgccagccggagttgagtggccgacatgcgttgctgctctcgcatggcctgcaggatgggtagtgggacaggtgtcttcttaatcaggccggctacggtgtactttgagcacaagtgaaaacgcagggctagtcttagtcaggcaccctctattgcatcagtgccagccgacagcagaaaatcccacacagattcacaggtccatgaaacacaggccaggcatacacacagaagcctttttcacacaacatctcaagcccacctcaacgcttggcatcatcatctccccaagcttgtcggccagaccgcggaacgggactccctgcaaagagtaagattgtctgcagttcaaccggcagacatcacacagcgggtgcaagggcatccgaatgttcaatcatcctgccaccacggacacaagtaaaaccatcactgccacaaattacgagctgtacctcaacactgctccgccaacacacctcaaatggatcgcgaacagccgttgggtcagctgactgtgaggagagggcgggctgctgctgcattgcgggcctctcccgtgcattgtcggtggggatgttcagggcagctccaatgtgcagcacgtagctctgcggtaggcgggcgggtgacccttctgagcttcacatccggatgcaacacgatgccgtagataagacggatcggacgaccccaactgttccccggatactcaatctccgacacccagcatgggaggcccgggataccggggcgccctgaagccacctctagaccatttaaatgcccaccttgttcactgcgcgcttcgagggttcgttttcgaacgcaagagctgcactcggagccggtgccgctggctcgggaaccggcagctcgggtttcattctggcccatcgctgcacctcaggagccccctgcgcgaagcgagaccgaatatggcgtttcagatgcaataaaaagctcggaagaggtgctcctgctcaggnnnnnnnnnnatgagaccgaatatggcgtttcagatacaatgaaaagctcggaagaggtgctcctgctcaggagacgccggtcgacacttgcctgcacaatgggcaggagcgataaggcgacgcgtcgtcccgcaatccccgcagacgcgctcttcacagctagggccgacatgatgagaagcaagcgtgaagtttgagtacaatgtgttgtccagtcacggaagtcgaactcgaaccgagcacttctgacgaggacacttgagcggggaccgatcttcccgggagcagattgcatcgaccccgggatccggttttgaacctcactccggtgcctgggaatagtgaggtcctccaccgttcttgggatggctaggcccgagaacttctgctctacatgttaccttacactccaggcaatgtgtgtcatgctggacagcgtgcaagtgaaggccaatcacagcggtgaatcagagctcaccatcccccactgtcatctggccgagcgtcctcttccacattgtcttcgttctcgtccgaatcgtaactgcaagcacagggcgaagaggaggtgttatggagtcttcgtgtttctgcagcggtccattgactctctgnnnnnnnnnnagaagaggaggtgttatgaagatttggtgtttctgcagcggtccattgactctctgcccatcagtgcggggagggcatgagactcactctataaacggcatgatgaagttctccatgttcccgcggttggtcagcacgatctcgaacggccctaattgcaacggcatggatggctccctcccagatcggaagagctgtgggttagggtggggatgggtggcggagagttcgtcagacaggtgcactgggcttgttggccatgcatgggtgaaaatgttggatgccagagcaaccgtgcctggacagacacccaacatgtacaccacttcattcgtgtctttgataggacgtcacagctcgtgattgcacccatgcccggtaccacgatccggctctgcttaactccccccctcccctacattagcccccctctcccctacatcaggggcccccccccttcccttccgaccctccccacacaaaacaacaatccccaaaacccacccctggcgggtacacgatgggcggcttctccactacatccggcatgctgtgcgcgtcaggctggggctcccccgggtactccatgaacagcctctgccggtccgccggccggttctccttgaagaggtagcgccgccccaggcgcgaggtgatgccccggctccacgcccgctccagtcccagggcacgcccagtcacgggcgtcaggcgcgccaccttgcctnnnnnnnnnncccccggctccacgcccgctccagccccagcgcacgcccggtcacgggcgtcaggcgcgccaccttgcctgatccatggcacgtcttgcagggcaccgtcccggccagcaccggcatgcggtggggcagggggtaccggttgaccaacgcctggcgcaggttctcgtacaccttcaccgcagtgctctcgtcattaccgccgccacccatggacagctccggcagcgcgtagccgccgcagaaaacgcagccgtacagcgcgtcgctgctgttggccaccgccagcgtgcgcaccagcagcatgccggggcggcgcagcagtgtggctgtgccgtggcactgtgtgtgtgaggggtgggggggtggggggtaagaggtgggtttgagttgggattctggtgtgtcataaggtggtgatgggcaacacagactcctggtgtgacgccagtctcgnnnnnnnnnncgtggctgtgccgtggcactgtgtgtgtgatgggtgggggggtttgggggtaagaggtgggtttcagttgggattctggtgtgtcgcaaggtggtgatgggcgacacagactcctggtgtgacgccagtctcgggcatggcaggtgtggcgccgggcccctcgaccgccctcgccgttgcacgccgacctcggacaacccccccccccccccccccccccccnnnnnnnnnnaacccagcctgctccaccccatgcagtgtgagacatggaccccaaccccgagccttcatgcagaacaacnnnnnnnnnnggcccagcctgctccaccccatgcggtgtgagacatggacccccaaccccgagccttcatgcagaacaacagcgcgtccaaaccctcgcccacacacgtgggggcaggtgagcaggcccgtgccgcggcagtgctcgcacgtgctgacgaagaaggtggagtatgtctccttcaactggttgatcacgatggcaaaggatgccacctgcgggtgccgaggaggactggtggctccagctcgggatcaatctggccagcaacacagcctccgtccgggtgcagggcacagcgagggcctccagtctccactccccacggcaaagcagtccacccagacgcaccgtgctcaggccgcggaccacatccaggatcggctccgacatggtgtacacccactagtgatgagccgccgtaggttgtagtggtagccctgcacgatacactgggacagcaaagcacaagcttggtgatgcactgtcacgcccgtgtgcttcgtcaccgagctgccagctggtatgtcgggtgatgcaatagtatggatattctatacaagttgcatattgtagtgacggtgagaggtgatccataggcggattcgctcccgtggctnnnnnnnnnnnnnnnnnnnnnnnnnnnnnnnnnncgaagtaccacacgtcgtaacaggcgctggccctgaggaagctcccttggggggacgcttcccatccttgtgtgtgcattgcctcgacgaggtgnnnnnnnnnncggcactgcaaccacgggatcggcaggcaatacatactttcaattcttatttccgcagttttcagatacagactcacctgcaagcctcttggccattactcttactcctctgcgcgcgcttgagggcgcgcgaagcatacctcgcaccaactctcgtcaggatgccgatcccgctgccagaggatccnnnnnnnnnnnnnnnnnnnnnnnnnnnnnnnnnnnnnnnnnnnnnnnnnnnnnaggtcacagggccggcgttccatgcaagccgatgccatgggaacctgcgcgtacggtgacagtgttgcctctgaaagcaccctccagctgtgaagttatctgacctcgctcgcagggcgaggtttccacctccatcgagagcttcccaggcttccggtcagacctatctgtgtgggacttttcctgcgagacctgcagccacacgtaaggggcgcctttcatgggctggagaattcgatcacactcgcgcagggagtccaggctcactgtgtgccctgggcgctctgatcgcgcctgttttctgttccctctttctccgtcctccccaccatctattcgggactccaccttcctgtacggaactcacaggagcaaacaggtgcagtttgtcggccagtacgacccccggggagtaacgtgccgactggaggtggggggccccgctgatctggatcgcatgctgatcaagagcgagaacgccaccatctccatccctgagctggagtttgagattctggggtcaaacactccctgtctgggcttgacggtgcgatgatcctcagggcagcagggtggaggctggtgcgtgcttgactgagtgagtaactcatgactgtgctctgctctgaactgccccgtttcctccttcaaaaccctcttgcagagaggggatgtgtcgtcggtgcgggacgtgctgctcacgtcaatcaccaatctccagatgaatcagcacgagcgtgcaccggagaccgcagaggccatcgagtctttcttgacagtgcgtggggctgtcattggggttttgccaccggcgccttgccttgcagtgggtgggaatggatgtacatggggccctcaactgaccagcaacaagcaannnnnnnnnntgggttttgccaccggcgccttgtcttgcagtgggtgggaatggatgtatgtggggccctcaactgaccagcaacaagcaagagaggggtcgacggcctggagtgactcatcgacagactgcaaggatatggcatatcgtgcaaggtacctccctcccctctctgtgcaggagttgcaaaagctgactgaagggcagcagccgttcaccttggtgatggacgacccctctggcaacagctacatcgagacaactggggatggcgacgccgccctcactgtcgaacagtacgaaaggagcgtgcgtcaggcccttgcgataggcctgcctgtgcaggcggagctggaggaaaacacgctggagagtgtggcggaggaggacgagctggacgattgaagttttggctgagggtgtgactgtgcgtacccacaaggcagacatatctgatgtcagaccctcacccattattccaactcgcataatatttcgttcagacacgtgtctnnnnnnnnnncacctacatgacagacatatctgatgtcagaccctcacccactattccaattcgcataatatttcgttcagacacgtgtctaaggctgcatgcggctcaggcatgtacgcctcggcattgtcacgctcccagcccttgcaaatggaatgattctgggccccattcttcctcctgtcctgctgtgcgtggtttgagtcgagctgcgagcatcgcgtttccgctctctcaagacggcacggggctcgtgcagctctgacaccatcgtagacaacgagtcgcctcagggttgaggcgcagtgcacgtggagcggggtcggtttgtctgcgacacccaccgacatgggcttcttcaccgactacctcacatgtgggtgcacggtgtcacatctgtgtgcctatataccaactgcgagctcgagggtatattttgtatcgttcttgagttggtgacccaactccccatcttcccactcggcacagcggtcatccagcggaggatggaggaccccaaggagcggagggcccgagccgaggcccgcctgcgccacgccaaggcagctgctgacgctacgtgagctcgcctgttgagtgatgagattgtcgctggtgcctcggataagctcctgaacaaacatgagcaagtctgggacccctcctccacacacaggaagaggaacctagagtaccctaccaaaaactggggcttctggcggtcagataagatgtctgcccacgtgagtgtttgcgcatgggcccagagtggtgacctgggagttgtagcagcttggttgacttgggtcgtcgccctgatgaggataccttggcaatgacgctggggggtgcttctcagggctcaaatgtaccatcagagacacgcctcgcctacaaccccccatgccctggcccctgcagtacgagaccaacgccaacccagnnnnnnnnnncaccaacccccccatgccctggtccctgcagtacgagaccaacgccaacccagctgtcaagcgcatgctcggcagggccgtgcccgaggtctgaacaccgtcgggcaatgcagtgtgcttgcctgcccactgttgtgacaatcaagccggcccaccctccctcacacctgggtccggcannnnnnnnnnctcgggcaatgcagtgtgcttgcccgccaactcttgtgacaatcaagcctgcccaccctccctcacacctgggtccggcaagtattacaagtgtgcagctggatgacaatgaggggcctgggtgtctggtctgattgcaggattgccgggcacccaccaaagcacacaccccggaggcagttcacattgccgcgagctcggcgagggcgccccggctgccgcagggcttgctcatgaggtatcgcgggtccacgccgatgagccgcaccatgccggaatcctgggacactgtctcgtacccggcgcggctgtacatgcgcacccccaccgcatcgtccaccctgcgagcagaccgtgggaggcagggggccggctgtgggcgcagaggccgtgctggccccgctctgcacatggccggtgttaggggcaatacggccaaccgtgttgcagccctgccatnnnnnnnnnntgcagagggcatgctggccccgtgctgcacatgggcggtcttaggggttatacggccaaccgtgttgcagccctgccatgcctacaggggaataccatcccctgatcagctccaagcccgcagcacctggaatggaggtagacatgggtgtggcccattgtctgggccagctcctccgccgaagacaggaggaagctgccgatgccctgcctccgcatggtctggctgacggccatgttggacaggtaggcgtgctcctgcgtcggcagtggggacacatggggaggtcgagctgtgcacagagaaatttcaagtgcctggggtttggcaaagccaaggcatggtcnnnnnnnnnnctgcggaggtcgagctgtgcacagaccaatttcaagtacctggggtttggcaaagccaaggcatggtcnnnnnnnnnnactcgggttcatggtcgagatgttcctcctccccctcggcatctcctgagccctccacagcaagctccgcgccctgctcatcacccaccctgaaggctgccaggatgaccgtcttgggcagcnnnnnnnnnntccctcaactcaagacccgccagcaagcaccctgcaccaccgcccctccacttaccgggggagggttcagcgttagtgctttggtccgagtggaggccgaaaaggacagctccacgatgccgacgagctcgcgctcgggttcatggtcgagatgtacctcctccccctcggcatctcctgggccctccacagcaagctccgtgccctgctcatcacccaccctaaaggctgccaggatgaccgtcttgggcagcagcgggaggtgctggcgcaggtactgccttatctgggactgcaggtaggacctgcacgcaccaatggacggggagaggaggtcttcacaaactgattgaaatgcaacgcttcatgccaccacaaggggtgatagtcagggactgcacatgctcgttgcagtcnnnnnnnnnngtcgaaatgcaacggttcatgccaccacaaggggtgacagtcagggactgcacatgctcgttgcagtctccaccccccgctcgcactccccaagcccacctgtacatcgatatgtagcccagggactcggcaaagctgtcgttcagcagggtggctgcatcctccaggcggtccttgggcaggggaagcaccaggaggccatccccgcaggccagggtaccctgccgctggaaggtggccgcacgctgggctgcgctgttctgcgacgagcaggaacgggggcgcttgaggggcgaggggggatgcgcaggaggggaggcccatctcaccgctgatacttacctcgccaacgtcccagctcacctgcaccacgaagggctctaatttcggtccaggggcacttgtgtcctggcgcagagcgcgatacctcggggcggaggcgccccgcctccagacattggcaaagcgtggcatggcatgggcccggccatgcccaggtcgtgcacagccatgtcgcacgaacgattggccatggcggggatccgtcgccccatgcacgggaccatggacatgttgtagctctaacatgtctgtagggtcgctacatgcagggcaccatgggtgtcgcggaaagggctagtcacggtaggtttgctggcagccgtgaccccaagtggcaccccggcttcagtcccgacccctcttctgatgagtgagtgtgaacatgaacacctggaacaacaccgggcgggggcaattgcgctgtcatggctggcgtcgggccttcctcatgacctcgcatgatcgggggcgcgcgtctgtcggaactacattgggtggtgaggatcctcttccgccttggccaccgccccttccccggcgccaggaccccggatcccacgtaccccggcgcatctgaactccctgagctccctnnnnnnnnnntcaccgccccttcaccggcgccaggaccccggatcccacgtatcccggcgcatctgaactccctgagctccctggattcatacatgctggcctgttcaagcctccactcacgcccagcccctccatcgcaggaaaatggcgaggaggaggagcgcgatggcgaagacgagcgccgcttggctgcgcagcagggcccagcaccgctttgccacggccgcgcaacggagcaggatgctgctggcgcgggcaatgcgctccagcgtcttctcgctcacattacccagcctgtgtaccatctgttggcgaggggcaggggggttaaggggtcggatgagattgatttgtgcgaggctgtagcattatcagcaggtaaatctgatggcaatggacccaagcagggagaatcagccagtgccgtttgacccaggctgccacagacaccaggtctggacaggcacctcaaagctgagaacgtgttcgtcgacgtatgtgccgggttcgactcctcattcctccacctccccatccctcatgcatactcctcggccatacccagcgccaacgacacacccaccccacctcggggcnnnnnnnnnnaggcacctcagagttgagaacgtgttcgtcgacatatgtgccgggttcgactcctcattcctccatctccccatccctcatgcacattcctcggccacacccagtgccaacgacacacccaccccacctcggggctgatgttgacccccgcctgccgcccgatctgctgcagcgtctcgggcggcatggccttgagcatcttctgcatggtcttcagcgtggctgggtccgtcagcttgctgaccatgtcccccgacagcagcgacgcggggtcaaaggcctgtgcgcccgccccaccattcgccgcgccgcctggcgtgggagggccgcccgcgccgccgggacatgcgccgccccccatcaagctcatcatgcttgccatgtcctccgcgctcatgctctccatcatccccgccactgcgtcgatcgtagaggcatccagctggcagcgtggcaagaggggcgtgagggaagaggggttggaaagtggaggaagggaggtgaggaggcgggcatggggactgcgccatgctgcccggcgatcctcttggtgagggcagcagcgacgcgcacagcaacgaccacgcactgctgtcactgccagccacctggatgtgcacctgggtcccggggggcaggcccccgctgccggccatgctcnnnnnnnnnnggaaacgaccgcacactgctgtcactgacggccacctgaatgtgcacctgggtcccagggggcaggcccccgctgccggccatgctctgcagcaggctggggtccatggagcgcagcatgctcgccatggcgcgggggtcctggggcgggcccggcagtccagcggaccccgctgcgccgtctgaccgcgcggcgggcgctgccgctgcggacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctgcgtggaggcgggttgcatgggagtgaggcgttggggcgtgggcgcggcacccctgcgctggactgggttccatcctccggtgcccgccacacggcggcgcaggggcgcacacccctcgaagcggtagcaatacctcccacgctctgtcccatgagcgcccagtgtccgcccgtgaggccccacctgagttggtcggggctcatgccctgcaccatgcccgccgcggcgcgggccatcgctggggtcatgcccggcggcgcccccccggccgccagctgcgccgccagctcctcgtccgacagctcgcccacggccctgagcgcgtgctgcacggcgtcggggtcctggccgaggcgggccgcca

SEQ ID NO: 46396 - DNA, 86 bp, Chlorella protothecoides
tctgcaggcgcggcgtcgatcctcagctgcggactgcgtgtcgggtcactatctcttctccagtccttggcggctgcatggcacct

SEQ ID NO: 46397 - DNA, 32557 bp, Chlorella protothecoides
  modified_base (151)..(160): a, c, t, g, unknown or other
  modified_base (352)..(361): a, c, t, g, unknown or other
  modified_base (1215)..(1224): a, c, t, g, unknown or other
  modified_base (1957)..(1966): a, c, t, g, unknown or other
  modified_base (2155)..(2164): a, c, t, g, unknown or other
  modified_base (2672)..(2681): a, c, t, g, unknown or other
  modified_base (6088)..(6097): a, c, t, g, unknown or other
  modified_base (7422)..(7431): a, c, t, g, unknown or other
  modified_base (8214)..(8223): a, c, t, g, unknown or other
  modified_base (8882)..(8891): a, c, t, g, unknown or other
  modified_base (9785)..(9794): a, c, t, g, unknown or other
  modified_base (10136)..(10145): a, c, t, g, unknown or other
  modified_base (10336)..(10345): a, c, t, g, unknown or other
  modified_base (10552)..(10561): a, c, t, g, unknown or other
  modified_base (10922)..(10931): a, c, t, g, unknown or other
  modified_base (11358)..(11367): a, c, t, g, unknown or other
  modified_base (11728)..(11737): a, c, t, g, unknown or other
  modified_base (12066)..(12075): a, c, t, g, unknown or other
  modified_base (12678)..(12687): a, c, t, g, unknown or other
  modified_base (13117)..(13126): a, c, t, g, unknown or other
  modified_base (14288)..(14297): a, c, t, g, unknown or other
  modified_base (15002)..(15011): a, c, t, g, unknown or other
  modified_base (16633)..(16642): a, c, t, g, unknown or other
  modified_base (16916)..(16925): a, c, t, g, unknown or other
  modified_base (18063)..(18072): a, c, t, g, unknown or other
  modified_base (18552)..(18561): a, c, t, g, unknown or other
  modified_base (18900)..(18909): a, c, t, g, unknown or other
  modified_base (19245)..(19254): a, c, t, g, unknown or other
  modified_base (19862)..(19871): a, c, t, g, unknown or other
  modified_base (21297)..(21306): a, c, t, g, unknown or other
  modified_base (21936)..(21945): a, c, t, g, unknown or other
  modified_base (22433)..(22442): a, c, t, g, unknown or other
  modified_base (22735)..(22744): a, c, t, g, unknown or other
  modified_base (23040)..(23049): a, c, t, g, unknown or other
  modified_base (23361)..(23370): a, c, t, g, unknown or other
  modified_base (24390)..(24399): a, c, t, g, unknown or other
  modified_base (25142)..(25151): a, c, t, g, unknown or other
  modified_base (25481)..(25490): a, c, t, g, unknown or other
  modified_base (26228)..(26237): a, c, t, g, unknown or other
  modified_base (26406)..(26415): a, c, t, g, unknown or other
  modified_base (27772)..(27781): a, c, t, g, unknown or other
  modified_base (28289)..(28298): a, c, t, g, unknown or other
  modified_base (28947)..(28956): a, c, t, g, unknown or other
  modified_base (29874)..(29883): a, c, t, g, unknown or other
  modified_base (31253)..(31262): a, c, t, g, unknown or other
gcgcgccacgcgcgccacaccgcgcgagcgtcaggaggccgcgcaacgcgcgctgcgcgaggaggcgcgccgcctggcgaaatcggggggcgagggtgcgggtggcggggaaggcagcgacgacgacgacctgaatcctggcggcgccggnnnnnnnnnnccaggaggccgcgcaacgcgcgctgcgggaggaggcgcgccgcctggcgaaatccgggggcgagggtggggatggaggggaaggcagcgacggcgacgacgacctgaatcctggcggcgccggccgcgcgggtaccaacggaaagagcggcgcggccgccgcggcgcgcaaggcgctggacctggaggcgcnnnnnnnnnngccggcggaaaggacggtgcggccgcctcggcgcgcaaggcgctggacctggaggcgctggccttccccggcggcggtcggttcaactccgcgcgctccaccacgctgccccctgggtcgtaccgcacggtacagaaggggtacgaggaggtgcacgtgcctgcgcccgcggcgccggccttcgcggagggcgagtcgctgcacgccatctccagcctgcccgcctgggcgcaggacggcttccgcggcatgaaggagctgaaccgcatccagtcgcgcgtgctggacgccgcgctgttcagcggcgagaacatgctggtctgcgcgcccaccggcgcggggaagaccaacgtggccatgctggccatgctgcacgagatcgggctgcaccggcgcccagacggctccatcgacaccgcggccttcaagatgatctacgtcgcgcccatgaaggcgctggtggcggagatggtgggcaactttgccaagcggctggagccctacggcgtgaaggtcaaggagctgacgggggacatgggactgacgggggcggagatcgcagagacccagctcatcgtggtcacgccggagaagtgggacgtggtcacgcgcaacgcgggcgagcgcgcctacacccagctcgtgcgcctggtcatcatcgacgagatccacctgctgcacgacgaccgcgggcccgtgctggagtccatcgtcgccaggaacctgcgccaagtggaggtgctcgatggtgctggcgtcctggctgtcagtgccggcacacctgacatcagggagcacctcatgctgctcccggccaattccctttccacccttttccaccctcctcacccccnnnnnnnnnnttgccggcacacctgacatcagaaagcacctcgtgctgctcccggccgattccccttccaccctcttccacgctcctcacacccccaccccccacccccaccctacacacgcaggccacccagacgcagacgcggctggtgggcctgtcggccacgctgcccaactacgaggacgtggcggccttcctgcgcgtggacccggccaagggtctcttctattttgacaactcgtaccgcccctgccccctggcccagcagtacatcggggtgacggtgaagaagccgttgcagcgcttccaggccatgaacgacatcacgtacaccaaggtgatggaggcggcggggaagcaccaggtcctggtcttcgtgcacagccgcaaggagacggccaagaccgccgcgcacctcaaggaggaggcgctgcgcaacgacacgctggcgcgcctgctgcgcgacgactccgcgtcgcgcgagatcctgcagaccgaggccgcgggggtgaagagcgcggagctgcgcgaactcctgccctacggctttggcatccaccacgccggcatgacccgcgccgaccgcaccctggtggaggacctgtttgccgacggccacatccaggtctgggttgttgggggtgggggtggggtggggggacttgacgccccagaggtgctggggtgagacgggggaggaggggcctgacccgcccaggtgtttcggggccttgcaatgcccnnnnnnnnnngttgacgccccagaggtgcttgggtgagacaggggaggaggggcctgaccagcccaggtgtttcggggccttgcaatgcccaaggggcctgctcgtcgaaccccggttgtttcatccgccccaaaccttcccccctaacactcatccacacacacacaaacacccaggtgctggtctccaccgcgacgnnnnnnnnnnagggcctgctcgtccacccctggttgtttcttccgccccaaatcatccccccaacacctattgacacacacacgaacacccaggtgctggtctccaccgcgacgctggcctggggcgtgaacctgcccgcccacaccgtcatcatcaagggcacccagatctacaatccggccaagggcgcgtgggtggagctgtcgccgctggacgtcatgcagatgttcgggcgcgcagggcggccgcagtacgacacctacggcgagggcatcatcatcacgggacacagcgagctccagttctacctgtcactcttcaacatgcagctgccagtggagagccagtacgtggccaccatccccaacaacctcaacgccgagatcgtgctgagctccgtgacaaacctgaacgaggccgcggcctggctggggtacacgtgagtttgtgtgtttgtgtgtgtgtgggggggaccttttatgggtggggagaggctcttcaaggacccggtgggggnnnnnnnnnngtgtgggggggtgggggggcgtccttttatgggtgggagaggctcttcaaggacccggtgggggtgtgcattcctcccacctcccaccctgtgaccctcagcctcatctcccctccgccatcccccaacatcgccaggtacctgtatgtgcgcatgctgtgcagtcccggggtctatggcgtgccgctggacgcgcaggcctctgatcccaacctgatggagcggcggctggacctggcgcactctgctgccacgctgctggaccgccacaacctgatcaagtacgatcgccgcaccggcaactttcagcccaccgacctgggcaggtgagagggaagggggggattgggagggggggaatgggagggagagtgatgttgtgggtacatatggggaagggctttgtcacaggactgggtttgtcactgcatgagagggtggtgggagggcaggtaggggaggtggtgcgtagtaactcccctgccaaggcctcagccagaagccctcgatgcatcccctttcaccgtctctgacttcctttcctctcccccccccactttatcagaatcgcgtcgcggtactacgtgtcctacaccaccattgccaccttcaatgagcacctgaagcccagcatgaccgagatcgagctgctgcgcctcttcgcggcggccgacgagttcaagtacatggtggtgcggcaggaggagaagctggagctggccaagctgctggaccgcgtgcccatccccatcaaggagggcctggacgagccggcagccaagatcaacgccctgctccaggcccacgtcagccacctggcgttggaggggctggccctgtcggccgacatggtgcaggtggtgggcagcgcggggcggctcatgcgctgcctgtacgaggtgtgcctgcgccgcggctgggcggggctggcgctgaaggcgctgggcctgaccaaggccgtggcggcgcgcatgtggggcagccagaccccgctgcgccagttcaagggggtgcccgccgacatcgtggcgcgcgtggagcgcaaggagctggcctgggagcgctggtacgacctctcctcccaggacattggcgagctgctgcgcctgcccaagatgggcaagtcggtgcaccgcctgatccaccagttcccgcgctacgagctggccgcccaggtgaaccccatcagtcgctccctcctccgcgtcgacctcaccctcaccgccgatttccagtgggacgacgccctgcatggcccctcccagcagctcctgatcctggtggaggactccgactcgggtaacattgggagggggggggaggaggagggatgcgcatgccttcgagcttgttggggcctccccagtgacgctgtcccatcgaggatcgagccagcatgcacctccaatgcctctggctcgcagtccgtaaccctttggaagaagggatgtctggccgtacctgacaccacgtctctcgtccccctcctccattgaccgaccctcaccaaactcatgacccccaaacacgacgacagagcacatcctgcaccacgagatgtttgtgctcaagaaggcggtggcagacgaggaccacctgatcaccttcacgctgcccatctcggagccgctgcccccccagtacttcatccgcgtggtctcggatcgctggctgggttgcgagtccagcctacccgtctccttccgccgcctcatcctgccggccaagtacccgccccccaccgagctgctggacctggcgcccctgccggtgacggccctgcgcgacgccgccgcccaggctgcgctctacccgcgcctcaccgccttcaacccagtgcagacgcagtgcttcgccgcgctgcactccagcgacgacaacgtcctggtcgccgccccggctggctccggcaagacgctgtgcgcggagctggccatcctgcgcatggccgccgtggccgccggcggcggcgacgccgcgccgccggcacgctgcgtctacgtcgcgccgcgggaggacctggtggccgcgcgcctggccgactgggcgccgcgcttcggcgcgctgggcctcagcgtggcgcgcctggtcggcgacggccccgccgacgccaagaccctggagcgcagcaacgtcgtgctggccacgcccgagcactgggacgcgctgtcgcggcgctggcgccagcgccgcgccgtgcaggccgtgtccctgtacgtattcgacgagctgcacctggtgggcggcaccggcgggcccgtgctggaggtggtcgcctcgcgcgcgcggtacgtgggcagcgtcgcgccgcgcgcgccgcgcatcgtggcgctggccgcctcgctggccaacgccggcgacgtcggcgactggctgggcgtgcgccccgcctgcctcttcaactttcccccctccgtcaggccggtcccgctggaggtgcacgtccagggcttcgaagtggccgacctggaggcgcgcatggcggccatggcgcggcccgcctacggcgcgatcgccgcgcatgcgcccggcgccgcgccggccatcgtgtttgtgcccacgcggcgccacgcgcgccgcgtggcgctggacctgctcgcctttgccgccgccgacggccggcccgccgccttcctgcacgccgaccgcgccacgctggcgccgtacctggagcgggtcaaggacgccgctctgcgccacgcgctggagcacggcgtcgcctttgtgcacgaggctcaggccgaggacgaacgcgccgtggcgcagaccctgtttgactccggcgccgtgcaggtgggtttgagtttgttggggggggtgagaaggagggggtgttggagggtgggatggggaggtttagtgagcctgaaaacagcttatcaggagtttttggattgttatcttaaccttgttccggaaagcagggctggggaaagactgtcgcaggtccattcacccacacgcccgcactctattctattccctcaccccccacccccccaccacacacacacgcacgcacacaccaatcgatcacatcaacctctgcagatcctggtggccacggcggcgacggcctggggcctgacctccgtggcgcggctggtggtcatccagggcacgcaggcgtatgatgcctcgggccagggcgcccgcgactatgccgtcaccgacctgctccagatgctgggcagggccagccgcccaggcatcgacgcctccggcatgtgagttggtttgtacaaagggagtggagggtagcggtggtggtttcgaggatgatgtgtgtttgtatgtgtgcgtagacatgcatgttggtttggagcgaaggggtgaattgggagaatgttgagacggagggccgctggcatgacaccagggccagggacggtggtgtggcgcagagnnnnnnnnnntggtggtggtttcgaggatgatgtgcgtgtgtatgttgcgtagacatgcatgtgggtttggagccaaggggtaatttgggagaatgttgagacggagggccgcaggcatgatatcagggccagggacggtggtgtggcgcagagcgcacccacctgattgtttctcgattgagctcgtctcccaaacctcaaacccctccatgccccccttcacacacatccagtgcggtgctgatgtgccacacgccgcgcaaggagtactacaagaagttcctgttcgagccgctgcccgtggactcccacctggacgccgtcctgcacgacaccctggcggcggaggtggtgacccgcacggtgaccaacaagcaggacgcggtggactacctgacctggacgctatactaccggcgcctgggcgccaaccccaattactacggcatgaccgggtccagccaccgccacatcagcgaccacctgtcggacctggtggagcgcgtgctggccgacctggaggcctcgcgcgtgatcgccatcgaggacgacatggacctggagccgctgaacctgggcatgatcgcggcgcactactacgtggcctacaccaccatcgagctgatggcggccagcctgggggccaagaccaagctggcggggctggtggaggtgctggcggccgcctccgagtacgacgacgtgctggtccgccccggggaggagcgcgcgatcgagcggctgctggcacacgcgcccctggcgctggccgcgccgcggtacaccgacccacacacaaaggtggatgcgctgctgcaggcccacgtctcgcgtgcggtgctgggcgccgacctggccgccgacgccgcggccgctgtggccgcggcgccgcgcctgctccaggccatggtggacgtgctgtcctcctccggctggctggcccccgccctggcggccatggaactgggccagatgctgacgcaggcgcgctgggcgcgcgactcgcccctgctccagctcccgcacttcacgccggagctggtggaggccgcaaaggcggccggcgtggagggcgtgttcgacctcatggagatggaggacgcggagcgccgcgcgctgctcaagctggaggagccgcagctggcagaggtggcgcgctggtgcaaccgctacccggacgtcgccgtgtcctacgaggtgacttgttggtggttctggcgggtgggaggtgatggtattcctggacagtgcgtgcagtcctcatccctgcttgccccacactcaagcccatcccgcaacccatccaatgccacacagttggcggagcctgacgnnnnnnnnnnacctacgaggtgacttgttgatggttctggcgggtgggagatgatggtatatcctggacagtgcgtgcagtcctcatctctgcttgccccacactcaagaccatcccgcaacccacccaatgccacacagttggcggagcctgacgcagtccgagcgggagaatccgcgagcctggtggtgtccttggagcgagagggcgagggcgaagtgaccccggtcatcgcaccactgtatgtggatgggttggtgaagggaggggtggtatcgagggtggcctgctcgcttcgcgctgggggtgggcgggggctgctgctgttttggtgcgtggtgatgcttttgcttatgggatccaatgcgtgtatcttgctctacagccgaccagctgtacgagtagaagggcagtatttcagctgaaccctgccactccacccacccatttcccgctgtgactctgacgatgtcccctctgctgcccacattcacaggttcccgggaaagaaggaagaggcatggtggctggtcgtcggcgacacctcttccaacagcctgctggccatcaagcgtgtcgccctccaggtgcccagagagaggggttggtggagtttggagtgccccgggctgggcctgaggcaatctccaagacgccgcatgacccgccgcctccaagcataccttggccagcccacaccggccctgcttctcatcgctgcccatccctctcgagccgcatagacagtactcctcctcctttccccccctcttgcagcgcaagtcgcgggtgnnnnnnnnnnactacgagacgccgcatgacccgccgcctccaaacgtaccttgtccagaccacaccggccctggttctcatcgctgcccatccctctcgagccacagagacagtcatcctcctccttccccccccctcttgcagcgcaagtcgcgggtgaagctggaattcgtcgcgccggccaaggcgggcccggcctcgctcaccctcttcttcatgtgcgactcgtacctgggctgcgaccaggagtttggcctggactttgaggtgctgcctggcgacgaggaggcagaggatgccggggaggagaccgccgtccccatggatgacgacaagtgaaactgtaactcatagcactgcagtacagggcggttgatgggtgaggatggagcatcccagcgcgcaaacggagcctgctccgttgcgtcaagcgcattgaggacatgccgcacaggacatagagacgtagcggatacccttttgctgaattgaataaccactgcagtgtctgcatgcggctcactgcatatttctgacgctgcagcaggcacgaggagcgatcacctgtgccgtgagcccccacctaacccagtgtcatggcggacgcgcccactggagatggagttgtgtcctccaaggcgccagccgatttcttgaagagtattaggnnnnnnnnnncggacatagagacgcagcggatacccttttgctaaattaattaaccactgcagtgtctgcatgcggctcactgcatacttctgacgctgcagcaggcacaaggagcgatcacctttgccgtgagcccccacccaccccagtgtcatggcggactcgcccactggagatggagttgtgtccaaagcgccagccgatttcttgaagagtatcagggggcagcgggtgatcgtcaagctgaactcgggggtggactataaaggtgaggaaggtggtgcacaccttttggcctcccttccgaagcagctggcgagatgttctcagtcacggcatccaccaatatctgaatcgcatcttaccttccaggtatcttggcttgcctggatggcttcatgaacatcgcgatggagcagacagaggtcagcaagggcggtggactcgctgactttagtacgtaatgactgtccttccagccaaggctgcagaagagtgcagcaggaacatagcattgctcccaacaccatgccatgcaggagtacgtgaatgggcagctgaagaaccgatatggagactgcttcattcgtggaaacaatggtgggcgggggtgggcagtgtggcatcgactgcctgcatcgtgcgtcagtggcttttccgaaccttcccaccactccccgtcatctgcgcagttctgtacatcagcccactggcgtagccccggaaaggcatgcgtttgagcagcaaacatgacaatgtgtgaatcgcactgtaaaagactgggaaaacattgaggaagaaggcttgttatgattcacacccccctctaagggtaccaaggaatgtcaggcagggggaatgtgtaggctcttcgaggaggggtcctgccacgtcaagtccaannnnnnnnnncaagtgtaccaaggaatgtcaagcggggggaatgtgtaggttttccgaggaggggtcctgccacgtcaagtccaagggtggtgggtgtgagtggggttgcacaccgccccttcaaggaaagcaagcccctggatcaccagtagtggtaaagggagtgcgcacgcatctggcccagccactggaagcacagcgcgacaagcagggacaggaggaccatcttcagcagctccttggccccgatccagcgagagtagtccagtgaggggcccagggccgggactgccccgccccacggcatcgccgtcggctcactgctgctcccgccgggctgggaggtgggtnnnnnnnnnntgggactgccccgctccacggcatcgccgtaggctcgctgctgctcccgccgggctgggaggtgggtcgccactctggcagcggcgcgccggggccaaatctgcgcaggagcagtgtcgccatgacggcgtacgccttcctcatccccgcctccgactcccgcaggatctggccacggatgggaccccagnnnnnnnnnncccgaatctgcgcaggaggagcgtcgccatgacggcatacgccttcctcatccccgcctccgactctcgcaggatctggccacggatgggaccccagacgttgccgtggaatcgggattcggctgggacgacgaagatcgaaggggaggggaaggttgggagtgggtgcgagcccgaccggttgcaggcagttgtgcaggggggaannnnnnnnnnattgccgtggaatcgggactcggctgggacgaggaagatcgaagagaaggggaaggtcgggagtgggtgcgagccttaccggttgcaggcagttgtgcaggggggaaactgttggatgggaccgcaaaccgagtcagcatctggacacatgactcatcaaaaagagccctccaccctcagcgacccaccagtgatttgcagacgagtctgaccagagaccgtctcgtgcgccacccattgcacgtagttggcaaaggcgctggaaaatggaacctgcaggagggggtaattgggtaggttgcaaagaagacacacgcaatgtagaagcttgcgtgcgactggacattcatctcgccacagnnnnnnnnnncgcgctggaaaatggaacctgcagaagtgggtgattgtgtaggttgcaaggaagacacacgcaatgtagaagctggcgtgcgactggacattcatctcgccacagcagctgtgcaccccgcgctcctcgaatccttctcaccccttgactgatgcagcgagtctgaatgacaaacccatcctccgacctcgagaccaggcacgccacctccgtgttgatggactgctttgggtacgctcgattcaggggggtggtgaagtcgatcgtgatctccggccttccacctgcgggcaggaggggcacgagctgaggctctggcacatcattgcaatatcccaggcagctgggtgacagagaatcatggcatcgcaagccctccagaacctgagcactcagcacacacctttctcctgccaggcagtggtgnnnnnnnnnncatcccaggcagctgggtgacagcgaatcatggcatcgcaagccctccaaaacctgagcactcaacacacacctttctcctgccaggcagtggtggagatgctgtggtcattcagttccctgtgccagcgcaagatgccggctgcattccgagcccagagctcgtcccagacctgctcgggtgttgcagccaggctctgatccaacagatcgatgggcagtcgcgggggtgatgcttctgtgcgcacggacaggcgctgcaaggttgattggagaggggggaaaggttgttggggaatgctggggcctaacccgggagccccaaactgagcttgcttgaccctctcccagcccgcccaccnnnnnnnnnnaaaaggttgtttgggaatgctgtggcctaacccgggagccccaaacagaacttgcttgaccctctcccagcccgcccaccttcaaggacgtgcgtctccgagatagctgtttccgacgatgagcagactgcgcgaggtgccagatcaaggtcaggcctccgatggcgaggacgggaagcgccacctcaggtcgcaggagcctcgaggggcgacgaccacctcccacacgaacggctgtcgctccaggcatgctctggacagaaatttccgcgttctaggtgactttcgcaagtggctgcaaatttgctcacgatgagaatggctttggnnnnnnnnnnaacggggagcgacacctcaggtcgcaagagcctcgaggggcgacgaccacctcccacacgaacggctgtcgctccaggcatgctctggacagaaacttccgcgttcaaggtgactttcgcgagtggctacaaatttgctcacgatgagaatggctttggtcccatgttgcccgcgctcgggtctatcgtccaacagctctggcctacacacgagctcacagctcgagctacttggcgtagaattccagaacctgtccaagcatgcagtcttgcttatacatgcgttggatagggaactattagtcggtcacccgcgatggcgcgccctgggtgagatctgtcatatccgggcgtgctaggttcacagcagcagtcaaattcacacaggacgagtgccttgcttcaaaaaccccgccacgcctggtgtgcggcagttacggcgcaatcccagtcattcccaccatcaaccactcccagcaccatgtcgaaggcatacttcttgggcgtcaccaggtacttggagtggactgtgtgcggggggcatggaaaatcctcagaaacgggtttggacgccctcgtccgcccatgccgtgtccacgtccnnnnnnnnnngcaaaggcatacttcttgggcgtcagcaggtacttggaatggactgtgtgcggggggctttgaaaatcctcagaatcgggtttgagcaccctcgtccgcccatgccgtgtccacgtccacgatagtgtccagcacaacaccccgtccagctctggccctcccaacaccgcaaacccacccgacgggctccagctgtcgtcccctccaaggcccatgtgcacggcatccaggtgcacatgcgtgaagccagaggcctgtgggcaggcgtgggcgtgggtcgcagaggttggcgctccagcacgctatcagacctctgtcccttttcttaccaggcctagtgggcatcactgccttggcgcctgtgtcttcaaccctggagcttgacccagcaccgccgctgtgcccctttctagccccacgcagagcatgnnnnnnnnnncatcagacccctgtcccttttcttgccaggcctagtgggcatcactgcctcggcgcctgtgtcttcaaccctggagcttggcccagcaccgccgccgtgcccctttctagccccacgcagagcatgcccggcaggcgcacctccagctcatggtcgtgccgtgccttctcgaagctctccaggccgtaggggctcacgctcatctgcaggggcgtcctctccgcagggctgaaggccaagaggccggccttggcatcgttgaccagcaccatccagcgcacatccgcgcggcccccactctcgcctgggcgagggcggagggtgcatgcgtcacgaggagcgcgagccagtgcggcctgccagtgccagggtcggatgggcccacacccgggacagcacgctcaacagttcccccaagcgcctcactcgggaagatgtagggcgtgtgcagtttcctgatgtcgtcctcgcgccacgctgccagcctccccgaggccatgcggtcggggtagcactcgtggggacccaggccgtaccacatcggcgcacggaagtgcgacgggacgccgaagcgcacgcccacccgagccagcgaccttgcatgggcgggtggagggggcgtatggtggcatgaaaagccttggatgaagcccgggggcccaggtgcggggtggcatgccgtggcaaaccatggtggatggccccctcacttctcacacaacacacccagcgccacccaccgtttcccatcgggcacccccgggagcgccgacgtggcgtccacctcccaggccatgctgagctggcgcctggcggcgtccagccggtactccaccgtcaccgggatgcgcgcagcgcctggcggctgggtggggagggggcccgcggcctccttgctcgcttcggagagccagtgcgtgccgccagtctgtgcgaggaggtggcggtcttggctctgacgctgcaggatcgtagcagcatgcacaagaagatccccatatgtcagcgtagaagaggctgccggccaggcgctgaacccgcatgtgccgcctcaagccccgatccaacttgccacacgtcccatgcacctcccctgtacctcccccgcaacaactcccgccgcgcacctccccgacgccgaccccctccacgatcacgcctnnnnnnnnnngtgtcagggtagcagaggcagccgaccgggcgctgatcccgcatgtgccgcctcacgccccgatccaacttgccacacgttccctgtacctcccctgtacctcccccgcgacaacccccgccgcgcacctctccgacgccgaccccctccacgatcacgccttcttcctcctcccccgcctgggcagggcgcggcaccaggacgaatgtgacgcgcacgtgcgaggcgtcagcctcgtcggccgccacgaccacagagccgggctcggggcgcaggcggtccagccccgccagccgccaccgcgccgcgtggctggtgccgccggacccgccgcggtcgttgtccgtgggcgcgcggtacaggcacggcacgaccggggcggccagcagctcgcccaggaccgggtcgcagaacgagaccagggcgccggtgtcggggcagacgcggaaggtggggccggcgcgcgcctcctcgccctcctcgccctcctccccctcctcgctcttgactggagggggcaccttggccttgggcgccgcggcctgcggcggcttgggggcctttgttgccagccaggctgcatagggcttggcccagtcggagagggggatctggtcgtgctgcagcgtgtggccctgcaagggaaagaaacggcggccacatgcgcgtcagcgagaagccaggcagcagcagcaccgctccgcnnnnnnnnnnactgcagcgtgtggccctggaagggaaagaaagggcggccacatgcgcgtcagcaagaagccaggcagcagcagcaccgctccgcacaacagcttgacccatgcagaccagagctggcgctgcagggaggacagcgtggacccccctatccatgcccctcagcatgactcccataccacacaaggagcacccaccgcttcggcccacagagtgggcttggtcaggtaggtctccacattgacgatgtcgtctgggcctgcgcttctcgggtcgatgccacccaggcacccgaaatccatgtctatgtactccgcctcctcggagtccatgaccctggtgggccccagctcaccgtctgtcagcaccttgacgccctctgcacacggattcaagagagggtgagcacgtcaccggcctgcgcccgctcaggccgggggctcgcgccgtctgctgcagcaccccagcccccagtcctcgtcagcgcaggctcacctgctctctgcagggtcaccttcatggctgtctcgcacgtgtacccaaagggcgtggtactcgccacctcgaccgccatgtgcttggaggtggccgggcaggccgtgatgcgaaggggccgctgcaggaacttgaactcccaggcgcaggggtggggttctcggtccggccacacgatgccgttcagacagaactgggggtggggtggggagcagcgcggggggaggggtgaggtggggtaggcagcgccgagcggccccacccaggggattgggcgccgggacgttgggagagtgtctgcaggccaccagcgggggaccagccagcgccagcttgcctgtgcatcgtggtgggtctccccaaagtcccccccatacgcccagtactgcagctcggcgccgcccttggtgccagccttgagcagggcctggtcggcccagtcccacacgaacccgccctccacgccctccacgccgtcaaaggcgcgccagtactcggccacgttgccggagctgttgcccatggcgtgggcgtactcgcagaggatgacggggcgggggtcgtcggcattcccggccagctcctccgcctggtgcacgcgggcatacatggggcagatgacgtcggtggcgggggtgcgactgcctccgccctcgtagtggatctgggtcgggtgaggcggtggtgggagagataggggtgtttggagcgtcagaggggggagggacgcaggtggcgcgaagcagcgctcaccctcctggggatgccccgctcgactctccatcggctcaggtacccaagcaccttcctcgatgcatcatcacgaggccatgactcaccaggcgcgatgggtctcgggcccgcaggtacccggccatggcgaggtgggccgcgccgtagccagcctcgttccccagactccacatgatgatggccgggtggttcttgtcgcgctcgtacatcctcacgccgcggtctgcaggcaatgggtgtggggaggcctgagcctggaggtctgggattcgagcagcttcctgtgcaagggctgcccctgggcaactggacggggatgaagaagactgtgcgcatgaacgccggccctgcagtccgctgcacctggactctgagannnnnnnnnnacgggcatacatggggcagatgatgtcggtggcgggggtgcggctgcctccgccctcgtagtggatctgggttgggtgaggcggtggtgggagagaaagggtgattggaatgtcagagggggaagggacgcaggtggcgcaaaggaccgctcagcctcctgaggatgccccgctcgactctcgatcggctcaggtacccaagcaccttccttgatgcatcatcacgaggccatgactcactaagcgcgatgggtctcgggcccgcaggtacccnnnnnnnnnnacggggaggcctgagcctcgaggtgtgggattcgagcagcttcgtgcgcaagggctgcccttgggcaactggacgggaatgaagaagactgtgcgcatgaacgccggtcctgcagtccgctgcacctggactctgagacccagagccccaccccgcatgcggcagcaggtctgtccttgcatctcgtgacgcgcagcaggcagctacgcattcctctggcctttcacgggtcccagcctaccgctcacccacgactgcggcgagccaggcgggcgcggcggtggggttgagctccggcttggacagcgtggcgtcgaagccgtgcgtctccacgttggcctcgtccacgacgtagagaccaatgagcgcgcagacctcgtaccaggcgtcctcgttggggtagtgggagcagcgcacggcgttgaagttcaagcgcttcatcagccgcgcgtcctccagcatggacgcaaagctcacggtccggccggtgcggtcgttgtgctcgtgccggttcacgcctgtgcagatggggtacgggggaggggcggagttgggaggcgttgcgggggtcgtgtgaggggtggcgtggcctctcgacacgaatgcagctgcagcgagtacgcccggtcctcgcgcgtcagcctctggggattcacacaggcctctgggcaccccttctccggcatgcgcatcggaccacggctcctactctcggctcaacgtgcccacaccgacctcggatcaggatgggccagccattgtgcaccagcttcttgttcctcacggaagtcgtacggaagccgacctggcacgcctcgtgctccagtgcgctgcccctggcgtccaccagcaacagggtcaggaggtagaggtgcgggcggtcggcggaccagagctgcgcgggccggcccgctccgtgcaggatcatggcgtccatggagaactgcgaggatttggaatggaagggtgggaaatgggtgtccagggctcgaagagcggggtcccgacgaagcacagcccctcccactgcgctcctgactctgcctcccctttgagcatgggggaagttcttgcagtcatccgctggaacactgcagccacacaccaccgccgaccttggcgcgcgctccgcggccannnnnnnnnncagggtgtccggggttcgaagagcggggtcctgacaaagcacagcccctcccactgcgctcctgactcggccctcccctttgagcatgggggaagttctggagtcattcgctggaacactgcagccacacaccgccgccgaccttggcgcgcgctccgcggccagtccggcccctggcctctgcctggttccgggcggtccacaggggtgtcaggcctgcctccgtcatgtgcacggggctctggccgtagacggcagtcagggaggtgtccccccggaccagggcatccgtgtcctgccggtaaaggcgcgcgatcatagacagggactccagcgggccggactggtcgtccacttccacatccacctgaacctccaacctggtggccgggagcgaggcgggggagggtaggcggcgctgaggctgacgaggcaagtgcggttggactcgggatgctgaggccactcaatgggctctgnnnnnnnnnntgctgaggttgatgaggcaagtgcgcttggacccgggatgctgaggccactcaatgggctctggaacccacaatccaacgcgcagcacctggcatcggtcagcttggccttgtcgtcaaaggtgagaggggtctggaccgcgaagtcagtgatatgggtagcgggcttgtgcaggacatacacgctcctgggaggacagggtgggcgagggagcgtgcgaggcaggtcggacagctggtcgtctcagcaattcctgacgccccacgatattcatccatggcgaggagacggtaaccgtctttcggtggagggatgcagctgcatgcagggccgacatcnnnnnnnnnngattcctgacgcccgacgctgttcatccatggtgaggagacggtgaccgtctttcggtgcagggatgcagctgcatgcagggccgacatcacatggaaacgtctggcgcctctcgcgtgccggtacctgtgcaggcccggcagtctccacatgtcttggtcctccaagtagctcccgtcgctccacttcatcacctgcgctagcgcaccgggttcgggacggtgggcgccagcccccacgaacgcacatgtaccactgcacaccccttttcctcatacccatcggccatgagacgccctctgccagctccaacaccccccagagtctctcagaccnnnnnnnnnngcgaacacacatgtaccactgcacaccccccttccgcatacccgccggccatgagacgccctctgccggctccaacaccccccagagtctctcagaccaacgacacagccagcctgcctgcagcaccaggacgttggtgccgcccccgggcggcagcagggcgcaagagacctcaaactccgcgggcaggcggctgtcctggctgtagccgatgcaccggccgttgagccagacgtacactgcagagtccgcgctttccactaccaggaaggagcgcgtgccgccctggggctggacgctcgggaattcgcggcggtacacgcccgtgggattggtctctggcacgaacggcgggttgatggggaaggggtagtcgaagttgagatactgaggcgacccatggccctgcagctcccaactcccgggcacggcgatctgtgagttgaagagggacaaagggattctcccatgaggcacagcgcggcggtgtgcatggtggtcacgcctggctcctgaccgacgaactgaggtcatctccgaaatgagctcacagctatcacaaatggcataccctttcccccctctcacacacacacaaggcccaacannnnnnnnnncccgaaatgagcccacagctttcacaaatggcatacccctctccccctctcacacacacacaaggcccaacagggggcagcacagctgattggctccgatctcacctgtgcccatccctgggatggggtagccattcccatgagcacctccctgggcacatcctcgggctttgcatacagctggaaggcccagtcgcttccattcaaagcctgaagcctggtgctggtctccttgccgtcccgaagagtgtaagctcgcagagcctcagctggggcggcgtaggaccgtaacttgacatgggcttcgcgcttgttgataccgaagactccaggggtctcccagtcccgagcgaccggcaccacgctcggaggcggcatcgagcccaactcagagcggacaacaactagatttcggtattcagactcgaatcagcgagaccagctggcggattggttacccgagacaggaagagggtcagatcgtgcatgaacatcccccacgggtatcggaaggcatgtcccgaggggtttccccacccaactctggaattcaaatcgcagctcgtctcacttacaggggtgtgctacgtaaagtgcagaagcctgatgcccaaatggtgtgtagggtttgtccagcaaaatcatacgcagtgtcaagaacaaggtgtggtaaggacaaaggagcaggcagcctcgcagctgtgctaaaactttcagggaacagagcaaatacaaagcgaccatcgcatagtacctatactcaagagtgacacagaacagggacacaatggcccggcagcttgcatccactgaaatccagacaaaggggagcaataaaagcgacatcaaccaaataaatgcaggatgcccatggttgggtggcggaggatgaagggtgtttcaccttcagggaggaggagtgaagaggacctgcgcatgcagggtggtgggggtcccctcagggggaccaggcgtcccggtgagtgaggcttgggtgctgcagacaaagaggagggagggccgttcccgatgtgaagcgccagcaggaaggtgaggggcgcggggtggggctggcgtgaggaacgggagggccccggggttgagacgcattggtgactgttgtgaataaaatccggggatgttgtctggggaggggtttgttcagaggaggagcgccttgcgggctttggtgggagacctcggcggctggctcgagttgtaagtggaggtagtctccaggagggtggcgtccagtgcctgtggggagcatggagtggaaaatatgagggagtcggggtggctggccaggtttcattgtgctcgctgtggcatccatggaagcgctcggcacggatcaggggcgtgaatactaaagggcacctggagccacatgccccccatccccaccggcatgctgttcacaaannnnnnnnnnttatgtgagggagtcggggtggctggccgggtttcattgtgctcgctgtggcatccatgggagcgctcggtacggatcaggggcctgaatgctgaagggcacctggagccacatgccccatccccaccggcatgctgttcacaaatcaccttggcggatgaaatgacattcacggcctggcggttgtcattgacaaaggatcctccagcagattgaaccagcgccgttgaaccctcagctgtcgcagtggtggcaccgttggcatacttgtccttcacgttgttggacaggtcgatggcggaagaaacctgcggggggaatgtcggggcgaagactcgcgtgagggggtggtgcacgttggcctcctcaggcctgctgggaattctccggaaaccctatccgccacacataacacggcgcaccttgcttccgggaccgagagcggccgcggacccggaggcagagacctggctgttccctgcggtgtgtacggattttcgtggttcacgccgcacggcacgctttcttatccgagtcatgagggggaaaatgaacgtcggcagcgagtcactcccccgcacgccagcccgtttcaacgcaccagtgctcggtgacccagccacggtagannnnnnnnnncctttcttatccaagtcatgagggggaaaatgaacgtcggcagggagtcactcccccgcacgccagcccgtatcgacggaccagtgctcggtgacccagccacggtagaattcgagccgtccccgctagcctgggccgaaacagaaacagtcccctggagggagcgccccgatgcactgacaggcctgtatgggtgcgacgaagcgcagcaaggtgagagggtggggtgcggggggcacaatgatccctcaagtgcaacaagtcgcacatgggagcggattcctcatatcggcagaggtctgtgcacgcacctggctcgcacattctcgtgtagggtcgcgaatgcgagaccccataccaaaaccatgagcgtcatgttgctggagaactgcatggtctttactggtgaatgggaacgacgcaccggacgaagaaaaccgggggaggtggggttgacaatgagtgccgacaagggggccgcgtattcnnnnnnnnnntgcggggggggtggggctgagaatgagtgccgacaagggggccgcgtattcttgtgtacttcttatcaacgtctcgtccaaggctgtctgacatggatgaacccccctccgcgagacagtctggacgtactggggctgcgaccagtaagatggtgccgcacgggtggggcccgcacagacattgtccttgcgtctaaaattggctccattccagtcccttcgtgggaattaaatacccagattctcctccgtactcccattgtcgtcggatgggtcgagattggcagaccgcnnnnnnnnnntagtccattcatgggaattagatacccatattctcctccgtactcccattctcgtcggatgggtcgagattggcagaccgcaagaattcgacacaccctctcggagtacgtgaccggatcgtgcccccggaaagacggcgcgcgaacgctcttctgaagaatctgagacgagagggcaagaattcagccccaacaccgaccgcgatgatcccggcagccatgcggtcttgggctttgaggtgttcgccgagattgtttgtgatttatttgctgacgccgacagtcttcagcaccgnnnnnnnnnnaaatctgagacgagagggccagagttcagcctcaacaccgaccgcgatgattccggcagccatgcggtcttgggctttgaggtattcgctgagattatttgtgaaaaatttgctgacgccgacagtcttcagcaccggagattcggtggtgggtcccgttggggtccgcggtctctccgccttccggccaaagatcacacttctgtgcatgatcgacatctccggcatgtcgagcaaagatccggaccggcggagccagggtcgcaaactcctcgtgggttgccacgctctggtgtttccggtgggacgatnnnnnnnnnnagcatgtcgagcaaagatccgaaccggcggagccagggccgcaaactcctcgtggggggccacgctctggtgtttccggtgggacgatgttcagccgacattcagggtgccttccggccccggggccgctcccttcccttggacctcgacttatcaaatcacatgctaaaacaagggggcgcaacgtttgtggatttgaaagtggaaatgaggtgggaggatgcaccatgtgatttcgaacaattggagtagtgatacattctaacaaagagtgcggtaggagcagggcccctataggttcattcacgccaccctagcagtcagctccggcatcagctgcatgtgccgcctgagaggcctccagcgcagagaagcgacgcatcattaattcatacaggaaatacatgccccctatggagggggcagcctgcaagtaggcatgggacatgacgtgaggaggtgggttggtcacagacacggaggatgacagggagcatccaaagctggtgtctccagcggcgcccgtcccgtatctgcagtgcatgcaggaccccgcaggagtacaagcggtagatatgcctgcaaatgtaacctgcctgcccattggctgtgtgctgaaagtgtgacttcccaaacaagaaagcatgccttggctgaactcgtgcgcctgctgccactgtcgcctgcagggcaacatcccccagtgtacaagctggggcccggacccaccttgagataccccggcagagcggccacgtagaacgccctgatgccctccttccttgctatgcaccgggcgcagtgcagggcgcccctgtacaggaccggcctgcctggtaccccctgtgcgtgaggcagcgggccgagacgggtgagcgattgcagggggacgtctgaatcgcacggccgcagccctgccaagctcttggtggggatctgtcctcccgagcctcccctcattccacctcaacggggaccgtccaaccccgagcccacctgggcctggagcctgcgcctcannnnnnnnnntgctcttggtggcaatctgtcctcctgagcctcccctcattccacctccatggggaccgtccaactccaagcccacctgggcctggagcctgcgcctcaccacctccatgggcatggtcagcgtcatgacggtggccgccgacgccgcgcccagaaggcccctgacctggggagaagcgtccgacccttgcgacttgcgccagagcctgcagcgccgggcgggaggtggggggcgggggagggtggcaccgcgcggtcaacgtgcgtacgcaagtgtgcggtgcccggaccggggcacgaccatcactccaccgggtcgggcggtgcccacgcccctccacataaaccacctggtgtacgcctcgtacagggtgaaccctagggccgagcccaggctgtcgctgaagagtgtggccccaaacccgcggtagaggccccccaggccctgggtgcgggcgatgccaactccggcctgccagaggttgccaggcacgccccccgccacgctcatcatctgtggtgggagtttgtggggttggtgtgtgtatcagtggctggcctgcctgcagacgatcccagggtgccaggcagggcgctctcgtgcgagagtggggaggcatggggatcctgaccccctcacacgacgagaaaggtgcccagtacgacagccacacagcgtctcagcgttgggcctgaaggtcaggtcgcaggcccggcaagtgggccgccctgcccctgaaccnnnnnnnnnncgggggagtgcatggggttggtgtgtgtgtatcagtggctgacctgcctgcagacgatcccagggtgccaggcagggcactctcgtgcgagagtggggagacatggggatcatgaccccctcacacgacgagaagggtgccaagaacgacagccacacagtgtctcaacattgggcctgaaggtaaggtcgcaggtccggcaagtgggccgccctgcccctgaacctggaccaaaagcctcacgcacagtggcaggcgctctcaccgtgcgcgtggcttccagcgggtatgtgacgagggtcgcggcggcgccccccgccgcccccgccnnnnnnnnnnccgccgccagtcgctcgggggtggtgaggccgccctcccgcgccgccgcaggccccggtcccgcgccgcgtcgcgcagccagcgtgtcgcgcagaccatggtagacggcgaactgcacggcggaggcgggcgcgatcttggccagcgtggcggcgtggccgcggtacatggcgggcaggccgccctcagcccaggcggcgcgcagcgcggccagtgcgccgggcgcggcacccgcggccggggccatgagcatgcaggacacgcgctcaagcggggccaccaaggtcttggtgaccgcacccgccagaccgcccgccaggaactgcgccgcgccgcgcgcagctcgcggcaggccgcgccgggggcgggcgcggcggcggggggcgagacgggggaggggaatgtgggagaacgggttgcgggggaggggcggggccatgcctggcagggcggccacggccaggctggcaagcgcagccgaggtggccaggggacgcagctcgaagtcccagactgtcgcggtgaggtggttgcgtgggagtggagcggagaagtgtgtcggcggctctgtctcggactcttgtgtgctccgtggagggggtgccgcactcagcccccatttcaaaccgacgcaccttctgtggtaatacatggtttgcggtcttccaccgggcgaagcggctctgcagctaatttaccagccattacgacttaaaagtgtcacagattggtgctcgnnnnnnnnnncctgcagctaatttacaagccatttcgacttaaaagtgtcacagattggtgctcgtgctcctggggctgctcaatgcctgaacggccgaagggccccgtcgggcatcccgacgcggtggatgtcgcccgtggtctgcaagcagccggggcgctggcggtccctatactnnnnnnnnnnagggctgctcaatgccttaacggccgaaagaccccgtcgggcatcccgacgcggtgaatgtcgcccgtggtctgcgagcagccggggcgctggcggtccctatactgtatgcaattagcataaccatcacaatagtgtgtctcaaaaggtccggaaagggatagtatcggaatcggaatcatgctgtgcatccccccgcacgaacgaaacgaaccctaacgtgcttatttcccgcgcaggactcccacccaagtatgggccctcggaatagtccgacgggtgttacccacggcggactcaagaaggcctgtgatacgctgatccactccgaaacataatttgagtctcggaaggttgcgaactctggtccacgtccttgcttgactatttccctgaaggtgtcccttagtacgaggggtatcccgggatccctcaccatttcacaccaatgtcccggacggtcgacaccgctgcctccataggctatggtacggagcttcacaacacgtttggaggatgtaacgtgtgctagccctggttttcagagggtcagcaagctctgtcatgaggcgtacgcaggtggcgcatatctccgacctccctggcgcattcaccttgcagacaagctaggagacgcaagcacgcagactgccgaaaacggcagcctgaaatacattacaatgaagatggagaaacccgaaccctgctgcaaaggggccgagctggcttcggacatgtcggaagcttgggaggattgccactgcctctgcacgatatggctcggcgcatcagtgggtgagctggacggccgcgacggagcacacgcattccgactgtggggacttgacttgatggttgaggctacaatgtgatgttgccgacccagtgcacctttccctcctggctgcctgtgccaagtatactgagcacatccgctggacacactcgtgtcttcttcgttgcgcaatcaccaccattacctttcctctgcattgcaggcacactcttgatatccatgtatggctgcagcgtggggatggtggcgggcttcctgggcgtcctgggcttcagcatcttccagaccccccaccgcccataccggcccgccggggccttgggcaccacttcaacgctcgctgcatgcactgcaattctggccagcatcatcacagggctctgcctaggctatctggtggtgtcacggaagatgtgcgtggggtgctcgtggtcgtgcaaggcgtatgaggggatgggattcagtggttgggttttgagccgctggggcaaatggtattgctttggtctgggcctttgctcatatcgaccattgctttacctgaacaacagggtagcttannnnnnnnnnatcagtggttgggttttgaaccgctggggcaaatggtaatgctttggtctggtgcttgctcatatcggcaattgctttacctgaacaacagggtagcttactcattacactgcatttgcgcaggtgcaatcgctctatcgaccagtgtgacatccttgaggaggccctcatgttcaataccttctggttcggcttcttcgcatgcatctccatggctgtattcagggagacgcacgctctggcggatgccctttcgatggaggagaccgagcttccagagaccagcgtcagaccacgagcagaaacagcctgaaacaggccgcagcacagggagttgtcgccaatctgcatgggattgccaccgtcgcttcctcgcatactcaagagtgcctgctcttagctttgcccttccataacaatgcacagccagaactgtacatcatacttgtaaagccgggcggggaagactttttttcgtctcggaggtgggaggaatggccatgataannnnnnnnnnaaaacaggccgcagcactgggagttgccgccaatctgcatgggattgcaaccgtcgcttcctcgcatactcagagtgcctactcttagctttgcccttccgtaacaatgcacagccagaactgtacatcatacctgtaaagccgggcggggaagagtttgtttcctctcggaggtgggaggaatggccatgataatcttgttgatcagggtcggccagagccacatgcgggggtcccggcgggaagtggcgtgtgacgccatgaggctgggcgcccgaacaccgcacacaactgctcccgacatagtgctgttgggcccgcactcattcaaatcaagagggcatgtacagattgactgtgactagcaaagctgcgcagtgcttcctgggatcactgaccctgggtacaggtgaggacagacccttcggagacgagtgcatgggtgcgatgtgcgcagaattgcatatttattctagctgcattgaccagagtcgatctctgagaggctgcatgaaggtttcttaccgtgtatagtgcttactgcccgtcctcaacttgaccgggtggagcatgtacaatctgtgagggacagagcccttttctcattattccatatgttgaaatcgagttcatcagatccctgtgctcnnnnnnnnnnttacaatctgtgagggacagagccctattcctattatttcatatgctgaaatcgagttcatcagatccctgtgctccatcgctgcagtgccatcgcttcacctcagcgctcggagcgtcttcagccctgcagttatcaggccgcacctcagacctcagaggtcccttgcacctcccctctgcgccttctccacagccacggccacgccagtcgccatggcagccactgataagcccgtggagaagttccgcaaggtgagttgattggcagaatacgagttgtgccaatatggcctcccacatattgttcttgccaaccctgtgtgcattcttgtccttccacaccccccaggactacaagccgagcccctacctcatctccactgtccatcttgactttcaactgaacgaggaaagcaccctcgtccagtccaagctgcgaattgtgccaaaccatgctgagtccagtccggtctccctcttcctgaatggtcagttggcgtgcaggttggatgtcctagtgtctgggtccaggaccttgaatggcaggatcctggcgtatcttcgaaatgtctgcaaggccgctgcatgctctgacctctcttatcattcccatgtctccctgcaggccatgctgatgttgtgctcgagagcatcaaggtcaacggggctgatctggaggcttcgcactatgctgctgatgcacagggcctgaccatcaagtctggacttccttcgggtagggtgtgggaagtcgttcagatcagtgccagtgtcagagtgtgggctggtgatgtcaaacctgagggtgcctggtttggcgacccttatgcgcatatcgtgttgaacagtgattgcaggaaggattccatggctcgcccctcttccctgctttgcaggcgagtgggacctggagatnnnnnnnnnncggacttccttcgggtagggtgtgggagttcgttgagatcagtgctagtgtcagagtgtggtctggtgatgtcaaacctgtaggtgcatggtttggcgacccttacgcgcatatcgtgagaaccaataattgcaggaaggattccacggctcgcccctcttcactgctttgcaggcgagtgggacctggagattgccactcgcatcaagcctcaggagaacacctccttggagggattgtatcgcagtggaggaatgttttgctcacaggtgttgtgggactctggggattccaaagcagggtgatggtgggcatgcaggccatgtctgctgggcagtgtcagcagtgcagcagttcctcttatagtttccatccagcttgggtcccgcggctcgcccccttgcagtgtgaggcggagggtttccggcacatcacctactttctggatcgcccggacgtcatggccaagtgcgttgtgggggatgagtctgcctttggagatggctgaggatggctgcgcaaggcacccacatctggatgtggaaaacctagtgcatgctggggaaggggtgtatggtgccttgggcatctgccacccatggacggccagacgccagtcagatgggggtgccgatcatgcagcacactcgttcccctggtccatcacaaggtacacgagccgcatcgaggccgacaaggccaagtatcccgttctgctgtcaaatgggaatctggtggaccagggggatctggagggcggcaggtgaccgctgggtttgggcagtgttggtcccaggggcatgggtgctgaaatgatctgcagggtgtgattcagtggcacacctgcgctgttgccctgcgccactggctccttcttgccctgctggctctcgattgaacgcaatccaacaatgcccccccctttccccctttcctcccccccacccaggcacttcactgtgtgggaggatccgtttgtgaagccctgctacctcttcgccctggtggccggagacctggcagtgcaggaggacaccttccgcaccatgagtgggaaggacgtcgcactccgcatctacacagacgtgagtggaagatgcaggggccatgcccctgtgccccctgaggagcgtgcaaggggtcggtcctgggtcgcagctcccgagccttgctccagatcgcctcagcaagcctatctctcacaccccccccttttccaccctcggcaggcacacaacaccagcaaggtggcctttgccatgcagtccctcaagcgcgccatgaagtgggtgcctgggacgctgagttgttctcggttgtggggcagtgtgtgtgcggctggctgtgctgtgtccgcgggtgcacagcgnnnnnnnnnngtcgctgaattgttctcggttgtgggggagtgtgtgcggttggctgtgctgtgtccgcgggtgcacagcgtcccatgcccctcccccccccccacaccctctgagcctcccatccactcgttccccaggtgggacgaggagacttttgggctggagtacgacctggacctgttcaacatcgtggcggtggacgacttcaacatgggtgccatggagaacaagagcctgaacctgttcaactcgcgcctggtgctggccacgcccgacaccgccaccgacgcggactttgggcgcatcgagggcgtggtcgggcacgagtacttccacaactggacggggaaccgcgtgacctgccgcgactggttccagctgacgctgaaggaggggctcaccgtgtaccgcgaccaggagttctccgccgacctgaactcgcgcggcgtcaagcgcgtggaggacgtggcccgcctgcgcgcggcgcagttccccgaggacgcaggcccgctggcgcacgccatccgccccgactcggtgatcaagatggacaacttctacaccgccaccgtgtacgagaagggcgcggaggtggtgcgcctgtacgaggcgctgctgggccgcgccggcttccgcgcggggctggacctctactttgcgcgccacgacggcggcgcggtgacctgcgacgacttccgcgccgccatggccgacgccaacggcgccgacctggggggcctggagggctggtacgcgcgcgccggcacgccgcgcgtggaggtcggggtcgagcacgacgcgggggccgggacgctgacggtgaccgcgacgcaggcgccgcccgtgctgacggccaagggagggcggggtgacggcggcaggggaggcgacgctcaggcaggtgaggagggcgactccccgccgccgctcctcatccccatccgcctggggctgctgggcgccgacggcgcggcgctgcccctgcacctgcgctccgggcccggccccgaccccgccggcggctccgaggcggtgctgcgcctggagcaccagcgtgagacctgggtgtttgagcgcgtcccggcgcgccccgtgcccagcgtcctgcgcggcttctccgcgccggtgcgcctgacggtgcgcgggcagagccgcgaggagctgctcttcctcctcgcccacgacgccgacgccttcaaccgctgggaggcggcgcagcgcctcggcaccgccctggtgctggagcggtacggcaccgccgtcgccgacggcgcgggcggcggcgcggaggcccgcgccgcgcg

SEQ ID NO: 46398 - DNA, 61 bp, Chlorella protothecoides
agatccagaaggctgctgagacggtcaagagtctggagcaggaggtcctgtcggagtctgc

SEQ ID NO: 46399 - DNA, 61 bp, Chlorella protothecoides
gctgcccctttgcactaggccacaggaaacctttccctctccccatacacacacctgccgg

SEQ ID NO: 46400 - DNA, 61 bp, Chlorella protothecoides
aagctctggcggtgtatagtggcggacaggtcaggaatggcactgatgcatttggcgagca

SEQ ID NO: 46401 - DNA, 153 bp, Chlorella protothecoides
tctgccaccgcatgaaggtccgtaactgcacgccaaatgggacgacgggtacaaaacgaagcgcctaaagaacatcgcgtgccaggacatgtacaggcttcatcaatatttgttgatgggtctcatgagactggtcaggcatgcgaatgttga

SEQ ID NO: 46402 - DNA, 140 bp, Chlorella protothecoides
gagcgagggggaggagggactggagcacgcactgcggccccacatccttgctgcagcccagctgagggccaacagggagcctacacagcaccgcgctgctttgccatcgccctgtcgacgctgaccacacttcatcagcc

SEQ ID NO: 46403 - DNA, 67 bp, Chlorella protothecoides
cgagctgcatgactgcaggccaggacccccccacccccccccacctgatgtccaggatgaactcatg

SEQ ID NO: 46404 - DNA, 14226 bp, Chlorella protothecoides
  modified_base (599)..(608): a, c, t, g, unknown or other
  modified_base (817)..(826): a, c, t, g, unknown or other
  modified_base (1279)..(1288): a, c, t, g, unknown or other
  modified_base (1434)..(1443): a, c, t, g, unknown or other
  modified_base (2365)..(2374): a, c, t, g, unknown or other
  modified_base (2806)..(2815): a, c, t, g, unknown or other
  modified_base (3324)..(3333): a, c, t, g, unknown or other
  modified_base (3544)..(3553): a, c, t, g, unknown or other
  modified_base (3764)..(3773): a, c, t, g, unknown or other
  modified_base (4416)..(4425): a, c, t, g, unknown or other
  modified_base (5316)..(5325): a, c, t, g, unknown or other
  modified_base (5561)..(5570): a, c, t, g, unknown or other
  modified_base (5737)..(5746): a, c, t, g, unknown or other
  modified_base (6425)..(6434): a, c, t, g, unknown or other
  modified_base (6784)..(6793): a, c, t, g, unknown or other
  modified_base (6897)..(6906): a, c, t, g, unknown or other
  modified_base (7529)..(7614): a, c, t, g, unknown or other
  modified_base (7682)..(7691): a, c, t, g, unknown or other
  modified_base (7793)..(7812): a, c, t, g, unknown or other
  modified_base (8142)..(8151): a, c, t, g, unknown or other
  modified_base (10159)..(10168): a, c, t, g, unknown or other
  modified_base (10477)..(10486): a, c, t, g, unknown or other
  modified_base (12127)..(12136): a, c, t, g, unknown or other
  modified_base (12789)..(12798): a, c, t, g, unknown or other
  modified_base (13159)..(13168): a, c, t, g, unknown or other
  modified_base (13261)..(13270): a, c, t, g, unknown or other
  modified_base (13354)..(13363): a, c, t, g, unknown or other
  modified_base (13589)..(13598): a, c, t, g, unknown or other
  modified_base (13717)..(13726): a, c, t, g, unknown or other
ggggtcgagcacgagcagcacggccaccgcctccgacaccccccgccacgtcgtctcgccgccgccctcgcccgccacgcccgtctctgcctttgcgcccccgcccaccatcgaccacctggcggcgcccacgcagcgcgacgccagcctcgtgtacgtggccgacagccagggcggcgtccgcatcttcgacctccgcacctccgtcgctgcgcccgtggcgggcctggtccacctccgctcgcgcctggcggggctggcggtggagccgggcggcgcgccgcaccagctcgtgctcggctaccccggcggctccctggcctttgccgacctgcgcgccggcggcagcggcggcgacggcggccagcagggcggcgtgtggaaggtggtggaggcgcacagcaagcccgtcatggcggtgctggcggggcacccccatgcccccctccttgccacggccaccacggggcaggtgggttaatccgttttgtgggaggggtggatcggaggctccacgtgagctctgatggggcgagggatggtttgagtgtgagcagatccatgggtgtcccaactcgcatttcccatcccaaactccnnnnnnnnnngatccgttttgtgggaggggtggacctgaggctccacgtgagctccgatggggcgagggatggtttgagtgtaagcagatccatgggtatcccaactcgcatttcccatcccaaactccccaccctcccacaatgtcggcacaccaacccaaccccttcccgccccccccaccccccatgcactgcaggtggtcaaagtgtggtccccnnnnnnnnnngcacaccaacccccccccttaccgcccccctccccccccctgcactgcaggtggtcaaagtgtggtcccccacgggcgacccgctgggcgtcatccgcgcccacacctccttcctctcccaccgcccgggccccatcacctgcctggcctgggcgccttacgacctgcacctggcctcaggggggcaggaccgcgtggcggccgtttaccacgtggggccgggcggcggcgccggcctttcctcctcctcccggccccccgccgcgcccagcagcagcatcggcctggcgtcctccgcccacccctgacgtgcttctttggtcccccttcccctcgaaatttgtcccctgaacatgacccccggatgcttcgttctgttgacccgaaggagcgaggagagggcgcacgagaagcggcaggcgagggaggtccacggcaaggcgaggacgtggnnnnnnnnnncgacccgaagaagcgaggagagggcgcacgagaaacggcaggctagggaggtccacggcaaggcgaggacgtggtagattgacatgactacaatacatggcactggcacagacctgtgcctgagtctggagtggcttgcacacgannnnnnnnnngtagatggcactggcacaggcccgtgcctgagtctggagtggcttgcacacgaattctttgagtctgtgtatgcgagtgcgcttgccactagagatgggacagacccggcacactcggaagacatgggccgctgtcagcactcgggtctcagtgttatacagtacccatcagcagcgcgcaaagcaatatgaactgcgcatgctgcgcagtcccatgaagcacgcagcagcagcacccatcaccacacctcaagacaagcggtaggtggcgatgacaaggagggcggagatcttgctgcggtatcgtagcggcgagctattctgcagccgctccaggatgtgcaccactcgctgctggtcgagccgctccacatattgcctgtggtgtgaggcaagacggggaactctgaaagggaagcaccaggtgtgatgcccgacgctgcgtggctctccttgggccatgccctctttgcttgatttgctgtggaggaggtgggcagctgcaaggacaccatgcatctcatcaaacacccctcaacctccactccctgaagtgacctgaggactgcatcggcggcctgggccaggccaggttccttgcgggtgaggcgggcgatgtccaggaggaggctgctgcccgggatcctggcccctggcctgtcgtagcgcagcatggcatccccatagctggtcaccatgtcgccgacggccagcagcgccgcttgcagtaccgctgagtcagcgtggtgcaggcagcgctgcatcaggcgcaccatgtcgtccctgggtggagggaggggccggcgctgaacgagagagacagtgaaaggcagagccttgccatgcactcgccaccgctccttttacccccccctcccctcaacaacgaccaactcacaagcagtcgcggacaagggagggnnnnnnnnnntgctgaaagagagagacagtgaacgggcagggccttgccatgcactcgccaacgctccctttacccccttttcctcaacaacgaataactcacaagcagtcgcggacaagggaggggtgaaaccggatcatgcgccgcagcatctctatggccgccagcagccccgctagggtgccagctctcagcagcgcctctgtttgcgccatcccttgctctgggtcggggagggggcagagctcccggcccttgcgggggctgcggcggctcgggccgtttccaggctgcagacggtgcgaggcggccgtgtcgggtccggggccggcggggctgcagccgcctggccctcgcggcgccgccacgactgcccgggcagtggcgatgcgtgcagttcccccaggccccggctgggaggaaccggacctcaccgtgtcnnnnnnnnnncttccaggctgcagacggtgcgaggcggccatggcggggctggggccggcggggctgcagccgcccggccctcgcggcaccgccacggctgcccgggcggtggcgatgcgtgcagtgcccccaggccgcggctgggaggaaccggacctcaccgtgtcgtggggctcctgtgggaaagcgcgaggggtgggcgcggcgcgagtcgtcgtccggcccgtgaccggcctcgccgtgtgaggggccccaccccggccgctggtgctgggctggtcctccgggagcgattgccttcccgtggagacggtgctgcgtgcagacaactgggagtgcagggctgggatgctgctggagctggctgcccctgcatcctggtacacaggggcctccttttctggtccagccacctgtcgccgccgaggtggaaggggttatccaggggtggtcctccgaatgggcacccagagcatcccatagagcgctcgatgcgatcctcacctcttcgtttgtcnnnnnnnnnnacaggggtggccctccgaatgggcacccagagcatcccatcgagcactcgatgcgatcctcacctcttcgtttgtcccctccttgtccccatcttttgtcagggaggcgcggaaacagcacctccagaacgacatgtccgtgttgacggcggtgaggtcctgctcgagggaggtcgcgaggaggtcaggggaagcactaaaccatctagannnnnnnnnnctatgctcgtcgctggccttcgtcaacactccgacactgtgctgcgcgtgattcgagcgcgcacagctgccgggaccaggtgagcttcttcaggcgatgcatcacgcacaagatagtacgacttactatcaaaactgatttataggtacacgtctagacctccatgcggggtgtcaattgaccgatcgcggctgtgttgttccaaagaccnnnnnnnnnntcaagatagcacgacttactattaaaacggatttataagtacacgtctaaacctccatgcggggtgtcaagtaaccgatcgcggctgtgttgttccaaagaccggcgtcagtcgatatcaggacataaacaccacccagggagggagcagattcagttcgagtctaccagactacttaaagacttggagagataggatgcagtagtttgttacagaatgcaaatagtctaaagtgcgaagcaccacgctctgcctgagagtggcaggggagctggctgtgcaggcacacccatgcccagcgggacaccttcctccgatgccagcggatcccaacaccgagacgatagcacagatggctgcagtaacccagggtcatcgcaccagtcgtcgagcagcagcgaggagagtgtgggaaggggacgctcacagggcgaagtgagctcgccggtcgacaagaaggatgcagcactgcaccttctccttgaaacgggtatctcagcagcaaggtacgtctatggtgccctcaggagccatgttgtcatttggacggtcagctcagggcctggtggcagcgtccttgccattgttaggccttggctggtcttttccaacggctctgtcccaccctcatcttgtcagggcnnnnnnnnnncgcgtccttgccattgttaggctttagctggacttttccaatggctctgtcccaccctcatcttgtcagggcctgtcaggctctggatgccatagaggagcatgcctccagccccacagcctgggctgaggaggcgcaaacgtggctggctgtagatcaggagcatgcaggtgagctgcttgttgcccatacaggttcgggtggatgcaaggcttggccatggttcgaccaacatgtagataccgatgatctcattcacatccacaatggagcagacgagtctgccaagctggcggaaggcatgcatgcgtccctggaagaaagccagaaggagatggcgccaagctgcttcgagcagacccctgcccagctgctggaggcgagaggatttgtgaggctctctgctcgcaacagccgtgtgccagaagatgctcactgtgcgcatcctcctccagcttgctgccccgcttgtgatgccacctctcccactcctatgccccacccccttgtcccagacctttgagggctcgccactcatccagcagctgcaacactgcgaggcggggcttggacacccgctggcgtgcgacccctggccccggcccctggtcggctacctggtcctggagcggcgctgcatgcgctggtacgccgccgcccgcgccttctacagggcccaggccgaggaggcctgcgccgcgctccagggctcccccgccggcctccagggctcccccgccggcgtggggccccggcaatgggacgcattcctggcctcgctggcagagcggcaggcggaggtggagcgtgcggtgtatgcgatgccggcgaatggcgacctgcatgctgccaccaacatccccgccctcttccaagggtatgccgcagacnnnnnnnnnncgcgatgccggcgaacggcgacctgcatgccgccaccgacattcccgccctcttccaagggtatgccgcagacacggaggtggacgtcatcgacctgtgcgactgaaggctcgcttctgcagctcgtaacgtctgggccctctccttgctggtggttttctgagcccaaacgacagggtatgcacgttattgagggtacagggctgttgcatgccgggtcacgtcatcgcggcatnnnnnnnnnncccagcttgctgccccgctggcgatgccacctctcccactggtatgccccccccccccttgtcgcagacctttgagggatcgccactcgtccagcggctgcaacattgcgaggcggggcctgggcacccgctggcatgcgacccctggccccggcccctggtcggcnnnnnnnnnncggacgtcatcgatctgtgcgactgaaggctcgctcctgcagctcgtagcgtctgggccctcgccttgctggtggttttctgaacccaaacgacagggtattcatgttattgagagtacagggccgttgcatgccgggtcacgtcatcgcggcatgagggccagcagggtgccaatggccccccgccccgtcaccagctccaggagcaggacggagagtagcgccagcatggccagacggccgttccacgtctccgcggaccgcgtccagccccagacccagccgccgatgggggcgggcagctgccgcctgtcccggtcgtacgtctccagcagcgcatccagctcgcctggggagggagggattcggaggggcgggtgcacgctgcttggtacggctgggggggcatgtgtttgggcggggatggaggcacaggagggggtcgtgctgggtgacggcgcggctggccgcggctgggccgacgaattcgtcatcggagagacattctttgagacggaaaagggattcgttgcggcgctgatgctggcgcgggggcaaaaccatctcgaggatgaaagtacacatgggcgccccggtgggcccagggctgcgggggccccactggaccagccagcgggctgtcacaggggcccgccgccgccgtacgtggcggcggccnnnnnnnnnntgtgctgggtgacggcgcggctggccgcagccgggccgacgaattcgtcgtcgggaagccattctttgagacggagaggggattcgttgccgcgctgatgctggcgcgggggggaaaaccatctcgaggatgaaagcacacatgggcgcctcggtggggccggggctgcgagggccccactggaccagccagcgggccgtcacagggggccgccgccgccatacgtggcggcggcccacagcgcgctctgcagggcacccccacgggccgcgggccgccgagcatagcacgttgcagtggccaggctggcgaatccggggcctggggaattggacagcacgcgtcgcggnnnnnnnnnngaacaggtgatggtccatgcaggcattcctgagcacagactaccatgacacaccgaggccggatcgcgtgccgcgagcccagcggccagccacagcgcctgacnnnnnnnnnnggcccacagcgcgcgctgcagggcacccccgcgggccgcgggccgccgagcatagctcgttgcagtggccaggctggcgaatcccgagcctggggaattggacagcacgcgtcgcggcaaggaggggagcgggtgagggcatgcggcgctgaggtggtgggcgggggtcggtgggcggcgagcacaggcaaacaggtgatggtccacggaggcattcctgagcacagactaccatgatacaccaaggccggatcgcgtgccacgagcccagcggccagccacagcgcctgacaccgctggcgcccgctcctccctgccccacggctttgaaaacccttgctgcgccggccctcgggaccccaccctcccctcgccccggcccctccctcccacctcaccccacccctccggccctccccgtctcgactcacccatgggcaccagggcgtcaccaaccgcgctgccggccacggagccggcgtagggcagggcctccagcacggcatccgccaggtcggcgatgaagacggggttggtgttgagcgcaggcacgcggccccacgacttgatgcccacctcctctgccagctccctgtgtttcggaagggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnaagggcgcatgcaatacgaggccccccaaacccctcaaacacaccattccacccactctcgagccccnnnnnnnnnnggacgggcgcatgcaatgcgaggccccccaaacccttcaaacacaccattccacccactctcgagcaacaacccccccccccccccccccccccgttccccnnnnnnnnnnnnnnnnnnnnacctgtactccatgtcaatctcctctagcgtctcgatgtgctccgacacaaaggagatgggcaccgccagaaggccacgcacacggcgctcgcccaagtaccggatggcgtcgtcggtgtaggggcgcagccactgcaccggccccacccgcgactggtaggccagcgtgtgcgtgttgcgcaccccccgcgccgccagctccgtcatgatcagcgccacgcactgctccatttcctccttgtacgggtcgcctggaggttttggtgaggaccaggaggagtggggcaagggggtttgagatgcaagccgatggaatgagggaaagaggnnnnnnnnnngttggtgaggacaggaggagtggggcaaggggggctgggatgcaagccgatggaatgagggaaagaggaccggggatcaagagcaccacccgtgcacatgggcatgcacccagagggttggccgcccaccctcgccccatccccattgcaactccctactcccttgatgctccatacccctccatccacccaggcccactgccccatcctccccctgattccacccaccctcgtcgacgtaggactggggcacgccgtgggcggagaagaagatctccacgccgtcggcctcggccgggaagcgcgccagctcggcctggatgaggtcgcaggaggcggcgacgtagccggggcgcgcgtaccaggaggggatgaccacgtggcgcgccgctgccagctgcgcgtcctcgcgcagtaggcgctccagcaggcgcagggaggagccggaggtggagacggagaactgcgggtacagcggcagcaccaccagcttgttgatgcggtcggccttcagggctgccaccgcctgctccgtggtgggcgcccagtagcgcatggccacgtaggcgcgggcgggcaccgcgcggtctgccagcgcccccgccagcgcgtcggcctgctcctgggtgatggcgcggaggggggacccgccgccgatggccgcgtagccgcgccgcgacttgggggcgcgcagcgtgctgatgagccaggccacggcgggctgcagccagcgcgccgcgggcggcaggcggatgatgtcagggtcggcaaacaggttgtacaggaaggggcgcacgtcctccagggtctcgggcccgcccaggtttaggagcaggacccccacccggtccgtgtcggggtcgtagccggggatgggccgggcggggccggggctgcgcagagtggggggggggacctccgtggcgcggtcgggggtggccaccgcgcgggaggtggatgtccgctgccaggactgggcagcgcagggccggtggacgttgtatctgagctcgggcgtgagggagggaaggggggtcgtgggaggagggactgagggagacatgagcatcgcgactggcgctgagcaaaatgcggtcgagggtgccctccccgaccaccctccaacgggtcatggacgcacctatgcaccagggatgggcgggccagtggcctgtacgaagtcgatggggggcagtccacatgctggagggcgctcacactcactgccctcatggcgtcgaccaagtggagggggggcccgcaccaagcgcacgccaatggcacagcacacagcaggattataactctccttttatcgcatggaatgtagcaaaaatgtgctcgtaaaggaagggcgtcatgtggtgtcgcgtgtgagctcactgcataaggccggagctgaaggaccacacaccccggaaggaacaagaaacatggaatattggggtttcgggctgctattctactttttgtgggtaaaactgggcccagaaacggcctttatgctcatctggaacgggtaaagcatgcagactggccacccactgttcctgccatgtgtccagtctggaagggtggcgctagctcctccaggtgcaatcaggatggcacaagcactcgttgaatcacttgcatggtttttcctgatgcaaaggtgtacctggcatttgtagcagtctcaaattactttcacacactcaaaaagcaaaaagaaattagcaggcttgcgccttaaccactcggccacgttgtcaagcggaatcgacaacggcaggattcgaacctgcgcccctttcgggacaaactgaatgccaaactgagtcatggtgtgagggccatttcttgcctactatgtaggttaatattcatcttggatattgtagtcatgaagctcgcaagagtcaatgtggtggaaaatgatcggatgtatgctctgaaatcactacaacagtcataaggtcacatctgcgacacatgttgttctgatgcactgtatgcacaacccaannnnnnnnnnagccatttcttgcctactatgtaggttacatttcatcttggattctgtagtcgtgaagctcgcaagagtcagtgaggtggaaaatgatcggatgtatgctctcaaatcactgcaacattcataaggtcacatctgcgacacattttgttctgatgcactgtatgcacaacccaaccgctgagggcaccgactctcacaatacgacctgtgccttgcttcagcttgtagaagatcaaggttgatctggacctgttgagtaagcatctgactcgaaaattctcacttcctaggatattcaagcatgaggcnnnnnnnnnntactctcacaatacgaactgtgccttgcttcagcttgtagaaaatcaaggttgatctggacctgttgagtgagcatctgactcgaaaatcctcacttcctaggatattcaagcatgaggcggagttatgttttgagcgtctttcatattgtggcaaccaacaagtgccacatgaacttgagaatggtgggctgaggaccactgactcacctctagtggacagtctactcagagaaagaggtggcgtgttcctgggccacctccacattggagatccaaccccggccatttcctcacgaaggcacccccacccacatacttgggttgtcaagtcacgatagtatctcatggcaaaaggcaaaagagaggtgtttgccgaggcgtgagagccgtgtatactaaccacctatacgatatgcgatcgtatcgtttggaacattcgcatacggggactcgaaccccggtcccacgggttatcctcctcgagatcggatgacgggaagcaataaattagggtatatcaatcccggaagatatgccccatccttatccttcagatttccagggtgtcggacatcgggcgccggagctgggcatgtattggcctggactggctcgtggaggagtgtagtcgatcgccctcgcattccctgctcacctgtgctcgacaaggcgcagccatggcgtccgtgtctgcctccctcatctcccggccgtcgcccacgctcctcttccaaggtcgggcctgagggagactcggtgcaatgcccccccccacccaatgcaccggccccacccccttccctcttcaccccttcccctccccaccctccacatccaatcagggaggagccggctccgcccctcgccccgggcccggcccaccccggcccaggccttcatcctgttcgacctggtggccagctctgccgccgcggcggcggtcaccgcggtgtcctgggccacctccgaggaccgcgacgcggagctggcgcggctgcagaccgccgccggcgtggtgccgctggcggccgccgtggccgccgacaccgtggtccatgccacgcccctgctcggctccctgatcaacctggcggtggagccgctgggcgcggcggcgggcgtggcctacctcatgtccatcgtgctctcctcccccgccgtggaccccaagacgctggcaccccgtggcaccgtcctggcagcggagaaggcgggggacgcccgtggatcgctgcgcgtgcccttcacccgcgtcatccccaccgccctggcggtggtggacaccagcaacgccggcagcagcggcgcggggtggcaggcgggggcgggcgagctgccgcggctccccctcaactccgtgctggtggtggtcggcgtgggggcggtcatcctggagactctggcgcacctgcccctcctctccaccggcctcccacgcgtcctgcaggtgatgggaggaggtgctgtgttcctttgctgtgtgtgttgtggggtgtggtggggtggggagctgcgctgctgctgcaggtggcggaggaatactctgctgaccatcggcgtgcactgggcgactgagagtgtgcatggtgttccactccgccagcagcatgcatcatgctgctggggcatgaaggagtgnnnnnnnnnntatatgctgtgttcctttgctgtgtgcggtgtggggtgtggtggggtggggagctgcgctgctactgcaggtggctgaggaatactctgctgaccaaacggcgtgcactgggcgactgagggagtgcatggtgtttcactccgccagtagcttgcatcatgctgctggggcatgaaggagtggtggcctgcagcaatggaccttgcgtgtctgcgccgcacttttcatgcctcagcctgacccatcccttgctcaactccatccctcagaccgctgcctgggtggcggcagcgggagcggtgctcgacaagcgcgacgactgaggggccgatgtccatttcagtccctgtgtctctggagcgagcccaggccaagttgccaagatgcagctgctgctatttgcgacacccccttccctttgcctgtccagggcggtccctggtgcctcccccgaacaatgtgtgcctctgctgcaatgccgcatgccccgtcccatggcaggggccgggacgcagtggagagtgtacagagagcggcagcgaggtcgtgggcaggcagccctgcgctcgccgtcggtctccatgggagaggcgccctcgagtcgcagtgcacccccccgccagccagccagccagccagcccgcatctaggcnnnnnnnnnnatgcgctcgccgtcggtctccatgggaaaggtgccctcgagtcgcagtacatccccccgccagccagccagccagcccgcatctaggccccgcccccctgctctgactcgaggtgcacgaaggacaccagccccgccccggccgccgcgcagatggcggggtcggcgcaggtcggcccgccgtcggcgaacgccgcgccggtcgcctgcagcagatcgcgcgtctcgcagtccgtgccgggcttgagcacgaagagctcgcgcagctcctcccgcgagaactgcgcgccctcggggccccgcccgccgccgcccgcgccgccggccgccccgccctgcacgcccgccgccatgtcgccctnnnnnnnnnnttcccgcgagaactgcgcgccctcggccccccgcccgccgccccccgcgccgccggccgcctcgccctgcacgcccgccgccatgtcgccctnnnnnnnnnngggttttgtgtttggcgtggagcgatgtgacagggcaggagtgaggggaactcagtgtgtgatggcaggcgcagatattccatnnnnnnnnnntcatgcgctgccgctggtacatcttctcgtcgatcgtgcctggcttgggtgaggtttcgtgtttggcgtggagcgatgtgacaggcaggagtgaggggaacttagtgtgtgatggcaggcgcagatattccatgggcgtgcctgggggcagtgtctgggccataccgccggcgagtctatcgggtacctctcgcagaaggtcccacatcaaacctggggacatcannnnnnnnnngtggggcgtgtgccatcgtcaggacggagcagttgtcggtgcactgctcgactcggacgcatcgcccaatcagggcacagcatggagcgtccatgcagcaggcttttcgtttgcacacnnnnnnnnnncctgggccataccgccggcgagtctattggatacctcttgcggaaggtcccacatcaaacctggggacatcaacccagtggtccgcagccactcaaacctcagcattccaccgccccaaacctcctaccgccacacccctcgccgacctgtggtgagcaggcggtacacggtgcacgccttcttctggccgtccctccagatgcgcgccatcgcctgccggtccatggccggattcctggccagggatgggcgtgtgccacggtcaggacggagctgttgtcgttgcactgctcaactcagacgcattacccaattgagggccaacatggagtgtccatgcagcaggcttttcgtttgcacactgcccctcaaaactgccaagagcacgaccacccgtccagcatgccgccacgcccccttgctgtcctcgtttcctttcctccgttgttgtcttcacccatccacatcacctcccccagcccctctcaaccccccctca

SEQ ID NO: 46405 - DNA, 61 bp, Chlorella protothecoides
ttcatgggcaggcagggtgcaagatgggggtggggtgagagccagcacccacccatgccag

SEQ ID NO: 46406 - DNA, 11032 bp, Chlorella protothecoides
  modified_base (541)..(550): a, c, t, g, unknown or other
  modified_base (846)..(855): a, c, t, g, unknown or other
  modified_base (1555)..(1564): a, c, t, g, unknown or other
  modified_base (2039)..(2048): a, c, t, g, unknown or other
  modified_base (2186)..(2195): a, c, t, g, unknown or other
  modified_base (2473)..(2482): a, c, t, g, unknown or other
  modified_base (3581)..(3590): a, c, t, g, unknown or other
  modified_base (4280)..(4508): a, c, t, g, unknown or other
  modified_base (5391)..(5400): a, c, t, g, unknown or other
  modified_base (6806)..(6815): a, c, t, g, unknown or other
  modified_base (6867)..(6876): a, c, t, g, unknown or other
  modified_base (6928)..(6937): a, c, t, g, unknown or other
  modified_base (7112)..(7142): a, c, t, g, unknown or other
  modified_base (7910)..(8000): a, c, t, g, unknown or other
  modified_base (9108)..(9117): a, c, t, g, unknown or other
  modified_base (9461)..(9470): a, c, t, g, unknown or other
  modified_base (9559)..(9601): a, c, t, g, unknown or other
  modified_base (9674)..(9683): a, c, t, g, unknown or other
  modified_base (9776)..(9785): a, c, t, g, unknown or other
  modified_base (10849)..(10858): a, c, t, g, unknown or other
cccccctcctttcctcccggtcccaccgtcgatgaggtggcgcagctggcgggggagcatggccctgcccagggccgagatgccggaccgcatcgccgccagcatgctgccgccgcgcgagcgttctgtggccgaggaggaggacggctccgaggccctgctcgccgttcggtggtgttggggctgtgagggcgagcctgcacggctgggcgacggcgccggtggccgctggtgctgcttctccgtcgctagctgctgcgacggcagcggaccgcccgcctctggtgccccttccccaggctccttcgcagccggccggggctcagcagcggccacctaggagttgtatgcaggagactggcgtcagagcgcagttatgagtgaagctggctgggtgtaagggctgtggcagggtctggcgcagaggctgttcatcgcacacgtcccaaccgttctcccacacatcccaaccttcggtccccgcgccctgccgacccaagattcaagcaggacagacgacacaagtaagggctgcacccannnnnnnnnnaggtctggcgcagaggctgtccatcgcagacgtcccaaccgttcacctacacatcccaaccttcggttcccgcgccatgccgacccaagattcaagcagacagacgacacaagtaagggctgcacccaaggcacacggtcgcacttgagggctctgggcttcgcgcccggggcgcagggggctgggcgccggtggttgcagggggatctgggctgcggccgctccctcccagagcccatcgaagagcgaggtggagaagaggtccccgtccgcccagtcgaacagctcgaaggggnnnnnnnnnnggggggctgggcgccggtgggtgcagggggacctgggctgcggccgctccctcccagagcccgtcgaagagcgaggtggagaagaggtcgccgtccgcccagtcgaacagctcgaaggggtgctgcggggaggacgctgccggctccgaggccgcggccaagcccggctcctgcacgggtggcgcagggcctggcgaggggccccgcccggactcagagtccagctcttccccggtgcccaccccggatttgctcaggccctgcagcatctcctgcgccgcctggatgaggtcgaaccccgcgatggccccctcagaggcacgctcgcgagccagggagagcagcgtcttggtgagggcctggaggtggtgcggctccaggccctgggcgtccttgagcctgagctccacggctccatcggggtaggcagtggggtagctgggagtgtgtaatgggggccaacggtcagctgggcatggaacgaggaaggggaaggaggcaggtgcggtgcgcaagcaagaagcggcgcccgtgcattcagtgccgacctcgcccaaaaccccatgcggcgagggtcccgagactcgcctgacgatgaggcgcagggacacggtgttcactgccgcctgccccggatggggtactatgaccagggagaaccccatgctgtcggcatggggcaccaggtcctccccgtatnnnnnnnnnncggtactatgaccagggagaaccccatgctatcggcatggggcaccaggtcctccccgtatattgcctgcagggccagcaactcctcggcgacatccccactcggctctcgatcccgccgccgggcacgggccctgcccttgcgcttcttggacatgacgtcacatggattacaggcattgggtggtcaagagggcagggactctggtcatcactgtactggccaacagggtgcacgcggtattcgcgcgcgcgccggtacgtgggctgtttcggccgacgagcggccagagccggtgtaacaatgcccctccttgcacggcttgcggtccagaggaacacatcagacatcccgaggctggcccggcaaaggcacagagggtcacaagggcgcatgcagcagggctgtcgagaagcgcgcgggcgtgcaagcccgccagggtgtccatctttgcaggggagtgagaggcctcggnnnnnnnnnntacatcagacatcccgaggctgggcccggcaaagtcacagagggtcgcaagggcgcatgcagcagggctgtcgagacgcgcgcgggcgtgcaggcccgccagggttaccatctttgcaggggagtgagaggcctcggnnnnnnnnnnggtgtggtattgtgtgcttgtggggaggaaaggggggggggcgggaggagagtggtactggcacgctgcgccagggtgcgtggaggcggtgcaggaggtgtgcggctgcgcagcgggacggcgctggctcacagcaggccagcctcatcgcaccggagatcgactgctagaggcgccaccgcgccggcgtttcctagttgccacgcaccgctccttgccgcccgctttcaggtcccgcgacgacgcggagctggacggcgcggcgcgcgccgcgctgnnnnnnnnnnggcccccaccctcccagcagcacagccctcacatgtcctcctgcgcccactggaaggcctcctgcccgcgtctcttcagctcgttcctgcgcttgaacatgtccacctcaaagccgttggagcggtccacgccgtcccagtgccgcccgggccggatgccgtaccggttgggcggcgggcccaggccgcggcgcagccaggagtggggcggcacctcctggggcaccaggaagccggagccctgcagcgccgcgtccagggcgggggcaagggcttccaggtcggcggcgccgcgcttgaccaggtgcgccatggggtccccccaccgcagcgcggcgcgcgccgcgccgtccagctcggcgtcgtcgcgggacctgacagtgggcggcaaggggtggtgcgtgacgactgggaaacgccggcgcggtggcgcctcaggcagtcgttctccggtgcgatgaggctggcctgctgtgagccagcgccgtcacgctgcgcagccgcacacctcctgcactgactccatgcaccctggcgcagcgtgccagtaccactctcctcccccccctccccttcctccccacaagcacacaataccacacaaccaggccctcacctggcaaagggcttggaggcctcctcgcgcatcgcccgcgcccgctcctccgcctcctgccgctgcttcaggccgccgccccaggccaggctgccctcctcctcgtactccgccttcctccgcgccttctgctgtccctccacgaactcctcccgcgtcacccgtgtccccgtggcgtcgcggtacacggtctgcgcgccgcgcccgctggcatcctcgcccatggccgcgaaacgccgcgcctccgcctcccgcttcagcgccatctcgtgcgccacgtcacgccctgagcccagcggttggaaagggtggcgttggacgcggttgtgggatcccaagtgccatgcgtcgcagtcaggagtccagacacggtacccaagtataaagtggggtgatcccggtgggcctgtgcatctggaatcaaggtacaaactcccaggtcgaagtcccaaccctcacgcgcagcccagtacacacctgacnnnnnnnnnnggcccagcggttggaaagggtggcgttgggcgcggttgtgggttcccgagtgccatgcgtcccagtcaggagtccagacacggtacccaagaataaagtgaggtgatcccggtgggcctgtgcatctggaactcaggtacaaactcccaggtcgaagtcccagccctcacgcgcagcccagtacacacctgacaccatgccagcccgagtgccatctgacatcttgtgtgcacccggctcctcctgatggggcccagaagcgccagattgtcgagggcgttgctgcaggcgggaactctcccggccaggcagcatgggcaaagaaggatccccccggctccccaggcccgtcctccttggaggtgaggcgtctgggctgtcgcgccttgctgctgctctcctcggaggagaagcgtctgggctgttatgcctcactactcttctccttggaggagaagcgtctgggctgtcgtgcctccctgctgctctcctcggaggagaggcgtctgggctgtcgtgcctccctgctgctctcctcggaggagaagcgtctgggctgttatgcctcactactcttctccttggaggagaagcgtctgggctgtcgtgcctccctgctgctctcctcggaggcgaggcgtctgggctgtcatgcctcgctactcttctccttggaggagaagcgtctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctactctactccttggaggtgaggcgtcagggctttcgtgccttgcaggtcgtctccttggaggagaactgtctgcagcggcgccgcccgccgcagcattgatggcttgccagccactgccatccccagcttgctcgtagaagttacgctcctgttctgcaatcctctgcaggcgagcggcttcctcgggatttgcaatcacaggaccctctgttcagatgggagggcgaaggtggatgctggactcggtaggaccgcgatggtcggtctgtgcaagatccttaacaaccagatgacgctgcaggtgtatcaaggcaagccttaccctccaagctcaccctcctcgtcgatggcctcctccgccggttcgtcgctgtcataggtcggcctcataggacccggggcagccccttctcccgtcaggtcatgataacccgtgacatccaggtccacaacacggacggcgctggccgatggggcagccttcttcttcttcttcttgcgcggcttctcagccgccccattacttccagctccgtatttctgggccaggtattggttgagggctttggacgcctccgtctcctccctcggcctctcttccttcttccggagcgagctcaggcccgtaaacacggaggccatgtcgacgccacgaccgagcaggccgatgcctgaatcagggtgccattgtgtgcattttcaagaggaataaaagtgtcagaactcagcaatgatgtagagggtacggcctgcatcgagtacggaagactccatcgcgccttgctcaaggcgatcttggggtcccccaaagaatgtcacatctggtgatgaatcaactgagaatctgcccacagtactgattgtgtttacataagggannnnnnnnnncccctcaaagaatgtcacatctggtgatgaatcacctgagaacctgtccacagtactgattgtgtttacataagggattgtatgaagggttgtttgacgttccaccaaaaattgcgacggcgcagcctggcttcccaggacggtgtacaggaggggcccatgacttgggtacagtatggcacatgtggaagctcaatccaggcggctcatgccgccaggacggcaggcctgtacaccaaggagcgtcctgcttctgcatttgccgcgaaaccctggctgtcaggggtccccgagcctcccggccccccctgcatcatcagcaagagggctgtgcaggagggggcggggtggtctccgcggccctcgcgccgtagcaccaccgccttggcccccagcccgtccgcccggctcgtggagctgagaccgtggaactccgccaggctgtgacagaggaggcgcccgaagctatccagcccctcaaacacaagctcgtccccggcgccgggctgggccaggaagccaccgatgctgtcctccatgtcggccaccacggcggccgccacgggctggcgcagcgcagccctgccgcgccgcgcgaccctgcaccaggcgcgctggcccgcaccctgcacgctgagccggggctcgccggcctcgccgtcgtcgcgggcggcgcctgcctctgccagcgacgctagcaggtccgcctgggtgtcggggtccaggctgcgcagggactcgcgcaacgccccgtatcgctcctccgccagcgtctcccagaccgtgggtgggcgcggcgcgccaaagggcaccggcttgaaaaggccctcgatgtcggccgcggtcagccgccccgccagggccaggagcaggcggttgttcagccagcgccgctgccgtctctgaccaatcctctgcagcgcgtccagctcggggatggaggggggctgggagccggaggtggtgagccagtcggacacccattcgcgggagggggcctgcggcttgctgcgcttgggccgggtcacaggctcctcggcgcgcatgaaggcggccagggatgtgccatccggcatgatgaaaggaccacgaggcacccgccgtggggtctccatggtgcgcgacggaagggcctggagaggcaggctgaagcgagtaactggtggctgggctagtgacgaaacggggtgcttgaccttgatcaactgccctacacggcggtgctcgtacgttgttgcactgaacgctgggagattgaccatccttccgccagatatgttgtcgggaggtgcacctgcattccagctgggtccgacatgtcgggagaagaaagtcggagttctccaagggccctcccgatcccgtcatgcaccttccccacccgccgcgcacacatgcgctcaacnnnnnnnnnnggcctgggaatcctaggggcctgtgcacgggtggcagatcgccatcatggannnnnnnnnnagcctgggattcctaggggcttgtgcacgggtggcagatcgccatcatggannnnnnnnnngtgggtccgatatgtcgggagaagaaaggcggagttctcccagggccctcccgatcccgtcatgcacctaccccacccgccgcgcacacatgcgctcaacaccttgagctcgtcctggaggattgacagattcaaattacgcagtggctgcgagtatcaagtgatcagaatctgnnnnnnnnnnnnnnnnnnnnnnnnnnnnnnncttccttgcaggtgtgatcagattctatatcaagtaaaaggaggtatacagactgcttcatcccctcccggattcctcgggagcttccgcaagggtggctcatttcggtagtgaccttacctggcacccctcccaccccctttctcaggactccgcggcaaggactttgtgatggtgtgcagcgatacaaatgcggcgcaaagtatagtgaccatgaagtcggatgaggacaagctggtcccgatagactcccacaagctgttcgcgatcagtggcgaggcgggtgaccgtgtcaacttcagcgagttcgtgatcgccaacgtgcgcctgtatgccctcaggaatggcatccctctcagcaccaaggcggtggcgaacttcacgagaggggagctggccacggcgctgcgcaaggtgggtcacccaggaggcgtgcggatcccacccgtgtgcgggagttgctggagcacaggagcatgctgtctcaccaggaccctttgcagacaccatggagtccatcaggggctaccaggagccatggtgcatgcccctgggagccatggtgcctgatgcatgaccaagtctccggaggaaccacagtctctcaacaccgtcctttcctcctctctatagtccccataccagaccaacttgctcctcgcgggctttgatgcatcgacagggccagccctgtactggctcgattacctggcgacgctgcaccagacaaatgtctgtggttcaggctacggtgagttcgattccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaccacactgcatccaatcctggcgtggggagcgcacggaatcattcagcagccacatcagactgatccccgtaccacccttatgcccaggctcctactttgttctctctctattcgatcggctctggcgccccgacctcacacaagaggaggcctttgagctgatgcgcaagggtgagtcttttgtgcacggactgcggcatttttgcagttggaggacctgcatgtttcaagtgccaggcagtttctcgaaattgggcacctgttgggttaaaccattctccacaataccctgcaggagtggatgaggtgaaggcgcggctggtagtatcaccttccgccttcattgtcaaggtcattgacaaggacggcacgcgagtgctgggaaccctgtgattggtgaccatgaggatgcaggaaagcttgtaatgtatagagcagttgccttggagaagctattcgagtaagaagtaaactggaaaattgttgccggaagaactcttttgctgtccatctctgttggagtatttttggaccattggacactcggtacgcttgggagtccagcaggacgaatgcctcgttggaaaattgaaaaatctgggccgctccgcttcgacccgggcctagcgaacgcacaggagcaatggcacttgggcctgcgcgcatcctacccgactcaccattcccagctcccttgtcgcatctactcaccctggtgactatagtcgtgtctgtgagcctcactgtattgagctggacctgtatggaggtgatgtaacggtcctccggcttcaaaccaggacgctcggggtatcttcccccgcgattcatcaaggtatgcgtgtaaaccgccgcgcagcgtgggctgtgcctttgtaatgatgataccaatctgtgcgttgcattgctggggttcccctggaagcggtcttgcctgtcgcaactggcatttcgagtgccaggggagcgagtcgcgactgccgacccgtcattcccacccatgcccgcatccaacaacctcgcagcctaagccccgccacaccttttttctgtgacattttgagcgacaggccctttgcctgcatccggcggaagtgcgaccnnnnnnnnnnccagcctaggccccgccacaccttttttctgtgacaatttgagcgacaggtcctttgcctgcatccggcggaagtgcgacccggtcgcgaggctccatgggagacgcgtatggctggcccatgcccggccaacccggcatgcatgccgactacctgccgccccagtttgacaccaggcaggccgactttaagcgtcacatgggacagaggtgggtgtgccggggatggatttgggtgcatgccgtgcatgcccctgccggggtcccatgtgacggggctctttgcagcctcaccggaccttccccccctccttgcagacccctgacggcggtggacatgcgccnnnnnnnnnntgccggggtcccatgtgacggggttctttgcagcctcaccggaccttcccccctcctcgcagacccctgacggcggtggacatgcgccnnnnnnnnnnnnnnnnnnnnnnnnnnnnnnnnnnnnnnnnnnntagggcagttgcccgtggattttggggtctggcctgcgcccaaagtcccgctgtgtcgcacgaagtcttccannnnnnnnnnggccgggtttcatcccagcgcaggaaacctcgccgcctgtctcacccccggcacatccagggctcctgctcctgtccccaccctcatgttggnnnnnnnnnnagctgtcccaggccctcatcgacgcgagggaggggacgggcgaggtccgctccgtcctgctgcgcgcctcttttaagccccgtctgccaggtgcgtggacagggcggttgcccgtggatttgggggtctggcctgcgccccaagtcccgctgtgtcgcacgaagtcttccacaatctgtcctcctacgacagcctgccccctgcacaacctcgtaccccccccgtcttaccaggcctcactaagatggtcagcaagctgagcaaggagggggcctggcgcaaggcgctggaggtgtacgagacggtggaggacctgggcctgatcccggacaccgccctcaccaactcggccatcagcgcgtgcgacaagggcgggcgctggcagaaggtgagcacggtggtgacatgaggtggaggggtgtgtttacccgggacaggtcgctgtccatccagccgggtttcatcccagcgcagaaaacctcgccgcctgtctcaactccggcatatccagaactcctgctcctgtccccaccctcatgttggcttagaagatccattcctatcacaagcctctcccctactcaccccccccacccccccacacaaaggcgctggaggtatttgagagcatggagcggctgggcctgccgcgcgacgccatcacctactcggccaccatctcctcgctggccaagggcaagcagtggcatgccgcgctgcaggtgttcaaccacatgcgcgacgcgggggtgcccgccgatgtcgtcacctgctgcagcctgatcaacgcgctggagcgcggcgggcagtggcagctggcggaggccctcttcctgcagatgtgctgtgtggccaaggacgccgaggtgggggtggtggcgcccaggaaggacggcaaggaggagggcaaggcgggggaggtgtcgccttcatccgtcttcgacctcctccgcgtcctgcccccgcccggcgaggacgcgccgggcgggggggaggaggtgcgggacgccggcgcgcccgcgggggagggcgtgccggggggggagccgtccgacgggacggcnnnnnnnnnnggaggtgcgggatgccggcgcgcccgcgggggagggcgcgccggggggggagccgtccgacgggacggcggaccggctgctggccgacggggaggagctggcctcccgcctgcgcagctccctgagcctgggcgacgtcgagcgtgcgacgctgggcgtgccgggggctgggcc

SEQ ID NO: 46407 - DNA, 76 bp, Chlorella protothecoides
gactttgtcgtcgcctacctggacgacatcctagtctactcccgggacatggagacccatctgatccacctgcgcg

SEQ ID NO: 46408 - DNA, 76 bp, Chlorella protothecoides
aaagagcgactccgaatcggcgcatggaaaccttgcatggattttaaagcccctgtgtgagctgcaacttgcagta

SEQ ID NO: 46409 - DNA, 74 bp, Chlorella protothecoides
ggcagtatccccatgaagggccatgcccccacgaccccccccctaaacaggcttgcagagcccggtgaggtgct

SEQ ID NO: 46410 - DNA, 10581 bp, Chlorella protothecoides
  modified_base (177)..(236): a, c, t, g, unknown or other
  modified_base (792)..(801): a, c, t, g, unknown or other
  modified_base (969)..(978): a, c, t, g, unknown or other
  modified_base (1274)..(1283): a, c, t, g, unknown or other
  modified_base (1425)..(1434): a, c, t, g, unknown or other
  modified_base (1705)..(1714): a, c, t, g, unknown or other
  modified_base (2130)..(2139): a, c, t, g, unknown or other
  modified_base (2530)..(2539): a, c, t, g, unknown or other
  modified_base (2815)..(2824): a, c, t, g, unknown or other
  modified_base (3216)..(3225): a, c, t, g, unknown or other
  modified_base (4564)..(4573): a, c, t, g, unknown or other
  modified_base (5156)..(5165): a, c, t, g, unknown or other
  modified_base (5851)..(5860): a, c, t, g, unknown or other
  modified_base (6274)..(6442): a, c, t, g, unknown or other
  modified_base (6497)..(6506): a, c, t, g, unknown or other
  modified_base (6737)..(6746): a, c, t, g, unknown or other
  modified_base (7050)..(7059): a, c, t, g, unknown or other
  modified_base (7226)..(7235): a, c, t, g, unknown or other
  modified_base (7624)..(7633): a, c, t, g, unknown or other
  modified_base (7936)..(7945): a, c, t, g, unknown or other
  modified_base (10430)..(10439): a, c, t, g, unknown or other
cgcgcgcccccccccctcctcccccccgcccacctgcgtgtcggacaggtagcgctgctcgctgccttgggtcatggcgtccagagagcccatgccgcggtacctttttacgcgcacaccgtccacactcacgtactggcctgcgagggaggggcgggggggggggggggggggggnnnnnnnnnnnnnnnnnnnnnnnnnnnnnnnnnnnnnnnnnnnnnnnnnnnnnnnnnnnntgcgcgtcggggtgattgttcacggagacgcgaggagcctgcgatgcgactcggagcgcacgcccgaccccagccgtgcctgtgctggtcctccccccgccccaccttcaacccccgtgcccaggtaagccacccacccaccctcgattcctcgggtcacacacctggcgcctcctccgtgccggcaaagagggagccgcacatgacggtggaggcccccagggcgagggccttggtgatgtggcccccgttctgcacgccgccgtcggccaggacggggacgccaaactttgcggccacgcgtgcacactcgaagacggcctccgcctgtccgcggccgacggcgcacacctcctgcgtggtgcagatggagccggaacccatgccgacgcggagcgcgtcggcgcctgcctcgatcagctccaccacctgggagcgtgatgtgggtgcggggcggggagggggtgggtgacggtggggagggggcaggtgcggtggcggtggggaggggccccgtcccgtcgaatgcatgtacacatggggctggaggtcgtgnnnnnnnnnnccaggtgcggtggtggtggggaggggccctgtctcgtcggatgcatgtacacatggggctggaggtcggggttgtccgagtcagaggcggggactggaccgccacaactccctgctccacactcacacacacaccaactccacatcccctcactcatcccagagcacnnnnnnnnnnccttcctgatccacacacacacacacacacaccacctccacatcccctcactcatcccagagcacattcttcccccccagtgacaagagcccgcacctggaaggcgttgatcacgttgccggcgatgatctgcaggcccgggtgctcgcgcttgatgtgccgcagcatgtccagctggaagagggaccagccctgggaggagtcgatgaccaccacgtcgatcccggcctccctgcggaaggaaaatgggggggggtgaagggagatgggtgcacctgcctcagcgcacagagacnnnnnnnnnngaggaaaatggagggggggaaggggaatgggtgcacctgcctcagcgcacagagaccatggcatcacgccaggttgcgtcagcaagttggcacatttccgccttcggcgcccaactcacacaagctggcgcaaccgctcctnnnnnnnnnnggtttgcacatatccgccttcggcgcgcaactcacacaagctggcgcaaccgctccttgtcggagtcgcgggtgcccacggaggcgcccaccaggaggcggccgtcggaggagagggagggagcccctgtgcatggttgcagaaagggtggttggggaggggatggagaagcatcccaggcgccagggctgtgctccgggcctagtcacccttcggtgatagaacaccggtgccccgatgagcattggcatggggcagaccaggtggggannnnnnnnnnggccggggctgtgctccgggcctagtcacccttcagtgatagaacaccggtgccccgataagcattggcatggggcagaccaggtggggacctgactaccctgctgccccacttttgccattacacctccatgccctgcacatccccaaccacactgctcccttcccccgcccacctcgaggggggagctgtgcggcgcgcatgaggtcggcccgcgtgaacagacccgtgagctcccccgccgcattcacgatgggcaggtgccccttgcgggacgctgcgagtgcctctgcagccttggtggcatccagcgtgcctggaagggagatggtactgggatcaagaccacgaccttgcctttcaaagcaccaacgacacagtaagcgactcagtgtgccgactgcgccgtggccaannnnnnnnnnaatggtactgggatcaagaccacgacctcgcctttcaaagcaccaacggcacagtaagagactcagtgtgccgactgcgccgtggccaagatctgtgcatgagccaccgcaccttgcgaggcctctcccctcccccagcctccgcctcaccctcagcagcggtctgcacatccgtggtcatgatggccgacaggggggtggacaggtccctcaccagaccgtagtcgccgacgcacaccaggcctagcagcctggccccgacctgcatgaggttgcatggggattatggagatctgtggaccagggattctccacggctcaaggcatgccaccaacatcaacggtccaagttgcagggagtttggtggtctcaaccaatcccaccttgccnnnnnnnnnnagcctagcagcctggccccgacctgcatgggggtacatggggattatggagatttgtggaccagggattctccacggttcaaggcatgccacccacatcaacggtccaagatgcagggaatttggtggtctcaaccaatcccaccttgccagactcggtgatgcagacagagctggtgccagtggaggcctgcaggaggaaagacggtgggtggcagtgggcatgggttgcgtccgggccaaaactctcaagtcctcaaatcactggctggcgcannnnnnnnnngaagacggtaggtggcagtgggcatggattgagaccgggccaaaaatctcaagtcctcaaatcactggctggcgcaaccctgcacttcgtcatgcagccactggtgcacccatgtcaccttgagcgccagcaggtccttcacggtggctgtcggcggcagggtcgggggaatcagcacctgaccaggcacgtgcctcttggcgatgcagacctagaatgtggattggcagggcgcagcatggaccagaatggggtcaacaggtgctgcttgttcgctgccagggacaatgattagtcaaaatccctctgagcgcaacattgtgcccacagccctccgcacccacccagatgcactccctttatgcccagccgttgcacctatctcaccatgnnnnnnnnnnctgagcgcgacattgtgcccacagccctttacacccacacagatgcactcccttcatgcccagccgttgcacctatctcaccatgcgtcccaacgactctcacctgctcaacctggtgctccaccgagcagttgtagtggatgatgccgatgccaccgacctgaaggtagtgtgggtatggcgtgaacacagcggggcagtgctgtcgaccagatcaccacaggcaggggcgccagctgcctccaagtttgagcagcatgccaccctggcaggggctcacctcagccatggccaccgccatgccggcctccgtcacggtgtccattggagaggagaccaggggggtgcgcaggcggatgccgcgggtgagctgggtggagaggtctacctcgtgggccccaaaggtgattttccgggcgcccagaatcaggtcgtcataggtgcgcgtctgggttccagtggaaaacagctggagagccgtggagcctgcgggagcatcgagggtagactatttgtatctggattgtgctcggagggacacaaggagcacggggtcgccccgacgcacctcccatccatggctctatggcgtctgaggctgccatttgggccagctgcaagtataccacgtcgggactcgctctagtatctatgttgagcatacactgcattgccgcaccggcatggaggctctcaagtattgcagtcgtttacgaagtggatgtcgcgcgctggcacgctcgggccagcgcgccatcctgcttgacgctggcgctcaaaccgggagcgcagatgcatcacagcaccaggaggcacaacatgcttcaatggaaatcacgacctcgtcgattcattcacagctgcagcaggatagcacgcagctccgcctccccaacatgccgcctccccaggacgtcgcggggccacagcggcccctccaggagcacaccccgcccgtccaccgccacgctcccctccagctccccgaggcagacgtggaggacgtgggggtcacctccccaacccccctcctcgtgcacgacgctcaggtcctgccgcgcagccaggcacgaccgcactccttcactcgcgacggccccacgcagggcggccccgagcgagcccgccagctgcgctttggaggccaccgcctggaggcttcccaggacgcaggacttgaaggcggggagcgggaggggcaaaggggcgtcggaccccggcgctgccgcgcgcccggcggcctccgcctcggcagccgccgccagcgcggccaggccccggtcctgggccccaccgccggccagtgcactgtgcacgctgcgccacagggccgccgccnnnnnnnnnntgccgccagcgcggcaaggccccagtcctgggccccaccgccggccagtgcgctgtgcacgctgcgccacagggccgccgcctggcggcgctgcagctcgcggcgcaccgcctgcaggccccgcgcctcgccgcagccggcctggccatcgggcgaggaggttatggttgcggtgtgctcgccgaagatgtggagggggagcagttccactgtgtggcccagcagccctgtgtggaggcatgaggtgcagagagcacaggatcagggatgggagggggtgagtgggcagggtttggggcgcttacggttggagtgccagggtgggcatgtgtgtggggggctgcgacggttcaggacagcagaatcggagtacaagggagtggaagggcggtgcatgagtagggtcctcagagtgcccatgccgtcgtacatgtgtgccacgggtggcagaacaagtccattcctgcatcgagcctaggaactccatggaatcacccaagcccgggtgcgatgcgattacctgcatgcaccacaaccccccctcttgatcggactcgtctcaccgttggcggcgcgcctgagnnnnnnnnnncctccatagaatcacccaagcccgggtgcgaagcgatcacctgcatgcaccacagccccctccttgatcgaactcgtctcaccgttggcggcgcgcctgaggtgccagcagcccatgagctgccgcacctggtccaggtactctgcctccgccgcggcggggcccctcagcgcggccgccgcggagcgcagcctggcggccgccccccgcagcgcgccacgctttccagccagcgccagcgcccggtcccgggccatggcctgtatggcggcgcggcgcggcacgtgtgccactgacaggaattgcgccgcctccaccatgcccacgacatccacgatcacgtccagctcagcctgtttgacggtgggcatgcagggtctgcgggtgggggagtggggcgcaggggcacggggcgagccgggggcggcgtgcaggcagtgacccacttgatgaggggtccaaacgaggattgttgtgcccctcccaatccatttccccccggaaaaggagaaagatgatgtcacacgaaccttggcgtcctggagcttgtccagcacccgttggggcgtgatgggcttggcctgctcctggtccggcttcagaagaggatcgtcatccacctcgtcgtcctgaggtgcacggggtgcgggtgggtggctcctcaggtcccgtcctgcgcagccggnnnnnnnnnnctccggcttcagaagaggatcgtcctccacctcgtcgtcctgcggtgcacggggtgcgggtgggaggctcctcaggtcccgtcctgcgcagccggtggcgggcacccacccctcgcccagcaccctcccatacaacctacctcgtccctgggcctgccgatcccaggctccgccgctctgtacagattccacagctcctggttctccggtagcacctcaaggccatcctgcaggatggcctggacgcgctgggtgtgtggcagggccatgtcaaaagacatgttcggacacgaccactgggaagggaggtgtcagacacatgcaatcaaaagcatgatgccatcgccagcaatcgaattggtagctcgatgatccctcgctgcgcctgccatcgatcgccagcttttgcactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatagtccactagatcgctcgtcgtcccgtcgccatgaggctgctcatggctggnnnnnnnnnntccagcaatcgagctggtagctcggcgatccctcgctgtgcctgccatcgatcgccagcttttgcactccgagttcacattcacgggaaatccccgctccccgcctggtactgcgcaatccacccgataagggggaggggacgtcaccattccctgtcatgcaggactccaggcatggtgacaataccaagtctgtgaagagtacaacattctgacatcgaccccgggccnnnnnnnnnncccccccggggggcgggatttgctcacgctacgggcaccgtcccccttcctggcacactgccatcgacgcccttcgtcgaggccgcaaatggttcgtgcagtatccagcgcccggccccgcacctcgctggatgactggcagagcgatggcccctcactgggtggcatgctgggtggatcgtcgaatggtgcccgtgggtcgggctccgcaccgccccccatggaggtcaacgatgtgcctctaaactccgaggtaggtgtatgggacaccggagagcatccggaagcgctgcgatgggtatgnnnnnnnnnncgtcaacgatgtgcccctcaactccgaggtaggtgtatgggacaccgcagagcatccggaagcgctgcgatgggtatgcatggtgcaccgctgatgcagtagccatggcatgggtggtgggcaagagcagctgtgtgcagagctgcagccctgacatcatttcctcnnnnnnnnnntagtagccatggcatgggtggtgggaaagagtagctgtgcgcagagctgcagccctgacatcatttcctcttccaccgcaaatctcggcatctggacccccccctcaccccctcaccctgggcccctccttcgacgcaggccaagcaggactacaccaagctgcagtcccttctgaaggctggcgacttccagggcgcggacgacgagacgcgggcgctgctcatctccctggccgggcccgaggccaggcaccgcaactgggtgtactggtcggaagtggcggccatccccgaggccgacctgaagacggtagacgcgctgtggagcgcggcctccgggggtcgttttgggttcaccgctcagcgccaggtctggacgcagcaccggnnnnnnnnnntgcggcctccgggggtcgttttgggttcactgctcagcgccaggtctggacgcagcaccggcggcgctgggtggagttcttcaaggccatcaactgggtggcgggagagtacaacatgtacaggtgggtgtgctggtgggaccatggggtgtgtttgtgcgctgtgctgcctggcatgctcacagggataattggagggggggatcccagctgggtataccacgtgtctcatccagttgctgttgctctttggaaggggactgttaccctggtatatgcatgagcgtggcagactttatcacnnnnnnnnnnagtgtttgtgcgctgcgctgcctggcatgctcacaggaataattggaggaggggatcccagctgggtataccatgcgtctcatccagttgctgttgctcttcggaaggggactgttaccctgctatatgcatgagcgtggcagactttatcacacactccttttattgcgatactgtagctccgtcggagatattccagcccgttcatgccgtgcaccaggtccggtgtcaatgcgcccaactcgcatgatacaaccccccctacccgaatgcctgctcaggaaatggccccaggagttcatttacagcacagaggcctgcaagggacacctcccgctgaccaatgcactgcgtggcacgcggctcatggaggctctgttggagcacccggccattgcagggcccacgaaggagcgggcgggcgaggtggtgggaggaaacggcaccgaggcgcggacgcagggatccaagctcccagattggctttcctgaagtcttgtgtcccctccatctcatttcatgaagaaccaatcccctgctgactgtctgtgcgtcagtgttgtattttatcttcatactcagggaccccaaatctttgggattcgctgactgttaacacaggatcgacggcgtggacccagttgcaagcagccccggacccttactcagatcacttcaccgctccgcattaagcgtcacaagtttaaaaaaaggtgcacgcaggtccgcgggggggccgcggagccgcatcgtcggtgacatagcctgcatggggtcccccggggtcgagaaacgggggccgaaatcgaatccgagcgagcttcgctcgcccaacttgcggtcctaatccgtggacaccaccacaagatcacggactctagtcgtatccagacttggcgaataactttgagataaatagagtctgctcatgatgcatcggagcgcggatcggacctgagtaagaagtcggctgtcagacagcgggtcgctccattatcgggagtggctgtctccaatacgacatctccccacgcggcagggcccacattgctcaatggacacctcacttggacctagaagccacggattcccaagggtgggtcgcccatggggtctgcgcgtactggattcttccgaggcgcctggcgggtcacgtggcgcaactgatctggcttcttccctctctttgcagggcctgcgagtcctcctcgtcgaaaccgagcctgagctaggagccattgcatcgcagctcacgcagcatgagctcggttacacgggtaagggtcggctggcgcgtaggacatgggcgcaatacggggcggagcccgtgccatgtcatgcgaccgggtctgattctgtcccatcgatcgccggatcttcccccccacagtcacttcatgcactaaccttagcgacgccatggcctattcgacgaacgggccgcgtatatttgacgtcatcctcgcaaacgtgagtccccgctgtggtttgctccaccccgtgacggagcatgagggatcgtaacatggcgaccttgcacgaccccgccccacacatcaagggtgtgcctcgagccgctcgctgcttctattccattcccctccccttctctctgctttcccactccagggtgggctgttgagcgcagatgacaccacgggtaggtcctttgtggacgccttcttcgacgtccccatcgtggccatgtcggactcggctgaggccaccaaggaggcgatgcacgcagtggagctgggggcggtggacctgctgagcaagcccctgtccatgctgaagctgaagaacatctggcagcactccgtgcgcatggtgaggaggtggaggggtgggttggggtggggtggcatgggtgtgatactgcatcccatgcagcgtgctgcctgggcatggccgctcccccaccaggagcccttggtgttgccagcaccccaccaccaacccctccccttcacacccgcccccacagatgatggccactccccacctcctgcccgtggacgccatgtttgacacgtccatgctcacgctttcctcctgctccagcctggacctaccatgcacaccctccgcggaggacacccccctggccgacgtcttctcctcctccttctcggcggtggacttctccgacctgtccatggacctggacgtggtggagagcacggccagcttcgccatggaccagggcgtggagcgcaccggcggtgtcagctcccaggtcgggagcaagcgcgcgggcgcggcccagccctacacccgcccgcccctggccttcaagccctcctccttcggtcccctggtgcgccggggtctgttttcttcggggtgggggggccctgtcctggtgcagaggtcctctcagggctggtgcctgccgagcggctgcagtctctgcaagcgctccctccagggatgcgtggcacagccccaccctcacatccccagcccctcagtaggccagccnnnnnnnnnntggggtgggggggccctgtcccggtgcagaggtcctctcacggccggtgcctgctgagcggctgcagtctctgcaaacgctccctccagggatgcatggcacagccccaccttcacatccccagcccctcagtaggccagcc

SEQ ID NO: 46411 - DNA, 75 bp, Chlorella protothecoides
ggcgcgggtcgtccagcgcacttgcaaggcgccggcgcctagtcgctcgcggccaggcgctcgtcctcggcagcc

SEQ ID NO: 46412 - DNA, 65 bp, Chlorella protothecoides
gggggcggcggcagcgcggcctcgtacagcgagaagaggcgcgtgcggtacgtctcctctggggg

SEQ ID NO: 46413 - DNA, 76 bp, Chlorella protothecoides
agatgttgacctggacatccgatgatgacatgtattatgacggaagatagtaatagacggtacataagatatctat

SEQ ID NO: 46414 - DNA, 80 bp, Chlorella protothecoides
tgcccaggctgacgctggtcttgatgttcaagctagccccggcgttgaatttgtcggcatagatgtaggtagtggagggg

SEQ ID NO: 46415 - DNA, 70 bp, Chlorella protothecoides
gcccgcaggacatgtgggggttgagcactgcatgggctgtgggcaacatgaggccgattttgcagaggtc

SEQ ID NO: 46416 - DNA, 127 bp, Chlorella protothecoides
acatcttggtgacaaagcccgtggctgccaaccttgctgggtgatgactccgcccccaaagccttcaacactacacacctctcgcaggaaggaaaaccgagccttgtactctgcttgccaggcgatg

SEQ ID NO: 46417 - DNA, 72 bp, Chlorella protothecoides
cacttagagcggagggtggagaggtggggggtttaagggcttctctgagtggaaacggggggggtgggacta

SEQ ID NO: 46418 - DNA, 74 bp, Chlorella protothecoides
ggccgaggcccccgccacgatcagcttgggcctggcgcgcatcaggttgggaggagggtgtgggcagcatgggg

SEQ ID NO: 46419 - DNA, 61 bp, Chlorella protothecoides
aatcacagtgatggttgcacgggagccgtccggcggctacctggaggagcggctggagcgg

SEQ ID NO: 46420 - DNA, 61 bp, Chlorella protothecoides
gccaggggtactgccatcgtcgcatgtgcatcctcaagagagcaggctgccctgatgcagc

SEQ ID NO: 46421 - DNA, 97 bp, Chlorella protothecoides
gcccgtagtcgcccgttcgcgaggcctggttgtggcccttagagaatttggcaggcacggtctttcagctccaaggtgtgcccagataaggagcaga

SEQ ID NO: 46422 - DNA, 88 bp, Chlorella protothecoides
cgggggattgaggagactgaggtcggtgggatgacatgttgaaaagtggagcataagataaccgccacatgtcacggctacgtgttca

SEQ ID NO: 46423 - DNA, 71 bp, Chlorella protothecoides
tgctgcagcgttgcagtgatggctggtgtaccggtagtgttacagaattattcggcttgccttgacgggag

SEQ ID NO: 46424 - DNA, 78 bp, Chlorella protothecoides
tgctttgttcccagggtagaccctcgcatcccacactcgctcgcccatgcagccagtctgatcacaaaatccgcaagc

SEQ ID NO: 46425 - DNA, 84 bp, Chlorella protothecoides
gcagtgagtttggtgccctcaaacgaggctattgagaggatgccagtgcaagtttctccaccgtgagctgcacctcggaccggg

SEQ ID NO: 46426 - DNA, 61 bp, Chlorella protothecoides
actttgcgtccgcttgtgccctccctgcccacatgcctggccgcctcttctgtctcccacc

SEQ ID NO: 46427 - DNA, 73 bp, Chlorella protothecoides
ttccggggcaagaccgtggtcatcaagtacggcggggccgcaatgaaggaccccaccctcaaggtgagggggc

SEQ ID NO: 46428 - DNA, 72 bp, Chlorella protothecoides
ggctggcaaaggcgaggaaggtgcgcgctggtcggcggcgacgggagaggggaggagtgtgccgggtcgcac

SEQ ID NO: 46429 - DNA, 61 bp, Chlorella protothecoides
ggacgctcaccggcgccagatggagatatttgggcagaacccggaccgggtgatcgagggg

SEQ ID NO: 46430 - DNA, 115 bp, Chlorella protothecoides
gaagactctgacgaagtgttactcaagccacctgctggtctttggattttgagactcgaatagaactctgggtgtcctcctcacgctgttcgggcgttttgtatactttcactcc

SEQ ID NO: 46431 - DNA, 74 bp, Chlorella protothecoides
gaggttgcggaagcgatcaaggagcacacaccgcaccgtctccgcagagccgtgctggacgagcttcgatccct

SEQ ID NO: 46432 - DNA, 119 bp, Chlorella protothecoides
ggtcgtctgcggagattgtgtgtgggggggggtgggagaatcgatgggcatgcacttaaacatgtgtacaggaagggatgctatgcatgagccatgcgaaagggacctttgcgtgcatg

SEQ ID NO: 46433 - DNA, 61 bp, Chlorella protothecoides
gggatgcagcaggtcgggaccacaggggagtctctggctaatcactcaggagttgcatctt

SEQ ID NO: 46434 - DNA, 61 bp, Chlorella protothecoides
caaatttagagtgaaagcggatatggatgggcatggccaatacgagacaactacacggtaa

SEQ ID NO: 46435 - DNA, 61 bp, Chlorella protothecoides
atgggctgccgttcttgaggctggcgaggggaacggtttgatccaagcattctgtctcaga

SEQ ID NO: 46436 - DNA, 86 bp, Chlorella protothecoides
cagcgcctgctgccggatgtccagctgtgctcggcgaacctggaggaagtagggagtgggggggcagggacgatgttggcaggggt

SEQ ID NO: 46437 - DNA, 62 bp, Chlorella protothecoides
agctggacctgctcgtgaacagggctcaggcatgtgttgtgtgtgggggtcatgttggaaag

SEQ ID NO: 46438 - DNA, 62 bp, Chlorella protothecoides
agaggcaccacgctggccgaccgctgcccatgccctgctgtgatctggcgattcgcttcctg

SEQ ID NO: 46439 - DNA, 61 bp, Chlorella protothecoides
atctcactcatggaggcattgactgcaaattatggacctcggcaagcaaacgaagcacaca

SEQ ID NO: 46440 - DNA, 18080 bp, Chlorella protothecoides
  modified_base (197)..(206): a, c, t, g, unknown or other
  modified_base (591)..(600): a, c, t, g, unknown or other
  modified_base (1680)..(1689): a, c, t, g, unknown or other
  modified_base (1931)..(1940): a, c, t, g, unknown or other
  modified_base (2284)..(2293): a, c, t, g, unknown or other
  modified_base (4244)..(4253): a, c, t, g, unknown or other
  modified_base (4960)..(4969): a, c, t, g, unknown or other
  modified_base (5270)..(5279): a, c, t, g, unknown or other
  modified_base (5445)..(5454): a, c, t, g, unknown or other
  modified_base (6155)..(6164): a, c, t, g, unknown or other
  modified_base (7906)..(7915): a, c, t, g, unknown or other
  modified_base (8540)..(8549): a, c, t, g, unknown or other
  modified_base (9186)..(9195): a, c, t, g, unknown or other
  modified_base (9675)..(9684): a, c, t, g, unknown or other
  modified_base (10808)..(10817): a, c, t, g, unknown or other
  modified_base (11262)..(11271): a, c, t, g, unknown or other
  modified_base (12222)..(12231): a, c, t, g, unknown or other
  modified_base (12439)..(12448): a, c, t, g, unknown or other
  modified_base (14494)..(14503): a, c, t, g, unknown or other
  modified_base (14825)..(14834): a, c, t, g, unknown or other
  modified_base (15731)..(15740): a, c, t, g, unknown or other
  modified_base (16603)..(16612): a, c, t, g, unknown or other
  modified_base (17740)..(17749): a, c, t, g, unknown or other
  modified_base (17837)..(17846): a, c, t, g, unknown or other
gccgcccaggccacccgcacgtgcggcggcgagcacgccctccacgccgccgtgcgcggccagcaggcgggccgcacccaccgggccgacgccggggacgccggggatgttgtcgctggcgtccccgctcagcgccagcaggtccgcgtactggttggggcgcaggcccgggaagtcggcctcgaactcgggggcgnnnnnnnnnntgcgtattggtcggggcgcagacccgggaagtcggcctcgaactcgggggcggcgtacgcgagcaggccggagggggggccgccggggacgtacgcggccttgccgcgcggggcggggcgcagcagggtcagcccgggctgcaggagctggcggaagtcgccgtctggggaggcgatgcccaccgtcatcccgtcctgggccgatatggagtgggggaacagtaggtggagggacaggggggttgagcatgcggggtgcactggctcaccaggcaggccaaggactgcaagaaacacatcgatggccaaggcatccgcccgccgcccagatgacccgtaggcctgccgcatgcgagtgacctacacagcgccctccagtcaccannnnnnnnnnaatggccaaggcatgcgcccgccgcccagacgacccgcaggcctgccgcatgcaagtgacctacacagcgccctccagtcaccattccccctcgacacgctatgcccaccgccacacctggatgcccctgactgccaggctggcgatgacgtcgtctgcctccacgcccggcacgcagagcaccgggatgccgatctgcgcgagcagggagcgcagctgcggccccgcctgcttgatctccgggggcgtcgccttacggtgcgccttgtagtcggggtacatctggtgccggaagttcttgccggggaagtcgaagacggcggccacgtgcgtggcctgggggttgaggcgcagcaggcgccacagcatgcccaggaacaggtgcacggtggtggtgtcggtgccgtcgggggccttgagccgctccttgggcatggcgtggtgggagcggtagatccaggcatgcgcgtccgtgatgatcagatggcttggaggggtgtggagaggggagggactctcacaattctgatcggatccagatcaatagataggagggcggcatggcaccatatcctcaccgaccgagcgcactgccggtgccgtagcccgttgtggcgtagcaccggccgtgaggcacagcacggctagccttccaacatcgttgtatgacccttgtgcatggcagcaacatggggcgttgcagtccgcaaggctgggagtcctggcaataacttagttgcatcacgccttgggggtgctacccccatgcatctcagccaacgggctggtcagtcctcaggaatcaggactatataccctttgaattattgatcgcgtcataacaacgttagctgcattgtattcaggatacatgtgtggtgcatgccgagaccggaaatgggacgatcaagtcgagcgcgccctcagcagcaaggtttgctcccgccccgcgcaccgttaatgcgcgcaggaaggatctgctcgaactgtgcgcctacaaaacccccatcacatttctcctatcaacatccgggttcctacttgcacagcctcagctcacaccatgatcaagtgagcgcnnnnnnnnnnctcctgcgcgcaggaaggatccgctcaaagtgtgcacctacaaaaaccccattacatttctactatcaaacatccgggtttctacttgcgcaacctcagctcacaccatgatcaagtgagcgcagagttggtagggcaacggtttggggcaggtcgcttcgtctgtaccgaaccgttgcttattctcgctcatcctcatgtattttcgcatcttcacaggggagacgctccatgctgcgccnnnnnnnnnnggggtaggtcgcttcgtctgtaccgaaccgttacttatgctcactcatcctcatgtattttcgcaacttcacaggggagacgctccatgctgcgccagcgggtgctcctgcaaggagagctgcaagtgcggcgatgactgcaagtgctccagctgccccggcagcaagaaggaggtgagcgggagggacgggacaggccgatgatgctgtgctgtagattcgggtatgcgtttatcacgaggtcgctatcgtgccgtgccactccggacgaccagctttcctcaatcccctccctggccgactctcgtccatccccacctcctgttcagtgatacccctggaannnnnnnnnntttccggacgaccagctttcctcatccccctccctggccgactctcgtccatcccacctcctgttcagtgatacccctggaatgttctacaccgtgcatgaaatgtcgcgatgtgatttcttgagctgcatgtttcattatagctcgcatatgcagctgtatggcagtctgtaacaagggtagatcgaagcaccatggttcatgacgtggttgaacaaatatgatttgtgagtttctgatggtgagctgttttatttggagacactcctgagtcaagttataaacatgcaacaagaatgatcaaagggatatcatgggtttggagctgacttccatgtgtaggaagaatgcagatcagcaggccctcccccccccaacccccctcgcgccctgcgatgcagcagataaaccacagccaagcatccaattcggctttccatctttggccattacattggcatttgattctcagattacatattaactcctcaacctgaccctcgtgggccgcaggtgtcgctgtgtctcgtagccggggccaccgcactcgggggccatgtcggcatctccaggattgatgcgaccatccacctcgtacccattccgagtgttcactagcaacgccccatatacctgcaagtgggcccgcggggccccgcgacggcctccggggcccgctcatggaggagcacggcccagccaggcccgggcaaggccgagtggcagcgacggcatcgataccgatgtggaggccatgtttcgcaggagagagcaggattcaggcacaattcacattcagcccgacgtggaggggtccacggagcggatggacgcagacgatgctgcagatgctgctgtagtaggaagttccaacgaccttgaagaagctcaggcggcgctcccatccaccccgcgacccacaaaagcacgggcaccggcacgaacatcgaaggcagttgggagtcatcggcaggtggtgcgttggtctgtcctaggattaggtggggagaaccaagctcgactgcagcaatttgggactggctgcattgcctgcatggtctgctcgcggctacatcacacagcgtaaaaggagtgcccagtcagacttctttgcgctgccaccgcacagtcagcaaatgtggagatgaacatggtttggcggacgggccttaccagcatcggcgccctggtgggcgtggcgggcctcgccttcctcggccatcgcctgttcaaggcacaagcgcccaaggtccaagaagtgagtcggaaggaggggtggtggtagggggcctcatatggtgccctgtgacctctgcctggtggctcgcatcctcgacggaactcccttgctttggccgcttccccagcatgatcggatgtctttgctgctgcaccatgcccagcggccagcaccccgcatctgcgcctctggacccgacttgctgcccctcccccaccccctcccctgcccctcccacaggcgatgagtcagcggggccttgcccgtgagtcgcagcagcgcctggccgactacatgtccatcctgcgcggcagccagaccgccgacctgtccgccaagaacttaggggacgagggttttgcctacatcatcgacgccctggccttcaacgaggtgtgcctggccgccgacttcagcaagaatgggatcggcgcagtgggcgcgagccagctggcgacggtgctccccagcaacggcacgctgcgcacgctgctcctcgacaccaatgccgtcggcgacgagggggctgctgagctggcaaagtgcctcgtgggtgcgctgggatctgtgatgcgtggggtgctgtgtcccgtcggtggtgtgtcgtgccctgagcctgactggtcactctaccccgtcccttgcctgtgcaacctgtgagcaaggcaggatccgaggtgactctggagggatacttcatgcagaatgcannnnnnnnnncgtgcaacctgtgagcaaggcaggatgcgaggaaactctggagggatacttcatgcagaatgcaaaattcaacccccctctcacctccgagaatcatcgcattcgcacaccgttctccactgccaatgtacactctccacactcccacaggcaacgcctcgctcaagtcgatcaacctgagcgggaacaacattgggaacgtgggcgccgccgcgctggcggaggcgctgcgcagcaacaccacgctgcgcacgctggagctggggtccaacgtgatcgatcctgccggggtcaagctgctggcagaagcgctggaggtgaacaccgggctgcgagccctgacgctaagcgacaactacctgggggcggagggggtggagaccctggcggcggccctgcgcagcaacaccgcggtgcaggagctgcacctgaagggcaacgaggtgggggacgccggggtaaaggccctgtgcgccgcgctcgagggccgtaaggaatcaggtggggtttgggcagggcttgagggaagggcctgtctgccgtgagtgggcgaggaaggcgaggctcatgcgagagtgctgtcctgggtggcttggccaggcaatgcccccacatctgtacagacctccctgcatgttgctgtggcagccccacctgcgcccaccagcatgcgtcgtgcctgagatgacttctcatgcgtgccagtnnnnnnnnnngatgcgagagtgctgtcatgggtggcttggccaggcaatgccccctcatctgtacagacctccctgcatgttgccgtggcagccccaattgcgctcatcagcatgcgtcatgcctgagatgacttctcatgcgtgccagtgctatgcctgatgtgcctcggaccccctcctccttcttcccccccagctctcaaggtcctggacctgggcaacaacggggtcggaaaggagggtgcggtagccgttgcagaactcctccgggcctgcccgggcctggaagagctcaacctgtacatgaatnnnnnnnnnnaggaaaggagggtgcagtggccgtcgcagaactcctccgggcctgcccaggcctggaagagctcaacctgtacatgaatgacattggcgatgacggcgcgttcctggtgcgaaggctggaaaacattgtgggtatccgcgagcctccccctcgcatgcatgcttgnnnnnnnnnnattcctggtgcgaaggctggataccattgttggtacccgcgagcctccccctcgcatgcatgcatggggacgacggcccccttcccacctttgcattggaccccagctgcactccctctctgctctgaccttgctccatgagttcccagctgctcaccccacacagcaccccccctcctgtggccccagatcgcttcggcgctgaatggcaacaagacactgaccagcctggacctgggtggcaacaacatcggacccacgggcgccaaggcgattgccgctgcgctgcagggcaatgccgccatccgcagcatcgagatggggtacaaccccatcggggcagagggcgcgcgcgcgtttgcagacatcctgaagtttgacatgcaggtggggtgggcggtgagggtctggcgaggtacctcgcggtgggccgggggagtggtgtgcaggtcggtgggtggtctgggccctggtgtgcccactggcactggggtgctcgtgattcccccccgccctcatcactccatgcaggtggagtccctgaagctgggctggtgcaagctggggcctggcgaaggggcgcaggccgtcgcaaacctcctgcagttcaacaccacgatccgtaccctggacctgcggggcaacaacctgggcaacgatggtgagcgttggtggtgggtgggtgagatggggagcgctgnnnnnnnnnnggcaaacctgctgcagttcaacaccacgatccataccctggacctgcggggcaacaatctgggcaacgatggtgagcgtcggtggtgggtgggtgagatggggagcgctgctgggttgtggcgtgtgttggtggcgacgagggagggccggccttgcactctgtcaaagcctcatcactgccatcccttccttgccccccagcccatcctccctccgaccccttcccctctcctctcctctctccccccccccctcaaactccaggcgccatcttggtatcgcgggcactgaaggagcacaccaacgaaaagctgcgggagctggacctggggtacaacgagatcaaggacgagggtgcgtgcgcgctggcgcaggcactcaaggccaatgcggagggcgcgccgcgggagctcaaggtcaacgccaactacgtcacctcctttggccaggtggcactcacagaggcactggacatggtgtacgacatggccaagcgtcagatcaccatcaccttctagttgtgtggcgctgatgcagtgggctgtaatgtatcaaggttggggcagaggacctctgctgcgtggccagctggctcatgagacaggggggggagccacggatgaacactggcatcgttgaggctggaacatggagaatgggtggtataggtcctcgtgaaaatccaggcatgcaggaaagcggggcacacgtccggcatccatttgccagtcagcctcagggctggcccctcagcttggtcccgcagccctgcggactcaatctgagccctcaacttcgtcgctggagtcctcgtcctcggcgagggcctgtgccgccagcgcagccagcatgtctgcatcagcacccagggccgcaaggagctggtcgtcctctgtcgccgccggggctggagcgatgtggggcggggcggccgggagcgtcgaggatgccctgggccgcgcaatgcccctctgcctagggagcgccggctgccacgtcaccttcttgcccctgggcgcctggctccacggcctgccctgcttgcccgagcctcgcccagcctcctcggagggctcctgcaaaccttgccctgcctgctgtgcgccggcgaccgggtcactaaacccttggacctcgccggtcccctccagggactgtgaggacgaggcgccctggagcaccggccctgaccccctggactggctgggtgtgtgggtgggcagcggctccggcaggccaggcaggctgggcatgtcgtcgtcgctgatgtggcccgagggcgtgccggcgcggcccaggtgctgggcccaggtggttgccctgcggagaagggctcgatgcatggggatggtggtggctgtgcatacaccaaagagccactaggaagccttgagtcagcaagtatcctctggcaattcagagccacaccccataacgaccctcgtcgacccacctgcgctgcacgtccagcttccgagcggcctcccgctccatcacacgccgggcggcggcggggaggggcagcgggtcaaacgccgcctgccctttgtggctggcgccagcggcctgccaaacggtgcgccttgccttggccatcgccctgggaaatgcggcatacattgggctgggctgctttgtttgccagaggacaggaatacccaagtataattggcgtatccgatggccagtctccaccgcactgcagcctgtcgccaggcggctggcacactgcctagccacnnnnnnnnnnaaggacaggaatacccaagtgtgattggcgtacccgatggccagtatccaccgcactgcagcctgacgccaggcggctggcacactgcctagccacttgtcgcaggaaccctgacatctaggcggcacccgtaccaccaccccccttcctcacctgctgccgccggggccgccctccctaggacgcgccgccttgccttgcgacggctccgcggcagcgcccctgcacgccagcgcccccgggccgctctgcagcagcagtgagatctcggaatgcttcgcctcggtgtactccttcagcagcctccccagggtcaagtcggcgatggcctgcggcggggctggggcgccctcccgcgccttgctctgccagacccggcccagcgccgtctgtggagagggcgcagaggagacggggtgggcgagaggtgggtgcaggtgggcacacgtcgccctgcagggaaagggtggatctcgtttgaacacaggagactcttcttcagccaagcataggaatgcagggccagcaccatcacgcgacggtgaccctctgccagcgagcgcaggaccctgcaaaccccatccaccctggccacgcagcacctggtactggtcgtagaggggcnnnnnnnnnnaccctgcacaccccatccaccccggccgcgcagcacctggtactggtcgtagaggggcaccaggtgctgggcacccaggcccctcatgcccgaggaaagcacgtacttgacctctcgcagggtgtgcgcctcctcattctccagccctgcaccgggcgtgggttggtggagaggcagatgagtggctggagtggcatgctagtcagactctggtgaaagggtacctcacattccaggcatgccccatgcccccacccccgcacagtccaggcagtgatgcctggacagacgagggaccccggccatacccgggggcaggctcgtctgggatccgggcctcctcacgaagggcaggcggtccggggggagcttgccacgtacaccagagcagccggggacaaacgcgcacgaccccagcaggcggcgcaggatgaccaccgcctctggccggcctccggccggcagctgggaggccagctctgcaggagagggaaggaggctgggccagctcattcatgccgccatggggctgcccctggcggtgaatcatggtgcagactgttgcgcaggtcggggttgcaatccagggcacgatgtgtggtgtcatcaaaggcaatgtggctgctgggcagggagnnnnnnnnnnaccatggggctgcccctggcagtgaatcatggtgcagactgttgcgcaggtaggggttgcaatccagggcacaatgtgtggtgttgtcaaaggcaatgtggctgctgggcagggagtatccagccccgtcctcatctccgccccgaggcagacctgcacccctaccgaggagtgcggcctggtgctccatagaaaggtagatcttcactcgcggccggcggggctgcacagagtggaggcagtacaggcagtacagggccgccaccctggcatccaaccctgcgagctccaggctctccaggtcggagggggtgaggggccgggcacgggggggcaatgaagggtcttgggcgaagtctgcatgcgccccgcctggaacggaagactcgttctcctgggacgcctgagcggcggccgggcctgcctccatgtccggggccgtgcagtcgcccgtcaggatgtgatccagttcctcgtgtnnnnnnnnnngcctgaggcgcctgagcggcagccgggcctgcctcaatgtccgggaccgtgcagcctcccgtcaggatgtgatccagttcctcgtgtgtgagctccacctggtcgggggcagcgcccggggcagaaggttccggatccagggagaggaggagggcctccagatccgtccccggctccgcctggggctcctgcgtgtcgctcgctggtgcgctgtcttccgacggctgggtggcaagcacggcgttggcctggtcagcactcacccctcccgcaacacagtttagggcggtgcagtaccatgcttgctggtactgacactttgagaagctgtaagggacgtcctgtgtggtggatgggtcgagcggcatggtccagcaggggcatcgagaagggggctgaacaatatctgcaatggcaatgtgcagaagccacatgcagtggcaatgggagggcagggagacagcgctcttttgcactgctttgcgactccatccttgggattctcacgtaacacaccctgcccacctgcaggacatgggagaagcccaggtccagccaaagtcttcggaagttcgggaagctgggagcctccccctgagctactcgtaccaaaaaatgcaacagcagtgcccagacatcccgctcatggggggcaagcttgttgagcttgctcccacgggcgaggggtttggccagctggctggccataccggagttatgggtcgctcattgcgctcggcgtctcacaacagatgacggggttccgcggcgcatcacgcactaagaattgtggacgaacttggcgagctgcaggtttcgaacctcttctctccggagaggtggctgcgcagggcaagcgcggggagcagttcaatgtttgatgtgccactctcccgattccatgggcagcgggaatgggcgcaagattgcagaatctgtcaccctcgtgtgctgcctgggcctagactgtatgcgtcaggcgtagcggaagcaattgtatactaagagaggtgttaaagaacatgttgtgctgtgtgagcggacaaggaactattattcctttcacaagttgcctcacaacactcatgcgctagctctggagcttccatctgcgatagcagtgnnnnnnnnnnattgccttacaacactcatgcgctggctctggagcttccatctgcgatagcagtgtccatcagaaccacaactttgatatcttgtagatgttgaacgaattattcggcctcctcgtcgattaagtgtgccttctggtcgggtaccccatggccaactgacaaccttttcagcacatcccgaaagatgcgtcctcggcaagcgttcgtttgtgagttttgagcatttgatctccccagcgacgccttgagccttcaatgatctcttcttctcatcctacacaagtttaagaagaacacctctggcctcctccacgagcccgaggtcctgagtgatgatcagccgcactggactcttgtcaacctctctccgatgacagatttgattgtccatgaaacaaacatgtctctgtgctctgctctgacgcgacagctcttgcgccgagannnnnnnnnntcgcactggactcttgtcaacctctctcctatgacagattttattgtccatgaaacaaacatgtctctgttgtttgctctgacgcgacagctcttgcgccgagacgagttgcacccccgatcggtgtgtcgctgctgtgaatgctgtgccccccgaggataggctcattcctcacgctcttgtcgtgaagtctcgcatgcaacgagaaagctttgaggcagatattccgccacgtacaggttatgattgtggtgcttgaaaccatgcatcccggccatcgctgagacttgggcatccaccatggccagcgagtgtccggactcttcacgctgattaggcacgatgccgaggcactgcagcccgttcaccagctctagcacagctccttccactgctagagtatggcggaggacctccagtccgcgtccacacctgggcatgccgtcccactttgctggactccagcaagcgctgggtagggcccgatacagacggaagcacggaggcgccccaccgcaagccaggagggacgagggcgatgtgtccctgtactacacccctccggagcagcccaaggggcccatgatagagctcccggtgcgtcaccttggtgctggtgctgtagtcagagagtgcatgcatgtctgccgccctgccctggtatgtcctgcctgcacccacccccctgcctcccttgatgccacagagccagatcaaaaggagagaggagctcagtcaggacgccccacccctagagaggtacctggcggtggccaaggagaagctgcaggcggtgtatgatcgcatctactatggcgatgtcatcccacctgtgggcgcctaccgcatctcctacgccaggtgcagtgggaaagggagccatacaaatttgaatctgtctgcagcgaccctgagcaggcccctgattggttttaggacagcactggaggnnnnnnnnnngcccatacaaatttgactctggctgcagcgaccctgagcaggtccctgattggttttaggacagcactggaggatacatttttatcatctaattcctcctgtagttttgtattgagcgtacaccgcctcacctgggtgctcacactcttcgataccaggatgctcgagctactgtccaagaagagggttaagcgcatcatcatgatgnnnnnnnnnnttcactcctgtatttttgtattgagcatataccgcctcacctgggttctccacactcttcaataccaggatgctcgagctactgtcgaagaagagggttaagcgcatcatcatgatggcagacgggcgtctcgcgctcatcgaagcctcggttgagaatgcctgctctgactaccacaccatcacatacgaccgcaacgatatccggtgcgaatcggctgggttgtgggtggtgtttcaacagcacatactgtgatgtgatggctgtgcgcttgtgacaccctgtttggtgacccacacaatgtgcaatcctcaattcatccccacgccccctctcaaattgcaggataatgtacgctgcagagttgccggagtggaagcaggagaagaatcgtttctactgtgaggttcccggggacatttgggaggagggggtcttcatgcggctcataaagcagaatcaggaggagagggtgagcaggttgagccaagtttccggtctggggggcaggctgattccggcaggcattgttggggtggctgtgatgtatgatgtctcgtttgaaccatttgcacatcccggggtcaccatccctcgacctggttgcttacttggcgcgctgcctacaacagacccacccgaggtctggcaacagcatcatcctagttcgcctctaccccactccctcgaactcagatatggaaggatggcaaaatgtacatcccaaacagcagcattctgcggatgaacgaagtgcggccggagctccagatcgtggacccctcccaagcgtgagtgcagtgttgcagcgcattatgtgtacggcactgccgggcaaattatctcatcaacagcacatgtagctattcataggggaatcatttgtgcctcgcacgtccagaccatgcctggcatgccagaaacctatcgctcggccccaacatgaagccatgtgcaacaatgaatcccctccattctcacccttgcctctgcaggaacgtgttcctgagcctgtacatgggccagttcctgcccatcgccggtctcctggcgctgagggccctggtgggggcaggcagccgtttcttcaccagcaagaaacctgtgaagaagacggacaaggaggagcaggccgaaaagtatggcgcgcaccgagctcgcgagtacaacgtccccaccaccgacggcaaggggtgagtttttgtggggtgaggcgcaggagtcttgggtagggttggagtgctccatgacgagggttcctgggagcagtggatgcaagctggacatgcgtagctgggcatcacttgccctccgacgcgatctgcacaccggtggctcggtgtccatggcctgtgaattccactgcatgcgctccctgtgtccccttgctccaaactcccaccactccgccgcgcgtagaaatccggtgaaggtcagggagacgggggtgcgatacagcgacgtggcgggcattgacaacatcaagacggagatccaggaggtcatcgacatcctgcttggaaaggaggagtacattgccatgggcgccaagcccttccgggtgagtgtaggcggggtttggcgggagggggtggttgcttcagggacgaagcctcggtggctgtcctttggcatcagcctgcttcactctgtagctctgtagcgctcatctgtgctctgtttgccttcagaccccccacctccttctcacgctccagggcatcatgatggagggcccacccggcacggggaagacgctgctggccaaggcgatggccggggagggcgggatgcccttcttctcggtcaacggcgcagagttcgtggaaatgttccagggcgtggccgcggcccgcgtccgctcgctcttccgcgcagcgcggaagtgcgccccttccatcatcttcataggtggggcggggggtgaggagcagtgggggaaaagtgtcttcttggggaggacgggggggaaagggacagtgtgtcacagggctctgccgggatgctcagaccctagcatggcaagtctgaccagcaacaagcacnnnnnnnnnncgcgcggaagtgcgccccctccatcatcttcataggtagggcggggggtgagggagcagtggggggaaagtgtcttcttgggcaggacggggggggggaccgcgtatcacagggctctgccgggatgctcagacccaagcatggcaagtctgaccagcaacaagcacccctcccactctgcgccctgtgcgggctccttgtctcacgccgctcctgctcagcctccctcacacacacacacacacacgcgcggcgtgttctccactgcccttgcctcaatcacaccccactactcccaacttcccacccttcccatcccagnnnnnnnnnncggcgtgttttccactgcccttgcctcaatcacaccccaccactcccaacttcccacccttcccatcccagacgagatcgacgcgatcggcaaggcgcgcgatgcgtcctcggactcgggcacccaggagcgcgagcagggcctgctccagctgctggcggagatggacggcgcggtgcaggcggaccaggtgctggtcatcggcgcgaccaaccgcatcgatcagctggacctggcgctgatgcggccggggcgcttcgaccgcaaggtgttcatgggcctgccctcccgacccaaccggctgaagatcctcaaggtaaatgcggtgggtgcggggatcgtttctcatgtgcatgtgtgggggggtgggggagaatgcgctgcatggaaggagtccctggggttgggaatcgtcggcactcgatgcacaggcgagcatgccagtcctggtcgttggcgccgtgggtagcccgtgcgggggcaacagggtgtcgaggatggctgtccccgcgcagcggggcccatcccccgcccgccgtgctcttctcgtgctgcggcatgcagtctcctgacgctttctcagtcgcctgcctttcccggtgctccacctgtgaagcccccataagccagcccctcccaatcccaaaaggtgcatgcggagggcaagcccgtggaccgcagcaacgacgatgcggcgctgcgggccattgccgacatgaccatcgggtacagtggcgctgagctggccaacctgctgaacgaggcggccatcctgagcgtgcgcgccgcctcccccgtcatcacgctggacaccatcctggagggcaaggagaaggtggagctgggcctgccgcgcgcctccctgcccgacacccctgccaagcggcggctggcggnnnnnnnnnngcgcgcgcggtggccctggcgctgacccccggtgtgccccagatggtggaggtgtccatggcgccgcgcgggcagagcacgctgcgcatcgccttcgaggctcaggacatcggccgcgacggcgggaccttcctgggcctgaccgcgcgcgggcggcgcaccaacgccgtggtgatcgaggaggagatgtccgcttttgacgttgcgtgcggtctgctggtgcccctctacgccgccaggtgccgtggtgctctggatttgtttttctgatggaaggagggggggatcgagcgggcgctcgctgccgatggatgcactcaagatgctgccaagggcgagacggcatgttgctggtgagccgcggtcacgtcttcttgagcgccgtggcctagtccaccatgccgcacccgcgtcccgcccaactgccctgctttcccccgcccgcccgtccctttccaaaccccacctcgacgcctccatgcagggtggcggaggaggagatctttgggcccgacggcgcctcgctctccacggggcgtgagctgggcctggccagcgagctggcgcggtggctggtggtggactccacgctgcaccccgactaccgcaacaccgtcctgcgcagcaacatgaccctgggcggctaccccgaccccaccaccgaggtgcgagaggggaggggggacgagaggggcctgtgttctccctgggagggaaggggaatggtgtccacaacatgccagggacagccctctgagggcaggcggatggattggggatgcagccttttcccatgcttctggtagagctgcatgggcaggaggagtgtgctggcagcttgcctccaccccccgatgctccannnnnnnnnncggtagagctgcctgggcaggaggagtgagctggaagcttgcctcccacccccgatgctccaacccccccttcagtatctcctttcttttccggccatccccccttgcagtggatggacgagctgcacgacgacgccatcctggcgctgcaggaggcggcgcacgagcgcgccgtgctgctggtgcgccagcggcggcccgtgatcgaggcggtggcgcgcgagctctgcgacgcggccgacgagaccgtgcccgcggcgcgcatcctggacctgctgaccgccacgccgctggccgtgccgcagcgcgtcacggcccgccaggaggagcaccgcgccgtcgcggcccgtgtgctgggcgagcgccagctggcggacgacgtcgtgcgcgggctggcagaggtggtcatgggccgggccgagggctgggactttttgcagccgcgggtggtgtgggagaaggcggccgcggcctgcgaggcgctggcggatgcggagacgcgcgcgcgcctggccgccatgcgcgagttcgtggtcagtggcggcgccgcgccgctgcccccgccgccctcctccccgctgctggtgccggcagggcatggggtggggccccaggtgcccgaggacatctttgtgcgctgagagaggggggcatggtggttgccgaacagttgtgtaacggatgggtgaacgccagacaggtgtcagtggggtgttcagagggatggggtccgcgaggccgggctccatggcttccccgaaggaagctgcggaaaatacgattgcacgcacgcacggtcaaaaacccggggctgccgcgcgctgccgcgatccgcatccaacccacctgacaggctgtgcaactcgattttgtacactgctaagtgtgtcctgcattgatcagcgcccattcccagaccctgacgacgagcgaggcaggcgttggaggagcacggaccccctccccccccccgcgttcaaccgtggcgatgcacaccgcccggcaatcatgcctatgccccgtttaatgaagggggcttagcgggtccctaacccccgcggggccctgccgctcggcatggcgccggcgctgcagggcctgagcgccctcggggcggtgctgcacgtnnnnnnnnnnggtgccccgccacgcctcccccaaaccccagtggtgaggggtgtgtgtttggtgccggtgggccggtcctcgattatgaaagaagggnnnnnnnnnnaccgtggtcaagatctcgcactgcatcaaggagtcgtcaggcatgcctcacacctggctagtgccccgccacgcctcccccaagccccagtggtgaggggtgtgtgctgggtgcccgtgggccggtcctcgattatgaaagaagggcacgcgacatgcagttggcagcgtactgatgctccatggcagtaactctggtacacaacccgacacaccacctgtgcatgctccccag

SEQ ID NO: 46441 - DNA, 95 bp, Chlorella protothecoides
aacggtgcgcggcggtggcgaaaacttgcactctctacatgggatggctgttaatgttttcccatcgtctcacctggcttcgctgccctcttcgc

SEQ ID NO: 46442 - DNA, 11402 bp, Chlorella protothecoides
  modified_base (98)..(190): a, c, t, g, unknown or other
  modified_base (285)..(294): a, c, t, g, unknown or other
  modified_base (387)..(396): a, c, t, g, unknown or other
  modified_base (643)..(652): a, c, t, g, unknown or other
  modified_base (1324)..(1333): a, c, t, g, unknown or other
  modified_base (1473)..(1482): a, c, t, g, unknown or other
  modified_base (1659)..(1668): a, c, t, g, unknown or other
  modified_base (1955)..(1964): a, c, t, g, unknown or other
  modified_base (2058)..(2221): a, c, t, g, unknown or other
  modified_base (2446)..(2455): a, c, t, g, unknown or other
  modified_base (3259)..(3268): a, c, t, g, unknown or other
  modified_base (4143)..(4268): a, c, t, g, unknown or other
  modified_base (4350)..(4359): a, c, t, g, unknown or other
  modified_base (4686)..(4717): a, c, t, g, unknown or other
  modified_base (5265)..(5274): a, c, t, g, unknown or other
  modified_base (5840)..(5849): a, c, t, g, unknown or other
  modified_base (5982)..(5991): a, c, t, g, unknown or other
  modified_base (6563)..(6572): a, c, t, g, unknown or other
  modified_base (7036)..(7045): a, c, t, g, unknown or other
  modified_base (7906)..(7915): a, c, t, g, unknown or other
  modified_base (8228)..(8237): a, c, t, g, unknown or other
  modified_base (8632)..(8641): a, c, t, g, unknown or other
  modified_base (9235)..(9244): a, c, t, g, unknown or other
  modified_base (9354)..(9363): a, c, t, g, unknown or other
  modified_base (9670)..(9679): a, c, t, g, unknown or other
  modified_base (10020)..(10029): a, c, t, g, unknown or other
  modified_base (10426)..(10435): a, c, t, g, unknown or other
  modified_base (10719)..(10728): a, c, t, g, unknown or other
ctcctgcggcggcgggacggcggggtggggtggggggctctgctgcagccgtcgccatgagaagattaggctgccctggggcaggcagggcggcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgggcgggcgcaggccgggggccgcggatgagggcaggccctgccccgccgtgggggcctccgagcgcggccgcgcccggaagtggcggggnnnnnnnnnntacatactggacccttgcacgatccccctcgtcgccgacacccctccctatctctcagacctgctgcccacctcctggggccgatacagcagnnnnnnnnnngccctgccgctccctcaccaggtcggggtgcaggtacagctcctgcggcggtgggacggcagggtggggtggggggctctgctgcagcggtcgccatgagaggatgaggctgccctggggcaggcagggcggcagcagggcgccagcatgctgggtcggggttagaacagcaccgccccatgcgccccactctgctgcttgccttgccacgccgtccgtgcacgcttcctccccaccaaggtcctcnnnnnnnnnngcagcatgctgggttggggttagaacagcactgccccatgcgccccgccatgctgcttgccttgccaagctgttcgtgcacgcttcctccccaccaaggtcctctcacatactggacccttgcacgatgcccctcgtcgccgacacccctccctatctcccagacccgctgcccacctcctggggccgatacagcagggggtcggcttcgcgcaggccactcaccagctcgtcaagcgtcttgcccacctgcggcatggagagagcgaaaaagagtgaatggtctggctcagccctccgtcgctccccttgcccaccaaggcccaccacctccagacctctccctgcgcctcacgagcttgaaatcggcggccacggcgcccaggtggatgcgcccatcgtatggcccgacggccagcgccatgaccctcacccattcgtccctggacatggagggggatgtgaaggccagcactgtccgtcagcctccataggcgggggaacccctgcatcccacagaacccccagaggcggccgcccaggtagcacagcgcacttgtcagccacgccagcctcgaccatggcctgaagctggggccggagctcctccaggctggcccccttcatggccaggggggccaggaggaggcgggtcttcaccatggtgtccagnnnnnnnnnnggaaggccagcactgcccgtcagcctccatacgcgggggaaaccctgcatcccacagaaccccaagaggcggccacctaggtagcacagcgcacttgtcagccacgccggcctcgaccatggcctgaagctggggccggnnnnnnnnnngtgcagggtcaagtcgcgcgctgccatggcgagggaggccctcgatgccgggatctttcgggagtggcaacaccttgtcacctcgtggcccaagagcaccgagacgatgatcaactagccccaatgcgccatttcatacccttaacctctctgataaatgaataagatcatgggatnnnnnnnnnncagtggcaacctcttctctcctcgtggcgcaagagcaccgagacgatgatcacctagccccaatgcgccatttaatacccctaatctctctgataaatgaataagatcatgggatagcacatcgtttgaatcgaaactcgcgtgccccaccgtccattagtacccgctgtgccaacctgcggaccttgtcattccggaaggggtcacggaaaatctacattgccctgcaaatgcctgcacttcctaggaccgacacttagacagtcccatctcatgcgggcacctcnnnnnnnnnncttgaatcgaaactcgcatgccccatcgtcaaatagtactcgctgtgccaacctgcggaccccgtcattccggaaggggtcacggaaaatctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatggacttgaagatctccacggcctctctgctggggctcttgaactctgcttggattgaagcggagggaggtggaagaggtggtttcgatcttgctgaaatgtgtctttctggctgggtggcgaggagggctcgagccagccagcccctccctctcgatgggcttctgataaaacagtatccaggcgcatcacccacacgccttgcctccgcccaccccccgnnnnnnnnnngatgcttgcacttcataggaccgacaattagacagtcccatctcatgcgggcacctcaaactcctgcagcggcgtcttctggtacatgttgcgcagctggccgcaggcagccgccgcctccaggcctcgcgtgatccgcacgctgacgggcaccctccgctcctccaggatggacttgaagatctccacggcctccctgctggggctcttgaactctgcttggatcgaagcggaaggaggtggaagaggtggtttccattctgctgaaatgtgtctttccggctgggtggcgaggagggctggagccggccagcccccctccctctcgatgggcttctgacaaacaagtccccaggcgcaatccccacacgccttgcctccgcccaccccccggcccatcccacaacaaaccccagggccccatcatccacgcgcctgcatcgtccacggcgttccaggggatgaggttgacgtggcacctcatgctgcggtgctggcgcagcagcctcgtcagctcgatggcatgctgcggctggtcgttcacccctgccatcagtgtgtactcgaaggacaccctccgcccagacaccctgtttgtagaagagggaagaaaggggtaatcgatgtgagtatgagatgggcatcaagaggacagcggctggggatggcgcggcaggcagcaccggccgacggggtgacgccatcagggcccaagattgtctgtggcgctctagagccatgacgtccctggggacccccttctcatgcccgtctcccgcccccatcctctcacgcgctcccttnnnnnnnnnnttgacgccgtcagggcccaagattgtctacgacgctctagagccatgacgtccctggggaaccccttctcatgcccgtgtcccgcccccatcctctcacgcgctccctttcccccacctgcctcccaacccaaccgacctacactcactcaaagtacttggtgcagtcggccatgagggcctggagcgggtagaccctggcggagggcacgatgcgctccctcagctcctgggtgggcgcatgcagcgacacagccagtgtgacctggaggcgccgcgctgccagctggcgcagcgtccccggcacgcccacggtgctcagggtcaagtgccgtgcacccaagcccaggtcctcgcgaagcgcgcgcagcgcggccagcaccgagggcaggttcagcatgggctcgcccatgcccatgaagacgacgttggaggggcggcggccaaagtgctcgcccaccgccagcacttggtccaggatctcgtggggcagcaggttgcgcgcgaagccgcccttccccgtggcgcagaaggtgcagcgcatggggcagcccacctgggagctgacgcagacggtgaggcgcgggccctcggggatgcccacgcactccaccacccgcccgtcggccagctggaggaggagcttggcggtgccgtcccgcgccgtcaccgcgccgcgcagcgtcgagcgccccgtgcgcactccagcccctcgcagggcggtgcgcagcgcggccggcaggccacgcacctcttccagcgaccgcgcgccggccagcacgccgtcacgcagctgggccgcgcggtaggccggcgcgcccagcgcgctcaccagcgcgcgcagctcggcggcgggccggcccagcaacacccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccacgctggggcctgagagggggccggggtctgagagggggttggggcccgaggaggagggggggtctggagtggggcgnnnnnnnnnngaccacgctggggcctgagagagggctggggcctgagaggggggtggggctcgaggaggagggggggtctggagtggggcggacaggcccggggctgctcgcaggaccctgaggctgcgtggagacagcggacgcgggcttgccggtgggacgcagggggcgcagcttggaccagccgtccgcggcgatgcgcccggcgcggaacccgatggaggtcttgggccggaccggccgtgaaccgcccttcatgccctcggcgctggctgctgggggtgcagggcctggctcccgcctgatggaggcagcatgtgtcgcataggcgggggnnnnnnnnnnnnnnnnnnnnnnnnnnnnnnnngcagcggacgcgggcttgccggtggggcgcagggggcgcagcttagaccagccgtccgcggcaatgcgcccggcgcggaacccgatggaggtcttgggccggaccggccgtgaaccgcccttcatgccctcggcgctggctgttgggggtccagggccaggctcccgcctgctggaggcagcatgtgtcgcataggcgggggcagcagagcggcggagggggggtggcacaaggccagcggagaatagccgggcacaatgccagcctgcgacgcaccgcatgcatgccattgtgttgttggggagggtcagcctgggattaagctcatgttttcatcatgctggcatgcaggacagtggcgttgctggtgagtggctgtatgttgtggagagaaaggtcccaaactctgccatgcatggtcatcacgtggatgtggaatacgaaaactctcacgacgcacagatgatacttgagccccgccaattgtctaccgaaaggcgtagcctacgatcgtgagtttccaagtgtcactgcggaatggcgacggnnnnnnnnnnaggatcagcctgggatttagctcatgttttcatcatgctggcagacaggacagtggcgtcgctggtgcgtggctgtatgttgtggggagaaaggtctccagctctgccatgcatggtcatcacgtggacgtagaatacgaaaaatctcacgacgcacagatgatacctgaacaccgccagtgatctaccgaaaggcgtagcctacgatcgtgactttccaagtgtcactgcggaatggcgacggtctgaggcaccactgcccacaccctcacctcgggtgggaggggctcttgcggagcgactgaggagcacaggcgccacccatggcccacgcaggcttcagccatggatctacaacctcggaaatgtcaacaccgcgacccacgccacggaagggatctgccagggtgccctcaacctccggcattgtggggcccgtctgccctcacctgagtcggcgtcagggccgaagtcccttctccactggcttgggacatcgggtgagcgctgctgatggatggtgtgcatcctagaggcaccgtggagccggctgcgcccatctcccnnnnnnnnnntcccacacaggcttcagtcatggatctataatctcggaaatgtctgcaccgcgacccacgccacggaaggggtcggccggggtgccctcaacctccggtatagtggggcccgtctgccctcacctgagtcggnnnnnnnnnntacatgctcctgtgccgcaccgtcatgttcacctgccctcccctccacacccacaaacttcctcaggcaccagacccccgcctagcgcccgtccgatccgtgtccagctccctggacatccccctgctccctgcccagtccgcctctgaaaccctgatcgagttccgggacgtgtacaagtcgttcggggacaagcacatcctgcgcggcgctagcttctgcgtgcgccgcggcgaggccgtgggcatcatcggcggctccggcacgggcaagagcaccaccctgcgcatcgccgcaggcctgctgcagcccgacgcggggcaggtgctggtgcggggggtggagcgggtgggcctgatggccgaccagcccgacagcgacggcgcgctggtgatgggcctggtcttccagtcggccgccctcttcgactccctcaccgtgggcgagaacgtgggcttcctactcctggagcacagcaagctgcccaagacgcgcatcaaggtgggaaggggggatactggagagggggggggatgacgccgggggttgctcatgggagggggtggatgcgnnnnnnnnnnttggagagggtgggggatgacgcggggggttgctcatgggaggggggtggacgcggtcgcctggcagtcccagcctgagctctccctgacccatggaaccccgccccgctccacagaagctggtggcggcggccctgcgcaaggtgggcctgcggggcgtggagaacctgatgccctccgagctgtccggggggatgaagaagcgcgtggcgctggcgagggccatcatccgggacgaccagcacgcccaggcggagcaggtgagcagtgtgggcgctgcagggaaagggggagttcaggagggcctcggggatgcaggtgcatgcgcccgctgcctgcggcatggcaacccctgaccctcatccaccgttcccctttgcagctcatcatgtacgacgagccaacagcggggctggaccccgtggcctccacagtggtggaggacctgatccgcggcatgcacnnnnnnnnnnctgtgggcgctgcaggagaagagggagtttatgagggcctcggaaatgcaggtgcatgagcccgctccctgcgtcatggcaacccctgaccctcatccaccgttccccctttccagctcatcatgtacgacgagccgacggcggggctggaccccgtggcctccacggtggtggaggacctgatccgcggcatgcacacgccaacgtcggcgaggtcgcgggggggcatcaccagctacatggtgggtccagggggtggttctggcattttggtggatgacttggtggtgggatggagggtctgaccacgcctgccagcgtcggtcctgaagaagcccccaggggaactgcaggtagaattcgacggcgaggcgtgtcgcccatcacctggccaggcaccagggaccaggttgtaatcggacccacacctggcctcctgagcctcctggaccactgcatgcatgcttgattgcaaatcccttcctgtcccacttcaccataccaaaactgcaggtggtgacgcaccagcacagcaccatccggcgtgcagtggaccgcctcatcttcctgaatgacggcaaggtggtctggcagggcacagtcaaggagtttgatgcctgcgacgtgcccatcgtgcgccagttcgcatcaggcagcctggacgggcccatcacatatgtctgaggagaacatacccactggagcctcctcttgtgggggtgattgatccgacgaggatgcgagggggcgtgaaacgtttactcacccgacccgtcctgcacttgcttgtacaatctagacaagttaagtggccaagatctgatacattaagcgcaggatggcgaagatcctgcttctggnnnnnnnnnnaaccatacccactggcgccttctcttgtgggggtgattaatccgacgaggatgcgaggggcgtgatacgtttactcacacggcccgtcctgcaattgcttgtacaatctagacgagtttagtggccaagatctgatacattcagcgcaggatggcgaagatcctgcttctggccggggatttcgtggaggttctggaggtgcgcaagtgatcgagcgcaatatttctcttcacatgttcttgccgtctggccaacagaaccgacaccaggaatcttttttacattttctgcaggtgttcgtaccgttccaggnnnnnnnnnngtacacatgtacttgccgtctggccaacagaaccaacaccaggaatctttttatattttctgcaggtgttcgtaccgttccaggccctccaggccttcgggttccaggtcgacgccgtaaccccgggcaagaaaaggggagacaccgttcgcaccgccgtgcatgacttcgaggtgcgctttgatattagatgagtgcatcccttatctaagagagtccctggaaatgcattgtgatgatcttggagaaaggcttcctctcagtctcagcccacgcgacttggctcggcagggggatcaaacgtacaccgagaagcggggccacaactttacactgaacactgatttcgacgaggccctcaccgggcttgacacctacgatggcctggtcatccnnnnnnnnnngtagatgagtgcatccctaatctaagggagtccctggaaatgcattgtgttgatcttggaaaaaggcttcctctcactctcagcacacgccacttggctcggcagggggatcaaacgtacaccgagaagcgcggccacaactttacactgaacttcgatttcgacgaggccctcaccaggcttgacacctacgatggcctggtcatccccgggtaggctgggccgaaaggcatgggcagacatgctgggtcttgggagcatgccatcctggtgcgatgccatgtgcccaggagcacgacagtgccgccccttcgtccaccgttctgccgctatgctcacgagctggatagcttcaggaatgcatcgcatggtcattcatgccctttctgcatggctggtctgtgtgaaaacaaatggtccttgcttctccaaactgtgcagtgggagagctccggagtacctgcgcctcaacccccaggtcctgcacatcgtgcgccacttcttcgagcgtgacgcccctgtggcggccatctgccacggcatccagatcctgagcgctgctggggtgctgaagggtcgcacctccactgcctnnnnnnnnnncctgtgcagtgggagagctccggaatacctgcgcctcaacccccaggtcctgcagatcgtgcgccacttcttcgagcgcgacgcccctgtggcggccatctgccacggcnnnnnnnnnnaggtccggctggcggggggcgagttcagtgaggtggaggccacggaggtagtcgtccagggcaacctcatcacgtcccctgcctggcccgggcaccccaagtggctggctgcctttgtcaaggcgctgggctacaacgtgaccaaggcgtgatggcctgtggggtggccgcagagagtaagctcctaggaggcaagccaagctgccgatgaccctgcgatcgtgcacctggtccttgtgcatgcaagaggcaaagcttacagaggaggaaatcaggatacatggggaggcccaggagttgcatcagnnnnnnnnnntggagagtgagctcctaggcggttagccgagctgccgatgaccctgcgatcgtgcacccggtccttgtgcatgcaagaggcaaatcttatagaggaggaaatcaaaatacatggggaggcccaggagttgcatcagggaccatgcctggatgcggtgggaagtctcatcccccctccaagtggagagtgagggaaaagtatcccgtcagcctccatggcctgagactggcaattgagtcgcagtctcggtaaagtaataatttatgcaggaagagcaaagctgtcggccgattcacgccctgacgcgtggcacagcttgctcatagcggtgcctcaagctnnnnnnnnnnctgagtcgcagtctcagtaaagtaataatttatgcaggaggagcaaagctgtcagccgattcacgccctgacgcgtgacacagcttgctcatagcggtgcctcaagctcagtactcgtgagcaggaccctgggtgggcagcagcttgaacctcctcttggtggtgatgcgctcacgggagaacttgtcgtccggggagaagcgggcggggtgcgcggaggctgttggcacacctttgggatcgagcttctgtgtgaggagaggatgcacgactgtcagagcttaacacacgagactgctgcgccccggtggagtttgaccaatctttccacgcccagcacctcgcacgcgcaccttcagggtataggagcgtgtgccgtcctcggcggtgtagtacnnnnnnnnnnaaacccacgagactgctgcgccccgatggagtttgaccaatctttctctatgcccagcacctcgcacccgcaccttcagggtgtaagagcgtgtgccgtcctcggcggtgtagtacatgagatacatgctggctgggtgtgcgctaaacgagaaggcttactggcatgcggggcgggcagagatttggagagcgtcgtatctcccacaggcttttcacgctatcatcaatgctgagtctggtgtagtatcgaggtgccgagactgagatgccggccacggaaannnnnnnnnncaaacgagaaggctcactggcatgcgcggcgggcagagatttggagagcgtcgtatcccctacaggcttttcacgctactatcaatgctgactctggtgtagtatcgatgtgccgagactgagatgccggccacggaaagggccgtgcattccgccggaggagggtgcgcgcgcgaagcagtacctcggaggatactgcctgttatgaaaaccttgcttacaaggcgcgttacaccagtgcccgatctgacatgacgcaatgctgtctagatttgcctttcatgcttaaacatagggatagtccattgcaagagttgagcatggtgtctagcgcgcgaggcgcaggccgatgagacttcgtcaggttcgatagtcgagggcgcccgtcgcggcagcgagcatgccgacgcgttggagggcacccagcctcgccgcggccctgctcctgctcacacacctgtctctgggcctggatctgcccccgcagcgaccatgtcgccgggtgcgcagcgtgttcgacctcccagacttcgcctcctgcaggcggtggggtgccatggtgcggcgccccatctgtgaggcccccagccccgccttccgggacatgtgctgccacgccgcctcctcattcgtctcctccgcctgtgcctgctggagcacggccttcgacgcgg

SEQ ID NO: 46443 - DNA, 74 bp, Chlorella protothecoides
tgcaggctgcctgggataaggtgaccctttaggttgggatcaacagatcggggattggagggatacggagtctg

SEQ ID NO: 46444 - DNA, 111 bp, Chlorella protothecoides
gtcactccactttcctcgcccctctgtgcctctcctggcccctggcacatgcctcccctgttgacctcctgcccccgccccgcaggctgcatcaaggtggtggtggccacc

SEQ ID NO: 46445 - DNA, 78 bp, Chlorella protothecoides
aagtgcctgatggctttgaaatttcccaactatcactccgtccatgtccaagactttctcccatcaaagtacatgtga

SEQ ID NO: 46446 - DNA, 61 bp, Chlorella protothecoides
cgtgtgcaaaaggatgagggggagggggggtgatgcatcctctccctcggcccctcctctc

SEQ ID NO: 46447 - DNA, 68 bp, Chlorella protothecoides
ggcatgtgctggggcgccgcgttcagggggttccgcggggggttgggaatgtgggtgggtgggggagg

SEQ ID NO: 46448 - DNA, 62 bp, Chlorella protothecoides
gtcttcctgtcagccgtctgtaccagcattttaagtcctgcctatccccatggtcggatccc

SEQ ID NO: 46449 - DNA, 75 bp, Chlorella protothecoides
cccccctttctccacccaccgtgcaggaggcgcagagggatcggcatcctccctgcgcccagatgcgccgccctt

SEQ ID NO: 46450 - DNA, 76 bp, Chlorella protothecoides
tgtgcttgtgtctgcagccacgcttccctgcgtggagttttgtagactcaaagcagccgcaacgattcaaaacata

SEQ ID NO: 46451 - DNA, 1035 bp, Chlorella protothecoides
  modified_base (246)..(392): a, c, t, g, unknown or other
  modified_base (451)..(666): a, c, t, g, unknown or other
  modified_base (743)..(969): a, c, t, g, unknown or other
tgggaggctgttggtagagtgcacagccatattcggtgaagcagagaacgggcagctgcccatcgcctcccgttgcatgttgggagcagggcgggcgccgggccccacatgctgcactgtgtccttccctcacccaaaccctgggttcttcagcatgtctgcttgacacaatgaatgcactgctctgcaaccgctacgccacaggatcccccccgtcagcacggtgtgtggcatgggctcgcccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcacctgtcaggccccgacgcacgtgtgcgcaggggtctgtgtggtagtggcaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatacactcaggcgtgtaatcgcatgcccatgactccctgtatgtggggttgacctcgcagtgtctgccataccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcacccaggtaggggacccctccgtcgacgcttggcacttgctcatcaggacccaatatggagt

SEQ ID NO: 46452 - DNA, 65 bp, Chlorella protothecoides
gttgtagggtctaacccgcccccacaacacccaacctctggtatggagatccagcgacctcgaga

SEQ ID NO: 46453 - DNA, 71 bp, Chlorella protothecoides
agggtcctggtgacattctgctcctccagcacgagcttgtgcgtgtaggcctcggccgtgggatatgcagt

SEQ ID NO: 46454 - DNA, 61 bp, Chlorella protothecoides
ggcacgcagacgctggtgcgcatgctgcgcgacgaccccgacgcgcgcgtgcggcgcaagg

SEQ ID NO: 46455 - DNA, 61 bp, Chlorella protothecoides
attccgattttcttccctcccccgacccatcacctctctgcagcccgagcacatccggcag

SEQ ID NO: 46456 - DNA, 61 bp, Chlorella protothecoides
cacagcgccagccagcggcggtgcgtcaggcgcgcgccgctggcctccccgccggcgaaga

SEQ ID NO: 46457 - DNA, 73 bp, Chlorella protothecoides
gaatcaggaggacctgaggcgtgcgatctcgtttcatcaggcgggtcctctccacatcccatccacggcagtt

SEQ ID NO: 46458 - DNA, 61 bp, Chlorella protothecoides
tcggagggccagggaatgccagtaccaaataccccgcggcagcctgtccaactgtctcttc

SEQ ID NO: 46459 - DNA, 70 bp, Chlorella protothecoides
cagcacgattcgcatccccacccttcctcctgatgcgtcccctcaccaggccgaggctgatgctgggctg

SEQ ID NO: 46460 - DNA, 61 bp, Chlorella protothecoides
ggagcagcagaccatctccatcgccaaggcgggcatccaggccacgctgaacgcgcggacc

SEQ ID NO: 46461 - DNA, 129 bp, Chlorella protothecoides
gggccgccgccagctcgtacagcggtcccgcctgtcgatcacaatggaaggagtgtgcaccgcgtcatgggggccatacagaaccgacactcgaccattcacctgccagcgctgccggggctgcacaca

SEQ ID NO: 46462 - DNA, 61 bp, Chlorella protothecoides
tctgcagaaggagctgtccagcattaggactgggcgagccactgcaggcaaatggaagggg

SEQ ID NO: 46463 - DNA, 61 bp, Chlorella protothecoides
ggagggcacgtaggtccttgactttgcacacgaggagctgcaagccatccagcttctcatc

SEQ ID NO: 46464 - DNA, 68 bp, Chlorella protothecoides
tgaaacttgcgttgcatggcgcacaccatgcagggctcagcgacacggccggagccatcgcgcaggca

SEQ ID NO: 46465 - DNA, 79 bp, Chlorella protothecoides
gacctccccggcccggcgaccccccgccccagcccccggacgtcccgaggaccggcggcaagcgcgatcgcagcggggc

SEQ ID NO: 46466 - DNA, 77 bp, Chlorella protothecoides
ctacatcaccgcaatccatggagtgcgtcagggcttccacgaaaccaagccttctcaccacttccaggcgccaaggt

SEQ ID NO: 46467 - DNA, 61 bp, Chlorella protothecoides
ctggacgccatgccaggctatcccagccccaccagccatgccttgagttcccagaccaccg

SEQ ID NO: 46468 - DNA, 73 bp, Chlorella protothecoides
gggcatctggtagcggggggtaggggcccatacctgggtggggtggtcgggagggaggagtcaggccggcaat

SEQ ID NO: 46469 - DNA, 61 bp, Chlorella protothecoides
gcgggcaagttccacagcgtggcgctgggccgcgacggcgcggtctggacctggggctggg

SEQ ID NO: 46470 - DNA, 61 bp, Chlorella protothecoides
tgtaggcttgattcattagcatgcagaccaatcagcgtgctgagcgcggatgcaggcgctc

SEQ ID NO: 46471 - DNA, 61 bp, Chlorella protothecoides
gacagctctccatgccttccacgcatgcgacgtgggacatgcattccctcttccaccctca

SEQ ID NO: 46472 - DNA, 62 bp, Chlorella protothecoides
gaagtgtccccctggaaagaatacaaactaggtatcaccgattccttcagtcaactcgaagg

SEQ ID NO: 46473 - DNA, 80 bp, Chlorella protothecoides
gctgatggggctaccacgcaccctgtagcaagcaagtacgatctattaatacaccctcctgcaagcagaggaaagataag

SEQ ID NO: 46474 - DNA, 61 bp, Chlorella protothecoides
ctctggtggcagatgccgcggtggggttccacctcccatgacatcacgcccgagactcagg

SEQ ID NO: 46475 - DNA, 73 bp, Chlorella protothecoides
ctgagtcccaccgcatctttcctctcaccccccacccctttttaaaaacagaacctggagctggtgtcccggc

SEQ ID NO: 46476 - DNA, 65 bp, Chlorella protothecoides
gcggtgcccggggggaggaaaggagcgaatctttcgagggtggagggacacaatcgcggggcgtt

SEQ ID NO: 46477 - DNA, 67 bp, Chlorella protothecoides
ctccagtgaggcgtcacctttgcaaggcccatccccttcgcccagccaatctccctcgcccagccaa

SEQ ID NO: 46478 - DNA, 50623 bp, Chlorella protothecoides
  modified_base (1382)..(1391): a, c, t, g, unknown or other
  modified_base (1662)..(1671): a, c, t, g, unknown or other
  modified_base (1794)..(1803): a, c, t, g, unknown or other
  modified_base (1970)..(1979): a, c, t, g, unknown or other
  modified_base (2517)..(2526): a, c, t, g, unknown or other
  modified_base (2726)..(2735): a, c, t, g, unknown or other
  modified_base (3755)..(3764): a, c, t, g, unknown or other
  modified_base (4007)..(4016): a, c, t, g, unknown or other
  modified_base (4198)..(4207): a, c, t, g, unknown or other
  modified_base (4940)..(4949): a, c, t, g, unknown or other
  modified_base (8368)..(8529): a, c, t, g, unknown or other
  modified_base (8597)..(8606): a, c, t, g, unknown or other
  modified_base (9300)..(9309): a, c, t, g, unknown or other
  modified_base (10174)..(10249): a, c, t, g, unknown or other
  modified_base (10355)..(10364): a, c, t, g, unknown or other
  modified_base (10535)..(10544): a, c, t, g, unknown or other
  modified_base (10750)..(10759): a, c, t, g, unknown or other
  modified_base (11881)..(11890): a, c, t, g, unknown or other
  modified_base (12258)..(12267): a, c, t, g, unknown or other
  modified_base (12991)..(13000): a, c, t, g, unknown or other
  modified_base (14499)..(14508): a, c, t, g, unknown or other
  modified_base (14594)..(14603): a, c, t, g, unknown or other
  modified_base (15076)..(15085): a, c, t, g, unknown or other
  modified_base (16352)..(16383): a, c, t, g, unknown or other
  modified_base (16852)..(16861): a, c, t, g, unknown or other
  modified_base (17340)..(17349): a, c, t, g, unknown or other
  modified_base (17562)..(17571): a, c, t, g, unknown or other
  modified_base (17779)..(17788): a, c, t, g, unknown or other
  modified_base (18189)..(18198): a, c, t, g, unknown or other
  modified_base (19108)..(19117): a, c, t, g, unknown or other
  modified_base (20340)..(20349): a, c, t, g, unknown or other
  modified_base (20809)..(20818): a, c, t, g, unknown or other
  modified_base (20928)..(20937): a, c, t, g, unknown or other
  modified_base (21045)..(21054): a, c, t, g, unknown or other
  modified_base (21145)..(21154): a, c, t, g, unknown or other
  modified_base (22716)..(22725): a, c, t, g, unknown or other
  modified_base (23283)..(23292): a, c, t, g, unknown or other
  modified_base (24426)..(24435): a, c, t, g, unknown or other
  modified_base (24856)..(24865): a, c, t, g, unknown or other
  modified_base (25363)..(25372): a, c, t, g, unknown or other
  modified_base (27405)..(27414): a, c, t, g, unknown or other
  modified_base (27677)..(27686): a, c, t, g, unknown or other
  modified_base (27884)..(27893): a, c, t, g, unknown or other
  modified_base (29038)..(29047): a, c, t, g, unknown or other
  modified_base (30496)..(30505): a, c, t, g, unknown or other
  modified_base (30723)..(30807): a, c, t, g, unknown or other
  modified_base (31644)..(31677): a, c, t, g, unknown or other
  modified_base (31806)..(31815): a, c, t, g, unknown or other
  modified_base (33171)..(33180): a, c, t, g, unknown or other
  modified_base (33376)..(33385): a, c, t, g, unknown or other
  modified_base (34349)..(34358): a, c, t, g, unknown or other
  modified_base (34890)..(34899): a, c, t, g, unknown or other
  modified_base (35096)..(35105): a, c, t, g, unknown or other
  modified_base (35455)..(35464): a, c, t, g, unknown or other
  modified_base (35849)..(35858): a, c, t, g, unknown or other
  modified_base (36071)..(36080): a, c, t, g, unknown or other
  modified_base (36141)..(36150): a, c, t, g, unknown or other
  modified_base (36234)..(36243): a, c, t, g, unknown or other
  modified_base (37047)..(37095): a, c, t, g, unknown or other
  modified_base (37275)..(37284): a, c, t, g, unknown or other
  modified_base (37341)..(37493): a, c, t, g, unknown or other
  modified_base (38048)..(38057): a, c, t, g, unknown or other
  modified_base (38667)..(38676): a, c, t, g, unknown or other
  modified_base (39263)..(39272): a, c, t, g, unknown or other
  modified_base (41729)..(41738): a, c, t, g, unknown or other
  modified_base (42161)..(42170): a, c, t, g, unknown or other
  modified_base (42530)..(42539): a, c, t, g, unknown or other
  modified_base (43156)..(43190): a, c, t, g, unknown or other
  modified_base (43580)..(43589): a, c, t, g, unknown or other
  modified_base (44871)..(44880): a, c, t, g, unknown or other
  modified_base (46557)..(46566): a, c, t, g, unknown or other
  modified_base (47117)..(47126): a, c, t, g, unknown or other
  modified_base (47434)..(47443): a, c, t, g, unknown or other
  modified_base (48114)..(48123): a, c, t, g, unknown or other
  modified_base (48558)..(48567): a, c, t, g, unknown or other
  modified_base (49285)..(49294): a, c, t, g, unknown or other
  modified_base (49684)..(49693): a, c, t, g, unknown or other
acacacacacgcacccaacacacacaacacaagaagaacattacatactatggtgagcaaacatacaggtacaggacagacaatacaatggtgatgatagtcaagccctaaatgcagaattacaacatcataaatcacgccagcatctccgtaatggtttccttgaggctgccatctgcagccatctcgagcacgatgtcgcagcctcccagtagctgtcccttgacatatagctgggggtatgtcggccagttggagtactcctgcactcatgggggaatacacgcttgctgcaacttgtgcctttggcgagggcataagagcctaagcaagcagtcaggcgcgctcagcggacggatgtgcaaacagtacgtccaagctccagtaccttgagacgtgctcgaacgtcctggtcggacagaatgtcaaaggtcccgaacgccgtcccggtgctcctcagtgcgtccacgaccttgcggctgaacccacagcgtggctcctccggcgtgcctgcgggcggaaggggatgtgcatggagagcagctgtggcatagatgcggaagcggagtactgtatggagggaccgcggggtcaccgggaggagagcgcatgacaaggaagagacaataatcaggcgcctgggcacagtgccgcagccgccatcattcatcgcatgaagactgccgtccgacgcgtgtcagagcaaggatgacgtgttgcctaggaatctcatcagagctggggagtcgcactggacccgggcgctcaggaggtggaaaacgcaactcatcatccacgacgcgggcgcggtacttgattcaggggcagctttgggccgggggcatgcccgtgcgggcagggagtcctgccttcccatgctcctctcaccacccatctccccctctgctcacccttcatgaagagcatgacgggggaggagttgacgagcgccgtgagctgcgcggtgcggtccgcgtcccctggcgcgcccgcagccgccagctcagcggccagctcgccgctggcggccagctcgaggacaatgtcgcagccgcccaggagctcccccgccacgtagagctgcgggaaggtgggccagttggagtaggccttgaggccttggcgcaccccagcgtcgcccaggatgtcaaaggagtcgaagtccgctcccacggcgcgcaatgcggccacgaccttggcggagaagccgcactggggggcgtcgggggagcccttcatgaagagcatgatggggctgcgctggaccagggcccgcaggcgctcctcgcctgccacggcaggtgctgcttccgtcactgccaaggtgagcgatgcgcggggggggggagtgggggggcatgtggcttgggaagtaccacacnnnnnnnnnnacccgcaggcgctcgtcgcctgccacggcaggcgctgcttttgtcactgccaatgtgagcgatgcgggggggggggagtggggggcatgtggcttgggaagtaccacactgcaggactttcgaggtaccctcatgtgaggcatcccggggcacccggtgcaaggcaaaccgcgcgccatccctcaaggcatctcgatgtgtcgaccgaggcggggttccacacccccccacacgcatgcgcacctggggcaatggctgcgactgcggcatnnnnnnnnnntgcccccggtgcaaggagaatcgcgcaccatccctcaaggcatctcgatgtgtcgaccaaggcgggattccgcacccctccacacgcgtgcacacctggggcaatggctgcgactgcggcatnnnnnnnnnncagggccagggccttggaggagaggtcggcggcggaggcgccctccagggtgtccaccagctggccatccttgaagaaggcaaagtagggcaccacggagacgtcgtagcgctcagacagctcgggcaactcctctgcctcaacacggaccacggcgagggaggggnnnnnnnnnnatagggcaccacggagacgtcgtaccgctcagacagctcgggcacctcctccgcctcaacacggaccacggcgagggagggggcgtcggagacgatggcttccaggacggtgtccaggaaagcacatggctcacaccaccgggcccagaagtggaccacggtctgtggtgggatggaaatggggattgagctatgaagggggggtgggagcctcgcgcgctcagcggcgcaggtaattgcacgggttgcttgcacttctcagcacacctgcggatgcgccctcaggatgtgctggagctccttctccgacgcgacgttgaacaccatcgcgctatgatctcagggtccggtggcgcagccgcttcaccgcctcctgtggctccttctcgggcggacaatcgcgacagcgacttacgttgatgatcaaccacaaattgtctgaaagatagatctggaatgacaagtgtcgattgtcttgggcttgctgaggcccggggatagaggcccctgccacagtgcgtcacgctctcgccccttnnnnnnnnnntcttgctgaggcccggggagggaggcctctgccacagtgcgtcacgctctcgccccttcccgccatcgatgatattcatcatgggagggagcagctctcgcagagacacaaacctcaaggggtcttggatgagaatgttcattgccaatgccgaatacgaggagctttcgtctcccccctgtggatcgctcttgaccatnnnnnnnnnntctcaaggggtcttggatgaagatgttcatttccaatgccgaatacgaggaactttggtctcccccctgtggatcgctcttgaccatacttcaataatggcttgactccagcaacacggtccctttcaatttccagatggaccctgtacgggcaaaagaacagtatgaaccaccatattcattagcttcgtgtgttaaggatgtcgcatgcattgaagagggtcgacgatgggggcctctggggttgctacctgcggtcatgaatgacgtaccctggggcgcatttttctttttcgacggtgccgtgcaggtggttgcgactcgacgctgggcgcaccctcgaacgcgtcacaccgaacacgcacccacctgtgaggatttgtatgtgcattatatcgtacgtagagtcccagccagccccaattattgaaggcgaggaagaggggacccaccgggcacagtcgctcagccttgccagaagcctcgggctttgtgggagctgcgcgaacggacgcttgcaaacgcctccctgacctctgtcactgttctcacagagcatgacgaggtagcaacatgggggaggagaagccttacactcctcggaacatattggtgacggggggagcaggtttcataggcagccatgtcgtcgtccgcctggtgcagcgctacccccagtacagggtgagtgattgaattgatgagccaaactcaagtttgggctgcccctgaatttaccatatgcaataccccagtgcttgggcaggggagggcacatcacgtgctggtcaggcctctgggcacatgcaagcgccttcctggccatcactccaggtggtggtctttgactgcctggactactgcgccaccctgcacaacctccaagccgtcaaggatgcccccaactttaaggtagggtggtgctaccagcgatcgcctgcctggatcgcaatggatctcacatgtgtcaccttgcagggtttgtgaccatgtcatgagccttgaagggcacgccggagnnnnnnnnnntgatcgcctgtctgggtcgcaatgggtctcacatgtgtcacctggcagggcttatgactatgtcatgagccttgaagggcacgccggagccacataccatcccgcctacaccggcatccccacccaaccaatcaacacaacataccgtgcagttcatcaaaggggacatcaagagcggggacctgctgtattacgtgatggaaaccgagaaaatcgacaccgtcatgcactttgccgcccagnnnnnnnnnnacatgtggaccactcgtttgggaacagcgtcagcttcaccatcaacaacatgtaggggacgagaggcttggtgatggcatggtcatggtagtcggccatttactcccagatggcacacaatgagcggggccccgacaagttgaactggctcgagtcgatgccacttgtgggggggcatctcnnnnnnnnnngacacttactcccagatggcacacattgagcggggccccgacgaattgaactggctagagtcgatgccacttgtgggagggcatctccgcatcagccaccctctccgtcactcctctcatcttcttccgtcgcaggtacggtacccatgtcctgctggaggctgctcggcggtacgggcaagtccatcgcttcatcaatgtatccacagatgaggtgtatggggagacctcctttggcctggcggccggcctggtcgagaagagccggctggagcccaccaatccgtatgcggcagccaaggcacgcaggaggggaaggagactcttaaggcttgtggctgtgaaatctgatgttatcattaagtccggcctctcctgtctgccgcacagcactagcagggcacaggttgaggacagctgcatgcccgtccctgtatccgttcccatgcccttgtatggagcagacctgcgctcacctctactgcactcctcctttccaggcgggggcagagatcatggccctggcatactacacctcctatcagctccccgtcatcatcacccgtggcaacaatgtctacggtccgggccagttcccagagaagctcagtgagtgtgactgtgggagcagccctggaggtggctcatgctgtgcagctggcttgtctgttgggatgttcttgtccaacctacggctgtatcgagtatcaagtttttgtgatctcaatcaggnnnnnnnnnncgggatgttactgtccaacctacgactgtattgagtatcaagtttttgtgatctcaatcaggaagggcctgtcctgcactccttgatatccactaatccttcaccccatcccgcccacagtccccaaattcatcctcctggcggccagcgaccggcccctcaccgtgtacggggcgggcgaggccgtacgctcttacctgtacattgctgacgtggctgcggcctacgacgccgtcctgcactgtgggctggttggggaggtgtataacatcggcagcgtgcgggagcgctcggtgctggaggtggctcacgacatcggcgccgcctttggcaggcaggcgccgctgctcgagcatgtgcgcgaccgagccttcaatgataggtgagctgcaaaggtggtgtaattcgggtggtggaaggggaaagagggaggcctgacctatgaaagcaattacggcgacgcggctgtgtcgtgggcaactcctttgcatccgttgatcctcctgctgaaatcgtactcttgtgcgacttgacccccaggatcgggcacccgatgccatcccatctgcaggcgatacttcatcaacaatgacaagctggcggcactgggttgggaggagagcacgtcgtgggagcagggtctgaggaagacgatagactggtacctgaacctgccatcgcccgctgagtattggtgagtgagatcagcgggtgttggcaaggaaggctctctggattgtggatgtgcgggttgcaacaagtgtgtgcttagcgaagatggggattgggtgatggtggtgcagacagagacctcgagctgagttggccttgaggtgaacatactgagccgccaaagcccaagaagggtcattttgctgcacgatacggctgatgtcctcaaggccgtagggcttggtgaatcctgtgcatcagggattcacttacacatgcacactctccatgtatgccaacagggacaatgggaatgtggatgctgccctccagccgcatgctggactgaatcgccagcggcgagtggtgcccctggaagggcaaaatggcttctgaggagccttgggacatgggagaattgtgcactgcctatggctttgttgacatccgctcacaattgaggacagggacagtctatcctgctcgcgacgcccagtgcaacagctcctggtcctggctgacgcaaataacacgatctcgtgtcacacatagccgtggcccgcctctcccacacaccgcccttgccccgtgctgtgaactacagttcaacctttgaaattaaagtagtttcagaggagaggagatattcgagccgttttagtctgagaagtctgagtcttcgtcagaggcagatttgtgcagccccatgctgaccccatgtcgcactgtccgtctgtccacagcctcagcttccgcttcagagtcgctgcatggattgacgcccaccagaacgccagactcttgtagccgctcctccaactgcactcaatttgtgcaagaggagtggttgtggatgggtatcacttttgccgagggtggtgtcaatgcatcctgcaggagaatgttcccaaagacttcacgacctttgcagccagtaagtgcacaggtcagactgtcacaaggctgtggtgaattgagtataccagtccatacaccatacagaggcccaattaacacaccgctgcagttttgaagtccgcgcctgccccgcggataccctcgaatccaacgatcctatccacagcgacgccacggtggaagacaatgacgcaggggagcgttcgaatcttcaacttttctgtgaagaagggggcatcctacagagggagaaagaagagggcaggcaggccttggattgtgctttgtcctgcagagagtgtcctgggacatggaggaccctgtgcccgcagcaatcagtaaattggcattcacctctgttgccagcagttatcacccgagcaattttgctagagcgccggccaagcacagagttctcctgtgctggccctatccctctcccttcccatgaacacccacgcaccggtgccgacagtctgagaaaggaggtccctggaaagcgaggtgcaaggatcgccaggtggcgatccatgctggcgcatcgctgaaacccagcatggaagaagtggcagagggcatgctccgccttcatcacggcggccaggaactctggctctgcaatctccacgagggaccctggccatggacgggaggaggaatgtgggaggaggagtctgggtgagggatctggacaatgcttgcaggagcagaggctgcaatgcgtgcagctaaacggcgattctgcacacggggatactattaaactgcatgcacacagacgtgttctttgtggacagcagctatgcattgcattcctcggatctgccctcatcaaacccatccggcacaacaatgcatcccttcagtctgcctcaccataagaggtctgggcagtctttgctgcacgtctctcggcctgcatcttcagctcctccaagcgctcggcctgcaggctctccacctccggatcgttcagcatgtcatccgcgtagaaggccggcaagcccttgccggcggcagcttgctgactcgccagaatatgctgcagtagtttccagatatgaggacgggtacatcagcaaggttcgttcatcgatgccagtgccccagctacaatcccatctcacccagacccacttgctggtagtcttgtgcggcctgagccatggcctcgcccatcgcgaagctgtgcatctggcccttgaccttggccaggttcgcggcgtccatggtggcagagatggaagcgcgctgggatatgttctcgatcactggtcagcagatttaggagcgatcaaatcaatacgcaccttcaatttcaatgctgtgcggggacatgcaggagcggctcgtgcaaggcaaggtccggagcgaaaagtcaaacagaccgaaattcccgcgcgcgtataaaccatgcccttcacaaacccattgtacgatcctgtatcctcagtaatgaaaaaggtgagaatgacttggtctgcagagatgcttcaggggtttaagagcgtactgttcgaacctggtctgagaatgagacccagctaggtctgacaaggatgtgtcacatgctggatgaccgtggaacatccggtgccatatttgatactgcagggaccggatggaaaattggatgcatttctgacagagtgtctgagacttagggggccagcaatgccaactcctggaaatatagccactggccgcctcagaatcctgtcacacacaagcagtcatcggatattaactctgcactccgcacaccgcaccccctctctagcattcgaaaccatgctcccccgcaacgctccgcagcctccagctgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgcagaagtaatggagaagtgcaagacaatgagttgattgtggtacatcaaccggagaggaggtnnnnnnnnnnccctttcacacacaagcagtcattggatattaactctgcactccacacaccgcaccccatctctaacattcgaaacaatgcttcccgcaacgctccgcagcctccagctgatcaattgggacgtgcactctggttggctggtgtctcgcttgcatgctgtgcaatggactccttggcagagtccgggagctggcggtgggtgcttgtcttggctccatgatgaagatgactcatcatcctgcagatgtaatggagaagtgcaagacgatgagatgattgtggtacatcaaccggagaggaggtgtaggccggaagctcccacgcaaaatgcatcacatcaccactcccaacggaacaggtattccttcctgctgctacatacttttcagcgcgatccttgccaatcgtctgggtctcgtccagtgcgcgcttggcactctcgtacacctgctcagcattctcacttgctacccgcatggcttggctggcatggctgttcgagcccgcgatccagtcctttgcggcgtctccggtccgcttggccgccttttttatctcctcgatggagcatccggcctgcacgggaacggctcaatcgtttgcgatgcccagtcgggctggcgggaccgtgctgggtaacagagcgatgcacgtcgcgacacgtacctcaggctcgccgcgatgtggctgcacnnnnnnnnnntattcgtttgcgatgcccaatcgggctggcgggaccgtgccgggtaacagagcgatgcacgtcgcgccacatacctcaggctcgccgcgatgtggctgcacgctgtgaatttttctaaactgcatgaacgtaaaggcacgcaggcattgcatgtcggcgctcatctgcgagaggcggagcagggatggcccagcggtccgcacagcggaactcattatactggaacggaactgcgtctgtgcgatgtcgccctcaacgattcgttatcgcctgaattgaggaattcgtcgtcgtataatgcactcgtctgctcggtgatcagatgctgcgcaagcatccttaaatgccaggggcacacgtatcctcctctgggtatctgcttggaagccgggctcgttccaacattctttttacagtcggcatcaggtcccccccttcccacaatgctcagagtaatacatgtgacagaggagcgctcatattcaagcacaattttcaaactcaaaacataggtgcatccaggtccacaactgccgggctgtcctcatcgtcccccagtcccagctcctggacctgtgatgaatcctcccagcccatgagctcgtgcagagcctcattcacccgtgctacagactcagccagggcgggggtcaaccccgctccatcgctctcctcctgcacgccccgtgtccactgtgaagtgcaagggaagagagttggatcagttgtgtaaactgaaaaattaaatccgtccgtgattccacttgaatgtgcaggagcaagcaaggtggagaccgtaaactgctgggacggccagtccaccaccaactccttccctcacctgaggcagttggtggctgaggannnnnnnnnnnnnnnnnnnnnnnnnnnnnnnnnnnnnnnnnnnnnnnnnnnnnnnnnnnnnnnnnnnnnnnnnnnntgaatagggaaatgcaatgtgtgcggattgtccttctttatcacatgcatggcaggcagtcacagtggtataccgccaggcttgtgatccggatcacaactgtgannnnnnnnnnaactgtcccggagcaattcatccagaaaacttgcgtcctgtgcacctcccactctcccctgtttcgaatagggaaacgcaatgtttgcggattgtccttcttcatcacatgcatggcaggcagtcacaggggtataccgcccaggcttgtgatccggatcacaactgtgannnnnnnnnnaaggaaagcaaactgcagctcgcctgtgaatgggacccagggagagagggatgcctctcatccactcgccgggggatggaagaaggctgctgggtgccgagctaggaagcgctcagtccgtgcgaccctcttgctgtgaagaatccgccaaaagtccgctggttgacggcatcctcttccctcatcctcctcccgccaacggctcnnnnnnnnnngcagctaccctgggtcaagtatgccttgcacatccctgactatcacctgcttctggcttgaggcagccagctgtgccgccagcacatcgagagcctgggcaaagagctgctggtgctgccccagggcggcagagaagcagccgagcaggagctggaggagcgcccgccactgtatgagccccgcaaagctctggcccaccaggaaggccaggaaagcaaactgcagctcgcctgtggttgggacccagggagggagggattggaggcacatgttggggggatgcccctcatccactcgccgcaggatggaacaagaaggctgggtgccgagctgggaagcgctcagtccgtgcgaccctcttgccgtgaagaatccgccaaaagtccgctggttcacggcatccccttccctcatcctcctcccgccaacggctcacccagcaggaggtcgccgtcccctgcgtactcttcccgaatcagcgagtccagcccctcggaccggtccaggttgtgccgtgtgcgcgcagccgcatcataaaccccgtctctggagacggtctgagtgcgggtgtaaaagcagcggccggcgtgcggcgccgcgaagagggcaccttgggggtgagagcctggcactgcactgtcatccgaccccccgcctccctgcgagcttgaggtggccttgcgccggctgagctgggcctccagggccgcttctgctggggtttggcgcctcccgcgcgaccccggcggcgcctccgccagcacgcagatgttccctcccacgggttggaggcggtcgatgacggcgggggtcacgtgggcggagagcgagcgccaggtcgccaggttggcgaggtcgtagggcgccaggtggcgatcaaactcaaacatgtgcaccgcctgggtgaattgcatgacctgggggggtcgtatagggatgggaaagggggcattcgggatccatgggaatgatcactggtagagttgcgctccatgaggcatgcctttgttgcaagtgtggtactctggtgccatcaggaggcccagttcccctgggaaggcgccccactccccactctgctggcaagcccacctcagactcctcgtccacagccacaagannnnnnnnnngctctggtgccatcaggagtcccagtttccctgggaaggcccccccactccccactctcctggcaagcctacctcagactcctcgtccacagccacaagatactcctgctgcggatcccagcgcttgatgacaacctggagcagggattcatgcagggctgggttatgttctgtaggactcgaggcgcagggacctccgcatccattgtattctgtgcaatggcaagcgtgaaactttgtataacaggagtgcagcccttccggcaggtgggagtaacattcgaggcatgttcgagtgtgacctcctctgcacacacctgtcccgcgctggggtggatgaagaagcaggtgacgggtccaaagtcacnnnnnnnnnntattgtattctgtgcaatggcaagcgtgaacctttgtataacaggagtgcagcccttccagcaggagggagtaccacacgaggcatgttcgagtatgtgacctcctccgcacacacctgtcccgcgctggggtgggtgaagaagcaggtgacgggtccaaagtcaccctgactgccctttgcgcagtatgacaccaggtggggccctggaggcagcatcttcacccctttaaactctgggccagacaggaagacctacgaattcggtcatattctaggtcacattgtctgcaacccaccatggcgcatcgagagggctatcctcgatgcgtcattgaatccctaccgcgcacctggtggtcgatgcccaccgctgttcccggaggcacgtccaggaggagaatggtggcccctttcttaaggagatctcgagccgcaacgttatccatgttgattctatatggcacagacatcgtggagatgttggcgatcgacaaaccgtgagcagcgcggacagggacgccaccctctgccctcagacgaccggggttcgatcaggacctcaatttgagatctcggaggccgaagtatatgcttgagtattacctccagcagacttaatcgtgcatgctgtgttgaatatatataaatggtgcattcacagcgcagaaaaccatccaagttctccggtacaccaattgagaaagtgggaaaggccacccgannnnnnnnnntcggggttcgatcaggacctcaattcgagatctctgaggccgaggtatatgcttgaatattacctccagcagatttaatcgtgcatgctgtgctgaatatatacaaatgctgcattcacagcgcaggaaaccatccaagttctccggtacgccaattgagaaagtgggaaaggccacccgaaaggctatctattcgccccggcggttgatcggggcctctgccacactccctgacgcgcatttacgttcgtgccctggaaacacagcagcggacatgtcactggcaacctgctcccacaagctcgcggcgtatcccctcccgcagaagtcccttctgccacccaggggtccatgcagggtcaggagggttgtcccccatgcggccatgcgagaccataaagtgaggcatgaagtccccaatgcacaccaaaaccctataaaagcttaatcgtatgaagctccgctcccgcatgctttggccgctcaatgccgtcaatgcaggctagccctgcccgtcatcccaagtaccctcttcacactccccgtcaggtggtcgctgccgccaccgggaccatcgcatcagcagctatgcttctagcccctgcagcactggcagcccaggagcacatgatgcttgcagaggtgagtgaagtagggaagccggcaggcttttgtaacagtcgctgggtgctccaggctgtgcagcattctgtgctagtacaagtgcctgccttagggtcttgagattcctccccacacctccacatcctccacaatgcagggtgaaccgatcctggtccaggtgggctgggcggcgacatgcgtcatcttcaccttctccatctccctggtggtgtggggccgttccggcctctaaccagaccacaggcagcgccccttgcggactgagagaagaaatatgggtcacatggagctgcgtagaatgtgtaaacaagcagtgcaccaaggggtaaggtcacgggaggtatgactggaccaaaaatgggctgcagtggtggggtgcaggattgagagggggaccccgacatccagggagcgtgcctgacactgtcctgggatacggaaaacccagtcagatgcccagggcacctgcaatttccatgacggtcaggctggtcagggggaccccgcccttctccgcccggccgagcgtgcacctgccgagggacaccttgatgaagggccagccaagcgccgcagcagccgcctcctcctccctgccgtcccctattgccacgaaggccgcgctccccgggaagcggtcacgcagcctggcaaagcactccagcttgccgtgcacgcgagaggacagcacgtccctgccggcgaagaagcggtccaggcgaaacagggccagcttggccagggagggcagcaggtccgaggaggtgacggccacgtgccggacctggggcaggtggtcgcggacgccagcgtgcgacggggtccccagcgcggcgcccagcagcaccggcagnnnnnnnnnncgggggaggggtgcagggcccggggtcgtttgacgccggtgccggcccctcacaagattggattcttcccaccacatccccatcannnnnnnnnnaacagccacatgccggacctggggcaggtggtcgcgggcgccagcgtgcagcgggggccccagcgcggcgcccagcagcaccggcaggcgggcaaggcaggcggccagcagcccctgcgcggccgtcagccagccagcggccagcgtgtcagtggcgtgccagagccggtcagagctgggcagcgcggcgtcggccagcaggccaagggagtaccgcaggtgcgcctcccggtaccgatatgccgcttcggggggaggggagcagggcccggggtcgtctgacgccggtgctggcccctcacaggattggattcttcccaccacatccccatcaaagtcgtaggacgccaggtcccggccatcatctgccgcggctgcatcctccagactcatgacaccatgagtctccagctggcattgggatgtgtacgggagtttggcagtgatggaagacacacagcctcaaaagtgcnnnnnnnnnngtcatctgccgcggctgcattctccagactcatgacgccatgagtctccagctggcattgggatgtgcaaggtagtttggccgtgatggaagacacacagcctcaaaagtgcttcccagggacagcatcagtcagcccatgaccttccactgaccactcaagcacctgcttgtagaagaggtgggagtccgcgaggtctagcaccgcggaggaccactgggagcccagggcctgggcctcccctgcaccgctgtccgagtgggcacgctcccactccccattctgcagggagttgaaaataaccagggtttcgtcaatgtcccagaccagaaccacgggggggggcggcggggcctgcgcgtgagtacgggccttcttgctgtctggggattcggtgccaccacctcccatccaatgagcgggggcaagtcagccctcccggcgctggatccaatgcagtatgcgctcagcacccgagaaaggtttaagcagtgcattaatgggcaaattctccggtaatcctgtatcctcgagcgttttgttcacacatgcgagatcttgccggggtgcccggcccgtcatggctcagcatgacgtcgcgcaaaaagcagagcacagccagcgccagttcgaatgggagcgcatggtaccaggtgcgcggcccaccactgtcgaatgcatacatcattacgatctactggaccgcctcacctcctccctcgagcttgtcggaatcgggtcttgcatcggctgtttctcccatccggcaagatgtcagaacccaggctgtgaggggttcgcggcagctccgaccctgccccctgaaaccccatggataccccgatgtacaccagtgtcacgggagaagagtatgtgctggagccaggcgaacgaggggagaagcagcagcactcgccctggtccgcaccgagggacaggcggaagcggaacaaacacaacccctccccgctcaccatcagcgaggactttgagtacaccagtcccccaaaacgtcacaatggtacgattgtggggccgaattctcatgtcgatgtggcacagggcgggattttgaaggatggtgtcgcccctacctgtcaagcagcccatgctcctgtgctgtttcctcctccagacggacagagcccggctgccagggccctacgcatgtcccagggcctggacgaccatatcccggcactgcacacggcaggacccctggcgcaggtgtgcttgatgcgcgggtcgcttgtaccgaggaagtacnnnnnnnnnnnnnnnnnnnnnnnnnnnnnnnntgcgcgcaagctcaggctgctcctttgaaggacagccacatcacaaggtacccaccctgctccatatgctgcgctctagagggcatccccccccctcacacattccttctgcagggattgttccatcgcagctcacccggcccccctgaccgcaagaagtactcgcccctccaggcggggctggacgtcgcctccttccgcgacatccagaccctgcagtccagcatctcaggtggcggagccagtgtgcgtgcatgcatgagagtacgaggggcgtccccccctctggtaccctggatgacatcggcagcccatgtgtggggtgcacccaggctgggacggcgctgagcctgcagctgtggacctgggatgatcacccccctgacctcctgtgaccccgtcgtccatccacagggcgtcgaagccacgccgccgcctccccagactccctccgccgcaccccttcgcnnnnnnnnnnctccatccacagggcgtagaagccatgccgccgccaccccagactccctccgccgcaccccttcgccctcccctgcgccgcccgcctcacctgtgcccgccccggcgccgcccagcgtggggggctccagcccggccacgtccatggttgacgcggaggggtgcggcctgctgagcacgctgcgggcgctggggcccgacccggcgcagcacgctcggcacggcgaggatgtgggtgcggggcccctgctgagcgcgcccgcgctgagcgcgccggcgcacggccaggccaccccgccccgcccgcgccggggccagggccactggtggcaggcgcgtaccccggcgcgcaccaccacctcttccctggaccccggcagcacgcggtcctcggagcgcgccagccggggcagctcccaggcgcgcagggggaggttttgtacttttgtgaggaggtggttggggggtggagtgcgtttnnnnnnnnnntgcgcaggggagcttttgtactttggggaggaggtggttggggggtggagtgcgtttgcaggtggctgggcaggccagggccgcatgggcaggaggtccgatgcatctggtgctgtgcagtggcgggcgctgcaccacgcccccctcggctcggccccgggatcgaagcctgtcgtcgacggccagccccttgctgggcgtgcgcccatctcnnnnnnnnnngtctggtgctctgcagtggcgggcgctgcaccacggccccctcggcttggccccgggatcaaagcctgtcgtcgatgtccagccccttgctgggcgtgcgcccatctctggaccatggggtaccctgctgtccgccatcctgtcaccccagcccacacaccctccacaccctccacaccccgcccaaccctgcagcgcaagacctgcnnnnnnnnnntcaccctgctgtccgccagcctgtcacccagtccacacacccctccacaccctcccgccccccgcccaaccctgcagcgcaagacctgcttcacctgccccagccccttctgcctgggcctgtccccggccagggactcggacagcgacgaggaggtcagcgtccggcggcccggcgcgggtgcagacggcttcgtgctgcgcacccgcgcagacttccagctggcgacgccgcggggtgcggccgtcggcgctgacctggtccgcgagtcgaggcgggccgcgctttcttcagggggaaggtgagaaagtgtgtcgatgggaaagggtggggtgcgagcagagggacggcagattccttcgtcaggccatcctgtgccctggtccgggaagctgaatctnnnnnnnnnnaagcagaggggcggcagattccttcgtcaggctgtcctgtgccctggtccgggaagctgaatctgtgtggggccgatggagctcagcatttttgaagtaccgaacgagcttgatatctttctcgccacactgctcgctcctgccaccccccgccctgcacaggcccaaggagcctgccgcggaaccctcggtgcgctcctcccgtgatgcccagcccctgacctcccgcttcgggctgagcagggcggcgctggaggcgccgcacccgcccgcgcgttcgtccaccttccacgcccccgccgccgcatgctggccggagcggggtctcacccccaacagtgagggggggcgcagcgaggggccgtgcccggggatgggcccagcctctgagacgcccctctctgtagaccacctcaacgacatgctcaggcaggctggggaccggcgtgtgtgtgtgtggagggggcccatgacccaaggtcaggtcccggcccagtctgccgcagctggcatcaggagtccccggtgcccacagtcccctttcaagcccaccgcctggcctcgagcaggggccgcgacaccgacccgtggcagacaccaccacccaacccacccacacccctgcccgcagggatttgtgcacgttaggcccttcaaacccccgcgatgcggaggccctggtgcgggacgcctgcaccggggggggcctggtgcccaacgccgccacgctgcgcacgctggacaagatctgggcggtgcacgagcagttgcacgggcagtactgagtctgtctgacgggaaccaggggcgtcgcatggtgccttacagctgtgagacgcccgtacatggggttactgagggggacagtgaatgaaatgagctggagaggggggctgcagcccgcagatgnnnnnnnnnntcgtacatggggttgctgagggggggggaagggaatgaaatgggctggagaggggggctgcagcccgcagatgggaaaacccgctcatcggtcaccaggaccagggaccctggccagggaatcggtgcgtggcggagtctgcagcccgcatcattcaatggccgactgaatcggagcgggagggaatctgggccccccggctgggccggtgggagcagagcaaaacggggtactcggaccgtgccacacctcgcccctgcctagggggagacctcctctgcgctctccacctcgatctgctgcttgccgtcgacgggcaaccccacaaaggcggtgcccagcacgacaatagacccgccgtcggtgcaggtgatgttcaccagcacctcgtagttcagtccggccacgacctgggtgcaggcctgcaggggcacggccgcaaactccccgcagtccattggattgtggtcggacgacatgaactggtctgtaagaagaggggggtggggtgggggtgatttgctggaggccatgtctgatgtgtcccttcacagcctcatgcatagcagcttccagtgccacacacccggcatgcacataccggctactgcaactgcgacatcctgggtttgcgatgagctcgtgtccgccttgtggaagccgcctgcaggaggagtgccccggcgtacgtgtcggtaacgaccgcacagcacacgacatgcccaaggccacgctagggtacgccgaggtgacaacatggcaatgcaatgttcttgaaattccaatcaatcagtcaggagtgctcaccggctaggccctggtcgtcgcagagctcctcttccgcggagattgtaggcgcggctgcagcacaagcgcagagcagcaacacgatgaagcagctgaacctcgacatggttatttctcgtctaagtaacctctcggtagagctgataggatgtcggagaattgcaaagtgtccctcgacacgttccgcagacccgtagtcgaaattttcagcgggtcgggctttgacgcgtgcgcgcccgccccgcccgcgggccggatggcttgccgcacccacggagcttccacatggaatgttcaactggatccaactaacaccattggtggacaagttaccagcaatgacgcttctcatgtgttgagtgagggtcgtcaagcccatgaacaaggcaacgtggtagaacatgtgctcctgccannnnnnnnnnagagcttccacatggaatgttcaaatggatccaactaacacccattggtggacaaattaccagcaatgacgcttttcatgtgttgagtgagggtcgttaagcccatgaacacggcaacgtggtagaacatgtgctcctgccatgcacaaaggatcgaagcgacgaccggacaatcagcttgagttctactcccggagccggcacccagagtcacatcctgcactcagatctgcgaggaacctccaaacctgtcgcactagcacaaaagcaaggcagtcaccaacccctcacgcatagcctggaaatcctcccctattattggccacactacggctcagctctgatttctcatacagttggcatgatgtctacagacaagtcatggggaaagccttttttcaaggcagcagcaggattcgatgaggttgagttgcatggtgtgaacatggattctagctcnnnnnnnnnngagttggcatgatgtctacagactgaggtcatggggaaaagccttttttcaaggcagcagcaggatttgatgaggttgggttgcatggtgtgaacatggattctagctcnnnnnnnnnngggaattgagggatttgttgaggaagaagaatacacagaagtctcttgctaggtacgagtttaggtcggtcgatgttagggatgcaagtggacttgttcaagctgctnnnnnnnnnntacgcactcgcttgccctcgtaagcttccttactcggggacttgctcaacctcgcccacgatcaggggccggccgcccttgactggcagtnnnnnnnnnncacgtactcgcttgccctcgcaagcatccttactcagggacttgctcaacctcgcccaccatcaggggccggccgcccttgactggcagtggcagatgcgcagatccgtacacagtgatggtggtgtcgctgacagggcagatgatgtgcatgatgacctcatagttggtgccggccacgacctgggagcaggccttcaggggttcaatgacaaagtcgtcgcacgtgaccgtagtgttgtgcgtcaggatgaactcatctgatgattaaaggagttaagggatttattgaggaagaagaatacacagaagtctctttataggtacgagtataggtcggtcgatgtcagggatgcaagtggacttgttcaagctgctgcacaaaaactgtacgagtgagggctgtggcatgtggtggacaatcacgtctcaagaaacttcccctcggcagacctcattcctaccagcgatggcctcaaagacttccagagtcgcgggctcgttgaggctcgcgggcgagaagcctcctgcgactttatgattggacagattgagcaccgttggctggtccgtaagccttcctcgcaaggtgcataggcagggcgcgcccccttcgcgaattggagatcgggagcaaacattgaagtatgaaccgaatgtgcactgacctggggcagacttgtcgctgcacagctcttcgtggggcacgatcagcggggaggcagtggtcgcaacggccagggccagaacaaggatggctgagaacttcataattcttataaatgatggcaattctgcaatttgcggcttgtttgcaaccagatccgagttgtagagagtaaggccgtccacagcccttcacccgctccttgtacccatgcgggacagctgtggttcaaacgagcagtatctcagcggtaccagcgacctgcacgatctgcaaagacttcgcgcctgtgggcttgttgctcgcctgtgcctctgtttcgcgcatgcccacattccaggctcaaccatctacattgggtatttagccagtggcatgaggagagcacctaggctgtgacacgatggcaggcgaggacatctggtcacccaatagccaggtgcccaggaccgaggtccgggtgctctggctggcggggtggctgttggccatggccttcgcagtctccccttggggttatacccatctcactgttccctccgtcagcacccctgtcacgcctgcaaggttgtcgtagtggagggtaaactgcagggagaaggggcggggtgtcggggctttgtcggcacacaccctaacgcaacatcctttgatcgcccaggtggacacaggacatctggttcgtcatatttggtctccaggcagtaggcatggtttaccagctcctcccatcaggtgaggggatcatactcatgccctgtcctgctgtgtcccttcaagagtctgttgtgctcaacctccttgtccatgcaccagcgctggcaggtatccccattctgagcatccaaccctctcctacctgttcaggctacgatccagatggagacaagcagcgnnnnnnnnnngtcatactcatgccctgtcctgctgtatcccttgaagcgtctgttgtgctgaacctccttgtccatgcaccagcgctgtcaggtatccccattctgagcatccacccctctcctacctgtttaggctacgatccagatggagacaagcagcgttgtgtgcatgccaccagtttcctgtgggctctgggagcgatgtgcacgctgggctggctggcggcgctggcccagggcaccccgggtgggacctggctgggtctagcatgcatcctggcagccctcttcatcacactgcgcagcctcctgcacctctacaggtgtttgttttggaccgatgatggggattgggaggaggggctggtggttgcattggaggcgttccatttacgctgtacatgtctaggagtggttgtcggtttcacattcccggctgcccggcagctggaacatggtggagatggctggccgagaagatgggttcgatctcaccagcccagcacaaccccgctcgctgccaggcctcatccttccctcacaatctcacaggctgagacgccaatnnnnnnnnnntacatggtggagatggctggccatgaggatgggttcgatctcaccagcccagcacagacccgctcgctgccaggcctcatcctcgcctcacaatctcacaggctgagacgccaattcgggcgcacctccagccgcctgctgtacctggcctacttcctcccgacctccatgctggcagcctggctgacgctggctgccgcgaccaccgcagtggccgcactcatcgtcagcgtgagtggctctgccagtcggtgcagacagcttgggggaccccagcgctgtgcggacccatgtccatgcctggctggaatgctgaaaggatacttcctccacacaccacaccctaggtggacccagcggacctcgacctggcgagcctggccttcctggcaggggtgatgctgctgggtgcggccgtcacgctgcgtcagcgcgacaccgtcttcggactgaccctggtgtggggcctggtggggacgtatgagggcaccagcgacgagtccgccatgctccaatgggcgagcctcgccgctgtggccctcatggtggtcctctgcgcgctgtcaggtggggggcgggtgtgggctggtggcgggagggcgtgcctgtgcgggagaaaggatgaccctgcttgccgggcatgcctggtggtaggagtgaggaggtgggcccatctgtgctccatgcaatcccaggcccacagctagagccccttcttgtttgtgcagtcttgcggaggaagggcagccagagcccgagcatcgacatcgaggcgcaggagccgctgcgggcgcatgagctgcgatgagattgatcatccaagcacgggactcctcttgcggcgtgcatggtggccctgggtccaggtaccaggagcaccaccagtggaccacaccgtgtgccatgcccatcatctatcgctcttgtcatacaaccttgcagtgagacatcccctggatgcgcaagccttcatgctgcttttcgctatgtcaacattcttaaagctctccttcgccagtgctgtgcagcaaaaattcaaaccctgcaatggtacaaagggcaggcgattggtattgttggccttgtagttcacaggcaaggtaccagtgagctttggtgaattcgcatcccacnnnnnnnnnnagcgtgcatggtggccctgggtccaggtgccaggagcaccaccagtggagcacaccgtgtgccatgcccatcatctattgctctcgttatacaaccttgcagcgagacatcccctggatgcgcaagccttcatgctgcttttcgctatgtcaacattcttaaagctctccttcgccggtgctgtgcagcaaaacttcaaaccctgcaatggtaccaagggcaggcgattggtattgtcggcctttgtagtccacaggcaaggtgccagtgagctttggtgaattcgcatcccacggccagggttcaaacgagacccagcactcccacctgagaatgctgcccctgtatcaccaacccgggaccgcatgggaagagtccagagcgacacagtccacccctgagccacaaagcatccatcctnnnnnnnnnnttgctgcccctgtatcaccaacccgagaccgcatgggaagaggccagagcgacacactccacccctgagccacaaagcatccatcctctcgcactcaccactccagggcgaactgacgccctaggtcatccgcactctcgttctcccccttgtagccatagtcctctgtgcgcctgaagtaccaggctgccttggaccctggcaattcgcccacgtcagcaaacacggcgttgaactccgggaaggactggtcgacctccgacacagcaaagtagttgatggggaactggctgctcagcatgatgcctgcgggggagatgcaatgggttcgccggggaggggccaaatgaggtgcctctcgtgcagactgttccctctgccacaggcatccttggtggtatggaggcccagatccacagccacaactattttgcactgcgcacatccccgactaccctcgggagggggttcagtgcactcagacttggcgcatacctnnnnnnnnnngacgaggtgcatctcatgcagaatgttcccgctgccacaggcatccttggttgtatggaggtccggatgcacagcaacagctactttgcattgcgcacatccccgactaccctcgggagggagttcagtgcactcagactcggcgcataccttccgtgtgccggggctggcgaatgctcagcatgaagcccatcgttcggtccagggtgacttccggggccagcccatagggctcatagtagtccttaccaatgatcaccctgtgcacgctttccttgtcctggggagaaatgttgggtgagaacattgctggtcgagaatgttgaatgctcatccggcgcgttgaccgcccttgatctgtagggcaaccctggtgatgcatctctctactggaaggcctacaagtactcaaacaagagctgcacggcctcacctggcaggtgacagtgatgtcatacagcatgccgccattcgtcttgtaggccagatggaccttgatctggtacttcagctcatgcccatcctggatgaccatgcactccctgcacaccacagtgatggggtcagaaggcagtcgggacagattgcatgtgacagtggcagcccgagctccggccaaccacgaccagacctgttggcaagcctaggttgtccatgatgcacatgcacagaccctcacctcacggcccttgccgcctcggcctcctcggcctcccggcgtgcctcgtcctctgccgtgatttgcttggctgggacaaagtccacccttccctccgcaagcagctcctcgttggcctcaaagacttccttgcagcccctcagcttcatccttgtttgcaactgcagagatgtttggttgtggagaggggtgatgggaacaggggcccaaacgggaagcatgggcccgtcttggaaatgctggcgcaccaatccgcattcacacagagtatagcaacgcatcccctgcaagctgcacatgagatcaagaggcatcaaagcacacctccttgacggtctcaagagccgcagccgccttcccacgctcagagatggtgaagggttccaccggctgctgccaagcagccttctcagcatccactgcaagatcataacaaataggagagccgggttgagtacgggcaggtgcaagaaatacccagccataggtcactctcactccagaaaagataagcatgcaaccagacttgaaccagcacaatctcacatttgttgccagggggaggtccaaaaccctccttaaaccaggcagccctgatgcccaccagctcggtttgatccaatcgtggcaggtgcagtgccctgatgcagagccatgatcagagggtgaggtgtaaagctggtagattgtgacagtggatcatacagtcctcgaattaggttcctcccttttcctcttggccccgtcacccacctgatgtgatgagtcttctcagggcgacgggagaacacggtgcggagtgagttcttcagatccctcgaaaacccaatgtactgcaagtccttggcctcatcatacaccgcaaagacagtggcctacaggaagttttgagcactgagggtctgtactcagaggcagggacgtccacgctctacatgccgtggtctcccagagcatcccggcccatcaaagtcaaaagtgcacgatgcaccttctcaccaatgttcctgccggcacttccggcctgatgaggcctctcttatccagcaccgcaaacatctcaagactctcgagggactgggtggctggagcagatgccgatgccgcagcatgcagcctagattgcttttgcgcgcgggtcgcgggaggcacggagggggctttgggtggaagcagtccgtttcggtgcatggagttctgtgcagcacgggcggaccgcagtccacatggccccgctcgaggtgtcacctccttagctaacctgcacccggggattatatcgattaactttcaagtttcatataagaattggtgagtctgcctgcgcaagctgtgttgcgcacctcctgtcacnnnnnnnnnngggccccgctcgaggcatcacctccttagctaacctgcacccgggaaatgaatcgatttacttccaagcttcatataagaattggtgagtctgcccgcgcaagctgtgttgcgcacctcctgtcacccagctgtgccctccggcacgacatctgtagcgacatggcgcccatggtttttcttgtatatctgaaatgtgctataatgtcaaatgatagccacctttgtgttggtatgatgatcatgggtccatgtgtccagatnnnnnnnnnnttttagcgacatggcgcccatggcttttcttgtatatctgaaatgtgctgctataatgtcagatgacagccacctttgtgttgctatgatgatcatgggtccatgtgtccagatcgagggtgtcgtatcaccccggggaacggcccgaggccgatttgtcatcactataatctgaacagggcagaacgccagctgagnnnnnnnnnnacctcaatggcgcgtatctccccgggggacggcccgaggccgatttgtcatcactctaatctgaacagggcagaacgccagctgagagcctgtctaggcaccaggcatgttcttggtgcgcccatccgggatgttgagcaggacaacacttccaccatgctccacgccggcatccacgatgaagtagcccttgcgctccagctggatgatgtctcccttctgcagctgcgccatgttggcatcgccagcggcggcagtgatggtgcgctgaggtgagggaggaggaggggtgggggatcaaggcagtggaagagactcttcctctttgtaggcacgtgagagcgacatttgacccttccattccactgctgtcaagcagggtcccccccacgcagaccctgacccctacgcaccgagttcctattgacacactcctcaaatatgtcatcctcttccagcctcttcttgttgatgaggtaacccaggtggtggagctcgagtggtaccagctctggaatctgcacgaggaggcggtgtgatgttaggggggtgacccgtccttcccctgagctcatctcagatggatggtggagccttatccagcaaggcaatctgggtgtagatgttaccatccaagatactaccacatcacaatgcacccaacagaatgactgttcttcctcacatctgcaagccaggtgagtttcagcttcgtcttcttgaagtctccctcgaggtgaagctctgcatgggtgggtagtcaggatagggggctgacatggacagcagacacggcctctggactagttggtgttacttggaccagatccaagcggcaaatgtccaggttgtgatctgtaacccccagaccacagaggatgcttcgcacacatgcccacctgcttcaatggactgcacagtgtcatcctcgcgcttagagatcttccgcacaatggcattgccccagcccatgagcgtgacctcctccccctcggccaccacggcggcgtcggcctggtcccaccagatgcgctgcaggtggtagagaggggcagtagtgggcgacaggccgggagcaattcctagagttggaaggaaagcaacccctctggctctcagtgactctgtagaggccgggactcccnnnnnnnnnncagtgggcgacaggccgggtgcaattcctagagttggaaggaacgcaacccctctggcactcagtgactctgtagaggccgggactccccagcatccagctctccaatgcctaaaccgaaggcatgtacattgtaaacccatttcccacccgaatcccagcgcaactcacattggtgcgggtctggatcttctcgcccgcagggggatactttgcgtgcttaggcacagacacggtctcgggactggcaggaccattggaaagcgtgaccagcaccctggcaattgccaatgggggggttggaaccggtggacgatcatgcaacaatttgtatggctcatgtgagggggacagggtgaagcgtgatggacgaggaggcacagctgccaggagctggtcactctgtccacaaagccctagctgcagaagccacaccctccccctcagtcatccccgaatgtgcaggacccctcgcccacctgttgctctgctcgactgcagtgtgacgcgggcacacagggtcaatcagcttcttgttgatggtccagatcttgtcccactcctggcagagcaaaagggtgcaggattgattgtggagtacatgcgatctggcagcagcatgccagtcatgaaatagcaacgggattgctcggcatccgactcctaaatcctgcatggctccatcccttccacagtacacctctcagcttcccaccggttccccacctggtacgtcatgttcttggaggcgccctgccccagcatgaactccttgagcgcctccatctttagcccacgcctcatgatgccctgcgagtgtgccgagcgcgttaggtagaaaaggtgaatatggacagcagcgcgggttgtgggcgcaggcgcgctcacaccatgacagatgtgccacaagcctctacggtggaccacaccgcatgagcatgtttgtcaagatcatggaggctcacaagcttcgcctgacatcgatcttaggtctgctctaccctcatccccgttcccagagcaagtaaagccgcactgcattcgcattccaaccccttcgtatcaacagcgcaggaaacccacctggacagtaggcatcctggggtcatcccagccatccacgatgccgttttccacaaaccaggtgagcttgcgcttggagaggacggtgtagatgaaggacagtctggcgtagtcccacatggtgacgtggggcagaccaggccagacatcctgctgcagcttcaggatcatgtagaactgggcctgtggagcaaaggatcaaaattttgggggggggggggttgaaaaatgcagaaactgaaggaggggtgatgcaatgatgcaggcatgaaggagcacgtggtggagcatatagcttgtataatgtggagaacccccacattacatcaaaccatgcccgtcccagtgctcaaacgcccctcgtacnnnnnnnnnntgcatatagcttgtataatgtggagaatccccacactacatcaaaccattcccgtcccagtgctcaaacgcccctcgtacctcgcgatccttgtactccgaggtgcggagcgcatgcgtcacaccctcaatggcgtccacaaaggggcaagcaaagtcgtaggtggggtagcactgtgcatcatgggaagtggtaaggaggggctgagctcagacaannnnnnnnnnnnnnnnnnnnnnnnnnnnnnnnnnnnnnnnnnnnnnnnnnnnnnnnnnnnnnnnnnnnnnnnnnnnnnnnnnnnnacgacatccaccgagtctcagcagctctggagcgcataaatgaggtctgtgccccaagtcccccccctgccatctcgcacacaccttgtacttctggccggtcctccagtgcggctccaggttgcagcggtacgccacggggtccctcagagctttgttgggtgccgacatgtccagcttcactcgtaggcagtgccgctggccctcctccgacgccaccagcatctcctcgaagatcgccgtcgtttccgacacgggcctgtcccgccgcacagaaggcgtccccgccatgcgctcctgaggtaggtaaggtggcagagggaggggtgtgagcgagccctgatcaagccaccagcaggtcggcccgggcgtagtgcaacttcacctgcatacctccagagaggcccacccccaaaggcgcatccccaggcgtctgcttgcaacaaacttgaattcaccccccatcagcacatgctactgttctcccacctcacgcatttgctccacgggtgtatcatcagcatacagatagcccttggcgatcatacgccgcgcacattcggccagctgctcaaagtagtctggatcggattttgtgattgggagggtgtgagatggggggaaggagagagtggagagtgctggattggtcgatgccattgaccagctaccacaccgcagcccctggctctctgcaacccaatgcataagggccgcaccagacgtgtaggtgatgcctgcgtagcgcaggcccagcctctgcatgtcggcgatgatgctctgggtgtactcatccttctcctggttatagaagggggggggggggggggggggggnnnnnnnnnnnnnnnnnnnnnnnnnnnnnnnnnnagtatgaggtgccggccttatgtgtaggctcaacaacccagattgccggtaaagtgagggcaggcgggagagtctagtgcaatcagcttcgtaatgggcgcgccaacagatccatgcccggactcctcnnnnnnnnnntgaggtgccggccctatgtgttggctcaacaacccagattgctggtgaagtgagggcaggcaggagagtctagagcaatcagcttcgtaatggacgcgccaacagatccatgcccggactcctcgccctgccaacctttgaaggattggtatcgtcgaagcgaaccagcattcgccccttgtacatgtcggcgatgtgctgattgatgagggccgccttggcatgcccaatgtgcaggtagcccgagggttcgggcgggaagcgggtgaccaccttgcccatctctgcgttctccagcccgatgtcaaaggacccggtggctgcgccgggagggcagagcgtgaaggtgattgaaggggccgaggccaaggaatgggagcaggataagagtgcagggtgtgcttgggaggtcggccccagataccaacatcccgagtcccatggagccgatattcacccagcaacccccgcacctccgccgccggccgccgcgcccagctccgggttggtgggcttgggggtggtgaagcgccggcgtggccccagcgcctctgcgacggccgccagggcgggggtgctgcccacgtggtcgtaccagcgtcccaggtgagccagggcggggttggccttgcgcagcttgtcccactgcagcgtggcctgcagctggccccacacagccacgtcggctagggacaaggagtggcccaccaggtaggtgcgcagggccaggaaggcgctgatcgcctcggccaggggctccagggtcaggccggggaccagagcggtggaagtgtcgatccaggagtccacctgggaagcggcgaggggggaggcgccgtagtagccatcgggagttcgggacaccctggccaggaaccgtaggatggtggccgtgcccaccagcttctccctgcggggagacatgggaggcaccatggattggggcataagctggggggtacattggttggcgggcgtcgcatcgaggctggcacatcggcagtgcgtcaacaagggcccaccatgaaccaccgggcggcacgcactgcaatcctcaccctccatcgaagatcagctccggggctgcatctttgggcagggaggcgtcagtcttgatgttgatggctgcacggagtaggcgtgcggtggccagcaccgcaaacggggtgttgcgttccgtgtacacgagggtgggacttgagcacccgcccatggctgcactagggttcaggccagccacgagatcatgcaatttagaatgaatacagggatttcattagcaaagtgttgccttgctcctctgccagccctgtactgaacaagatatcagagtctggcgcgctgggcttatactgnnnnnnnnnncttgcctcgctcctctgccagccctgtaccgaacaagacatcagagtctggcgcgctgggcttatactgccacctggcggccaaggtgcggtgcgagacatcgcggggggtgaccttgtcgatatacccaatggcaagcatatgctgtcgggatccatccattgataggacaacatcgaattacccagagcttcgnnnnnnnnnngtgaccttgtcgatataccccatggcaagcatatgctgtcgagatccatccattggtaggacaacatcgaattacccagagcttcgtcccgtgcagtctcctggatccatgccccactcgccatgttgatacatggaccgcacgaggatgctccaggcagcgacctcatccaggaggggagcctggtcgtggtgtatgagcgcttcgatagcatgaaggcagtgaaagtcacccccaagggccagtacagcaatcgatggggcaactttgcaatgaaggtaccggtgcactaagctcgtattgggcactctagctcatgagcgccacgaaccttcgtgctgacagactccagcccagccaccctcatgctccacaggaatggattggggtgccctacggcagccgcgtgcacgcccgggccccagactctggctgggcctatctgctggcccccacgccagagctgtggacggcagtgctcaggcaccggacccagatcctgtacgtcgctgacatcagcatggtggttgccatgctggagctgcggcctggttgcacaggtaagccctgggtcaatgcgctgtgtggatgccaggcctgctgtcatgcagagcccttgcattctgaaaatctcgccctctacccgcactctgccgtaccacgccctcctcacccccactctcctgcagtgctggaatctggcacggggagtgggtccctgacaacctcacttgccagagcagtggcgcccacgggacacgtgtacacctttgagttccacgagcagcgggcacagctcgcccgggaagactttgctgccaatggtgggcggcgaggtttctccttttcaatgctgtacatagacacacacagtgtgcatcatctggagggttaccgtgtgcaaggtttcagctccgtgcagcgccatgccttgtctctctctttcttcctgactcctacttannnnnnnnnncggtgggcggcgaggtttctccctttccatgctgtacatggacacacacagtgtgcaccatctggaaggttcacgtgttcaaggcttcagctcagtgcagcgccatgcctcgtctctctctttcttcctgactcctacttatgtgcaccgcctgcagggctgagtgatgtgatcaccgtccagcatcgcaacatagaggagtcgggcttcccttctgatctacatggcaaagcggacggcctcttcctggaccttcccggcccatggaaggctgtcaaatcggcagcagcctgcctccgaccagatggggtgttctgttccttcagcccctgcatagagcaggtgagggaggtcaggggggctgcagaaggagcattgtggaagagccacagccacaatcctttgcgaattatgttctaagctgcacagtaatcatcgctgcaaccagacctgttttgggactagtggatcttattctttgccatgagctgcctcggagatgccccgatgcctcgactgcaattcctgacannnnnnnnnnaaatgttctttgctgcacagtactcatcgttgcagccagacctgtttggggaatagtggatcttatcctttgccgtgagctgcctgggagacgccccgatgcctcgactgcaattcctgacatctttcctttcctcccagcaaccattcaaagttcccatgacctcattctcccccgccgcccccccaccccccccnnnnnnnnnnttcccagcaaccagtcaaagttctcatgacctcaatctcccccgccgcccccccacccccccgctcccgacccaaggtgcaacgcacgtgtggtgcgctggctcggagcgggtttcactgcctgcgcaccatggaggtcctgctgcgcagctacgaggtcacatccagtgggctcaaggccgtggaggagtcggtcctaggagacgatttgccttccggtgaacctgccgatgtgggcggcgacccagattccaagcgcgcaaagcgagaggacggagcagcgccggaggaggcacacaccgcagcttcggccgcccccacactgcccagccaagcccaggttctggccnnnnnnnnnngtgccgcagctccggccgcccctacactgcccagccaagcccaggttctggcccggcccgtggcctctggtcggggtcacacagggtacctgacctttgcccgcctggcagtcactgtgcccgggccacagccgcaggctgtgctggttgtgcctgccccggcagaggggggtgctgaacaggacactgcttgaatcacatgtgtaccgcacctggcgtgatgatcgctgccttttgggggccttggcaagggatttgttgtccctggaatgcattccatgcatgtgcaggtccatggagagtgagcggggcagtggctgacacaagtgcactttgccagccatctgatggacagagtgaaacagcatccgtctgtcttgtcccnnnnnnnnnncacagtggctgacgcaagtgcactttgccagccatctgatcgactgagtgaaacagcatccgtctgtcttgtcccacgatgacacgctgttcgaccagcggacgacagtttgccaggaatcgcgcgccatgcacagcacgcagtgcagtcctcacagcgagccagaatcagaggaggatgtggttgtacccagggcacactccatgttgctcnnnnnnnnnntacagcccgccagaatcagaggaggatgttgttgtacccagggcacactccatgttgctcnnnnnnnnnnacctccctcgcagcctgcagggccctgagctcctcctgtgcctgggacaagggagcgggggcatgtgtgctggtcagcatctgnnnnnnnnnntgcccactaccattcgtcatcctcgtccaccgcgtaatgccctcgccactgcgcgtcccgggcggcgtcctccctcgctgcctgcagggccctgagctcctccagtgcctgggacaaggaagcgggggcatgtgtgctggtcagcatctgaatgtggcgtgggggtcatctctacacgatatgcaccctggtgctgggtgtaagtcgccagaggccaccatccccgcccctccacacctctccagcacccattcaagcagcacctgctgcacgacgtcctcccgccccgcctgccgccccgcggctagcagcgtggtccaggtcacgacatccggcttgaccccggcggtgagcatggcgttgacggcggccagcccgccgtccggccccgccacgtggcactccaccttgaccaaggcgttgaaggtgggtgcccccggcgccaggccccgctcgcgcatacggcccagaaggtcccaggccagcgcgccctgccgcccgaaggagcaccccgcgatcaggctggtgtaggtgcgtgcgtccggcgcgacgcccgcgccgcggaagtcggccagcagccgcgcggcgtccgccacacggccctcccgcgcgcaggccgccacgcccgcgttgagcagggcctgactgggcgccactcccgacccggccagcagcgtgcgcacccgccccgcagcgcccgtggcgcccagcgcgcccaccagcgccgccaggctggaggcgtcgtgcgcaacctcggccaccgcctgggcgtcctccatggcgcgcaccagggccgccgccagnnnnnnnnnnnnnnnnnnnnnnnnnnnnnnnnnnnnnnnnnnnnnnnnntgcgctgaggcccgctggcggcggctggacccacaccaggcggggcgtccgttgggggcccagccccttcgccctcccggcccgcccagccatccgcatccgcagcgagggcccccgcgcgcgcgtccgcctgcgcccccgcccaggccagcacgccgccgtaggcgccggcaaaggccnnnnnnnnnnatggcgctgggaaacgcgggaggcggcctggccgggagcacgccgcgggagcggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcccccgcgcgcgcatccgcctgcgccctcgcccaggcaagcacgccgccgtaggcgccggcaaaggcctgggcgctggccacggcccccttcgccaaccggtccaggaagaaagagcgcagggcctgcagatcgccaccggcccccagggcggcgaaggctgcggcctggccgccggcatccagggggacgccggcgccctccatctcggccagcaccgcctcggccctctccccgtctgcggcctgggccagggcagccaggcgcagccgccagccgcgcggggtgggcttgattccgagcccctccatctctcgccaggcatcctgcggaccggatggtgaggaaagggtgggcagcgaggcgggcacgagcaagtttgcaggggacaggcaggctggccattgttgggagatgcattggatgaggaacctcgagatgatggtgggccaaccgggactgtttccatgctggggcctgcacgaaactcccccctgtcgccctctagcaggaaccccggtttgaccttgaaccatccacgcctgcttccctannnnnnnnnntggtttccatgcgggggcctgcacgaaactcccccctctcgccctctagcaggagccccgattcgaccttgaaccatccacgcctgcttccctacctcgatggcgtcggcagcgcccgcccccctcctcagcgcggcagccatcatgacgtcgtaggtggctccgtccggagtcaagccacgctgaatcatcagctgccgcaccccgttcacggccgccaggctgcccacctcttctgcggcggtcagggccgcattgcatgccattcgaagggtctgcacctcgggagggatgggcgctgcgggcgcccccccgggtcccacaccaccctgaacatccacgggcaggggaaggtgcgtgctgtggcgatcgaaaagctccgtcagggcctccagcatcgcgtcaaagtcgcccatcctatagcggcaggagcaggggtgtgagggcttcggtgcatgctgtctacaaagatgcacatagtgttcatactcctcgcactccttgcaaaaacaagcccaccttgcaagtgccacagcgtgcccggcgcgggctttggcatgctgagccggcggcagcgcacacagggcgtcctggatcagcccggtcaccnnnnnnnnnncagcggcaggagcagaggtgtgaggtcttcgttgcatgctgtctacaaagatgcacataatgttcatcctcctcgcactccttgctaaaacaagcccaccttgcaagtgccacgacgtgcccggcgcgggctttggcatgctgtgccggcggcagcgcgcacagggcgtcctggatcagcccggtcaccccttcgtcgtccccggtcgaggccgcgagagacatgcgcgccgcccaggtggctccatcgtgatccaggtgccgccggcgcatcagagcgagggtagcgtcaaaggacgcggtgtctcctgcagcagcacagattgggttgtggcaacttgggatgagctgattataggtttgacagcatgcaggcgcagtttcggtcatacagctgcaggcgggcgggcagccagcgatcgccacagtgaagcaacgaaagtatttatgctccctgcccagatacatagtgcacagcagattatgaaatatggctgccaccgccccctcctcagtcttcagggcccccccaccccacaacacaccttgtgatgcagcagcctccagcacgatgttggcgaggcgggnnnnnnnnnncatatatcgtgcacagcagatcatgaaatatggctgcccccgccccctcctcagacttcagggccccccaccccacaacacaccttgggatgcagcagcctgcagcacgatgttggcgaggcgggggtccacatgccgcgtggagatggagcgcaggtacttgagcgcaccatgcaggttgttgtctttgcacagcgcgcccagtgagctggcatgcgccacgtgcccgatgggcagcctgaggctccacatgcgcgcggtgagggccagggccccctctgagtcgccccgccgagccgcactgaccagggccgcatcgaacgcgccggccagcgtccgtgccaggggcaggggcgggcggactgccagcgctggctcgcggtgtaagaggaggcgcagggcctgcacgtgctgcccctgcctcacgaggtctcgtacggtgcgagacagggctttgggattcaatgcggctcgtggatggaccaaggggggaaggctggcggttcgtgcttcctgagcctggatggcactatcggacggagaggtgctgcccacagcggtcgtcagcgggctccagaggaatttccgcgtgtcgtcctggtgactgaaacccacattcacgcccttcaggggtaagagagcgctcagggccccgcgtgcacgtaggatggacgtgggtagcggggccatcgggtggggcacccaccggtgtcgcggcaagtggacgggcccgagcttgcgccaacaaattggtgcctagctactaagatgttagtacttgcataatgatcaaccccgcaagcctactatcctgggtcctgagtctaccgaaagccaggtgggaagtacgcgcgcgctgggatatccacctcagcagtgttgttaagtgcctgcatccttaccaagcaggcttggcaactctcaggttcgtgacggcttacattgccgtcgtaactcttctgggtaggtaggcaagccagtgaggtcctggatccaagatcatgggcgtgaaggtcaccgaaggagaggcgacttccgtgacgggggagaagctctacacgacatcatacctccctgatgagccgcccagagccgcctttgtgattcatcatgggctggcggagcatatagggcggtatacaccaagtaagatggtggaatgtctctggggagtttcggacgtacgtgactgttcggggaccgggggcactgcttaaggtgcgctggctgaaccaaacagagggggatgccacatgaagcatgctcatgactttaaatcgcctcgtctcttgctgcagtggccactatcctggcggagaagggcatcgccgtgttcctgcacgacgcatacggccacggcaagagctccggggagcgggcctacatcccctcctgcgacaccatggtggccgacctgaactcccggcgcgccaccgccctgtccgagatcgcggccatctggcccggggaggcccccgccctcttcctggggggtcactccatgggcggcctgatcgccgcgctggccgcccaggcgcagcccgtgggcctggccggggcggtcatcatgtcccccgccatgggcgtcccggcctccctgggcctggtggtgcaggaggccgtcgccggggtgctggtgcacatcgtgccgcggctcaaggccctcaaggtggtggaccccaccgggctgaacgccgaccccgccctggtgcaggcctacgtggatgaccccctcaacacggtggcgccgctgagcctgaagaccgcggtgtccctgcgcaggggaatgcgcgaggttttccggggcgcgccggggctgacgatgcccatctacgcgcaccacggcgactccgaccgcatcacccacgagctctttacccgccgctggacggaggcggtgggcagccaggacaagacgtaccgcctcgtggctgggggttaccacgaggtcctgctggggccgcagaaggacgagctgatcgagggcatcgccgagtggatcctggcgcgcagcgccgtgcctgccaggctctgagagggtggtgcagagcctcgacaccggaaagcccgatgccttttggagagtctggctcgtgctgcggccgcagcacagggtccagcatccagcggggcgcacgggacgctgagttttcatcgcagtggcagtgacggcctcagaggccatggttgcgaatactggagggggaaagttttgatggcgtgtctgtgcaatgccccctccccctccccctcgtgtacctccatgcatgagtactgtgtaggctgccctccgtgccgcagcgtgtgcctagcctcgggattgacgggtcgaggaatatcgggcgagaatgtgtgctgggacactgcacatcgccatgcgtgtcagcagtgcaggcccgaccagagcaaagtccatgcaaagaacccccggcacaagaaggacccgcccaggaaaannnnnnnnnngtcgccatgcatgtcagcagtgcagacccgaccagagcaaagtccatgcaaggaacacccggcacaagaaggacccgcccaggaaaactgtcgacgcagccacccgccgccatcattcttctcatggcgcggggcaggtctcgtcctgccgggcggccagcaacgggtgaagcgctccctccttggcagcccccggcgtctggtcgcctgcctgcagagcgagctgcacggccgcgacgatgccggccatctcggcctccccactcgacaggtgacgcagggcgtgggcctgggagcgcggggggaccatcagctccagggaggccaggcgcaggccggggtccagcggcaagggcccggctgcgctcgcggaggggagggccgtggcgtttgccggggccgggatcccctccgcggcgcgcnnnnnnnnnnagcaagggcccggctgtgctcgcggaggggagggccgaggcgttggccggggccgggatcccctccgcggcgcgcaggcgcagggtgggccgggtgcgggaccgcagcaggtccagcagcttcccgccagctgccgcgctgaccatgacggccggcatggtcagcgcgccgaggtctgcggtcggccagcgggaggggcatgccatggcaggcgcggcaccaccagacgcggcgcgcacacatctgagtcggtgctctggccccgtgccgactggcgatgctcgctgcccccgccaagcactccgaagcgacacctgggtgcacgagcgcatcagccccatacccaccatccccgccccnnnnnnnnnntgaggcgacacctgggtgcacgagtacatcagccccatacccaccatccccgccccacctggcgcgccatcgccgctcatcggccagacagcccgctcgtcctcgccggagttgatgacgatcagggcggcggcccgggaggcggcggccgccctggccttgtctgcaaaggggcaccggcccctccccgccaggagcacactcccgcgggcgggcggggctggatcgcctggcccagcctcgccgccgcacaggaagaggggctgggcaaggagcagcggccccttcacctctgtcagaaaatcctgtcccgcagctcccgtgccggggcaacccaggagcaggtcttgcagtcgaggctcgggacatgtgcagggagcctggccaggatcacggtattcaacggggccaccacctgatgtaggtcgagaggctgattgcccactccccagctctgcctcgtcctctgcagcaggtccagcagaggagcccagctggcaaggcggggcaaaggcaggcccaaactctgctaggatgccttggatggagtcgaatgccccatcctctgggtcgtcgatggacacaagctgcacatcttgcactgggaaaagaggggnnnnnnnnnnnnnnnnnnnnnnnnnnnnnnnnnnnaaatccagctcactatgtttggccctcggcgcagatcccgcgttgccattcaacatgctgccgctcttaggctcccaacctcccgagtaccaccacatcagcgccgcaccgtcgtccccgtcctgatgatagctggcctccaggatgactgctgtgggcctgagtgcctgcgccaccagcaggtcacgggagtggctgagcacagtatacttcccttgatcaagggaccaaggggcatgtcgttgcagtgttgagcacagggaggtgcaccagcgtagtgagctatggcccatttcgagctcgctgcagcccaccctgagcatcgctgcctgctctgcttccaaccccccaccaaagctttccaccctcccttccataacgcaccatgannnnnnnnnnagctgagcacagtatacttcccttgatcgagggaccaaggggcatggcgttccagtgttgagcacagggagatgcaccagcgtagtgagctatgccccatttcgagctcgctgcagcccaccctgagcatcgctgcccgctctgcttccagactcccaccaaagccttccaccctcccttccataacgcaccatgaggtcctccagttccatgccggcttgcagcaccttcagcgcgccgcagcccagcacccccccggtcctgcgcaggtcgcacaggaagtacgcgggcggcgtccagccccgccgcgccgcctctgcggccttgcgtgccgtggcgctggccagctggcgcgcgaaggcggcggttgcgccgacgtggcgtctcgcggcccttgcgcggcgcgccgcctcgccggcgcgcgtgaaggcctggcacgccgtgcagcgccggcgccggatgagcgacggttgcagcggctgggagtcgggcagcgcaggcagggcggcgcgcagggcggctgcgcgcctggcaaactggtcggggtcctgcgcctcgcacaggtgccggcagcgagccgctacggtttctacttccatggacaccacctcttgcgtaggggcgacggtggtctcttcatggctcaggaaggttccggccagcatcagggctgctgcatcatgggacgcattcccgggaggtgcctccgtcacatagccgcctggcctggccccgctacccttgccagtgctggccgggacaggtgctcccacagggccaccactcgttgcattcgcaccgatggggccctccgcgcccgcagccccgagcatgactgtcccatgctctgcctcccactgctcctccgtatcagcccaggcgtccaagaagtggccctccgtggtcagcacccaccggtccagggccgctgaagcgttggcgaagaggaggtacaggtacttgacagtctcggacaggaagaaggactccatgctgtccgatagctttcctgtgctgacgtcgtgcacagcggcgtacccgcaggccacctggttgcgggagcgcagcgtgcccagcatggcctcccctgcccgcaggtatgaggcgtcgggtgcgtcggcggccagcatgaaggtggactccatgagctcggggcggagcgggtaccctggcacagaggtggaggggaaggttggactggtttgtagagcagcaatgtatgtgcgtcagcagagtcacagtgtgcaacatgctagcttccacgctgcccacattgcccggnnnnnnnnnnccttgtagagcagcaatgtgtgtgcgtcagcagagtcacggtgagcaacaagctagcttccacgctgcccacattgcccggggctgaggagtcgcccaccaggaacagtctccccaacccaccgctgagcgtcgggtgccgtgtctgtttctggacgtcaaacatctccggcagccagccaaacttgttccagacggccagccactgccggtgctgggcggccgcctcctcaagctgccctgcaagtgcatgcaggatggcaggtcgtggttggcctatacatgactgatgcatgagcccggaaggtactcaaactctgggggagaggcaagtttgagacccaacagcctggtcgcatgccctctctgaagtctttccgctgagtcagggctccccgcccctttgcgcaccccttcccttgctcctggccctccctccacggcgcacctgcaagggcctggaagcccggccagtacgccgacagcgaccagactcctgtgtgcagcagcagggccgtggacatgtggacgtccagcagccagggcgaaccagacagcggggcgcccacggcgctgtgcgtcaggagggcggcataagactcgctggcccactgcaggtgggtcctgttgccaaacatcaggtaggcctgcggggatttggggttcggagtgagggggtgataggatgcgggagccggcctccgcgccaatgcgcaacacctgacccttgtgggagctgtgctaggagagtcgcacccgaacccccttaaaacccccgctgagcagcacatgagcgcagcagccagcactccaagccgccagccctgcccagcgacgaccggggcctgtttcgctagttccaaccacaaattgggccctcctgttaccttgaggagatactcatagtacgagtccactccagccccgatcccagagtcgtgccgctcccagcccctggtgtcgcagctgatggtgttccccacaaggccgatgaggctgcgtgcacctgtgctcagggtgggtgggtgagggttggggagcttaccgggcagaatgcagttcaaaggacttcttcgctgtgccatctccgatgcctcagtgtacgacgcaagactctgttggcacccttcgtatcccggatggaatgcaaccccacctcacaactcaccatgcagagcttccagggcccttcgggccgcagcgtcgtacttcatctcccctgtcatcctcgacagcgtcccaaactccagcagcagcgtccccgcacaggcagtgcaggtgatgcgggtctcataaagaatctaggatggcgagtagattaattgacgctgtggagactcagcttcagggtacgcacgatcaaacgcagatgcctgggggttccaatgatgcagaatgctttaagctcatgcttaaagtcccttgccaaccctccacaaccctgtcacttgcctggccatgcctcaggttgatccatgacagggggatcccggatggcgtgttgaatgcaggaaggaggcgatcggccagatcgaccgcagcgagcaggaggcccccccgataccagggtgccagctgcagattctgtggggcaggagggatggggggtacagataagccacagctgagagatgctacgcatcagctcccgagcccaccatcaggtgcacaagggatnnnnnnnnnnatgggggttaaagataagccacagctaagagatgctacgcaccagctccccgagcccaccatcaggtgcacaagggatctgccctcgtcgacagcaaaaatcatgaacagtggcacgcatacgcaatgcataattaccaaatggtcacagcgcaccacaatcacctgagtgagcagctggtgagcggagaggaggcctcccagggcacgaattgtgacctcaaagacatgcaccctgacatcaaggtcaaaggtgaggcggggagggggatcgccgccgctcccgcagtcggttccctccccagtgacccagcagagggctttgtaaaatgcttccagctggttcatcacctgcatgaagcgatcgaggggtccttaacgatcgacttgtttaccttgcccagtccccacctctttgacaaacaaaaccggcaccagggtgcgcagcaggacataccccaacaggaactcccaagggcagctaatgctcccccagaaaaaacaactcgtcataatgacaaatgtctgtggaggcctctcactccctgctcnnnnnnnnnnccaaaaaacaacttgtcataatgacatatgtctgtggaggcctctcactccctgctctaggctgtaggtcctcaccaggagggtgtcgaggctgtccagggtcgtgagcccgatgcccccttgggaatcactcccattgcagctgagtggtcgaaggtcatcctggcagagggcaatgggacaggggctcgagcatctaggctgtttctggggaggcacgccgggtcccacacccatgatgcgggcctcctggcatcaccagccctgtggcctccgtggccccataccattgggaaggcatgggtggnnnnnnnnnntccatgatgcgggcctcctggcatcaccccctgcaagcagccctgtggcccccgcggccccataccattgggaaggcatgggtggtgtaattggagtaggcctgcacaaacatgtcccgggcctcctccgccagagtggtagtgttcaggacggcgtgagggaagggtgcctctcgggcctggtcgccagccaggcatcgcatcaccagagtgaagacgaggcagcagtgccatgggcaccacctccctgaccagcacatcagtcatcgccatgggaaagggcaagtcatggtgctaatcacactctccaatcaagactcggcggacagagggttggcagcatcgatcagaggtcacaagggtcaggaggctaccctgctggacgtgtgctcctgcatagtcctacaccgacgatctggtggctgcgagtcaaaaggctgcgatggtctattcaagaggcactaattaccttgcagcaacgagcggcgcgcagcgtgcaagcttcgagacggtggagggcaatggaatgagcttgaaaatgccgacgtggcgcgacggcatcgctgagcgcaccagtgatccgtggctctgcttacaccctcctcagctttacaatctagatacaacctttaattgcgagattgcagtcaatttgaggtccgaaaagactnnnnnnnnnntcggtcggcgcgcagcgtgcaagcctggagacggtggagggcaaatggaatgagcttgaaaatgttgacgtggcgcgacggcatggctgagcgcacaagtgatccgtggctctgcttggaccctcctcagctttacaatctagatgcaaccttaaattgcgatattgcagtcaatttgaggtccgaaaagactgatcaacgccccatcgtttctcacttgctgtgcaagggcatggcaggtcgcttacggccgagcctgctcgtagcagcgctgtcgctgttggtgctcttgaccccatctacaagggcattggacatagagggcagggtgatcctcccaggtatcgcttgtgctcacctgcgaatctgcagtgggtgccgttccctctcgtacatcacaccctcgctggctcacccttgcaccccaacagagannnnnnnnnntgaatctgcagtgggtgccgttccctctcttacaccacacccacgctggctcacccttgcaccccaacagagacaaccccgaatgcgctggacacagagctggtgctgagtaaggagcagggtgacgaggtgcgcaccttccccctcccggacggtcgcttcgccttccacaacgtgcctgctggcaagcactacttggaggtggagttggtcggactcgtctactccaccgtcgagctcaccgtgggtgttgctggggacgtcaatgctctcctgtcggatgtcatcaatgtaaggtctcacgcgtggtgggagggttggtgtgggacttcttggatgctgggacaggtgacgagatgtgatgatgtgctcgtcgcatgtttttcacagatgttgtcctatgtgtttgcccttgttggtgttcctcggcacaaacagttcagctgagctcaccctgcatttaccaccgattgtcattacaacttgaacagagacctgccgtcccctacccactcgtgctgcgtcctatcgggagactggagttcttccaggtgtgtgtgtgcgtgcgaccagtgggcattcctggtcagagctgattgcagggcaatgcactccacaatgtgcagcaccatataccggccccctgcgttgctgcgcaacctcactcccttgcgctgctggaactgtccttgcagaagccccagccattcaatgtcannnnnnnnnntttgcagggcgatgcactccacaatgagcagcaccatataccggcctcctgcgttgctgcgtaacctccctcccttgcgctgctggaactgcccttgcagaagccccagccattcaatgtcatggcattcatcaagacgccttacgggatcatgatcagtgagtctgtgtggattttacacccatgtgtgcatcgcagttgtgtgaggcctgatggtctgcaacgacgttttgctgtgtagatcacaagaattgcatgacggcctacccacggttgttattgttgatgctgccccccccacagtacacacactccaatcacaactccctacccatccatgcttcgcagtcttcggcatcttcagccttgtcgtgatgccccgcctccgcnnnnnnnnnngtgtgtgggttttacacccatgtgtgcattgcagttgtgtgaggcctgaaggtctgcaatggcgttttgctgtgtagatcacaagaattgcatgacggcctacccaaggctgttatcattgatgccgccccccccacggtacacacactccaatcacaactccccacccatccgtgcttcgcagtcttcggcatattcagccttgtcgtgatgccccgcctccgcgcctattcggaggagctcaacagcgaggagaccgcagaggagagcacagtgcccccacccacagtgactgcagtagcatccccacggcagttgcagcagcggcgcaaggatcgatgagctggggacttgggcctacttgtgtgaacaagcaccccgaccgaccacccctccagcagtatgattctttacagataatgaaatgaaaaaggggtacggaaccaaggtggcagagcccagagaacagcagccaaataatgggagcaggcagtgtgacatgggtcgctcgcagcatggtgcgcgccgggtgacggtggtggtgtatgtgtgtgcagtaccaaacagtatcaagaaagctgagcaacggccccgcaatgggcagggcgcggcgcgaggcgaggggcccctggaccatgagcggtccctcacctccggccggcttggggtgtggtgacgtgcccctggctgtccaccgggcccgttctcctcactgtgatgatggcaggcagaaggctgctccagccctgctccctagcagccgacaggcgccggccgagcagcgagatgcccctggccggtggcgcgccgccggggccggccccggagccgctcccaccactgggtgtgggcgaagcgcccagcggcgccagcggggagtccggcgcagcggcctggtcggctgccgcggccggccaggcctcgatgcgg

SEQ ID NO: 46479 - DNA, 61 bp, Chlorella protothecoides
aacccagccaagccgagcggctggcagaggtgagtgtggctgcaggaaagtcactcgagca

SEQ ID NO: 46480 - DNA, 68 bp, Chlorella protothecoides
ccatgacgcgcaatgcacggtgacacagcacccacgatgcaaggaggcatgcccagcgtgatcaaagt

SEQ ID NO: 46481 - DNA, 76 bp, Chlorella protothecoides
cctggcatgccatggcggggtcccgattcgattctaccgcctctcgcacaatcaacccaccttcttagatgcgacc

SEQ ID NO: 46482 - DNA, 15789 bp, Chlorella protothecoides
  modified_base (293)..(302): a, c, t, g, unknown or other
  modified_base (422)..(431): a, c, t, g, unknown or other
  modified_base (621)..(630): a, c, t, g, unknown or other
  modified_base (722)..(731): a, c, t, g, unknown or other
  modified_base (1951)..(1960): a, c, t, g, unknown or other
  modified_base (2080)..(2089): a, c, t, g, unknown or other
  modified_base (2722)..(2731): a, c, t, g, unknown or other
  modified_base (3149)..(3158): a, c, t, g, unknown or other
  modified_base (3226)..(3235): a, c, t, g, unknown or other
  modified_base (3969)..(3978): a, c, t, g, unknown or other
  modified_base (4562)..(4571): a, c, t, g, unknown or other
  modified_base (5152)..(5161): a, c, t, g, unknown or other
  modified_base (5726)..(5735): a, c, t, g, unknown or other
  modified_base (5966)..(5975): a, c, t, g, unknown or other
  modified_base (6793)..(6842): a, c, t, g, unknown or other
  modified_base (7787)..(7796): a, c, t, g, unknown or other
  modified_base (8740)..(8749): a, c, t, g, unknown or other
  modified_base (8866)..(8875): a, c, t, g, unknown or other
  modified_base (10213)..(10222): a, c, t, g, unknown or other
  modified_base (10839)..(10848): a, c, t, g, unknown or other
  modified_base (10904)..(10987): a, c, t, g, unknown or other
  modified_base (13382)..(13391): a, c, t, g, unknown or other
  modified_base (13471)..(13480): a, c, t, g, unknown or other
  modified_base (13860)..(13869): a, c, t, g, unknown or other
  modified_base (14097)..(14106): a, c, t, g, unknown or other
  modified_base (14706)..(14715): a, c, t, g, unknown or other
  modified_base (15274)..(15283): a, c, t, g, unknown or other
gggcgcggggcgcggcgcggcatcctcgccgccgccgggcgcgcccacgctgccgctgccgctggtgacgcccgacccggccgaccccgccgccccggacctcagccggttgtccagggtctggctgaaggccttgaactcgtgcaggtccggcctgcttgggttaaaaagaacgaaccagggtggcaaggctgaggtgattgcgcagggtgagcgaggcgagttggacccggtcagcgacccaactctgggacgatgatcggccagtacaatcccaagcagacaggcacatnnnnnnnnnntgaaccagggtgggaatgctaaggtgattgctcagggtgagcgaggcgagttggacccagtcagcgacccaactctgggacgatgatctgccagtacaatcccaagcagacaggcacatnnnnnnnnnntcacttgctggctctgggccgccttgaactgctggaagtcccgtcggacctcctcgtccaccaccgtggtgccagggttgaggttgagcgcctccagcttggccgcatcgctgggtgggcagacggggtgatgagatgagacttccctgtaatctggtgcagccaagtggcaccactgtgcagggcccannnnnnnnnntccctccatggcaaccacagccccaacccctcctattccaccagatgcagcgcttgtcttacccccccaagacccagtcccctccacgatgnnnnnnnnnntagcttggccgcatcgctgggtgggcagaaggggtgatgggatgagacttccatgtaatctggttcagccaagtggcaccactgtgcagggcccagctgtcccctcatcatcgggcgccgcgcaacccccgtccaattggaggacccctctgtggctcgactgcaagcatggctcacccctccatggcgaccacagccccaacccctcctatttcacaagatgcagcgctcgtctccacccccccccaagacccagtcccctccacgatgccctcgctcacttgatcaggggcgaggccagcggcgacttgaggctcttgggcgtgccgtagggcgacgtcttcttgccctccatcatctgcgcgcgcagcttgttggtctctcgccgcgcatcgatgtcgatgggcgcagagcgggaggtcgcgggtttgggcaccggcacggccgcggaggcgcccgggcgggcggacccgccagaccccgcaccgttgcgctcgccgctggccgcgggccggccggcggccgcgccgcccgggccatcggttcgcagcacggcgccgtacaggtcctcctcgtctagcccgctgtcgtccagcacggccaagccccgctcctccagcacgtggcggctcgccaggccgccggccttgccatgcgcgccgccgccctcgatctcgcgcgcgatgcggtccgcctccgccgcgctgatggtggaggcgcgcgggtccagggccgtggtgtacaactcctcggcgtagtcggtgcgcacgccaaacttggcctcgttcagtgcgaactgatcccagccggagttggagccggagccgccgcggctgccgtgcgacgcgctaggcctgccgccgccgcggccgccgccgcgggcaccctccagtccctccagggaccccaggtccgcctcgtcggcggtggggacccagcgctgcagctcgcggtctgcgcgcctgtggatgaggaggcgggaggggagggaggtgacgggatgggaggccccaggggacattgaacgggaggcccaggttccatgtgtcaggcaagtgcctgacgacacacatctgttccagatctacggtcatgcatgcacactcatgattgcaggccagcattgtgtacaagaaactcagcaacccattcgcacacaaacacaccaactcacccgccgcggccacgcgagatgtcggcgtcggtgcccaatccctcgnnnnnnnnnncgaggaggtaggaggggagggaggtgacgggattggaggcccaaggggacattgatcgggaggcccaggttccatctgtcaggcaagtccctgacgacacacatctgttccagatctacnnnnnnnnnnacacgcaaacacaccaactcacccgccgcggccgcgtgagatgtcggcgtcggtgcccaatccctcgatgccgttgtgtgtggaggccgtgctcacatcctccgctcccaatgccacgcccttggcggtgatagacacgatgtccagccatggcagggccagggtgggcgtggggcggaccaccgggagctcgccctgcaccttggcatcccgcaccagggtggtcatgctcaggtgggccaccagtgcgcccttgtcgctgctgatcgagctcaatattccgctatatgtctttcccgactttgtctgcgggtagtcgagatcccaggggaggctcatgtcgcaggtcgggtacgggtgctcgggaagtggagtatcgatctggatggcaggcaccctcccagcgccccgggatgcctcacctgggcatcgacggtatatcccaccaggaccttggcggtccatgccatgcgcttctccatgaccgtcagattactcgccgtgcctgctaagcaggcaaaagcgatcgcgctttgctgtcggcccgacccagcgcccctcgatgtcccctagatagctctggaggaaccgaattccgccgatttgctctggtgtcgcactgggtgttggagnnnnnnnnnnttcggctgacgcaaggcggggtcctagtggccctgcgcgggcaggaatgcggctgtctgacgcgcgtgaggggtcaaggccccttgcacaaccttcaaggacggtgtgcaacgtgctggtcgagtggcggtggacagaggtatctgtttccacatgacctgcgcatgccgtacccagcctcgcgggagggcgggaacctgggagtcacctcgggggaaagggccgtggcgatacactgggtccaggatcttggcgttggagggacaacttgttaaaataataagggagcaacctccacaagctgcacttgattggggtggaggcaagaagaagacacacgttgtcggcggggtgacaagcaatgagtcacagggcgtcgaccggtccggccgccatttcagacacgtcagcgcgcggnnnnnnnnnnagggcgggaacccgggagtcacctcgggggaagggcagtggcgatacactgggtccaggatcttggcnnnnnnnnnncagacacacgttgtcggtggggtgacgagcaacgagtcacagggcgtcgaccggtctggccgccatttcagacacgtcagcgcgcggcgccagccaccccggtcacgggcgagccagccccacgccccgcacgcccctcacaagcgctgcaggaaggcggtcatggcctggaccagggcgcgcggcgcctcctcgtgcgacacgtgcccgcagcgcggcagcaccacgcgcggcgcgtcggccgggaagcgccgtgccagctcggccagcgccgccggggtgacaaacgcgtcggcctcgcccgtcagcaggcacacgggcgcgcgcacgcgcgcgcagagccggttgcggtccgcggtgtgcacgtccacgggcacgcggcaggtggccgccagcgcctcgtcccaggcgcgcaggcggcgcggcgcgccgtacagcgccagcacctcgggcgtgagggcggcggggtcggcccaggcgcggcggttggccacggggcccacctcggtccgcagcaggcccgccagcgctcggcgtcccagcctgcgaggtggtcgtgtgtgagaaggtgtgagtgtgtgtgttgagaaggggggtgctggacatatggccgagggcggagcagggcgtgatggccaggcatccggcgccttccgccttcatcgcctgcaggctcagcagctctgcgccatgttggtaggttccatgccccttcaaaggtgtgcacactggcnnnnnnnnnncccgccctcatcgcctgcaggcacagcagctctgcgccatgttggtaggtcccatgccccttcaaaggtgtgcacactggctctgcctgcgctccttgcacacacccctcccctcgtccatggcccgcacctgctctgcgcgagcacgcgggcgtagaggggcgcggggacgccggagatatcggggtgcagcagcgccacgccccgcaccagcggcggccctggcggcaggatgctgggcgcccgctccagctccggcgccggcgccggctctgacgatggtgctgcattcgcaacacccgtggacccctgcatggccggcttggcttccagcgcggcctgcaagaagggggacggctccgccgccctgggcatagccgcgggcttggggggttccgtgggactgggcacggccgcccctgcgtcggaggcgggcgacccccacgaccccggcgctgtcttcacgggcgcatccctttcgacgacgccccgcgcggcgcgcacgccggcccccgtgcccaggggccagtgcgcgccgggaacaaactcgccccgcagcaagctggccagcagcgcctgctgcnnnnnnnnnntggcccccgtgcccaggggccagtgcgcaccggggacaaactcgccacgcagcaagctggccagcagcgcctgctgctcgggcgccgaccccgcccagtcgggcgaggtggggccgccgcggcgcggccccggcggggggtgcccgagcggcgcaggcgcgtgccagggtgggggcggcggggtgccgggggagcctgtggtgccgctgctggccagcgccggcccctcccgctgggagtgcgccgagccgtcccgcgtggagggtctggcgccggcgtcgtcgccgggcggggcggccacgcggtgtgcggtgcaggaagatgccacgcgcagggccagcagcgcgccgtcgccataccctgcgggtgagacagcggggtgtcgcacggatggacgatcagtgtcccagctgggaatccggggctgaacagctgtagcgttgggcgccgcatctggagcggcgccacaaagggtcatgtgacctgtcacagccatcccctgagccaccctgtccaccatccagctccagtctcgctcaatacttgcacccctccagggaacccctcaccagccatactcnnnnnnnnnngggatggatgatcagtgtcccagctgggaatccgggggcctgaacagctgtagcgttgggcgccgcatctggggcggtgccacaaaaggtcatgtgacctgtcacagccatcccccgagccaccctgtcctccatccagctccagtcttgctcaatacttgcacgcctccagggaacccctcaccagccatactcaccaccgccccctgcacgaccaacaaaacccacccatgagcacgaggctagcgatgtgcaggcggcggcagagctcgagggtcatgcgcgcctggaagcgctgggcgtaggggttgtgccggttaccgcctggcgcgtctggcgggcgtggggggcgcgaagtcagcccgaacccgggccggtcgaaggcaagcacgctgagcccgctggcgtcggccagcgggcgcatgacgtggcgccaggcaaacacgcccccgccgaagccgtgcaggaggagtatcaccgtggacgtggcccgaggctgcccctgtgggttgaagattgtatttttgggggggaggggggaggggcggggattggtgacgcagtnnnnnnnnnncgggttgaagatttttttttttttgggggggggaggggcggggattggtgacgcagtgcacccactggagcctgctagatggtgatccttggaatccaggcggtagccacaatccaccagcacgtcaagccccctccttgccgttcctcccgctccccccctccctctcccctccacacacacccaccccctcccacccacccacctgcgggtgcaccaggcggtagtgtnnnnnnnnnnatccccctccctctcccctccatactcacccaccccctcccaccctcccacctgcgggtgcaccaggcggtagtgtaccgtcacccccaggcagtcggtcatgaagagggagtcgctagcctgaagcaacgcgcccccgtcctcggcgctgagctggagggcgtccagctcggcgcgcgccgacagctcccccgccagcagccaggtctcctccccctcctcccaggggtagcctaggcccgtgagtccgaggcggtgccgccgccgcgcccagatgctgacctggcgcgcggcaaccatgtgcgccagcgcgaagccggcgtggagcaggaagaagaggaagaaagcggggtgcttggcggggggcaggggtccctgctccagcgccgcggtcttgaacatggccaggggcaggctgatgcagcccaggacggtggccgcgtagaggtaggggcgctggtgcagcccgccggtgccgcagaagtggcacaccaggaccaggccggcgcggagcagggacagcgccagcacgtcctcggccgaggcggcaaaggcgtagggcgcgtcgcgcgccttgcgcggcagcgtcagcgcgtacagcagcgtcatggtcaccgcctccgccgtggccagggcccaggggctggccgcggccaccaggcccagcgaggccacgcaggcgaagcgcgcggcgttgacccagcgcgccagggattcggggcggcaggagcagcaggcgccgcgttcgggggggccgccaccagactcgtactcggccatgacctcgggcatctgtgtgtgtgtggggggggggggcnnnnnnnnnnnnnnnnnnnnnnnnnnnnnnnnnnnnnnnnnnnnnnnnnncatggagcacaaagtggccccgtgatctgagggagtgccagcaaatgggcgtgccagcacgacaccctgtattgcacaacctttgacgtgatgatggcgtcccggaccatggccccggcgaagtcagcgtcctatctagcagtacaacccttgccggccggcatcccgatcggggcacagccccgggtccgcatggctggggacgcgcggcgattgaaggacggcacgcccgtcacccgccgacacccgcaacgcagcgacaaggggggctcggcgtgggggtgggcggtccatgccatcgatcatggttgtagcctgcgatcgggtgcaagttgcggcatgaacctctcggcacggtcagttccgggggtgatggcggagatgctgctgtgcatgcggcggggatcgttcctacgagatccgtgcaatggcactagggagggggtatacagactgatgctggagggccaagcggcgcagaacagatcttgcagaaatgacagggcaaccttgacagattgccacgcaagcaaaggtcacgcatggatgcatacaggtagatgccatgtacagcacaaattaggacaggagggcagctgtcagtggatgtctcaggttgaattaagtctgcgctgggtatgacgagttttgggtcatgctgcctcgtcataccactcagcatcaccggaagtataggcgtgcctgctgcttcaacttctggtggaagctcgcagaggtgatcttgctgctgaaggtaaagaacggattcatcatgacctgcagtaatgcgcagatgatccttgtggtgaggagacattggagcatatcatgccttccgatatattgttcaggccagaccagtcacccatccgtcgcctgggtgtacgaaggcgccgccatcccgaatgcagcaggcaatgcctccccagctgccaggttcctgcnnnnnnnnnngatgcgcacatgatccttgtggtgaggagggattggagcatatcatgcctttcgaaatatggttcaggccagaccagtcacccatccatcgcctgggtgtacgaaagcgccgccatcccgaatgcagcaagcaatgcctccccagctgccaggctcctgcagcccagcagagctcagcctacatccccacagctcccaccttgaggtacagctcatggacgtccttgaagaagctcttgatggcatcatcgctgcgcccatcatggagcagcatgaaacggatgtgcgctgctgtagagtatgcagagacctggaagttgttgaatcgatccaccacccccaggtgcatggacggggaggcccattcctgttcctccacggcgtctagcgcggcgtgcaggacaaaatggtagaggtactggggccgttcctgacatgttgtgtgaggagggggggggcaatgacggatcacaattcagctgggaccccatggctgaaaccaacgaagcaacgaatgcaatccggtgataaaatacaaagccagcatacctctctatgactggcatcgcccgccttgctgctgaggtctgcctcgaagatggggtggtcgttttggcccacgattacaaagtggaggactggagaggtcatgccaacaccggcgatgaaagctcaaattgtcaagatagttgagagatagatctggggcttgtcgagattgcgtgggcctccaaaattggtgcgggccatcgatctcctgaacgtaacaccagctcggggagtgggatcccacacctggtactgcacacattgaaggatgttcaatacgtgtcgatgccccgctcacatcagggtgcactccctctacccgatgctgaatgccctattgcttacaggagcttgtccaaggtccgatatggtccccctcccgacctgaccgcccnnnnnnnnnntaaattgtcaagatagttaagagatagatctgggacttgtcgagattgcgtgggcctccaaagttggtgcgggccatcgatctcccgaacgtaacaccagctcggggagtgggatcnnnnnnnnnntcagggtgcaccccctctacccgatgctgaatgccctatcgcttacaggagcttgtccaaggtcggatatggtccccctcccgacctgaccgccctcgagatctctccttgctgagcccatagcggagcgcagctcaggccccccggccatggctcgcagggcagcgggcctcctgctgtgcctctttaccctgggagcatgcagtgtccatgcgttctacctgccaggcgtcgcgcccgaggactttaaaaaggtcggtgagggcccaggccttgcccccgtcttgtcgtcgtcgtgcccactccccccacgatccacaccatcgcatcgaatgcagggagaccctgtcaccctcaaggtgaacaagatcatgtcggtgaagaaccttccctacgactactactccctcccctactgccgtcccgagaaaatcatcagctctgccgaaaatctgggggaggtgctgcgtggggaccggatcctgaattccccatacacggtgtgtgacagtgtggggagaaggggggagtcggaccctgtctcaccatctgaaagggcggcttacaggaggagtctctcgcgcaaggctttctggacccccactcgaacgccgcctccccctcccaccgcccccgagcccctcgacagacccagtttcgtgtgcccaagtcctgcgcggtcctgtgccgcatcgcaaagctggacaagaagcaggccagcgcgttcacgaaccgaatcgatgacgagtaccgcgtgaacatgtgggtcggaaaggtggctgtgcattggtttttacagggccggggtcgggcccgtgtcagcgtgctggtatggtgtcctgcggtgccgccccggtctcagccgctccccactcgaccatgacccccaccaggatcctggacaacctgcccatcggcatcgtgcgcattcggtccaaccagggcaagcagatcaaggcctatgagcgcggcttccctgtggggttcaaggaggtggggatcgtggggctcagggttggtgcagggcggcgccgtgccttgagggctggacaggcctgccaaatgtgtggacagcgtgccccagccaggccctgctggccgagtcagcccgatggggcggcgcatgcatgagcgctgcgcttgcctggctgccggctgcgcctccccacactgatcaattgatcccgtgggagcatcatggcgtccccattcacctgcctgcccgtaacccttccgtccctttccgtgtacgggtctcaacggcattcccagtcggcacgcctcacctgaatccccccacccgcccacccacccctccaggcggacggctccgtcatnnnnnnnnnnagtctcaacggcatttccagccggcacgccacacctgaatcccccctcccacccctccaggcggacggctccgtcatcctgaacaaccacctgtccttcaccatcctgtaccactcggacccggccagcggcaccgcccgcatcgtcggcttcgaggtggtgccccagtcggtgcaccacaagtatgagggcaagtggcagggcgccgacaccaagctgaccacctgcagcagcaccaagggctcctccgtggccgcgggggcagaggcccagctggtgaagcaggggcaggaggtcgtgttcacctacgatgtcaactatagggtgcgtggctgtgcctgctactgggagggggggcggggggagcaagggtgttgcagatggcgcgtgagtttgtgtggtagtggggactgttcactgaaggaggggagggttgcaggtgctgattcttggcgctcagtcggcgccggggcttggaggccctgaggcccatcgtgcctctgcttgcacgagcgctgcgtcaccctgtagcctgcctctcttggagagacatcactgctctgtgccctctggttcctcctccttcccccctccctcaatacctccccccctcccgnnnnnnnnnngtgcttctgggagggggggcggggaagcaagggtgttgcagatggcgcgtgagttnnnnnnnnnnnnnnnnnnnnnnnnnnnnnnnnnnnnnnnnnnnnnnnnnnnnnnnnnnnnnnnnnnnnnnnnnnnnnnnnnnnnccggcgccggggcttggaggccctgaggccaatcgtgcctctgcttgcacgagcgctgcgccaccctgtagcccgcctctcttggagagacatcaccgcgctgtgccctctggttcctcctcctccccctccctcaatacctccccccctcccgctccacatccccctctcccttccaggcctccaacatcctgtgggcatctcggtgggacacgtacctggtgaacctggacgaccagatccactggttctccatcgtgaacagcgccatgattgtgctgttcctctccggcatgatcgccatgatcatgacgcgcacgctgcgccgggacatctccacctacaacgcgctggaggccggggaggagggcgaggaatccggctggaagcttgtgcacggcgacgtctttcgcgcgccgcgcggtctgtcctggctggcggcctgcgtgggcacgggggtgcagctgctgggcatggccggcgccacggtggcctttgcgctggcgggtttcctgagccccgccaaccgcggcggcctgatgacggccatgctgctgctgttcgtggcgctgggcggcgcggcgggctacgcctcggcccgcctgtacaagtcctacggcggcccacaccgccgccggaccacgctgcgcacggcgctggccttccccggggtcgtctccgccatcttcctggcgctggacttcctgatctggggccagcgctccagcggcgcggtcccgctgggcacgctggccgcgctggtctccctgtggttcggggtgtcggtgccgctgtgctttgcgggcgcggcgctgggctaccgctccgccgtccccgacccgccggtgcgcaccaacaagatcccgcgccaggtcccgccccagcccttctatctgcaccccaccaccggcgtgctggtgggcggcgtgctgccctttggcgccgtcttcatcgagctcttcttcatcctctcctccatgtggcagcaccagttctattacctcttcggcttcctggccctggtcgccgtcatcctgggcatcacctgcgccgagatcgccatcgtcctctgctacttccagctctgcgcggaggactaccactggccctggcgcgcgtaccagtcggcggggagttccgcgctctacctcttcgcctactccatcgtctactttgtcaccaagctggacatcaccgccctggtgcccatggtcatgtactttggtgcgtggagcgatcatcggtggtgtgtctggctggtgacgagggcgggacagggagcaggtggaggcctgacattgagtggcggttgaagggtccctcccccccctcccaacacacacaccaaccccactgcgcaggctacatgacgattgtgaccctggccttcttcgccatgacggggacgataggctactacgcctgtgccgcctttgtgcacaagatctactctgccgtgaaaatcgactagccaggggcctgtgggttctgccacatcgccgccgcaaccctgcccacttgtgcgtctgtgttcactgcctcgccccgcgacgtcacagagcagcatggggtccggtgggaggggcgtgtggggcgggcaagggctaccagcgatgcaggggcagcatcgtggcaagggggtcccttcctcctcagcccctccgcctggggccggagtctctgggaagcgttcggctcctactcggcgaagaaccctcccgcccagagggccgggtgccctcccggctggcgctcctgtgcgcttcccggcccgggctcctggccggcgacgcctccccgtcggagcccgcagccttgggctccccggcccccgccgcgccctccccgctgccagcctcccgggccagcagggccttgcgcgagatgaccacgttccctgcctcatcccggcccaggcacagcacctggaccgtctggttcagggcgagctcatcctccacggcgcgcacgcgggtggccgccagctccgagatgtgcagcagggccttgagccgcgtctccaggatctccaccatggccccgtagtcgcgcagcgccactaccttggccgtgtacaccttgccctcctggacgtgagggtgtgggaggggtggctgagcaggggagggcgagcaccgggacgagtccggggcgctgtgggcggccgcccagcctggagtggacgctcatcgatgcatcgagagggccaagcgctcgcatgtcaaggactctcacgacaccttccgggccctggcttgaacgtgtgacactcggttgctatgacagaggaccaccttctcatcatcatccacaggaaaactgcacacccatccccccccctttcctccgcccctactctccacccacctccatgctgtcgccggcggtgtccagnnnnnnnnnncgagggtgtgggaggggtggctgggcaggggagggcgagcgccgggacaagtccggggcgctgtgggcggccgcccagcnnnnnnnnnncctgcacacccatccccccccccttcctcccccctactctccactcacctccatgctgtcgccggcggtgtccagcacccgagcggcggccgactcgtacgccgcggcagagggcccaaacacgtgcactcgcccgtcgtcctggacctgcacccgggccccagtggcctcctcgatgccgcgcaggttggaccccgaggggccgatgatgcggcccagcatgcgcgggtgcaccttgacgtgccccaccatgggtgcctcggcaggccgtgtctgggggtgtggatgggggacaaggtgtgtgtgtcagattgggtgcccgtcgacaatcattcacccgagactttgaggctgcaggagcctgcccaaaccctgcatgnnnnnnnnnnggtgtgcgtcagattgggtgcccgtcgacaatgattcatcagagactttggggctgcaggagcctgcccaaaccctgcatgcagccccctgcaggcctcaatcaaccataccttgggcagggccgccgtcatgtcctccagcgcctgcaggcggctggcgcggccgagggcgatggcctcctccagcaccgccagcaggacgccgccgtgcgccgtggccgtgaaacnnnnnnnnnnaatggcctcctccagcaccgccagcgggacgccgccgtgcgccgtggccgtgaaactgacggcagtcaagccctcgtcggtgcctggggggaggagcggaggatgctgtttgggcaagggggggcaccatgaatatgtcatcaagagtcacaagggtagtgccaaggagtggtgggacggggacaccggggctcacaacgacaaaccatgcacaaacctccctggcgcatgaggagtgccacaccgcccgacctagccctcccggagcacaccccacctgccaggttgaggcgcatgtcgccgtggcggacctccagggcttgaggatccaccagcagcgcgtacctggacagccgggcgccaggtcctggtgcctggtcgccgtcgcccatgggtccagcagaggcatctgagagcagacccacgcagacgcctgagtggggttggggaggcttgtgagggtacacgcgagactttcgacctgctcgtcgacggcggcttggaaacagacctgagcctcttcacgtgaccggggtcatgtgaagggatgcctggacccctcgcaaacccccgacctcactcggccaccccacgatgacnnnnnnnnnnaaagcttgtgagggtacacgcgaaactttcgacctgctcgtcggcggcggcttggtaacagacctgagcctcttgacgtgaccaggggcatgtgaagggatgcctgggcccctcgcaaacacccgacctcactcggccaccccacgatgaccatcccgcacccacctgcaacgagcttgggcagcggcagcccagcgtccgccattgctaggcaggcaccgcacaccgccagcgcagttgagcccccgttctgagccaaagtttcggcatgcaggcgcacggtgaaggggaaggaggggccggagggcagaacagccgccagcgctcgctccgagaaggtggctgcctccagttccttcctcagcccggtctccgactcctgcaaaggtggtttgtgggggtggggggatgcttcatcacatgtgcactgaaccatgggcaatagcttggacaagagcgccaagtccggagccagggcccgtctcgggtacaagacgcacccagcgcacaccctctctcgtcctccccctcacctcatccccggcatactcgggcaggnnnnnnnnnntccgggggatgcttcatcacatgtgcactgaacgatgggcaaaagcttggacaagagcgccaagtccggagccaggacccgtctcgggtacaagaagaacccagcacacaccctctgtcttcctcccactcacctcatccccggcatactcgggcaggctgtactgcatgaacagacgcttggacccgcccgcatcaaacaaggtgtccgtcttctgcgcgtcggcgctgccccccaccgtggccgtgaccagggcctgcgtctcgccgcggttcatcagcgcggagccgtggaccacggggagaaagcgcggcgtggccagcagccgccgcgtgtccaccgcgccgcgcccgtcgcagcgcacgccctcttgcagcgccagctcgcgcagcgcgcgcgccgtcacctcggcgaaggccaggtccaggtcgcgggggctgacggcgccggaccccggcacgcgcacggggtccgcgcgcaccgcgcccgcgtcgcgcagcgcgcgc

SEQ ID NO: 46483 - DNA, 79 bp, Chlorella protothecoides
ggcggagggctgagagacttcttgggtggaggaggtggtgattcggtgggcggagggggtgggaactcagtcgatgaaa

SEQ ID NO: 46484 - DNA, 95 bp, Chlorella protothecoides
tccgtcagtccaaggatcctgcggtggggtctggctgaaactcagcaccggggcctggtggactctgcagcactcctcacatgcagacccaagac

SEQ ID NO: 46485 - DNA, 68 bp, Chlorella protothecoides
gatctcatcaagaccaaccgttcctgcaccatagccttctcccctattccgcacctggagcaccgtgc

SEQ ID NO: 46486 - DNA, 105 bp, Chlorella protothecoides
aggcaggcatgggcagtgggagcctgggaacaacgttcttccaaacctcctattttcacccctcgccggcctgatcccgaggacaagcctccaagagccacagcc

SEQ ID NO: 46487 - DNA, 61 bp, Chlorella protothecoides
cggtgacactgcagcgtcagccgccgcagctgcagcagccgcagcagcagccgcagcagcc

SEQ ID NO: 46488 - DNA, 99 bp, Chlorella protothecoides
ggagggctgaggtcttgatatacactaagacagggggacacccttggggtccattgtcccgtcaaaatggcatcgctgctgagaatccagttctccagc

SEQ ID NO: 46489 - DNA, 65 bp, Chlorella protothecoides
tgtgcatgaatgtgagcatacttatcgagttcatcttggaaatctcctcaacccatccccccctt

SEQ ID NO: 46490 - DNA, 69 bp, Chlorella protothecoides
tcgacaggttggaagccgtacttcagacaatgttaactccccacctcgagacctacaagtatcgtgcgt

SEQ ID NO: 46491 - DNA, 61 bp, Chlorella protothecoides
gctggaggagcagaatgtcaccaggaccctcaccctgtgccccacccagctggtcaagggc

SEQ ID NO: 46492 - DNA, 101 bp, Chlorella protothecoides
tcccgctcaacctcccgacagtgcgtggggttacgggagggggcccgagtgtgagtatcacaagtgtgcactagccaggccttgcttgggatccgtactcg

SEQ ID NO: 46493 - DNA, 70 bp, Chlorella protothecoides
cgtggcgccggggtcgctggacgccgtgcccgaggaccgtgcgatgcaggactcggagctgtctttgaac

SEQ ID NO: 46494 - DNA, 61 bp, Chlorella protothecoides
tcacatgcctcgcggttgacctggagggctacccgccgtgccccagccctcttcccactcc

SEQ ID NO: 46495 - DNA, 61 bp, Chlorella protothecoides
gggactctggggggggggacaggggggggggacacattagatactgggtacatgctgagag

SEQ ID NO: 46496 - DNA, 61 bp, Chlorella protothecoides
gctccacatcatggggctctccatgtcagcaattcgcgtgagcaacttggagatcctgtca

SEQ ID NO: 46497 - DNA, 61 bp, Chlorella protothecoides
aggacgctggagggtgtgatgattgcaatagattctcctgtacgccagggatccccacacc

SEQ ID NO: 46498 - DNA, 61 bp, Chlorella protothecoides
ggccacgcccagcgcgcccagcatgacgtcggcgtgggagcgcagcgcgcccagcgtggcg

SEQ ID NO: 46499 - DNA, 61 bp, Chlorella protothecoides
tgtgggtgtgctggaggcctgcagcatgtcaccgccagtcgagcgtcgccgggggcacatc

SEQ ID NO: 46500 - DNA, 63 bp, Chlorella protothecoides
aacaggctctttgaggccctggatggtgagcgtcatgaatgaggcaggctcgtgagggcatgt

SEQ ID NO: 46501 - DNA, 61 bp, Chlorella protothecoides
cagcgcgctcatgctcactgtccatgatccgcgaggatacgggaggcgacggtgtcatttg

SEQ ID NO: 46502 - DNA, 61 bp, Chlorella protothecoides
cgtgagtagccatggctgctttgcttgaggtggtctcttgtcaccctcgacactggggtgg

SEQ ID NO: 46503 - DNA, 29046 bp, Chlorella protothecoides
  modified_base (930)..(939): a, c, t, g, unknown or other
  modified_base (1262)..(1271): a, c, t, g, unknown or other
  modified_base (2547)..(2556): a, c, t, g, unknown or other
  modified_base (3323)..(3332): a, c, t, g, unknown or other
  modified_base (4073)..(4082): a, c, t, g, unknown or other
  modified_base (4424)..(4433): a, c, t, g, unknown or other
  modified_base (4829)..(4904): a, c, t, g, unknown or other
  modified_base (7514)..(7523): a, c, t, g, unknown or other
  modified_base (8192)..(8201): a, c, t, g, unknown or other
  modified_base (10276)..(10285): a, c, t, g, unknown or other
  modified_base (10638)..(10647): a, c, t, g, unknown or other
  modified_base (11594)..(11663): a, c, t, g, unknown or other
  modified_base (12111)..(12120): a, c, t, g, unknown or other
  modified_base (12524)..(12533): a, c, t, g, unknown or other
  modified_base (12585)..(12594): a, c, t, g, unknown or other
  modified_base (12866)..(12962): a, c, t, g, unknown or other
  modified_base (13108)..(13324): a, c, t, g, unknown or other
  modified_base (13457)..(13466): a, c, t, g, unknown or other
  modified_base (14775)..(14784): a, c, t, g, unknown or other
  modified_base (15177)..(15186): a, c, t, g, unknown or other
  modified_base (16089)..(16098): a, c, t, g, unknown or other
  modified_base (16168)..(16177): a, c, t, g, unknown or other
  modified_base (16769)..(16778): a, c, t, g, unknown or other
  modified_base (17569)..(17578): a, c, t, g, unknown or other
  modified_base (17709)..(17934): a, c, t, g, unknown or other
  modified_base (18315)..(18324): a, c, t, g, unknown or other
  modified_base (18407)..(18609): a, c, t, g, unknown or other
  modified_base (19156)..(19165): a, c, t, g, unknown or other
  modified_base (19393)..(19402): a, c, t, g, unknown or other
  modified_base (19456)..(19465): a, c, t, g, unknown or other
  modified_base (19521)..(19643): a, c, t, g, unknown or other
  modified_base (20007)..(20016): a, c, t, g, unknown or other
  modified_base (20178)..(20187): a, c, t, g, unknown or other
  modified_base (20521)..(20530): a, c, t, g, unknown or other
  modified_base (21086)..(21095): a, c, t, g, unknown or other
  modified_base (21426)..(21511): a, c, t, g, unknown or other
  modified_base (21741)..(21750): a, c, t, g, unknown or other
  modified_base (23125)..(23134): a, c, t, g, unknown or other
  modified_base (23441)..(23450): a, c, t, g, unknown or other
  modified_base (23851)..(23860): a, c, t, g, unknown or other
  modified_base (24550)..(24559): a, c, t, g, unknown or other
  modified_base (24755)..(24764): a, c, t, g, unknown or other
  modified_base (24875)..(24933): a, c, t, g, unknown or other
  modified_base (25202)..(25211): a, c, t, g, unknown or other
  modified_base (26004)..(26013): a, c, t, g, unknown or other
  modified_base (26083)..(26092): a, c, t, g, unknown or other
  modified_base (27380)..(27389): a, c, t, g, unknown or other
  modified_base (27721)..(27832): a, c, t, g, unknown or other
  modified_base (27989)..(28106): a, c, t, g, unknown or other
  modified_base (28748)..(28757): a, c, t, g, unknown or other
ggccgcggcggccgccgcggccgggcccctgaccaacaacatctcggcattctccttgcgcagcgtgccctggctaggctctcgtgctgtgaggccccaggggtctggtgacagcatggaaccccggtccggcccggggtccgccgtggtggccccagcgcagcgcgagatgccaccccagcatccccccccctccgcctcctcctccatggagtggtacgtggccgactgcgcgcgtacgggggtgcgctacgtcgtgctgcaggggtcggacaccctggaccactggcgcgtgaacctgacctttgaccccgtgcccttcgagggcgccgagctgggcacccaggtccaccgcggcgtctacgagctggcgtgcgcgctgtaccccgtcttcctacccctcgtgcgcgagcacgtgatggcagcggcgacagactcgcccggcgcgccgccacgccgcctcgccttcacggggcactcgctgggcggcagcgtgggcgtggtgctgtcgctgatgctggtggcgcgcggcgagctggcgccgcgccacctggcgccggtctacacctttggcgcacccgcggtgctgcacgacggcacgaacgacggcctgctgtgcgcgctgggcctggacgagggcgccgtgcgcggcgtcaccatgcaccgcgacatcgtgccccgtgcctttgcctgcgactacgcgcccctggccgaggtcctgcggcgcctctccgccgccttccggggccacgccgggctggcgccgggcgccggacgccaggtgagcgcgcctgggagggggccagaggggggtgggcgttgtggccctcatggggcaagagcatgtgggcgagagggtcggtcggcgggccgggcaaacggtgcacggggaggctcatcgacgcggcgcggcaactgctcaacaccgcnnnnnnnnnncgttggccctcgtggggcgagagcatgtgggcgagagcgtcgttcggcgggccgagcaatcggtgcactgggtggctcagcgacgcggcgcggcaactgctcaacaccgcccgccggcggcccacacgagcccaccgccgccgccgaggcccctcctctccacggcattgcctgtacgctacccaagcctgatccatctctgtgcccccctcccccacccacacgcccctgatgaccctccctcacccccactcaaacactcaaccaggccatgtaccgccacgtggggcgcctgtacgtgctgcagccgccggcggagctgnnnnnnnnnngcccaagcctgatccatctctgtgccccccacccccaccccacgccctcaatgacccccccccaaaacaatacactcaagcaggccatgtatcgccatgtgggccgactgtacgtgctgcagccgccggcggagctgcgcttcacggcgcgcgagggctaccacccgctcctgccggccgcgcccggcctcttccgcttcgtggcgcccggcggtggtacgcggggggcgaccgcccgtgctggccctgcaccctcgtccaccgcacccagcaccaagccctgcacccggccggactccctggcaaacgcggtgtgggccttcatgaacgacacccatccgctggacacgctggcggacccggcggcctacggtcacgccggcagcatctcccgcttccacaacccggacaactacacccgcgcctgcggcgcggtcctgcgcagcgccggcgccaggctcgagcgcgtgctcgggcgcagcgtgagggcggggcgcgggcaccgtgtcccccgggccgagccgcggcgccagggcgggccgggtgagaccgtgcgcgacgcggcggaggccccccccccgctcgcgtgcgtccccacttgatatacaagcaggcacagacccggcgtggtggggatgcgctgggggcatccccagccccccttcgacccacccgccccttggatgcgcagcatgccagtagacgtagattaggcggaggtttagcaacctcctggtggcacccctcggcaaggactgggcgggtcagagcggtcaccgcacccctccccccccatgttctcgctatccaggaatatgctctcgttctcctgctcatgcctcaaataacacgggtcctcaaacctgccgtgcctccctcctaaatgggcccagtgccccatacacaccatcaatacacgattcccacacttgactgccccccatactgatcccacttgagagatgaaccctgccatgactgtgccctttgtggcactccactctgcctgcacaggtgttgtgcaccccccttatttcacttgctttgtccatcctggttcccaattgagtgtgtgtgtgttttcactgtaatcctgtctgcgataaattccaggggaatggccgcgcaatgcttggggacaaccgcaaggcctgatttctggcagttggtggcagaggccgagcgtcgcacgcgcagcaccagcgctcgttgccttggagtcctctcctgggcatgcacagcgaggaggcgagcaagatgtgaccaatatttcagnnnnnnnnnngaattccaggggaatggccgcgcaatgcctggggacaaccgcaaggcctgattctggcagttggtgtcagggcccgagcgtcgcacgcgcagcaccagcgctcgttgccttggtgtcctctcctgggcatgcacagcggagaggcgagcaacgaggcgagcaagatgtgaccaatatttcagcatcgacaggggtgacagggagagacggtgcttcccaggagcgagctttaattctggcgagcggattcgcaccctacagcgaccaggcacaatggagttggccgcgaccaggtgcgtacctgctttgagaatgcgagagcatccttgtaatggagcctcatgatatattcacatgctcatgcaggtccgatacaggaggaggccttgtcttgtcggagcacgcccatgggcagcactccggcaaggcgcatgggcccctcaaggtgtccccatgggatggaggctgagaaactccatcgtctcctgtcctttgacatggtcccctctgtaattttatcttgaatgtgttcttcccattcctctccctccagatcaccgatccagtggcgttccagaagatgcttgccgacatgaaggccaaggctgaagagcaaaggtgggtggtatgcctggggttgtcagcattagactgtgagtttattcgcttgctacgggtgtactccatgctacccgagctactcacaacaagtcccaaatccacgccgttcataacataggttgctggctgccaagagggaagcagannnnnnnnnnaatctactcataacaagtcccaaatccacgccgttcataacgtaggttgctggctgccaagagggaagcagagcgtgcaaaacgggaaggtgccaactacaaacctggcgcctcagaaagcattccagccagggtgagggaaaggatgtacaggggtagtctgtgggtttgggagggtggggggcatgtgagcgctctcaagccaggctcttgttcagtgctgctcctcccatccccacactcaggctgctgatgaggtagaggcggtcgggaggaaggtcgatgcccagagagattactatgccacgctggggatcgaaaggtgagctgagaccgccatcctcacccgggatgtgtgtatgtggcagacagaatctgcatgcagcgcgaatgtcatgtccagtcacgctgggagaattgaagctgctctgtgcatgcagatgtgatcctttgtacctcctttaaatagccaatcactgtacctggcaccttaaatgcagctgtgccgcagtggcggagatcaaggcggcttacaagaagctggccctgctgtaccacccagacaagcacaaggccgaggacgctgagcagcaggtggggcttggaaaggaaggtggtgatgcattggcagtgtgagggacagctgtgctcctcatcgattcgaatgctggcatccaggtggcgctccttgcgctggccgcatagtggcggcgagtttgccgagtggggagggaaggcagnnnnnnnnnntctcatcgattcgaatgctggcacccaggtggcgctccttgcgctggccgcttagtggccgcgagtttgccgagtggggagggaaggcagtcagaccaatctcgacaccctgctttcacacacaggccgccattgccgacaagttccgggaggccgccgaggcattcgaggtgctttccgacgagcgctcgcgaggcctgtatgacaaagtcagggactaccaggtcggttttgttgggccgctgatggatgtctatggcgatgtgatcgaggtgtacctcctgagtccggccgatcgaagtagctgtttttgttcgtctcattctaaactcttctttacgnnnnnnnnnnagccgatcgaagtatctgattctgttcgtctcattctaaactcttctttacggaactagctgatcctatgccccgaatacatttctcacacctgcagggcgccaaccccgggcggggcctgcccctcctgagccgagaggaggctgccatgatggcctccggggccgctgagctggcgcgcttgcggcggctgggcaccaagcacatcaagcacgcgcccagcgcacgcagcgtggccctgcccctcgagcagctcaactccgggtgcatgaagacggtgaccttctctcgccggcgggtggacgaccacggcatcgagtacaactccacccggagcttctaccttgtcatcaggtgcggactcgcagggcgctgggtcaagagacaaagaagggnnnnnnnnnnnnnnnnnnnnnnnnnnnnnnnnnnnnnnnnnnnnnnnnnnnnnnnnnnnnnnnnnnnnnnnnnnnnaggagcagggcaagacattcctcatcctgcagcagtctggtgcttgaaatgtcactgtttcatgctccgcactccccagccgagaacgcttggccaggctcccccccccccctccccatgaactcccccgctcaatctctttgccctgcgacaggaagggctcgcagcagggggacgtcctgacctttgagagcgagggcgacgagacggtggacacgcagcccggggacttgctggtcacactggcggcggagccccaccccaggttcaggcgctcaggtgaggggtgaatgacctctcaagtgcagggcaggggcgggcactgcttcatcccggatgaggtgctcccgttctgctggttgtgctgcaaaccctgaagccttccccatgccgcccaccccacacccaggccccaaggacctggagaccttttgcggcctgctccccgccgcccagtttttcgcagccgtagaggtccccaccccctctggcgcgccgcgcacgctatgcgcccgcatcctgccccagctgctcgcctcgggcggcgcggggggcacctgggtgggcaccgtccggggccagggcctgttcgaccacgacgacccctggggcgcgccgccaggcgacctgagggcctgcctgcgctacccggcgctgagactgagacccggcagcgtgcgcgtcgcggcgaggcccgggctgctgttgctttttggcagcgccagcgatcccatctccggcgccgcgttggggggccttctggccgcccagcttgcccacgaggcactgacccaggacctgcgggagggggagggcgagggggcatgcagtgcagatgttgccagacgccagaccttggtattctgggacctgggccgtggccggggcctgccagtcggcgcggccgccgcggcccaggccgtgcgggtcctgcggccgggggcacacctctgcattgtgcaaggcgtcgagctgctggatgaggaaatggcggcgctggagagcgcagacgctgtggtccttgtcgccgctgtgtcgggcgagggctcggagggcggcgcgggggcaatgggcgtgacgaccccgaagggcagagttccagctccagacctgtcagcctcgcccggcggtgcacgcgcctcaaccccctctacacctcccccacccctcctcctgcggaccctgctggcgccgctgctggccaggggcgcggcggtggccggcatgggcggagccctaccgctcctgcactccgccggagtactgccctggtactgcgcatgcgcgggcgaggccgacggcggctggcgcggcctgcaccgagaggcgcagcgctcggcggtgccctgcgtgggcgtggcggcgggggcgggataccgcgtcgatgcgctcacgggcgaagcgcacgcgatcgtggcccctggcaccgacgccctggtggcggcggccagctgggaggcgggaccgggggagccgcagggctttgaagcggacgaggaccgggggtttctcctcgccctggagccgggggcagcctgagcgggcctactgagagcatggctccgcgcgccggtggagcccgattatgaccctgatgacaaggtcgtgaccttgcagtgcatggctcgacggcatgacgctcctctcgtcctgcataggtgtgctgctcccgacctgtcaaggtacgtctcccacccccagctagcctcctgggcaactgaccatacccttggctcttcacagcacgcaagcattcgtgacaggtccctccccctggcttcaacccccttcaaaacccgaggcaagggccaaatacattacagtgcagcaaatggcatgctcagagaaagagagtcatagagctgcatagctgtgattacagggcaagagtacacatagagggctcggccccgctgccgcctactgagctcacccgcatcagagagctcaggcctggccacgctgttcactgaggacaggattgggtcaaatgtctgaggagctttgcatgaggccaggaacaccaggatgcaaaagtcccaaacgatccactgccaactctgggtctgctcaccaacacgaggacctaggggaagacgcaggctgccatgcaggcgctccatgctccacctcggggaggcgacaagtagggagccacaaccacaccccatcacggaaaactgcaggggttggcgagccaggaaaacaagccacaagggaagacttcgagcaatcaatcatccttgctgttacttgaaatcggttccgtgattgcaccctcttcattggacgtcggcgcgcctcctgccgacacgggaacaccgacagacttggattgccctgtcacctcgccagcatcgctctcgttgtcatgactggccccagactggctgggactcgccatagaatcgcccgctgatttgccgccgccagccgcacggtgcagctcttccagctcctgggccatcagctccaatcgctccttcagcctgcacacaggtttaagcttgccgtgaattcatgtggggttactccatgatcagacggcatgcctccaaaccttgctatgggtgcattctcccaaacaaagtagacatcctagacctccannnnnnnnnncaagcttgctgtgaattcatgtgaggttactccatgatcagaaggcatgcctccaaaccttgctgtgggtgcattcccccaaacaaagtagacatcctagacctccacatacccaacctcacttcaatctccaaagaacacaagaaggtccatcaaaaacataagcaaacccacacactcccattccaaataaattaccttagattctcgtcctcaaggcgatctatgtatgcctcacgctcaggcggaggtgcctcgtggcccgcacctggcaggtgaatgctgtgttggcccgaaggacccggagagtgggtggagacgcagtcatgcctagcacctgccacctcgctgtcgtcggaagaggagccagagctggtggggaagacatccatggggaggaccaggccctcattgcttccgtaaaaattcacgccggaggcatcgaacatggtgccatggccgccccccttgaagggctccagggcaggtgttgccaagggattcaaagttgctacaaatgggagagatgggagaggtataagtgacgacaaaagggtgcagtatatctgatcatcacaagcacatgcaggcagcaggcaagcccacatgtgatccatctcattctgcagaataatccacaccacaaggcctacatgctagagcttggcnnnnnnnnnnagtctcattctgcaaaatattccccaccacaaggcctacatgctagagcttggcgggtggagttgaagggcgccgggggcacactcaggggtgctggcaggggaacagcatttcctccgctgggtaggagggcctggcctcgagagttgcctgggagtgtccccgaaccgagggaatgagccagggtaaagggaacataacagggccaccacacggtgctgtccccctgcctaccatgtgctcggtagtgtcgacgggtgttgcgtcggttctcacgccgcagatcttgcagggagggcacgctcccgaagaagccgagctgctgagagccctgttgcggaggctgttgagacgttcgcttgtactgcgcatttcgaggctgtaggttcaagcctgcacggtaagaggcttgcttaccgtttttattactaccgcgtttccgccggggcttgcgaggcacggaggcctgcgtcccggagggcgcgtccatccctctcaactttctggccaaggacattcacggtagaccagaaaggagcgagcgctcggtagtttatctcttagatacacgagtgctgaacaggacgaaatgggatgtgctgaacggccgtttgggaacaagagcttgaaaacgcaccttcttcaagaagggccttccggggtcgaatcttgaactctgttgttttgttgtggttgaacaggacccgcctggcacattctaatatttgcccacacacttgccacaacatattatcagccaatgacacatgattaggcagcatctgcaatcctagcctgcttgagggtcctgggcaggatgctggatgggatctaacattcacgtcaatatgctgggtaccttcatgatccgacattgtacaagaattgcaagcttccgttaattctttctgaaagacagggctgtctatagtgccttggtgtgccaaatgtcactctatatgggcaagacaagcagctgcaccatgacttgctgcgtcatattctgcgcattggcgccgtatcagcacagggacctcccgtgcacctaacatgcgctggaattcgaagctatccggacatcatacgaagtttaccgctaccctattcttgatggagagtgatcatacagaggggcctcctctgtcggaggcctcatttttgaaaagaaaggctgaggaatgggatccttgggaagccgacctcgtcacgcgacaggttggatcccatgcgtgcgatcagtgccctctattcacgttctctacacccttctgttcattacactcggcctggcgcgtttggggcttgtctacagccgccctagtccattccagttgcacaggtgcgagcacctgcagcgtcggagttcgatcgaccatgcctagcctggtttggtgtcgccgagctcctccacagcccattacgtgcattatatacctgtttacgagttattgagaggagggttgcctggctcgtcggggatcatgggcgtgtcgactgagacagcaccctgcccctaccgcccaatcccagcccacctgtgcctggaccacgaagccgatcatttcctgtcgaccactccctgtaacggcgccactgctgcgtagccccgagggtacattgcccagaccttcgtgacgcgcttgagagggtgagcctgcaagcccggatggagccatggggtgaccatctgcaatctcctcactgtcagtgtctgaggcacgcggctgcatgactggcctggatcgtccgtttgtgtaccctagtacccggctgtctttccatcagcccgtccctgcaacaaataaaatcaatgcagggcagaagaggaggacgatgcataatgcctactatgcgtctgctggtcctgcgatgggcccagatgggcaacagaaacggcaacgcttggatctgagcgggtgcggggcattgcaggtttggggccaaacacacctgcagccttgctcagggattgcgccgtccatgaccttctctgcagctctgcgcaatgttgcatctccaggtcccaagcttctgaccccaccatcacacaggaacatccccgtggctcccagcgnnnnnnnnnntcgaacacacttgcagccttgctcagggatcgcgccgtccatgacctcctctgcaactccacgcgccattgcacctccaggtcccaagcttctgatcccaccaccacacaggaacatccccgtggctcccagcggtgactcccaggctttccagggtccgccacagcctgggctgacccagggttcccaaagtagggcagctttcctgttgtcgtgctgtttgcactcgaggacgggtgcatctggatggccagccctgctccccgcgacagcctcggcgtccctgtcctaagccgtacatcagtgtgctagctttccaatgccatccattctagcctcacactcacgggttnnnnnnnnnnttgttgtcatgctgtttgcacttgaggacgggttcatctggatggccagccctgctcctcgccactgcctcggcgtccctgtcccaagccgtacgtcagtgtgctagctttccaataccatccattctagcctcacactcacgggttccctgccccttgcaggtgatggccaatgggtctggcatgcggaggttgccaaccctgatggtggccagggcacctgggtctggtccccggcgaccctccaggccacctaccaggctgccccccccccgttccagcagcaggggtgggggcccccacactctggtggggcactggcccacccaggatcatcctacggcggtcagtgtgtgtgggctcgaaggcttctgggtgcggagacgcctctatcagcatgttgtcaatatgctgtagcccatcaaagcaggtcgccttcctgccatcggtttcccgaccttgtgccattcccccatgcccggcttccctagcgcccaatccgtggcctgaacaaacaccaacacacacccaatccaggcacacactccgccgtgccccccccggggacgcccactcagcctgcgccgcacgccggcgcatacctgtccggccccggcgcgggcggccccattggcggcatgcccgggcccccgcagtaccaccagcccatggcctactacccgcaccctcatcccccgcaccccttcttccacccccacccaccgccgccgccccaccaccacatgccccctttcccgccgggccagtttgggccgcccgccccccacttcctggaccagccccggtcgcaggggtacgcacaggggcaggccccttcgtaccccggccaccccccgcgcggccagtcgacggggctccagccccccggccaggggcgcggaggaggtcggagcgggggcggcgggggccggggcggcggcggcggnnnnnnnnnnnnnnnnnnnnnnnnnnnnnnnnnnnnnnnnnnnnnnnnnnnnnnnnnnnnnnnnnnnnnngacccggcagccatggcggccatcgagatcaacaagcgcatgacgggcgcgcgagacgccggcgccatcctggacatcgtgcagaccgagtcggaccgcttcgacaccatctgcctggccacggccatgcacaagctggcaaacatgcgcggcgcccccaacctgcactcccagatcgtcacctcgccggccttccacaagctcaaggccctcatgcgtgcgaggggctgggaaggaaagggggaaaaaggccgcaggggttgggccgtgagatcgccggccgggcaggtcggggttggagtggaggcgtggcctggcatgtggctgacggtgctgacctacgaggttgagccctgcacactcgcgtcgcgcaatgaatgcacaccggggtgacgccaccccctgtgcgcccgccacactgcagtgcaacgcaagacggagagctccnnnnnnnnnncggggcggggctgggaagggaaggggggaaaggccgcaggggctgggccctgagatcgctggccgggcaggtcgggcttggagtggaggcgtggtctggcatgtggctgacggtgctgacctacgaggttgagccccgcacactcgcgtcgcgcaatggatacacacgggggtgacgccgccccctgtgcgcccgccatactgcagtgcaacgcaagacggagagctcctgccgcaacatctccaacacgctgtggtccctggccaagatgaaccaccacccaggcgaggagttcatgcaggcgtatgcggaggagaacgcgaagaaagcgggggacgggaactcccagaacacggccaagtgagacctccaggggtggggggggggggggggggggggccgcnnnnnnnnnntgtgtcacatgcaggatggagacctgggagacgcgatactttacagttcacnnnnnnnnnnatgcctccagggggtcttcggattgggtgtgtcacatgcaggatggaaacctgggagacgcgatactttacagttcaccgtcctgcctctcgaactgtgcgccagcaccaacctcccaccttcgcttcccatccacagctccctgtgggcgtttgcaaccctaggtagagagcaggggtctgactgcccaagttcagttgcacatacttacacatgctcttcatcctgtcggcccctcgtcctcctcaccccacccctgacccatgcgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcccagaacataaggtgtgtttttaatgtctgtgcaggtatttatcggggcccaggcggcgtggttggggccgagaggggcaagacacatgatgatacaagacggaggagggctctgttgactgtccaacaagaaaatgcccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctcagggtacctagggttatgagtgaagctgcagaggagcgggtccccagctgctgtccctccgtccaacgtcatctttttgtgaattttcatcatcatgtcaccgagcggagccccctccttcccaaaannnnnnnnnncttcagttgcacatactcacacatgctcttcatactgtcggcccctcgttctcctcaccccacccctgacccatgcgccgccatgccacagggtatcaccctggcaatgctgtgttggacgccctgaccgagacggtgctggccaagctcccagagttcacagcccagaacataaggtgtgtatttaatgtccgtgcaggtatttattggggcccaggcggcgtggttgggatcgagaggggcaagacacatgttgatacgagacggaggagggccctgttgactgtccaacaagaaaatgcccacctgcgtttgcccctggcaatgaccctccaccatgatcccgctcaccgcatccatcgctccatcttcacctgccctgcagcaacacactgctgtcatatgccaagctggagtacaacccaggcccagaggtggtgacggccttggccaaggaaaccgcgaccaagatctccacgttctctccccaggtgagacctgcggatggataggctcaggggcacctagggttatgagtgaagctgcagaggaacaggtccccagctgctgtccctccttccaacgtcatctttccgtgaaatttcattatcatttcaccgagcggagccccctccttcccaaaacaggccatgtccaactccctctgggcgctgagcaagctggagatcgaggaccaccagctgctggaggccatcggtgcggaggtcaggaagcacatatgggagttcaactgccagaacctggccaacaccatctgggcgtttgcaaacctgggcatcaaccccgggcctgacctcctcactgacatcgcgggggctgccatccatcgcctgcccgagttctcaccccagaacctgtccaagtgagcaatgaggagggggggttgaagaggtttgtggcacagctaggcaaccatgacatattcaggatgctgagccctgccgctgcatgtcttaaatagatatcacgagcagcagagggggattgtggaggtgtatctccacaaagacattccatcaggcattggtgggaccctccctaatcaaaccctcattgtgcagcacgctctgggcgtttgcaaagctggagacgtaccacaaggagctgtttgacctgggtaagtccacctttgtccatgccgcccatcaatccccgccagaccttgcatgggtggagaatgggtagttgagaaaccacctggccgtggtgctgcatatcaatggaacccaaggaagggcataaccattgctaccggcgtaacagaatggttcagagtttctgtccacannnnnnnnnntgccgtggtgccgcatatcagtggaacccaaggaagggcataaccattgccaccggcttaacagaatggttcagagtttctgtccacaatgtggagtgccaggttggaaggacgtctgtcacatcaggtccccatggcggcatcctctcaccactcactcgccttggagccaccgacatccacacacacgttcctgtgcaggcactctgcatgcgctgcgcatcattcacacgctgcagccccagaccatggccaatgtgagttctggtgttgaaatggaggatttgcaaaaggttttgacttgggaggacaccctccggtctgattgcatgcaaagggcccacttcaatccttccatcccccttccagatcctgtggtcctttgctgccctnnnnnnnnnnggacttgggaggacaccctccggtcgaatcgcatgcgaagggctcacttcgatccttccatccctcttccagatcctgtggtcctttgctgccctgggggtgtgtcccgaccctgccttcatccaggtgacgcctttggtgtgggttttatgcagcacctcaacgggcttgctctcagggctgtgggagctggagaagtatgagcatctggccaaggaagacggtggtagcctccagcccaagcatatttgacccctcatcaccagcctccccctcgttgatcacaggcgctgtcgccccaggtcctgcggcagctggaggagttctccccgcaaaacctctccaacactgtgtgggccctggcaaccctctacaacttcgagcccgtcaaagagctgcacaaggtgagtgggatgaccttgcgtggcaccagcgcagggaggctgtggcgcactgcctgagaggggccaaccggaatccaggaaatcaggacagcgggaaagccttgccaggcacaatgtatgatgggggtgtcctatttcaatgtccatccctcctcctccttccaccatgacagccgatgacggtggagctgtgtcgggagacataccgccgcctgaccgatgccaagctggcgacaacctactcgcgtcagcacctgtcaaacacggtgcgaggggtgggtcgcacgacgacaattggttccatgcactttaggaggaattggagaacgcatctgtacctttagggcatgtctgccacctgcgtggatgtgcagagctcgaggggtgggcgtctgggtgatccaccgcatgccgaggcctcgatcggccctgctcctactcagtatggtccccccatcccacctgttgagtcactgccgaccaactcacatgccagatnnnnnnnnnnactccacactaaaatgcgagtgcgttgggtcagaggccgtgcaacaaatactgatgggataaatgtgtannnnnnnnnnaatcggccctgctcctacctagtatggtccccacattccacctgtcaagtcactgccgaccaactcacatgccagatctgggccattgcgaccctgggctacgatcccggcaggaaggtcatggaaactctgggcctggcccagtccatgcgtgtggagagctgctctggccaggagatggcaaacactgtgtggggctttgccaagctcggtgaggtctggggtgcggcagtgggtttcgagaagagtgctcattcatggaagacatcaggctcacccctgggatctccacaataaaatgcaagtgcgttgggtcagaggccatgcaacaaatactgatgggataaatgtgtactttccctccaccctttgctccatccacactaccctgctcccaggcgcctactgtgctcccctcatggccaaagttgctaccgagtctactgctcgcatccaggagtacacctctcagaacctgagcaacctggtgagacgggtgtttgcgcgggaatcgtcaccagctgcctgtgtatgcttgccctgttcgaacgatgaccgtggggtgggagtggtgcagcttcctccctgattnnnnnnnnnnttgtgtatgcttgccctgttcaaactatgaccgtgaggtgggagtggtgcagcttcctccctgattaaacagaatgtcttcaacccaagcattgcctgctcgtgcaggcatggtcatttgccaagtgcacctaccaggatgatgacctcatgcgagcaattgcacgtgagtggcgggcaccgtgtatgtcaggctgggctacacttgccattgacgatcagcacgcagggtggtttatgccctgcggtacctggcctgcctcccagcatgagggagtgtcatgctacacccaagatcacgtgctcctcctcacctgcccccggaacagagcgctccatcgagatcaagcaagatctcagcttgcagcatctatccaagtgggtggttgtggagcatctgatgtgcttgtgtgggtgcttggtggaatggctgaggatgtcctttgaccaaagcagagattgccacctgacgagtacagtccagcctctgaattttgaatccccacctccacaacagtttgctgtgggcttatgcgaccctcaaattcacggtgccagccttccagaccgtcatgacccaaggtacacgggtgttgtggtgtgtccagcgaggctttcttccaggtggctgcccgctaaagtcgccatctgctgagcttgcactttcaaacattgcagccgtgcctgacacccagtggctccgccccaacccaccctgcagaggtgaagcaccggctccagaccgacaccttcaacctgcagcagatttccaagtaggacggggctctcagnnnnnnnnnnttgaggatgtccgttgaccaaagcagagattgccacctgacaagtacagtccagcctctgaattttgaatccacacccccacaacagtttgctgtgggcatatgcgaccctcaaattcacggtgccagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatggcttcatcccgccctgtcccaaacaagttctggatcattctttccccgttcatcaaacccttgctgcatgcattcatcccttcctttgccctcctcactcgcagcatgacctggtccttggccgtgctggaggcgctggatgaggaggcctgggacctgttcatcgaggccctgcggcccgatgtcttgggcatgcccccctctgagatcccagacgaggcgctgtcccaggtgcggggccaggggggtggggaaggggtgcgtggtgtgtgcacgcagctgagcgagcctgcgacgcggacagacagccatacctgtcctgagcggccgcgccggccctgtcctcgcctgtttggactgcaggtgttccaagccnnnnnnnnnngaacggcttcatcccgccctgtcccaaacaagtgctgaatcattctttccccttcatcaaacccttgctgcatgcattcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagggggttagggttaggggtgcgttgtgtctgcacgcagctgtgcgagcctgcgacgcggacaggcagccatacctgtcctgaccggccgcgccggccctgtccccgcctgtttggactgcaggtgttccaagccctgatgctcatgcaagtcaccaagccggatgggaaatgggacatcccagacgagctccgaatgggcggccgcaagtcttggctcagcaacaccaagaatgtcacgtgcgtactcagcaggggtggtggaatcggcgtgatcttgctgtggtggctggtgttctgcatcggcaggctctggacattgctgatcgcatccccccgccccccctcccctcctccatccacagcatatcggagttccacagcgaggtgtcccgcatgctgtccagcatgggcatcaaccacgagtttgagcatctcacagaagaccgcctcttctctggtgcgctggggttggggagcagcacgaatgaatgtgccgtaggtttaccacaagggttccctgtcctcagatgcaccgccagcggnnnnnnnnnnttcagttgatatcgcgctgtcggatgagaagatcgcactggaggccgacggaccccatcacttcacggcaaacacgctgcaacccctggcggacatgtattggaggtgaggggccgtgggcctgggcatcggggcttgaccatgactggtggctgccacccggtgcacaccgtgatagcaggaggggctggcagccgtggccccagcgcaccaaggcgtcacccttgnnnnnnnnnnacagcccggcgccctcactgctccccccccacgtgccccctcacatgatcaccnnnnnnnnnngcagcccggcgccctgactgctcctcccccccacgtgccccctcacatgatcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcctggcaccggggctcgactatgactggtggctgccacccggtgcacattgtgatagcaggaggggctggcagccatggccccagcgcaccaaggcgtcacccttgtgctgccctctcctgccaccctgagcgtactctcatgttctccccacgcaggcgcacgctgctccacgcccgcgggtggcgggtggtgtcggtgccgttctaccactgggccggcgccgaggatgaggaccggagggcgctgctgcggcgcttgctggcggaggtgcgggcggagcccataccacggggccccgatcagggcaggaccacagagccggagcagaaggcgggctgccctggcctggagccacaggcnnnnnnnnnngagcgcaccagagcagcaggaggcaggcaggcagccccgggaggctgaagggacttcttaaggttttgctacctgcgagtcctctctggaacatgttgaagagactgcccagtggggacccaagttgcagccgtctgccactaccacggcattcgattcagnnnnnnnnnntccacccgcgagtcctctctggaacatgttgatgaggctgcccagtggggacccaagttgcagtcgtctgccactaccacggcattcgattcagattgcaagatacccttcctcatgttgcaatgaccatgttaccttgcgatccccgtcacggggcggaccctgcttgccaccttgcccttccacattggtttcgtattcttcttgcgtctgcaattgcagtactgtggcatgcggttgcactgatggtaagttttattcatagcgatgacaagtaagggctccagaggttggtttgaacagggcttcgtcttcatacccatgcacacaagcnnnnnnnnnnggcactgacggtaagttttattcatagcgatgacaaataaggctccagaggttggtttgaacaaggcttcgtcttcatacccatgcacacaagcctgccgtgcctgggtctgggcacctcatgtccaagacggccagcgatggccaggcaatctagcaacagctggacgcccgctgctgctgggcggccttgggcttcagcccaaagttggaactcgtccctgcgagcagggttggcgtctccaagatcttcagcaccaactcctcgaatgcctgatccactgcgatgttgcccttggcactggtctccaccaagagcgcgccgtgcttccgtgcaaagttaatgccgtcctttctgctgacctggcgctcctcctcctgcaagggcacatgcaagcaagcgggtcccagggctcaggggggtgctcgtgtcagtttggagagtcaatggggctggttgcaccatgagcagccatacacaccgcacaaagcccctggaccaacattaaaaaacacaagcacccggctccccacccaacaacccaccaagtccgtcnnnnnnnnnnaccagggctcagggaggtgcttgtgccagtttggagagtcaatggggctgggtgcaacataagcagcctgacacaccgcacagagcccctggaccaacgttcaaaaacacaagcacccgcctccccacccaacaacccaccaagtccgtcttgttggcgaccaccatcttcaccgcatcctccaccgtggcatacatgtcgacctcccgcagccagacctcctccagactctcaaatgtctcccttcgagtcacatcgtacaccaagatgattccctgggcgcccctgtagtatgctgcagcagcagcaggggacgagggggatggggatnnnnnnnnnnnnnnnnnnnnnnnnnnnnnnnnnnnnnnnnnnnnnnnnnnnnnnnnnnnnnnnnnnnnnnnnnnnnnnnnnnnnnnggcaaggaaggacgcacagctggtcagcgtcctgaaacgttcttggccggccgtgtcccagatggacagcttgatcttctctccattcaattccacaacctttgccttgaagtccacacctgccagtcgatgagagtttttaagggagctgggggctcaggaggaagggcatggccaggtgggtggagagggtgtcaatcgatgcaggacatcgccctggaggagatgcnnnnnnnnnntaggtgggtggagctggtgccaaccgatgcaggacatcgccctggaggagatgccagtgcagagcagccaaacgctgcatcgctcccatgtccttgggtccgaaaccatgctcaccaatagtggggacgagctcctcaaaaccaccagtggtgaaacgaaccagtaaggaggacttgcccacactgctgtcgcccacgaggagtatctgttgggaagaagtagagcgattaaaaacaatagcacaactccaagcctagtgtatcgctaagttcgcggagagcgaaccttgaaagagtgggtaggctcctcctccgacagcatcccgggaacttcacgcgggtcggttggcgcacacggcagttccttgcaaggtttattgtggcgaagaaaagataatatttaatctccgctctctgggtctcctgcatcgtcgtctgagttcagcagtgacccggaagtcatgccaatggcctcgccttggtcctgaccacgtgggtgggtcgtcccggagaatcaaattccttctgcctggactccaaacacgcaacatgcgttggctggacatctgcgttatgtatcacgtcatcacatacatcctatgctctgatctgcgatccctgaagtcgagtggcggaagtcagtgtgtcccacatgtccagccggaaccccttgtgagggcatgctggatctcgaggacgacatccctctgtttgatggaacccgcctcaagccctttcaacggcctggggtgcctcccctccgccttcacatgccccggggctcctcgtctcaagacctggcgcccacatcgcccaccagctctgctgacgccgctgggtctgtgctgattcacaggaccgccagtgggagccagaggggtacgattcccgcctggagggaggccagtcctcacctggagctccccagcacctccaaggaggtggaggcggaggtggcctgcaaggcctccagtagatcatggaaagggccatcttgcgtgggcaataccgatgctggtggaggaggcctgccgcctggtctgccctcgccacatacacggtcgcactggccacaagaacgggacaggggaagctgccctccagtgtgcatacagcgcgtaaaagctgtgcgctgcagagggtctgcggaggcttttccacacgcagagaccctgtgccgcaggcaagtggcatgattttcaggactcggggcaggacactcaggaggttattccacatgccccctcggaatgtgccttggggctgtgtgtgccgtgctggatctgctgagacatgaccaggaagaatttcatacctactagaatgcgcctttactgaatatgcgaggcccacatactggtacagggcaatgccnnnnnnnnnngggggacactcaggaggttattccacatggcccccccccgaatgtgccttggggctgtgtgtgccgtgctggatctgccaagacatgaccaggaagaatttcatacccactagaatgcgcctttactgaatgtgagaggcccacatactggtacagggcaatgcccatggacatgtcattgcaaggtctgagcgcatctaagccttcagcccacatgcttaacacaattcagggtcattcgggactcgacacccagagatggaagtagggatggcaagcccggccgcaatgtagccagctggagcannnnnnnnnntgccttcagcccacatgcataacacaatacagggtcagtcgggactcgacacccagagatggaagtaaggatggccagcccggccgcaatgtagccagctggagcatacaggacgcttgtacctggctggagagcatagggctgggccagtaccgtaaacgcttcgtgcatcatgctgtggacggcaggctcctgctgggaatgacggcggcacacctcaaggtgctttggggagggttgctgggttgatgtagtgggtgctgcagtgacacagaggttgacgatggtcatcttacgcctattctgctgatccacgtcaacttggtatgtcaacccatggctcctgctaattccttcattacatgatatcgctgcaggaggacctggggatagggtcgctnnnnnnnnnnatctgctgatccacgtcaactggccatgtcaacccatggctcctgctaatcccttcattacatgatattgctgcaggaggacctggggatagggtcgctgggccatcgccacgccatcctccgtgcccgggacgagctcagggaaggagccctggccgaagcccgccccgcctcacccatcggcggccctgtccagcccgcggcagcctccagcctgatgagggtgcatgcccagcgtgccaggctggccagggcgcttgagagggcggttgcccgacaggcgcaccgggccgccacggcacagcacgctcagcacagcgtcgaactggcaagcgacgaggtgcgccggctggaggcgcggatcgctgccctggactgccagctggcggctggctctgtggggctgagcaagcaaggatcggcactgggcctggccgtcctgggacctggcatggacctggcagtcccgccgactggggaggtgggtgggctgagtgggcgtgggtcaaaggggggcctcagtggtgctgaattggtattgggaggggaatctgggaggcaacgatgtgaggttggacgagttctggtagaagcacaccactttcaaagccattctgctggagtgagcacccggcacaattggactggtgacgtttgagttggatttcgatgacctttgcatggcgcaannnnnnnnnnagccattctgctggagcgagcacccggcgcaattggactggtgacgtttgaattggatttcgatgacctttgcatggcgcaactcaccgagcattgcaggcactagattctttccgagctagtattgaactgctcccccccttcttcatgattctcttatactcagcaggaagtcaaggcgtgtctgacactgctnnnnnnnnnntttcttcataattctcttataatcggcaggaagtcaaggcgtgtctgacactgctgagccaggctgctgccgagaccagggacggcctgaaaccggaggtggagagcagcnnnnnnnnnnnnnnnnnnnnnnnnnnnnnnnnnnnnnnnnnnnnnnnnnnnnnnnnnnncctggcagctcccatcctggggagccgcgaagccatgaagctgtggcgagatctgggcctgatcaggtgtggtgagagtctgatcgagagtgtatacttgtgactggcagtgtggcaatgtgggcttcttttcctgccgcagcaggtgtactcgtggatctctgcccgtttaggagctgctcttcccccaagtccatgctcacatgcatgaacttgttctctttagtaccagcacaggcccttggcccccacagatcagcccatctcannnnnnnnnncctgggcctgatcaggtgtagtgagagtctgatccagagtgtatatttgtgactggcagtgtgacaatgtgggcttcttttcccgccgcagcaggtgtactcgtgggtctctgcccatttaggagctgctctccccccaagcccatgctcacatgcatgaatttgttctctttaataccagcacagacccttggcccccacagatcagcccatctcattccaatcccactcccccaaaaggtcggagctggaggcggtcgacccagtcctggcggctgcattggcaaacccctccccctcgcagcctctcttagctacgctgcgccgcgcagccgaggccctgcaccccccgctgccctccgccgcggtggtcgcggtggagcgatgcgaggccgcgcccgccgccgccgcccgcctgtcggatgcgctgcgctgtgcacgcttcgcaaggcggtattcaagcgacatgtcgcggcgcgcggcgcggcgtgcggcagccgtccagcgctggaaggaggacggcggggaggcggcggcagcggcggcggcagcccgcgacctcgccactgcccgggccatgctgtccgggctgggctggcccgccgttgaagtggaaagcgcggagggcagcgccgcagcccgccagcttgagcagcgggtggatgggctggtgcaggaggcgctgggcgccggcgagggccgggctatgtccctcgatgccggtgccgggcgtggggcgattgctggtggagcagcgcacgcggattccccctgggatgccctcctggatgannnnnnnnnntacctggcatctatgtactgagggacaagttacccgacccggcgctgagcgggccatcgccgcgaggggnnnnnnnnnntcgggctatgaccctcgatgccggtgccgggcgtggggcgaccgctggtggggcagcgcacgtggattccccctgggatgccctcctggatgacctggcggggtgccgacgcgacgagctgggcatggtcctccaggcctcagggccccataagatcctgctcctgtacaggtgcctagcagaggagagggggagtggggcacagggggagagctggggcacctggcatctacgtagtgggggacaagttacccgacgcggcgctgagcgggccatcgccgcgaggggcggcacagctccctcgcagatcacctgcctctcacacctcccccccttccaacctccaagcgccccacccactcaccacctcaccccgcacaggctgtccagggcgcagcgcttcgtgaggagcatgcgcgacgacatggcacagcgtgcgcagcgcgccgccgcgctgcaggcggagctctacgcccgggccccgcgcctgctcagcgccgaggagcaggaccgcttcgtgtcgcggctgatggacgacgcgcggcgcagggcccagaaccgggaagaaattgcggccaaggcggagctggagcggacccggccggcgtgggagggcctcaagggccggcaggccaagacgcccgtgcccctcaggcgaggctccaagcgcaggtgaagcgcctggtccgtcggccggggtggcagctggtcggctgagtgtggaggatcggcgactcgaaggtcctcgtgctgcaagccaggccgtcccccctccctctggtcaatggtgcatgctctgggctgcattacatgggacagtgccgcccctctaggaggcaggcaacctgcacggagcggcatgctttctgaacatggcagcaacagtgatgcatcagcggtgtacaacaggatggcagcgagctgatggggatggtacaggagcaagcgcatggcatcgctgccatggcaatgctggctggtgaggtgaaggacacgccgcccgctcttcagagcgggaagcatcatcatcgtacaggaatgcacacaatgggaagggggaatttgggggggaactctggagccaggtgacgatcgaacatgcagggcatgcgacgctactcctccgccaacccagggcccatggggtcgaggggaaaggggccgatctgccgctccgcatgctgctcgggctggatgcaagccccggaaagagatccctttgggctgcggcaccggctgttccatccccccccctccaccactccccactttgagcccgctcacgagnnnnnnnnnngtctgccgctccgcatgctgcttgggctggatgcaagccccgggaagagatcccttttggctgctgcaccggctgttccattcccccccctctaccactccccactttgagcccgctcacgaggcgaagacggccctgggctcggggtcgcgctcgtgctcggagcgcaggggctgcgccacgccgccggcacccgcgcgaaggccccgcgcctccagcgcggcggcaagggcgcccgcgccgcggcagacgtgcaccacggcctggtcggcgtcggcgtccacgaggacgccgtccacctccggctccggcgcgtcaaacatggcctccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccatgatggagcggaggccgcgcgcgccgacgccgcggccggccgcctcgcgggccaacgccgcgatgcccgctggcgtgaccgcgaatcccgcgcccgaggcggccagcatcctgtcgtactggcggacgagggcggagcgcggctcggtgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcggagacgacagggaagcggccgacgaactcggggatgaggccgtagtggatgaggtcgcgctgctccacggcggccagcgcggcggcggccgccgccgactggcccccatgccggccggcgccgtgggcgccctcgcgcgcgcgcacgtgcgcgccgaagccgatggaggcggcggccaggcgctcgccgatctggcggtccaggcccacgaaggcgccgccgcagatgaacagcacgtcgctggtgtcgatttgcaccgtgtcgccgcgcgggttcttgcgcccgcccttctccgggacgttgaccacgctgccctccagcatgcggaggagggcctgctggacgccctccccgctcacgtcacgagtcacggtcacgccctccgcgcgccgcgtgatcttgtcgacctcgtcgatgtacacgatgccggtctgggcggcggccacatcgtaccccgacgcctggtacagcttgtgcaggatgctctccacgtcctcgcccacgtaccccgcctgcgtcagcgtcgtggcgtcggccatggcgaagggcacgtcgaccagccgcgccagcgtccgcgccagcagcgtcttgccgcagcccgagggccccaggatgagcacgttggacttgtccagcnnnnnnnnnntaccagccgcgccagcgtccgcgccagcaacgtcttgccgcaacccgaggggcccaggatgagcacgttggacttgtccagctccacgtggtcggcggggagcggcggcggtggggggggcgcgttgaacgcggcccccgccgccgccccgcccaggtggcccggctccaggccggacaggctgcgcaggagcgcggcgcgggtgggcgcaccggggggtgtcatgccgtgcgcggggggcccctccccgccggggccgccgccgtgctcaggacggcgcaggaggttg

SEQ ID NO: 46504 - DNA, 61 bp, Chlorella protothecoides
tgggatgggagatgctctccctgctgccagaccctgcacacccctcacacctcctcgctgc

SEQ ID NO: 46505 - DNA, 61 bp, Chlorella protothecoides
ctgtaaccacgccgtggaccccagctgccttgcatgtaccaatcttgtcgctggaggatca

SEQ ID NO: 46506 - DNA, 10910 bp, Chlorella protothecoides
  modified_base (109)..(118): a, c, t, g, unknown or other
  modified_base (418)..(427): a, c, t, g, unknown or other
  modified_base (2545)..(2554): a, c, t, g, unknown or other
  modified_base (2607)..(2616): a, c, t, g, unknown or other
  modified_base (2739)..(2751): a, c, t, g, unknown or other
  modified_base (2954)..(2963): a, c, t, g, unknown or other
  modified_base (4525)..(4534): a, c, t, g, unknown or other
  modified_base (5092)..(5101): a, c, t, g, unknown or other
  modified_base (5355)..(5364): a, c, t, g, unknown or other
  modified_base (8857)..(8866): a, c, t, g, unknown or other
  modified_base (10118)..(10127): a, c, t, g, unknown or other
cgcgccgcgcgcgggcggcggccgccgccaccgccgccggtgccggcgacgcaccgggtccgagcaccacgaccctctccccctcgccatgcgcggtgtgcctggacgnnnnnnnnnncgccggtgccggcgacgcacggggtccaagcaccacggccctccccccctcgccatgcgcggtgtgcctggacgcggactgcgccatggtcttccccgcctgcgggcacctgtgtgtgtgcgaggggtgcggggcggggctgcggcgctgcccgctgtgccggacgggcgggacgccggtcaaggtgtacctgtcctgaacctcggcggggtttggcgtatggtgcaggggttgcgtagctgttccttgcgcggctccactacctcactcactgatgtgcagtccgccctgctgtacatnnnnnnnnnntgggtcgccggtcaaggtgtacctgtcctgaagctcggcggggtttggcatgtgatgcaggggttccatagctgttccctgcgcggctccaatacctcacgcactgatgtgcagtccgccctgctgtacattccaagccttattcagccagtggaatagaggggaaggagcacaggcactcctgtgccacccaatccagggcaccagaaggcatccccagcacgtgacatggtcgccccctcacgcaaggggggggggggcttggcccgatcgcacccacatatccccgcgctcctgcacgccgtcgcaataccctcccacgacattcccgcaatgtcgttcgccctgcgtgccctgcccgcccctgctgtcccacacgcgggtcgcaggcaggccttcggcactgtggtccccgctcgtccggcccggcccgcgccgtgccgtgcggccatggccacgcccgccgttgagcacaagccggaggaggtgggcatccacgacacccccctccgccccgacgcctcggggaggtatggcaagtttggaggcaagtacgtgccggagacgctcatcgtcgccctgacggagctggagcaggcgtacaaggaggccctcgccgacccgaccttcattgtgagcgaaatacaacgggaacttgttgttgtgcatgcccatggcgcaccatgcctggccggccgggttcacaggcccatgcatggcgagcttcatgggtcttggtgctcaggggacttgctcgtgccctgagcgtggaagccattcctccccccgccttcactccaccacaccccatcgcgattcctgataccttctaaaaccaaagccgcccctccccctccctcgtaggccgagctggaccaccttctgaagacgtatgtgggccgcccctctcccgtttaccacgcggagcggctgtcggagcactaccgccgccccgacggctccggccccgagatctggctgaagcgggaggacctgaaccacacgggcgcgcacaagatcaacaactcgctgggccaggcgctgctgtgccagcgcatgggcaagaagcgcgtgatcgcggagacgggcgctggccagcacggcgtggcgacggccacggtctgcgcccgcgcggggctgcagtgcgtggtctacatgggcaccaaggacatggagcgccagtcgctgaacgtgttccgcatgcgcctgctcggcgcggaggtgcggcccgtggcctctggcacgtgcacgctcaaggacgcgaccagcgaggccctgcgcgactgggtgaccaacgtggaggggtcgcactacatcctgggctcggtggcggggccccaccccttcccccagatcgtgcgcgacttccaggcggtcatcggccgcgagctgcgcgggcaggccgctgaggcctggggcgggctgccggacgtgctgctggcctgcgtcggcggcggcagcaacgccatgggcctcttccacgagttcgtgggcgacgcatccgtgcgcctcgtcggcgtggaggccgccgggcacgggctggccaccgacaagcacgcggcgacgctgacgctggggcgcgtgggcgtgctgcacggctccatgtcctacgtcatccaagacccggatggccagatcgtggacccccactccatctccgcggggctggactacccaggcgtgggcccggagcacgcctacctgcgcgacgcgggccgcgccgagtacgggtcggtgaccgacgcgcaggcgctggaggccttccagctcctgtcgcgcctggagggcatcatccccgccctggagtccagccacgcgctggcctacctggacacgctgtgtcccacgctggcccacggcacgcgcgtcgtggtcaactgcagcggccgtggagacaaagacgtgcagcaggtcatccagcacctggacctctgagggaccgggagagggcgaggggaggggtggaagcggaggatggggcctcaggggtggtgagcggtgcaaggggcgtggacggccctgtccccgccaggagttgggatgggtcaagcgcgtggggcggggggggggacgtcgctccatgcaacctagcccccagtgccacagccactgccgagnnnnnnnnnnaaccaccccccacccacccccctgccctgcatctttgctttgtttctgccagnnnnnnnnnngagcgcgtggggcaggggggggggacgtcgcttcatgcaatctagcccccagtgccacagccactgctgaggtaggaaaccctcacaaccagcactcctccttgaatctgcacacccgttacnnnnnnnnnnnnngcctctttcatgcacccccgctgcactgtatacgccgccggggaaggaaggacagttgcttgctctcttgaatttacagtcgggggtgcaacaaaatgtcgctgcaacaccggcagcgccactgaacaacaccgtcaaccccccattcaccgcgcgtcagccccgctgcaattccagggcctggatcttggcctgcacggccnnnnnnnnnnccgtggttgcaacaccgtcggcgccactgaacaacaccgtcaaccccgcattcgccgcgcatcagccccgttgcgactccagggcctggatcttggcctgcacggccgccagctgctgaccggcttccgccagcgcaccgcgcacctccgccaccacggccgtgggggccttgtcggcgaagccggggcgggccagtcgtgcctccagggccgccctttccttctccagtcgctcctgctgcttccgcagtcgggccagctccttgtccacgtcaaacaggccttgtttattgggcaggaggaggcggggggtggagaagggatcccacggcctcttgtgatcgcaggacagattgcccaagtttcagcggaagccaagccctgcgcgattctttgtggcgacactggactcccatacattcggcccccttcccacattccccgatcaaaatcctgacctgccatggggaggtccacctcgaggccatccgacaccaccagctggacgtggtctgaggagttgcagggcccctcaaaatcgcggaactccagctgcagcggggttgaggtggctggtcggtgatgggtactcgggggaaggcggcaggcaggggaggatgcgcacctcgtgtcgccctcattccgtgccaggatggtgctcagcacccacgcaaccaccactcaaccctggacgcccagtcaagaccgctcactgaacctgcaagcatgccgggcctggcccttgaggccgacacaagccagcttcatgcaacacactcaaacccagcagcaccccatctcgcacccctcacgcgcacctggccggggtctagccgggccagcagggcgatggccgcactttcctgctgcagggcggcgcgcagcgccgggtccccggcgcgcacggtggcggggattcgcctgccgggctccacgccatactccgcgcgagagttccgtaccgctcgtaccgcggcctggagagcggcaaaatgcgctgcggcgagatcgtcgcggtcggagccggaggtctcgggccaccggcccacgatcagcgcgggcgagtggattgcgggtgggaaggcggaccagagctcctcggtgatgaagggggtgaaggggtgcgccaggctgagcaaggaggtgtaggcgtacaccagcacctcccgagtctgagcgtggtggggcgagcatgaaggggggtgagagatgtgcagaggatatgagcatgccctgcatgcgatgccaagcacggcagcagccaccttcctcgcccagcctccttcacacgctccttgcctgcttcccacccccgtacccatcccaccttggcagccaggctggcatcggagctgtacagcctcgtcttggcgatctcgacataccagtcggcaaactcgctccacacaaactcgtacaggagccggcccgcctctccaaagtcatacctggcgtttggggaagaaagaactcagcacaccaacgctcgatgtgcagctcgattcagagcccacacaccagtgcacagtcatcacaaccccagactgacctctccagggcgnnnnnnnnnnaaacgctcgatgtgcagctcgattcagtgcccacacagcagtacacagtcgtcacaaccccagactgacctctccagggcggccgtcatggcagcggcggtgtcgtccagggccagtagcacccagcgctccgccaggcccagctccgcgcgggaggttggatcggcaaagttcacctcagcgagcgcggcccactccttgtccgacacctggtaattggtccacagggaggatagggaaaaggtggattgtggagggcagggcaactctacgggggagcacagagcacacaggctcctcgccagaaagagcatcaaccgcaatagagcaggccagtgcaccccatcctgccccccttccctctccctcagaaaacatgcacacacactcacacacacacacgcacctgggagatattgtgcagcacaaacttgcccgcgttccacagcttgttggtgaagtttcgggcatggttgactcggtccaaggacaggttgacgtcctggccaggggccgtgccggtgcagagcgtgaagcgcagcgcgtcggccccgtacnnnnnnnnnnatttcgggcgtggttgacccggtccaaggacagattgacatcctggccaggggccgtgccggtgcaaagcgtgaagcgcagcgcgtcggccccgtacttctcgcaggtctccactgggtccaccacgttgccaagcgacttgctcatcttgcgcccgacctcgtcacgcacctagggaggacggggggaagagagcgagtgcatgatgtgagcatggaagggtgtgtgtgagagggggaggtgggcattcagannnnnnnnnnagagaaaagggggaagagtgcgagtgcatgatgtgagcataaaagggagtgtgtgagagggggaggtgggcattcagaagggtgagatcacagcagaaccaatgtacccagcaagagaggcacacaatgatcatgctgtgcacagacatatctccccgaggcagagtgcatgtttagctgaatccatcaacttcaccccaccctcaccagcccatgcaggtagatggtgtggaaggggaccttgcccgtcagctccagccccatcatcaccatgcgcgccacccagaagaagaggatgtcgtgccccgtctccagcagcgcgccggggtaaaaccggcgcaggtcgggggagtcgccgggccagccgaagaccgacatggggaacaggccggaggagaaccaggtgtccagcacatcctcgtcctgggtcaggcgcagcgcacgccccgggaagcgcgccgcggccagttccagcgcctcggcctcgctggccgccaccacccagcgcgaggtgtcctcggagggcgcgcccggcgcgcccgcctcgtcgccctcccaggcgacgtagtaggcggggatgcggtgtccccaccagagctggcgcgagatgcaccagtcgcgcacgttctccagccacctgaaccaggtggcctcgaactcggcggggacaatgcgcacggccttggtgcgcacggcctcgcaggcggcggcggccatgcccgcacaggccacccaccactgcggcttcagcaccggctcgatgacgtcggaggagcgggagcagacgcccaggcgcatgggattgggcgccgcgccgcggaacaggccgcgcgccttcagccagtccacgatcgccacgcgcgcggcgaagcgcggcatgcccgcgaactcgccggtgccgtcgccgttcatcctgccgtcgtcgtccagcacgttgacaaactccaggccatgccgcttgccggtggcaaagtcgttggggtcgtgggcgggcgtgatcttgaccgcgcccgtgccaaaagccatgtccaccagctccgcgtcggccacgatgggcaggcggcggccgttcaccgggtggaccacgtgccgacccaccagcgcctggtaccgcgggtcctcggggtgcacagcaatggccgtgtccccaaacatggtctccgggcgggtggtggccaccaccacctccccctccccgccctccagcgggtaggcaaaggaggtgagcacgccaaactccacgcgctcggtgtagccgggcacggccagcatcgtcggcccggggacatccacgtagtccacctcgatgtcgctgactgcggtcttcagccggcagtcccagttgaccaggcggtggtcgcggtagatcaggccctgggcgtgcaggcgcaggaaggcctcctgcaccgcagcgctcagcttggcgtccatggtgaacacgcggcggtcccagtccaggctggcgcccagtcgccggcactggtacaggatgcggtcgccgtggcgcgcgacccagtcgtgcacgcggtcgaggaaggcggcgcggcccaggtcgtgccgggtctgccccgtctcccgcgccagctggcgctccaccaccgtctgcgtggcgatgccggcgtggtcggtgccgggcacccagcacacctcgtagccggacatgcgccgccagcggcacagcgtgtcctggatggccagggtcagcgcgtggccgatgtgcagcgaccccgtgacgtttgggggggggatgaccatggcaaaggggggcttgcaggagtcgctggacgcggcaaagtagcgagacgcctcccaccagtcgtaccttttcaggtcaggagaaggagtgggggagccatcggtcaaggcacacgggtgaaacgagggcgacgggagggcgaagatcgagggagcgcatggtgtgcatgcgagcctgcacccgcgtggtgcctgaacccggggccccagcacccagccgccccacaggatccaacacacccataccgacacgccatccaacgcaccagccggtctccacggccttggggtcgtagcccttgggcatcttgccaggcagctccttcttggagcccttgggggtcgtccgcgcctgctccagccatgccgccagctcagcggcctccacggcctggaaggaaggtgcgtcggggcctactctagagatgctgtataacactcagcccaagaccacctccctgccaagcagccgtccagtaccagaagcgttgcaggcgctgttgaagtccatgcaagatctcaccttcttggcctcggcctcctccttggccttggccctcctcgagctgccggctggagcgccctccgcagccttggctgcctctgcggctgcccggtccagcgccttttgcttcttggcctgcttttcggctgccttggcggcctattggtgcgatgattgaaagggtggatgggttggtggggctgaaggtgccatactatacaacctatactaaagattccagaactcgtgcatcctcgtctgccattcacacctggtgccagcaatagacagtccaaaatgccaaaagggtgtcccaatccctgacgcaccttcttggcggccttctcagggtccacaggacctgcagacgtagctgcctgcaccgcctctgcctccgtcattcttgcagattctgtgaggaggttcgtatggctgcgatgagattattcatcaggacctagttagagtacttccttcctgagacgaataggcttggagtcccaggacccccaatggagggagactccgaggtagcatacgaagacagtacaagctctgcagatatatacgcctcaataccagttacatatgtctgctcagggcattacagatcccgtctcagcaatgagatcgtgcaaggccgtcccaacacggtgcgcggagacagtgcagcccctttccctctccatggcgcacctctccaagaagcccaatgcgcagagggttgcaatcaggcacggtacggttctcgtccaaaagctccatatcgaggcctcgaagcgagtgatgggtgtgtgagtcgcagccgcgccttgcgactccaccccgcgctttcttacgagtcggagtgatggatagacctgtagtggacagcctcactcacagggactctgggctgcggcttgccgatactgcacatccaaaagcagattacacccgcatacattggcccaagtggtagcatggcgagcctgcgctctgcgggggcgttgcccaagctgggaagcacgcagtccacgtttcgtggcctgtctgcagccttccagcgagtcagcatctcgtcgcctccccagctgcggcaccagctcaacatcacaggtatcctccccgcacccggcctgctggcgaatgcatcggcgcggaatccacgctcggcctctcaccctgactgttcacccacccccatgccctttccctctccgcagcatcccgcgtctgtgacctcacgggcannnnnnnnnncgactgctcacccatccccatgccctttccctctccccagcatcccgcgtctgtgacctcacgggcaagaaggccaacaacgggtacaacgtgaccttctcccacaagcgcaatcggaagctgcaacagcccaacctgcaggacaagaaggtgtactggccggagggcaagcgctgggtgcggctgaagctatgcacaaaggccatcaagacgatagacaagaggggcctctctgtgatggccaaggaggcggggatcaacctgtggaagcttcccttcgaggatgcgcggccagagcgcacgtgaggcccgcctatttgtcgtgggctgcggtttggtgtgcaggtggcaacttcatgtcgcgcctctggcctgattgctttggagggtgcgatgattggcccctcgtgtccccatcgagtgatcctgggagtccgttcatcctgcagggagtggctggcgacgcatgagcacaacccccccatggccaaggacccaagaaagatgaagaaccccgagcgcctcgccgcctccaagtgagcaccagaaatcaggaggggagggcgtgtgtcacgttgcttgcgccggcctgctggcctcgctgcagggagagcatgctgctgcctcaggagtttgagagatcaaccccatcccaccatgcaggaaaacgccgctggtggcaaggtacctgtcgggcaaggttgtgtacatccgggaagggtccgacctgtcagagctctgacggggcggagttgcagatgtatctacccctgggatcctcgtgtccttgctgtaaataccttcttgatactgctagtgccaaggtccagccaggctgcaagggccatgcccaagggtcttcagcatgtgtacacaagccagtctgggggttgaaattgtctgtagcaaggggcagggggggttcaggcatcatgtgccggcaccagccagcacggcgtcagtgtacaccgcaaacatctgcgtttcggagaaggcggtcatgaaggctctgtccttggccggcaccgactcgatgaacgactcgcgcagcaggatgctgcgatgagtggaagaaggggggaatgtcggactgcgaggtgtcgctcaccaaggaggggggtgtccgggggcatgcaacgaagcaatgcagggtgggcagatttggggtgggtcaagctgatgcgcgaggagtggtgtgtgctgttccaagcgacgcaccccggacaattgagcatggaccgccgacaagccnnnnnnnnnnaaggaatggtgtgtgctgttccaagcgacgcaacccaggacaattgagcatggaccgccgacaagccgcacaacggcgcgcactggctcccctggtgcgggccgggacgatggaagcaggagcctcgctcccggtagccagcgattccctccccaatgccttcactgcttctttccaccacgtttccccatgactgtcccctcctcttcaccccacctcaatgaaacaccacattccctctccccacctagacacacaacccccccattcacctggtgcgctcctggctggcggagacgtcggtgatggtgtaggcgcggaggtcggacaccagggaacgcagataggtctgcaccgtggacaggaacacgcccgccagcgcggcctgcgcgtccgaaacctggtgggcggggcgcgcgcgtgcggcgggcgtgcgccccagcgcgctcagctcggcgtaggtccccgccagcgcctcggccagcgtggcgcgggagggcagtggcgccaggcgccccgcgttgctcacccggtccttgtagacgttgacgcggaccagggcgccgcagcgcgcccacacctcgggcgtcttgtactggatgccggccacgaagggcaccggcgcgtccagcaggtccaggcgggagcgggggtagggcatgacggggagcagcaggctctgccagccaaagggcaggaggagggggaccagggacagcaccaccgcactgagcaggcccaggttggggcagaacaccaccatctgcgtgtggggaagggggg

SEQ ID NO: 46507 - DNA, 77 bp, Chlorella protothecoides
cttacagccacggcgcccaaccgatgtacatgcgcgacaggttgtctgggtccatggcttcctgtagcaggcgctgc

SEQ ID NO: 46508 - DNA, 61 bp, Chlorella protothecoides
caggagcagtggtgagcatttatctcaggcactgcaggcggcagggtggctggggtctcag

SEQ ID NO: 46509 - DNA, 69 bp, Chlorella protothecoides
aggaggacctgccgccctcgcaacactcccaaccccatatcgctgcaccttgtccttggcggccttctc

SEQ ID NO: 46510 - DNA, 63 bp, Chlorella protothecoides
gccatcgtcctccgacaccaggccttgccacagcccgtcatgctccaccgcccgcccgcgggc

SEQ ID NO: 46511 - DNA, 74 bp, Chlorella protothecoides
tatattccatgatgccccatgcaaggatatattaacaccatgaatctgtccccgaacctgcatgctggggtgtg

SEQ ID NO: 46512 - DNA, 123 bp, Chlorella protothecoides
tgaaaaagcctcgaggtttatgtgggtcctcatcgcgtagttcgtgatcactcgtcagagtaggaggggtgtccaagccctaggagggtcactgggtggtggggcaatgcccgccgacctcag

SEQ ID NO: 46513 - DNA, 61 bp, Chlorella protothecoides
ctgggggcctgcgtgggcagacattggcggttgtgagaagaaagtagaggaggcaagcaac

SEQ ID NO: 46514 - DNA, 44705 bp, Chlorella protothecoides
  modified_base (1043)..(1052): a, c, t, g, unknown or other
  modified_base (2403)..(2412): a, c, t, g, unknown or other
  modified_base (2617)..(2626): a, c, t, g, unknown or other
  modified_base (3152)..(3161): a, c, t, g, unknown or other
  modified_base (3221)..(3408): a, c, t, g, unknown or other
  modified_base (3636)..(3645): a, c, t, g, unknown or other
  modified_base (4317)..(4326): a, c, t, g, unknown or other
  modified_base (4606)..(4615): a, c, t, g, unknown or other
  modified_base (6168)..(6177): a, c, t, g, unknown or other
  modified_base (6477)..(6486): a, c, t, g, unknown or other
  modified_base (6910)..(6919): a, c, t, g, unknown or other
  modified_base (7365)..(7374): a, c, t, g, unknown or other
  modified_base (8300)..(8309): a, c, t, g, unknown or other
  modified_base (9310)..(9319): a, c, t, g, unknown or other
  modified_base (11680)..(11689): a, c, t, g, unknown or other
  modified_base (12922)..(12931): a, c, t, g, unknown or other
  modified_base (13410)..(13419): a, c, t, g, unknown or other
  modified_base (15406)..(15415): a, c, t, g, unknown or other
  modified_base (15960)..(15969): a, c, t, g, unknown or other
  modified_base (16457)..(16466): a, c, t, g, unknown or other
  modified_base (16560)..(16569): a, c, t, g, unknown or other
  modified_base (16646)..(16655): a, c, t, g, unknown or other
  modified_base (17237)..(17246): a, c, t, g, unknown or other
  modified_base (17729)..(17738): a, c, t, g, unknown or other
  modified_base (18343)..(18352): a, c, t, g, unknown or other
  modified_base (19351)..(19360): a, c, t, g, unknown or other
  modified_base (20330)..(20339): a, c, t, g, unknown or other
  modified_base (20938)..(20947): a, c, t, g, unknown or other
  modified_base (22447)..(22456): a, c, t, g, unknown or other
  modified_base (22529)..(22538): a, c, t, g, unknown or other
  modified_base (22701)..(22710): a, c, t, g, unknown or other
  modified_base (23411)..(23420): a, c, t, g, unknown or other
  modified_base (23710)..(23719): a, c, t, g, unknown or other
  modified_base (24162)..(24289): a, c, t, g, unknown or other
  modified_base (24476)..(24485): a, c, t, g, unknown or other
  modified_base (24981)..(24990): a, c, t, g, unknown or other
  modified_base (25807)..(25816): a, c, t, g, unknown or other
  modified_base (27000)..(27009): a, c, t, g, unknown or other
  modified_base (28166)..(28175): a, c, t, g, unknown or other
  modified_base (28231)..(28240): a, c, t, g, unknown or other
  modified_base (28352)..(28361): a, c, t, g, unknown or other
  modified_base (28440)..(28449): a, c, t, g, unknown or other
  modified_base (28653)..(28662): a, c, t, g, unknown or other
  modified_base (29135)..(29144): a, c, t, g, unknown or other
  modified_base (29702)..(29711): a, c, t, g, unknown or other
  modified_base (30179)..(30212): a, c, t, g, unknown or other
  modified_base (31289)..(31298): a, c, t, g, unknown or other
  modified_base (34797)..(34806): a, c, t, g, unknown or other
  modified_base (35054)..(35063): a, c, t, g, unknown or other
  modified_base (35333)..(35342): a, c, t, g, unknown or other
  modified_base (36117)..(36126): a, c, t, g, unknown or other
  modified_base (36438)..(36447): a, c, t, g, unknown or other
  modified_base (36795)..(36804): a, c, t, g, unknown or other
  modified_base (37725)..(37734): a, c, t, g, unknown or other
  modified_base (38772)..(38781): a, c, t, g, unknown or other
  modified_base (39291)..(39300): a, c, t, g, unknown or other
  modified_base (39514)..(39523): a, c, t, g, unknown or other
  modified_base (40567)..(40632): a, c, t, g, unknown or other
  modified_base (41635)..(41644): a, c, t, g, unknown or other
  modified_base (42110)..(42119): a, c, t, g, unknown or other
  modified_base (42943)..(42952): a, c, t, g, unknown or other
  modified_base (43524)..(43533): a, c, t, g, unknown or other
  modified_base (44602)..(44611): a, c, t, g, unknown or other
gggggaggttcctgcacatacatacgtaaattttgcctgtctcggttgccacctccctagtcacctcgctgcacattgccctcctacctctgaagcccacccccccaaacccaccccccattcaccccactcactcagggtgcgcgtcggtatgggagcgaggagtcggacgccatcgactggatcatgcccccctcccgcagcatgaactccctgtccgacgtgggcatcagcgagatgtttgcctaccacgcggtgaccatggccaacaccatccgcaccagcctggtggtgttcagccgcaaaggccatatgcccgccctcctctcccactaccgccccgactaccccatctactgcttcaccgagaacgaggcggtgcagcgccggatggccctgctccatggcgtcaccgccatctacacccgcttctccgagaaggcggccgtcacctttgacgccgccatcgaggagctgaagcagcgcggctacgtcaagggcggccagctggtggccatcgtgcagagcgggcgccagcccatctggaggtcctcctccacccacagcatcgcggtgagggcggtgccccgcgacgtggtgcccgacgactccgacgaggaggaggaggagaaggccaaggccaaggccgccaaggtcgggcgggcgggggttaccccggccgtcctcacctgacggcagcgtctgcgccgctgtggatctggtgggagggggtggcaggctcacctccgcagccgagggcgtgcctgctgcacctggaagcccagtgtgtacaagaattgacatttggtgtgaggattgggaaatctagtgtcagccagggggccccacagaagggtgcgtccagagccgaggtcgcggaccgaagcataaacccttcccgcctcgcacatgtacccctcgagagtccgagtgcgggccatgcatcccacgaatacaggctgcaacaccttcatagagccacatccagccaaccagcaagtaaagttccgtacgcccacaggatgatgttcgccatgacgagnnnnnnnnnngccgaagtaaaaacccttcccgcctcgcgcatgtacccctcgagagtccgagtgcgggccatgcatcctacgaatacaggctgcaacaccttcatcaagccacatccagccaaccagcaagtataattccgtgcgcccacaggatgatgttcgccatgacgagcatggccaccgggtgtcccgcgacggcgaggtcggcctccagggcccccgcccatgccgggcctgccgctcgccatgcgccgcgcccgcagcgggtagggaggcccggtgctcccggcgcatcgaaatcactgcgatttgcgcgcacgcccatggcagcctcggtagataacgcccaagcgggggtgggcaagctcatcagcaaggtggagatcccggccttcatcccgcgccaggatatgatgaaccagctgttccggtgggcatccgacctggaggacaacgggtatgccctcatcggcagcccgtgcaaggtgtgagaggtatgggactccaagagctgcatttttgccaggtcccaaggtgctggcatcggtatacatgcagcatggggacagggaacgggattgtgcaacactcagtgccggtgaaggaatctgcaagccaagcgagtccttccacagtcacctcgctggcgtcgtgccataccctaggctcatgcccaacccccgttgccctgccccagatcaccccgctgatggaggacgagcaggtccggaacttcaccatcagcctactcaacagtggggtgtctgttgcggacatcctcatcgcattcgacgaagatgtggccgtgaagcacgagtggattggcatggggccgggtgagacgcggcgtgtgggggtgtccaagggagggtcccctgtggtggaattgggtgtctctctctggctgcggcatggcatgggcgcgtctctccatgcgcctgccccctctgcagctgggaaggtcgatgcaaacccgacgactgctcgcaatgtcagaggcatacccggcggcccactcgctccctccctcgcccatgcgtgcccgcagacaagttcccagtgcctgagggtaaggccaccgacgtgcatggcaagcacctggaggtgcgcaagaccgacaccaacagcgtgtctgacgctctgcgggccgccttgcacctgttgtgcgcgaatctggcggaggcggtgaacaaatactacgcctttggctcctgcttctcggaggatgccacctgatgcgggtgggtgcctgcgggagaccagttgctgttgaggttttatccctcggaatctttccgcctctgctgcctcatcctctgacccctctgaagaccgtcctgtgttcacgttttaatagccnnnnnnnnnntggacaccagttgctgtcgaagtttatatccctcggaatccttccgcctctgctgcctcaccctctgacccctctgcagaccgtcctgtgttcacgttttaatagccgtcaatggagtccttgtggcaatgagaagggcacggggcgtgtagagctgagcagcttgcctcatgggtcgtgcagcactgggcgcctgcccctctgnnnnnnnnnngcacggggcgcacagagctgagcagcttgtctcatgagtcgtgcagcactgggcgcctgcccctctgctacagtcagggcctccaggcccccgctgcctgctcagccccctcgcgctgcccgtaccacctgcttgaactcctcgtcgttgggctccagcacctggggcagattgggaggctggcgcaccgtgacgctcttgtgatagtgcacaaggccggcgcctcttctccttgtttgcaagctgcaacactgttacgcggtgccacgcatgctgcctcgcactgagaccccttcacccctccgatcacacccttcatccaagcccacaaacctggtcaatcaggttgtactccacggcctcgtacggcgtcatgtacctcggccgcttgatgttgctcgcagtctgctcctcgctgtgtcccgtgtgcttcgccagcaggcggacctgcgcggtgggccaaggtgttccatgaaacacagggcctgcggtctcgacagcagtggaactccacacattgcagctnnnnnnnnnnctgtttgcaggctgcaacgctgttacgcagtgccacgcatgctgcctcgcactgagaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcccatgaggcacagggcctgcggtcttgacagcagtggaactccacacattgcagctgccacacgcccccaccggccctgcctgcatgcccaatggcacgctccagcactggccggcggtggacaaccccccccctcggacagcatctcccttctcccccctcggctccccaccgccaagtcgaggtccacaccaggcacccaccacttcggcgttggtcttccgnnnnnnnnnncctcggctccccatcgccaactcgaggtccacaccagggcacccaccacttcggcgttggtcttccgcagctcggtgcggtaaatgtcaatgtctgtcgcctgcatctgctggaatcgctggatgggctgccggatcatgatgctggcggagggcagcgcggccctgcgcccgggctcccccgccgccagcagcatggccgcctcgccaaaggcgttgccgatggcgatcgtggccactggcggcttgatgtagcacatggtgtcgtagatggcaaaagcctcggcctcgtatcccagcttcccggcacctttctgttgtcatattggttagtgtgatgacgggatcagggccctggatggcccacgctgaaggcgccgagtcagaggacagcttccgaagattccgcaggactgactccggacacttgccctggcaatgcagcctgttccagggctgtcacacccccacaatgtgacaccctaccctcaccgctacgccggtcgagttgatgtacatgaagacgggggcggtcacactctcgtactgcaggtacaggagctctgccagcatgagctccgtcacttgcggcatgaggggcattccctgcgcggtgcgagggcaaagggtgtggattgggggtggtcggtttgatggacgatgcaagcaccannnnnnnnnnacggtgccagggcaaagggtgtggattgggcttggtcggtttgatggacgatgcaagcaccaggcccctccaccaccaagggtatgggcaggccactcaccaggtacacaattctctccttgaacaggtaggaggggaggtccgggggggtctgtgacgtggcatcgcctgagagttgagggatgacctggaggggccaaggaggggtgggtggatgagccgcgaggagcgggagcctccatgcggatgtgatgcatggcagagatgggcttctccctcnnnnnnnnnnaagccgcgaggagcgggagctgcatgcggatatgatgcatggcagagatgggcttctccctcgtgccgctccctgtcgcaccgcttgcacatccaatcgccccgctgctcgagcctggatccgctggacgcggcgtcccgctgtggtctggaatggcatcaatcggttttgctctttcagtcgctggacccggaaggggctcacaggcagcaccgccatggcagccatggcctcggggccacaggtttggctgcttcttccccttgatccacctcttttgtaagatatggagtatagacctttgatttccctcaatatctgcggacgagtagcgaatgtggtttaagacctcatcgtcgcggagaaacttggaaaggaggagcgtgcccggctttgctcgagccccaagtggctgtcagtgcaccaccaccaacgcgagtttcactgagaatgacgtgtctcagcattccattgcgtttcatgggagaaccatttgcatgcaggggcagatcacgctgcctgggctgcaaccactgggatccccagggcctccctcaggtccttgctcagcgcatgggggatggagtggaatacttgcatctcctctgtgcaagcctgagccagggatgcatccagcaccaagacctcctgcatgagcgatcacgggaggagctggatggagcatggtgtcagatctagcatggcggagtggccgccataccatcagcaacaaccagccagaatgaccacgcgtaccttgctctccaggttgaagcgcatgaagggctccctgttctcctgcaccagctctaccagatgctgcaagctgttgaccttcacatcattgaacttggccacctgccatgtgaagggttcaggagtgtggggagtgtgcacttgccatgcgactgcgacaaaggggcgcacatccttgaggatacgctgtgcaacactgccacagaagtgcacatatcagagctcttacctgggagttggagatgtcctcatatccgatggtagcctcgcatgccagaacctggttcagcatgacgacctgctgccctggtcgatccttgtgagtgtacagcagccggtccaggagtttgacgggggcttcccgcaggtagtcgggcccaaactcggatgccaggtacggctctgcagcaggttggtgcgagggagggggcatggatcgggcaggcagcccagccgcacgagcttcccgcgtcgcgctgcgtgctggggtcgatgccgaaccccaacgcccctcccatgcctcccacctgtgagattggtgaacaccagccccgccacgacaaagtaggatggatccttgttgaagagatggtgaggcacgaggaagtcgggcctcatcagcctgtggtggaacaaggccatggtgaggacgacctctgggcggcatggctgggccatgtgccagcaccacaggcaccctagcacaccgcgctgagcacccacaaacgccagacagggggtgtgcccagcaaggcagcaagggcagacccactgacttgatgcagaggtccagctcnnnnnnnnnntgggtatgcccggcaaggcagcgagggcaaacccactgacttgatgcagaggtccagctccttgccctctctcaacacccgcagggatgccacgtcaccagtgaacttctgggacgtgaggaagcctgcgcgggtggggttgaagcgcgcgattgccccatggcaacctgtggtccggctcgcacagaacagaagcgcctcatgcagcaacccttgcactgcgtagacccagagcacgtgggcttcccacccccagcaccctccagccggctgcctgctcactgtaagcgatgcgctcgnnnnnnnnnntgcgcgattgccccatggcaacctgtggcccggctcgaacagaacaacggcgcctcatgcagcaacccttggcattgcgtagacccagagcacgtgggctacccaccccccacacccttcagccagctgcctgctcactgtaagcgatgcgctcgttgctccggaaccccaccgtgccgtcgttggcaatctgtgtctggtcaaactgcatcagcacgtcccccggctgcagcacgccggcagcctcgctgaggggcagcacctcccgcaccaacacccccttctgtccaggggccatgccgtgggactgcctgcatggtggagggtggaggcatcagacgtatgcagtctctgcccagggtggcattcacctcgacgcggtattgcatgtcatgtgattctgaagcctgcatgctcgaggcannnnnnnnnnaggtggagggtggaggcatcagacgtacgcagtctcagcccagggtggcgttcacctcgacgcggtattgcatgtcgtgtgattctgaagcctgcatgctcgaggcagcaccccttcctccccacctcccaaatcacatgcctgagcgtcgcagactccatgcgctgccactggatgcccagggctgggaagccggtgaaggtgccatttcgttggtagtccaccaggaagtggtggatcactggggtggggatcacgtagctgtgcagggggaaggggtttgggtacatactggtgggcatgccatggaaggtaggggtgcaagaccagcaccttggagggcaggaagcagaggcggccaggattaccatccacactcgggtcctgcccactccctcccctcaggtgcccctggggggacagatgtggcccggccccaggcaggnnnnnnnnnnaaaggggattgggtacacactggtgggcatgccatggaaagcagggttgcaagaccagcaccatggagggcaggaagcagaggcggccaggagtaccatcctcactcggggtctgcccactccctcccctcaggtgccccttggggacagatgtggcccggccccaggcaggcagcatgggctcccatggcaccttggatcccagcatccagaagcccctacaccaagccccagcgcacccaatgttctccgcctcgctgccggcgtaggactggaaggccacgcccacgcactcgcccgcctcgttgaagaccgggcccccactgttgccgctgttgatggcggcgtcaatctgcacgcccaggagctcggtggcgccatgcgcatacgaggtgacctctatccgggacactacccccgaggtcaccgagatctgcaagggcgcttgaggggggcccgtggtgtcaatagttgcagggagagtgggctgcaggcaaccctttggttgttgcactgaagctctcataacaaggacaaaaagccatgtgccgaccctgaaacccacctcctcggaacccgttcccactcacagtgtctccacccacagggtaccccacgacaaagaccgaatcctggagctggggcaacggccccagcaccaccggctccacatccttccagaattccgggtcctccactgcgcgcagagagagggtttgtcagtggtaggagcgaaacggttgctgaaactgcagtgaacaggccagcgatgcacgcgcgcgtcttgcaggtcttcttctcagtgcactaggaattgcgtgcttcaacacatccatttccaacacaaacaagcactccattctccctccaaacctcgtcctcctggcacccccccggaccgacctgtgagcagcgcgatgtcgcannnnnnnnnnatcttcttctcagtgcgctaggaactgcgtgcttcaaaacatccattgccaacacaaacaagcactccattctccctccaaagcttggcctcctggcaaccccctggaccgacctgtgagcagcgcgatgtcgcactcggtgccgatggccaggaccttggccaggaacttgctgtcgtcgtcgcgccgcttgaccttgacctgcgtgcgtgacgggtgcccgctgggcgacggtgcctccgtgcttgctgcatgacgacaacactcacatcgattccaatccttagcagtgcccacgccatgcattcggggccacacatgccgtctctccgtttcaccccctcccccccccaaaccttgcctgggagtggttttccacggagtgcgcattggtcagcaggtacttgccgccgaagcggtcgccctccaacgcgatcacaaagccgctgctggtgctggaatattggcgcttgcgctgccagggcaggctcatgtccggctccgtgtggacgcagaagaccttgcacacggcgtccatcacattgatctgtgaatgttgtgtatggagaggggagtggaggggtcgcatgagcttgctgtgctgcgctcagacgcggccgtccagcagggtggacctgtgaaggcgccacagcaggtgggatccccggcggcggagcatgcaaccctgtgatacatacacgactggctgtcagcccagcctcccactcggctcagcttgtcactcaccgtctctaggccatctgctccctcaggcatgctggggacctcacccaggtacctcgcagccgtattgaggtggggatcatgcagcgcatggtagcccttgctgacaatgcctgcatgatgaggcatcgggggagcagctcccgagtcacggaccggagatgccaatctcacttaggaggcgcaaggcccaatcaccagcattcaaggatacaacctgggaacgcaccctcaacgtgaggtgcaggggctacctnnnnnnnnnnccatgcaggaggcgcaaggccccatcaccagcactcaaggatgcaacctgggatctcaccctcaacgtgaggtgcaggggctacctcctgcaccggttgggaggcgcctctgccagcctgctgccgcctgtccctgggctgggcgcatgccacccggactgaggcggtgcggggagggtgtgggggcctaccggagctgaaagccccaacgaccctcatgacggcgtgctgcgtatatgaatggagtcgaggagtgctctattgatctgaaagttgcattagtctggatcgggtccctcagcagtccaaaatcggctggagtcgcgctccgccgatgtgcggcccctacgccgaacggatcagggtgacgtatctaagttgggatacgcacaagacctcccattgactcgtgaagatttctggcagattttcgccacaagcgatgtccacctcaccgtcttcaagctgcatgggcacagcatgcgccgctgcaacctgctgcactccttgcgtttcggataacgaaggggggcgcagcatgcatttcccggtcgggatgcccgagagcccaaccttaccatacaaagcctggtgcgcggtacacgatctgatcacatcgttaatgaagacaagtggatgttttctcgtttttttctgctttgtctcgaccatcagccgatgtgcgatccaggggttccaatagagacggcaccctgccctgaggatcgattactactcactcaaccgtgaggatggcggtgtcgagcattcgcttgttcgacgctcactgccatctacaggtggatttgtctgcatcgcgagggtgaggtcgtgagaggaccctgttggccagcctcaccagcacttcccacccatcaccacgcaggacgctcgttttggcgcgggcgagttggacgacatcctgagcaggagcagggctgcaggggtcagccgcatggcggtgaatggctgctgcgtggaggattggccgctggtgcatgccatcgctgcggcccatggggaaatggtcgtcgccaactatggcctgcacccttggtgggtcggccggcagcccgaccactggcttgacctgctgcggcagcgcctgctggccaatcccggggctggcctcggggaggtgggtggttctggggtctgatggggtagtggcatgccttggttgcacatgtcgctccttgtctggtgtccaaggcacataagcacagccgccagggacattttgccctcacttttgcgggcttagacccccgccccccccaccccaccccatcacagtgtggcctggacaggagcaggagggcccccccttgcccctttgaggagcaggtctcggtgttcaaggcgcagctgctgctggcccaggagctgcagcgcccattgtctgtgcgcagcttgtcggttggagatgtggaggcaccaattcatgggaacctgtgtgaacacgcaaattagggtagagcttcctcgcacaatgtctgccaaagtactgccatgtgtgagtgtggggcacagtgtttgcagcgaccccttcaggtctcggtcagggcctcttccagcatgccaagcagctccatgcttgcagggatcttcgtggcacccctcctcccacccaccacaggtccactgcgtcagagcggtcggccacctgcgcgaggcgctggccgaggtgcgccccacggcgcctgtgctgctgcattcctggtgcggcgcagccgaggacgtgcgtgccatcgcctccgcacacccctccgccttcttctccgtatcgggcggtatatcagcgctgccccccgccaaggccatccgcacggtgagcgggacctctgctgtatttcctgatcagccatgttcacacccagccctcgcgctcactccctcatgacatcgcctctcccgccccgcctcccctcttcagctgcgcgccatccccgccgaccgcctgctgctggagaccgatgcccccgacggcggcctgcgactgggccctgcgtggctcgaggcgctgccaggatttgcacgctccgcgcccccttgcccggagcgccaggagcccgcggggctgaggcggatgctggccctcgtggctgccgcgcgaggcgagggcgaggtgggcctcgcagcgctgacctggcgcaacgcgtgcgccgtcttcgccgggcttcccgccgcccgctaggggattacggtgactgcatcgcgccgcggtctcagcctcccatctcctgcctcgcctcgggcgctcctgctcagccgggcttgccctgaccaagatccccggcgaccaccacgcctcagagtgaacctctgatgacagcctgaacctcctgctccacgcccttnnnnnnnnnngcggtgactgcatcgcgccgcggtctcggcctcccatcgcctgcctcgcctcgcgcgctcctgctccgccgggcttgcccccgaccaagatccccggcgaccaccgcgcctcagagtgaacccctgaagacagcctgaacctcctgctccacgcccttgactgccacccagctccgatgcaccggcccactcatacatcaagcttgtcggagtgttgacatgttggggcgttgagaaagtggacagaggagcggggcagcctgtttcaggcgctgagcggggggggcgggggcgcggcatcgcagcaccccacccctcccctcgtgaaacgaaatgggggacgggcaccatgcactgatcttgtatggttctcagggccagggacagggcattcggggccgggccggggcatggatggtgccctgggcccagcccggcccctgcctccatgggcaccagggtcgggttcctacctaagaatgtgtggggagcggaagggacagggaaacagcaacacaatgggggacacagacggaagggtacagggtggtgtgtgcctcgcagggttcctgggtcgcacggcgggaaccgcagcgcgcgcagaccgcgctccgagcccccccgcagcgggccacggcgaggtcgtgctgggcgggcgcgtggctggcggggtatcgagccggcccaccgcgcagcctcccctcccttctcagggagggggcctcctctccaaggggccgggcgccgcgcccgctcaggcggacgccccctccagcagcgaggaggggctggccagcttggccacctggcccagcttctcgctggagaacttcttgtacacggccgacagggaggcggccgacgccccggcgtgcagcgcggccagcatggcggcgcagggcctcacctctgcctcggtcagcttggcgtggcgggccagcgcggggggcaggccgggacccctgttcagggccgccttggccgcgtacagcgcggcgcaggccgtgacggagcccgggtgcttcagggcggcgtagttgggcagcgccagctccaccaggtaggtcgcatagttgaccagctcgctgcaaaagggggggggcaaggggatggaggctgttgatctggatattcggtaagggtcagcaaggagcacaggcgtgccaggctttcctcttcacctctcaaaacaccctgcatcgccccctccgccatcctccaactcacgtgtcnnnnnnnnnngtagttgaccagctcgctgcaaaaggggaggcccaaggggatggaggctgttgatctggatgttcggtaagggtcagcaagaagcacaggcgtgccaggctttcctcttcacacctttcaaaacgccctgcatcaccccctccgccatcctccaactcacgtgtcactggcggcgtccacgatcttgaggtagcgcgagaggaactggtgggccgtggggacggtgaggttaaagcgcagggtgttcagcatcaccttctccatctgcaggatctgctcgcgtgagtaggcgcggtctgagatgtagacaaagtcgcggacctccggggcccagatctcctcatacttggaagcgatgagcatggcggtgacgcccacctgtgggtcaaggcggtgtgaggggttttgcaaagagaccgccatggcgcactggtagacagacacggccgtgtgccaaccatgccgacacctggcatgtnnnnnnnnnngcaaggcggtgtgaggggggttgcaaggagaccgccatggcgcagtggtagacagacacggcagtgtgccaaccatgccgacacctggcatgttctgagaacatgcctgccccttgacaccccacgccttgtggaccggagtctcttccctccctccaccatcccccccccacacagtgccaggcagtcttcaccagctgcaggtgcttgcgggtaacttgcttggcctccaggaaacggtcaatcaggttcacagtgaggtacagtgtctcaggcatgagctgcgccgggcaatagatttgagagactggattccacaacactttctgcgtcagcacagagctcagagcgtttcaggcgcccaccctaccactctgtttcgttcccccactgaccttgaacttcaggtggacgtccaccagccagtcgatgaggatggcccgcatgcggtcgttcacatcgttctgtgggggtgccagaggttcagtgtgagcgagtcgatcccacagcaacctcatgtggtcaccatgctgctcacagagacacggaccgtgttcagcctccacacctgcttggacatgtagtcgctggccaccatgaactgcggctccacgccctggtagtagctgaatatatcctttgcatagtctgccaccgcgagggggtcggaggcggaggcggcatccacgtcctggggcgcggagggcctcgcgggctttgcgccggcagccgcgctgcggtcctgcagcagctggctcatgctgcggcccgggttggagcggggctcagtcccagcaggtgcggcggcgcccagggtggcatctcggggcctgaggctgttacgcggtttggcgccccagctgtcggtggagttggtctgtggaggggtggaaggggattggatgagggacaggaaagggcgatgcgagcgatcgataccacgtgcatcgcagtgtcgaataggctcgccaccccctcaccagagcgttactgccatccacagtgggtcccacagccgcgagctgggcggcagcgcggcgggtgagcacaccggggcggacctgtgcgcagtgccgggggatctggtcagggtaccgttcaatacttagcgcccagcaccgcacgcattgccaatatcattgttggtaaagtacatgaagaatgatcggctcagaaccctgccgcgagcctcgcgcggaggacttccaacggacgctcacctgtcccgacagaggtgctttagggtccactggtgccgcatccttgccaacgttcaccttctgatgaaaacctccgacaaggttgccgatgtcgccgagcgccctgcatcgccagcgccagtttgaagcatgtcagtacaccgaggcaagcggtttgagggtgccagcacctgctacagccaagcacgctgcccggcgtcatgaacaccctctgcgcatcttatcctacctccgagcaactgcctgagcggccagggagggcttcccgatctggaggtggctcttggcgtcgcggacgttcggcccgttctcggcatctgccgccttcgcaaactgcatcgtgccgccgcttgcctcacgaggacaggggaaagctcccgaacacactggacagtggatatagcaggcggatctggtgcgatcgtgccgggttattcccatcgacagccctgcgagttttgtgtgtcggcaggggtcaaagcccctgatggccccccggccccgccatgggagggggtcctcgcaccttgcatgggggagatggctgccctcctgtgacccggaacgcgtctctttgcgtctggattatccttggacagcaagcagctcaaatcagcgcactgtgcccctatgcgagggtgttccatcttccatggttgagatgttgcttcgtacagtactcgggcttggtggaagggtatccgccgggctgagcggcgagcatgacgccactgacccagttgttgccggggaaaaggctttgtgtnnnnnnnnnnggcagcctaaatcagcgcaatgtacccctatgcgagggtgttccatcttccatggttgagctgttgcttcgtacagtactcgggctgggtggaagggtatccgctgggctgagcggcgagcatgacgccactgaaccagttgttgccggggaaaaggctttgtgtgtccagcattctttcaagtaactcgcagtgcgcccttcatatctggttgtgcccagtggccatgcagcttacagcggcgggtgcgtgcagccacagactgtgcgacaatggacaacacaggggtctactttgcgaaggagtccttgagcgcacacgtgcgattgagaaccatggcatcatctctgctgtctgggtccacggtgaagtagccaagacgctccagctggaacctgcagtgacatttgagatcgcccggaatcagagcgggttccacagatgggtgcagcgccgcaatccacgcagcaccggccagtctgcatcgcatgcccgcacagcctgcgtgcaaactctcgcacctgtcgccgacgcgcgccgccgcnnnnnnnnnnggagcgggctccacagctgggtgcagcgccgcactccacgcagcaccggccggtctgcatcgcatgcccgcacagccggcgtgcaaaccctcgcacctgtcgccgacgcgcgccgccgcgagggcgggggtggccagcgccccatgcaccaccgccagcgagttggggttcagctcctccagccaagtctcgctcccccccggggactgggtggtgaagagggtgtcgtacagcctggcctcaaaggagggcggctccacccccggcttcggctgggccacccagttgagcacaccctgcgcccaggcggtgttggggaggggatgaagcgtgctgccccctcagtggtggaaagtgaggtaggatgccaacttctgtcgagtacaccagaacggtgcccctcacaccatgcagagggctgcctcccacaacacccgagtccggtcccaccttggggggcttcctgccctcgccccggaagtcgcgcnnnnnnnnnncgcccctcacaccaagcagagggctgcctcccacaacaccccgagcccggtcccaccttgggaggcttcctgccctcgccccggaagtcgcgcnnnnnnnnnntggtgttcgggaggggatgaagcgcactgcccctcattggtggaaggtgaggtaggatgccaacttctgtcgagtannnnnnnnnntcgtatgtggcctccagctcttccacctcgccgcctggccccttcttgacccccgtgcacgtgatggggtaggcgtacctggggagagggtggaccgacaggagtcagctggagcgcacgagacggcaggggaaatgactgcctggcaggagcaggcatgggcatccccaattcctcaccccaaggccattcaaccccaagctgccttccaggaatgtagcctttctctggactttctggatcccttgtcttgacttcccccccccaaccccttccccctccctccttccacctgagcatgatggtcttccctggcgccagcccgtaaaagtccttggagtcctgctcccggaagtccgtcgcctcgatgtacaccacccgcgtgaacggcaccgtgtacacccccccaccccgcccagggaagtcctggcgagggcagtgcagaggagaaggagaaaactggctcagggacgacctctggaacaagaaggatgccagtgtgggcccaggcaccgctagccatccatgctgttcctcctttcctcccctgaagccatgcccaacatgaattccaccccatcnnnnnnnnnnaaagtcctggcgaggagagtgtagaggagaacgagaaaactggctcaaggacgacctctggaacaagaaggatgccagttcgggctccaggcaccgctagccatacatgctgttcaacatttcctcccctgcagccatgcccaacatgaattccaccccatctgctcgcacctgggcctccacctcctcccaatgcccctccgccaggttggtgatggtgacgcgcagcgggcgcagcacggccagccgccgcgccgaggtggcgtccaggtcgatgcggatgtggtggtccagcttgtgcaggtacacctcgccctctgaacgggtgacccccatctcacgacagaagttgttgatggcctgccagtgtggtgatgatgatgggagggggggcgaccaaatggagagcttgcatgggcgagccgccacagcacggcgcggcggccacccgcggcccagcatgctgtggtcagaccccggcannnnnnnnnntggggcgatcaactggagagcttgcacaggcgagccgccacagcacggcgcggccaccacccgtggcccagcatgctgtggtcagaccccggcaagcctgcgtccacgctggcgcggtgagcccggagcagggccccgcgctcggtcagccgatgccatggcacccacccactccccgccctttcacacccctccagccccggccaccttgggggtaacgccccgccgtctgagcccagccagggtcaggagccgggggtcgtcccagccgttcacgtagcggtctgtcaccagccggttcagcttgcgcttgctcagcacgttgttggtgatgttcaggcgggagtactcccagaccacgggcttgtaggtgtccaggacctggtgcaggaggaggggggggggccatgggggttactctggtgcggatcggccatggccagtatcgcagcagcgtgtcgctgacagctctgcgggtaccgatcgacactcggacccggaccgcgccccgccaaccccacacaaggcccaggcccccctgaacctgggcccccggggcggcagccagccaagtacaacacgcacatccaggagccagtagtagnnnnnnnnnncatgggggttactctggtgcgggtcggccgtggccagtatcgcagcagcatgtcgctgacagccctgcgggtaccgatcgacactcggtcccggaccgcgccccgccaaccccacgcaaggcccaggcccccctggacttgggcccccggggcggcagccagccaagcacaacacgcacatccaggagccagtagtaggaggcgcggcgtgactcgaactccagcgtgcacagggagtgcgtgatgttctccagcgcgtccaccaggcagtgggtgtagtcgtaggaggggtagatgcaccaccggtcaccggcgtgggggtgctccgtgaacttgatgcggtacgcgatcaggtcaaacatgttgtagttgtcgttcctgtggtcctgcctcatcctgcatgtggccggatcttggtgatctgggggacgagctggaggccatggcgtgaggtcggtgggccagatggggatggggcccgaccaagccagaaatcaggggatcactgcaggcgagcagccgagtacagtggctgttcgaggtggcccagcgctgacgtcaggcgcacatgactgacatggcggcaggaaccacagcgcccttcccaggaggagaaggcaggggtggtgccagctccgtgacccgctgcatgtcgcaatcatccaggccacaccagaccaggccatcacccacccttccaccaagcaccgacctgagcgtggccttgccctcgtccactagaccccggcgcatgtcttcgaagagctgcagcgactcggcgatgggccggtccctccaggggctgggctcccgcttgtcccgcgacctgttggtttcatatttgacggtgtcggggggttcgcaaggatccagtggatgggcgcaacaggagtaggaacccacggaatgacgagcatacctcggcggccaattggcgtcggggcaaggcgctgccacacacaggtccaatgcaggccgttcctggatcgcctgtgagcnnnnnnnnnnctcccgcgacctgttggtttcatgtttgacggtgtccggggggtcgccaggatctagtggatgggcgcagcaggaggtggaacccacggaatgacaagcatacctcggcggccaattggcgttggggcaaggcgctgccacacgcatgtccgatgcaggccgttcctggatcgcctgtgagcatcgaccccagagccacaagtctcccccccccaggaaacgtactccttaatctcctcgccggtctggtggcagacgtaggcgttcccccccttgatcagctgcaccgccagctcgtacaggcgctcaaagtagtcggaggagtaggtgacccggtggggcgtccaccccatccacgcgatgatctcctggatgtggtcgatatactcccgcttctccgcctcgggattggtgtcgtcgaagcgcaggaagcagtcgccgccgcgcgcggcggccatgccaaagtccacgaacatcgccttggcatgcccgatgtgcaggtagccattgggctcgggaggaaagcgcgtgaccacgcgcccccccgtggcgcgcaggtgctccgccagccgctctgcggagttggagatgctgagctggctcccgtccgagaaggccacggtggtgtggcacttgttgttctcctcgggtcggggcaggaaggcgtacgggtcggcggtgcgccaggcctcctcctccgctgccgcggggccgggcttgccggccgccgccccgccctccgccttggcgggcttcttctcctgcgtgtgtcgtggatgggaggagcgcttggagagtcaggccccgtggacacgggcctttagcgcagagggtttcattggcacacccggcgcgaccccactcagggcggcgcagcgccgggcaccgagcgtgcccttgctccaggccctcaaccctcccgatgtagtctcccctcttcccccctcccccctccctcccagaccttgannnnnnnnnncagcgcttggagagtcaggccccatggacacgggccttgagcgcagagggtttcgttggcacacccggcgcgacccccctcagggcggcgcagcgccgggcaccgagcgtgccctcgctccaggccctcaaccctccggatgtagtcttccctctccccccctcccccctccctcccagaccttgatctttttctttctctccggcttcacgcagtccgcctcggtcttgggccccagcagcgcctccacctggcgctccagctccgccttggccgccgcgaggtccacccacttcagccccgcccggatctccgccagcagcacgttggtgttggcgtggtaccgctcctcctgcaggcgctgcgcgtgctgggcgagcgtgctcgccaccgccgccgagatctgctccggggtcacgaccacgcccacccccgccgcctcgtccagcgccccggcgtccagcggctccgaccccgtctgggcaaggaactccagcgcggcgtccagctgggcgttgctctgtggcagcaaaggagggcggcgtcggggtgggcgggccctgtgccttgcaagagagtcacatggacaggcctatacnnnnnnnnnntaggaaaggagggcggcgtcggggtgggtgggccctgtgccctgcaagagagtcacatggacaggcctatacatttccgacaggtgcatgttcgcaccatcccacccaggcccgacgcgccttcagcttgtcggacgtaatgtactccagcagcgtcttgcgatgcaccagcgcgttcccagggtactgcaggggggtgaggacgcagggtgagggggcttggagccgctggagaccttgctgctggcgtccagcgtaccgccagtgctaagccaaagcgcgatcttgatcccttggcacccctcccatcaccttgctggctacggtgtaaagcagagcgccctgctgcttggtgcaccccgactcgacgcctgcttcgcgcacggtctgcaccagggcctgcctgaacttgacattcttgatcgcccctctgcaggtaatggaggaaggctgccctgacatgatgattggagagcgatgggtcaggagtcccgtcacccaatcgatataattcaggctcacgctagagttccaggcgcgagctggatggcctcgaagaggcgagtggcctccgcctcctgctcctcgcgggtctgcgtcgccatgaccaagggtgttgagggacttgtaaagaggtgaaaccagactacccacccccaataaaactttacggctctggatggtgcgatcttggtccagtcggatctgccatgcggcaagcggacccaatactgtgccctcgggccatgctgggcggtggtcgacgacagcacccccagcatgcacttccggaatttggatcagcaaagcccgggccgggacattggcaacgcattccgtaatgaagtcaaccatattgcaaggccgcgggattgacattattacaactcctggcactctgcccaattgatcaggcccttgtctgctcctcgcaccgatatgtcctttaaactcgctgtcagcgctcgtgacggcaggaccatcctccccaaaggggagaagtacataagccttgctgataaggtgaacctcgctcattggttgcttatattcaggaggatttcaagggtggccactgcgtgatccaccgtctgcattgcccaccccaggatgccacggtggccgatctgaagcgcggcattgccgacagccgtcccgagctgtatacggcgcggcagcggctcaccactgtcgcagagaagggaaagaagggcaccgtcctggaagatggaaagaagctagcggagtacgggctgaccaatggggacaccgtcgtcttcaaggaccttgggccgcaggtcggtgattccaatcaagccccttgatcccgcaatgattcatggagggcccggggacagttggcgggagcaccgagctcacccaagttgtgtgaccccctttccactgcagatcgcgtaccgcgctgtgttcttctgggagtactttgggccgctggtggtctactccctcttcttcttcttcccctacctgttttacaannnnnnnnnngggcgggagcaccgagctcacccaagctgtgtggcccccttcccactgcagatcgcgtaccgcgctgtgttcnnnnnnnnnnccgcaccaggcaagccatccggggccccaggggtggggcaaggggccttaccgcagacggaaatgcatgcaattcttggtgcgacggcaaactccccatgatggcatgcagttcccctgagtgtagtgaatcccccctcccccgcccccctgcagcatcccgnnnnnnnnnntcgcaccaggcaagccttccagggacccagggtgggccaaggggccttaccgcagacagaaatgcatgcaattcttggtgcgacggcaaactccccaggacggcatgcggtttccctgtatgtagtaaatccccctcccccgcccccctgcagcatcccggaggagcatggctttgcccagaaggccgcactcaccttctgggttgcgcactacgccaagcgcatcgcagagacgttcctggtgcacaggtggggcatgcatgcaggaggacatgtacggaaattgtgccattgtggtctgttcggtcggctggctcccttgaagttgggctttacccttgcctggtgtactgtcaatcctgcaactggctgctgttgatccttctatccggacaatgacgtcctgcatgcccctgcacgccgcagttttgggcatgccaccatgccgatccgcaacctgatcaagaactgctcctactattggggctttgcggccttcatcgcctacttcatcaaccacccgctctacaccccgccatccaccctccaaaccgtgctggccctggctgccgccttcacctgcacgctatcgaacctgaggtttgtggggttattgggcgcctggtggggtggatcatgttccgacgcacaaccagggcaatccgctcacttcacccctgcggaactgttgtgtgtgatcnnnnnnnnnnacatgttccgacgcacgaccagggcaatccgctcgtttcacccctgcggaactgttgtgtgtgatccaccaacccggacatgatcagcaggcatgattctggggcatggtcagatgcatccaggtgccgagcgagaccctcctgtctagccagcactgaaggaatctttgtgcgggtgcccccctcctccacattccgtctccctgtgcaaccatacaggtgccacttgatcttggcagacctccggtcccccggacgcggcgggtactccatcccacgtgggttcctgnnnnnnnnnngtacaggtgccacttgatcctggcagacctccgatcccccggacgtggcgggtactccatcccacgtgggttcctgtttgattacataacctgcgccaactacaccgctgaaatctggtcgtggctgttcttctccctcgccacccagagcctgccggcactcgtcttcaccctggctggagcagggcagatggcggtgtgggcggcgggcaagcaccagaggctgaggaaggtgagttgcagcgtaatgtgggatggggggacctggtccagcgcagaggcgcctcacatgcggtaccgcggctggtgccttgcgtggaagtccgtgcagctcgacagaaggaaccaggaggcaggcaccgatcggcccgcatggcgccatggtagcttgcgcctctgcagctgcatgtttcactcatccttgcctcccattcctggcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctttacgaaaatatgggtcagagaacttgcatgtctgttcattcatgagtagagctccacagtgcaagctgccgcgaatctagctgcgcaccagcgcgcgagtgtttggaactctgtcgtgaagggcaatgttttgggtggtcgacacatacaatagaccgctgtcgcccctgagttggcacttgnnnnnnnnnngggaggcaggcaccgatcggcccgcatggcgtcatggtagcttgcgtctctgcagctgcatgttgcactcatccttgcctcccattcctggcacagctgttcgatggcaaggagggccgcgagaagtaccccaagcgctacatcatgttccctcctctcttctgatgcacgttctgtcatgattctttacgaaaatgtgggtcagagaacttgcatgtctgtccattcatgagtagagctccacagttcaagctgccgagaatctagctgcgcaccagcgcgcgagtgtgtggaactctgtcgtgaagggcaatgttttttgggtggtcgacacatagaacagaccgctgtcgcccctgagttggcacttgagcatttatacttggagtaagcattgagcagcgggggctggtgaagcctgtcgccttcagcgtccgggactcagtgggaggctttaaacttccagtgatctgggagcctggctgcctgatcagtnnnnnnnnnnccgggggctggtgaagcctgtggcttgcagcgtccgggactcggtgggaggctttaaacttcttgtgatctgggagcctggctgcctgatcagtgcaagcccgccctagccgatacgaggagcccttgataacccaggcatcgtccggctgcggggatgggtctcaccctctctcgcatcgggtcggacccatactacgcaaactacgaaaagagtctggcacgaatccaaaaggatgtcatcaagctgaaggtgggaaggcgtgtaaagtccgttctggcgaccacattgtcagcctggatggaccaaacagtctgtgccatcacaatgctgtcgagggccgtggggttccacctcttcccggtgaattgtgtcccctctcccaccaccccctcatcgcaggcccagctcgaggcccggcgtgccgtgagtgcacacatccgttctcgctttcttggcggctttgcggccgtgtatgtggtcatcctggcctacgccgcctgggtggcacgcgccccgcccgccacatacacataccggcagcacctcacgtgtgtggcgcctgccatgtatgccccgcccgcggcctggcttctctaccgcctcctgagcgcgatactccaagccctggactcctactctgcacggaaagtggctctcctggactccaagctgcggaaaatggtcgcggaactcaaggtgtggggggctggatgttgaggagaatttgcaatgccaagagtatgtagggagagatgagaaacccacaggaagcatctgtggcgtgtgagcgacaccctgtgcgtctggggagtgnnnnnnnnnnggaatttgcaatgccaagggtatgcagggagagatgagaaacccgcaggaagcatgtgtggcgagtgagcgacaccctgtgcgtctggggagtgcagctcccaagcatcgctctggcgtgcactggcgtcccgcttcccactcgccgacctcttgtgctgcctgatcccacacaggagtcctcgcggtatgaacgcactctggccctgctcaagaagtatgaccccgagtacaagccgcccctgcctacgcctgcgccaaggcctgctgccccagcgggcagggcgcccggggtccaggggccacggccccccccgcagcctcagccggcggcggggcccaaggtcgtaccggccctcacgcaactctggacacgcgccgccgacaggctcataggtatgtgcgcaggctggagagtcgtactgacgaagcggtgctcaatagcccttatacaggcgggcactgccatggatctgaaggtgcaacagagggtgatgcgctgagaacccgcacgttctcccggccacctccatgaccacctccagggcccattcaccgaccgcacccccccctttctttggcagcggacgacccggtggcgctgcgcctgctgcaggaagcgcaacgcgaggccgccgagctgcgcgccgcgctcgtggcgtcggagacagagacgctgcgcctccaggcccagaatcggcacctgctcacggaattgggggtggacatgggttctgacgtgacaggccaccagccccagccagcagaggccggggtggtagaaggccacgccatgcctgctggaggtgagccggcggtggcggccggtgagacagcgttagatacagtcgcagcgtccgggaacggaaagacgggggcggcaggcagctgtgatccgacactcaaggagcccgtcacggaacgacccaggtcccctgcgcggaaacgcctggtctagtcctgaagcggggcagtggcttgagttgttgcctgtatggcctgcggcgcgaggggtgtcctgttccgcttcctgaggctctgcaccacctgccagcgcacaaatcatccgacagggtaccacctgcggatgttctcgtctgcctgtgctgagcacgccagtgctcacactaaacacccaatctgcaggctggacgtgtgcatggatgtgtacactggtctcaaggnnnnnnnnnnacgaggggtgtactgttccagttcctgaggctctgcaccacctgccagtgcacaaatcatccgacagtgtacaacctgcggatgttctcgtctgcctatgctgagcacgccagtgctcacaataaacacccaatctgcaggctggacttgtgcatggatgtgtacactggtctcaaggcttgcagcacaggggcacaggtggccgagcatcatgatcaggctcgggatgggcgtcttttcgagcagcaccagggacatcttctgccgccctggacggacggcagcctcctcatgtacacccatccccgtccttcccccgccgcctcacacacggcagaaggggtgtgccaggagggtggaggtcagcacctcccccgacagcatctcccccaggaggtgccaccccgccccttcgccctccgccaggaaggccgtcgcctcgccccagtccggctcgtgctcgcagtactgcctgttggttagttggtgggcggacggggcgcgtgaggctgttgcgtggtgactgcctcagatgggattggaacggtcaagacccaccgttccagagagcgctcccaccctgggaccacacaggcgtcgaggccttggaacccaacccccatggtccctgacctgaagaggctgagatcatatcggtaaacagtgcctagcacacgacgcagcgcatcgccgtgcgtccccgcgcccggccctgccgccgacagcccgcccagcaccgcctcgagcaggaccaacgcggcggactgcaggtcggcggccatgccctggcgaagtgggctgtccgccagccccgcctgggtgtccagcatgtcctcgaaggagccggctgtgtaggaggagggggaaggggggggggttgatagggaaggggggggttgataggggaagggggggttgatatgggaagggggggggttgataggggaggggaccttgtagtggagttggtggaggggtgtgagcgggagaaaagagcggtcaagccaggcagcacagggtatcaggtcttgtcaaacaacagacggcggagcagacatatcacccctataaaagtgatcggtgcaagcacggagcctcaccggtgctggcgccgtcggggaggggacagaagacgcggcgggcgaagcccaggttgnnnnnnnnnntgagccggagcctagcgaaccgtgcaccacgccgcgcacgtggcagtagcacagcnnnnnnnnnntccagcttgaccaccaggcgctcggcatgggtgtcgtcgaatgaggaaagcaggaccgaaccggagcccagcgaaccgtgaaccacgccgcgcacgtggcagtagcacagcnnnnnnnnnntggtgcaagcacggagcatcaccggtgccggcgccgtcggggagggggcagaagacgcggcgggcgaagcccaggttgnnnnnnnnnnaatggccctgggtgtgagggaggggggggaaagagaagggggttcttgtttggggaatggaatgtctgatgcgtatttaccatttgtgtcgagacgatgcaggactcaacagcacttactcggttctttgaggcagtgtgccacgttgcaaatgctctgtaaccacgcctctaatcacaccaggcccccacccgccctcgccannnnnnnnnngatggccctgggtgtgagggaggggggggaagagaagggggtgcttgtttggggaatggaatgtctgatgcttatttatcatttgtgtcgagacgatgcgggactcaacagcactcgctcggttctttgaggcagtgtgccaggttgcaagtgctctgtacccacgcctctgatcacaccaggcccccacccgccctcgccacagcctcacctcagcatgcgcttgcgggtgtgggaggcgccggcgccctccccccagcgcctccccagccccagcccgctggtctgctgctgggcggggtaatgcgtgagcggggccaagccatcccacttggtgaccaccctgtgtgggaggggtgaatcgagcaggggggcggcatttgctgcattgcgctgccctacaggccgagcggatgatgccgagggacgatgatggacccctccagccacaaccaccatccaggcacatgccnnnnnnnnnnttacattgcgctgccctacaggccgagcgggtgatgccgagaggcgatgatgaccccctccagccacaaccaccacccaggcacatgccatgatcaaacgcccgcccttgtctcgacccaccagatggtgttctctggatgcgcaaggatggcggccggctccaggcgccgcgcgctgtcgctgtgcccggcgaggaagtagcccagcagttcgaccaccggggggttggcgctgagcgaggaggaggccgccctgaacttctcatgcgcgtgggggaggccggtgagcgccctcagcacctgcagctcgttgaaggcaactgcccgggccgcggggaggtacctgtgcattggggaaggggggggggtgatagttggatgggtacctagtggagctggcatgctgtaggctctgaaattgagacactgctgcaaggcatcgacacaagcatggcttgcgatcgcaggctcatcacaacaccgtgctggcggctctcctgtttactcaattccgctggtgcaccaacccttaatactcatcctttctgcatccccccnnnnnnnnnntagtggggggattggtacctggtggagctggcatgctgtaggctctgacattgagacactgctgcaaggcatcgacacaagcatggcttgcgatcgcatgctcatcacatcactttgctgacggctctcctgtttactcgattcccctggtgcaccacccttaaaactcatcctttctgcatctccccccccctttactccccaccacatcctgctcactccttgagcatgaccatcaccgggtcctcaaagggcatgccggagcggtaggcagccgtgtagccaatcacggcgacgctgcgtgccgtgttgtggtgcagggcatgctgctgcggctcctccccgcccggcgacgtctccacctggggcggacagaggggttcttgcgtcagggggaggccctttgcagatggtgatggccctggagtcctgaataactcagcccccccccccccccccccccccccnnnnnnnnnnnnnnnnnnnnnnnnnnnnnnnnnngaccccagacctgctggatgctgatctggcccagctcctggagcagctcgaagtcggaggcgtggaagccgccagggcccacgctggcacggatgctggactcggtgatgtgggcctcgtcgcccgcgggggtcagcaggaagcccatgttggagatggcgcgctggcgcccagtgccctgccctccctgcggctcggcgggggctccggcgcgcattctgccggcgtgggcagacagcttggacaccaggtcgtctatgtccacggaggaggaggagggcagggacgcctgctcatcatcatcatcgtcaggcccgggaccccggacctgaccggctgcacggccccgcagcctgcgacaccgctcggttggcggggcggggaaggggcggcgtgtggccagtgaggctggccgaaacagcgcagggctgcatgtcgagagatcctgcccatgcatggctgcaacagtcgggctcccaaactcagccacccggctgttccatgacacaacgatgccgcgacggaacgcacagatcttgggcgcaaaatgtgtaatgtagtcgacgacgacgcctcgtccgcagtcgagtgcgaatcggggccatgctccccccatgcctcggcatggggggacccgtcgcgtgctgaggatcgcctcgtcatgggtggctgctggctcagactgcttgatcttcccaactgcacgttcgtcagccccgacaccttggtatgaacgcccattgtcggactgtaatgttcggtcattgcattgcacattcacaatggccggagtcagtgcccacgtttgaaagagggcagatcctgccccggtgctgcccgccgctctttctggctttcgccggcaacaaagccccgagcctccctccgccgctgcgctgaggcgctctcgtctgggcgtggtgcgctctcagtcttggcctcgtgcccgagcccgagctcgcgcaggtcctgctttgccatgaggtccctgttgtggaagaagaggcagtgaagtgactcgaacaagtgtaccgtgcgaaccctcgggataggccccagagcgccagggtgttcctnnnnnnnnnnggtggaacaagaggcaatgaagtgactcgagcaagtgtaccgtgcgaaccctctggataggccccagagcgccagggtgttcctcaaggtccaccctcggcccacctgtccatccggcattgcaggtactcctcagcgagggattggcaagcccgggtttcatccctattgctcctcaggcatgccatgtacttctccttcacctgcgagcaggtggcgcatgcatcaatgtaaggggtcatggcacagagcatggagtcgacggccattccccactgcaccgaatcctacctctttgcactccccaaagtggtccagggggaagacacccttctctggtggcttgggcttcaagcctcgactgcctccaaaagcacccccgctcgacattcagccacaatgaaaagctgtttggtattcaggactcgcgtgcaggggaattgagttaaatcaggggctacatgtggccatgcttgtcaagtatgcaacaaggagtgctcatccccagcacgttaccgtagcatgaagaatgaacgattcaaagtgatccataaactcgcataagaagtaggtttggagagcgtggcaatcacgagtggaggccaggaacaggggttgacgtcgactggaagcgtgcaccgcaagtccgggactttgtcgggagcgcgcggaaacatgatcgccggatcgttgtgcatgggaagatagtcttgtcagacaaactgatcatggtcaactatcagtcgagttgagatatctgacgttcgcccggcttggctgtgagagagacatcgcagcgggtgatcggttgagcgacccaacttcacctctacagctcactgagcctgagggagcatcaggaggctgcagaatcactccataaactccatggtgtagacaagtgtgggatccgagcaggttcctgtgcctctgccagacatggagtctcattgggaccccttcgctaccaacgcgtcaactgtacacgagcccacctctgtgagcaacgatgagctctacctcagctggttccagaccgccgacacaggtgagggggctgtggtcggggaccccatctcagtctctgtatgtcgtgcagatcaggcattcgtgatgcctgcaccttgggttgttgtgggagcctgttccacctaacaaccctccaccgtacccaaatcccgattcccagacggcgacgggaggctcaccggccctgatgcagtgacctttttccagcgcagcggtctgcagagggatgctctggccaaagtgtgggcggcggcagactacagtcgccgtggcttcctggacctgcccgcctttgccaaggcgatggagctcatctcggtggcacagaggacgggcaaggtcggaggcgaggcatatacccaggcaaaagccatgggcgtggccccaccgcgcatggcggggctggaaaagaaagcgggtcccggctcgcacacggagcgaggcgggatcaatccctttggcggcgcagagagctctgtgagtaggtcggggagagtgcgaggctgtgaggattttgctgagctgcttaggagatgtggagggccttggttgggatgtagattcctgtgtcatcgtcgcctgctgtcctgcacaagatttccagtttcagcccccaccctaaccatgccaggagagcaccccacgtctggcttcgtcgccccccgtgggtgtcccgcccttcaagctggctttcccaccgcaagccgaggcgagcagtcatcccagcaccgcccggacaacgtcacgccggcatcagtcgctgcgacggccggtgatgaccaccaaggaggcggtgggcatctctgaaggcctgaagaacatctacttcaacaaggtgtgggggagggaaggtgatgggaatggggcaagcctgtgtgtgtgtgtgtgtgtgtgtgtgtatgtgtgtaaggtagatgcctaccatgcccgggcccagtgtcttgtcatcgttggcacctgcttctctggggttgtcgtcagctacaaaccagcatgagtcgacgctgggaggagccctcacccatgctccgccccccaccctctaagatccgcccgctggaggacggctacaagtttggccacttcttctcccccctcctctccgcgggcgactttgaagccaagccctccgtcctgctgctcggtcagtactccacgggcaagtccacctttatcaagttcctgctggggcgcgactacccaggcatccacatcgggcccgagcccaccaccgatcgcttcgtcgtggtgatgcatgggccggaggagaggaggacgccagggaacaccctcgtggtgcagcccgacaagccgtacacagtgagtccttgggaaggggggggagccctgcaatcagaccctggggtgcatgtcctgtttgaccagaccctggggtgtccagtaggcctgatttcattggacagagcaagcctgccacaggaccagggtcgtgaaccttggccccatgtggtcccagcgttccaggatcgggatgcttcacaaaccacgcaagccttccattcatgccaccaaaacaaccgcggtccactcactgtacaccacagggcctgtcccagtttggcaatgggttcctgtccaagtttgagtccgcccagtgcgacaaccgtctgctggaggaaatctcgctggtggacaccccaggtgcggatctggggcctgggcatgcgctgcgccaggcgcagtacgtgagcagggaggagtcgtgctgcggccctgcttgcgagcttgtcggcaagaatcttctcagcgagggcgcccagccatgcctgagatgcatgctgaggatggccctccacctcgtccacgccccaccacatcacacctccctgcacgcaggcgtgttgtctggcgagaagcagcgcatagagcgcacctacgacttcatccaggtctgcggctggtttgctgcgcgctgcgacctcatcctcctgctattcgacccctacaagctggacatctccgacgagttcaaggaggtgtgtggggaggagggaccctgggggtcgcccatgagtcggaggcttggcgatcaacgggagtggggctcacaggacacgcagctggccaacagccagagccagtctggaatgtatcatggagcaagcacgctgtgcacagtggtgtgttgatgcacaggggccatggcatggctgcccccgtttcgcacaccctctgacccctcacacccttgcccacccccctttcctccctcaggtgatcagcacgctgcgtgggcacgatgacaaggtgcgcatcgtgctgaacaaggccgacagcgtggaccagcagcagctgatgcgggtgtacggcgcactcatgtggtccctgggcaaggtcttccgctcgccggaggtgtgccgcgtgtacattggctctttcaacgcctccaaccccattcgggacgacgtgaaccccacttgcaagcccctcttcgagaaggagcaggagnnnnnnnnnnttgtggggaggagggaccatggggtttgcctatgagttggaggcttggcaatcaatgggagtgggcctcacaggacacgccgctggccaacagccagagccactctggaatgtatcatggagcaagtacgctgtgcaaagtggttggttgatgcacagggccatggcatggctgcccccttttcgcacaccctctgacctctcacacccttgccattccccctttcctccctcaggtgatcagcacgnnnnnnnnnncggctccttcaacgcctccaaccccatccgggacgacgtgaaccccacctgcaagcccctcttcgagaaggagcaggaggtgaggatctggtgggtgttcttttcgaggagtgggggagatgtgaggtcgggggggggtggctacatcctgtgtagcctggccagacagcatccatgtgccagacaacgccttgccagccgcctctgccgtaattgtctcagcatgatgcgcatccgcacctcccagcatgccccaaccccgcgacctcnnnnnnnnnnggggggagatctgaggtcggggggggtggctacatcctgtggcgcctggccagacagcacccacgtgccaggcaacgcctcgccagccgcctctgccgtaagtgtcgcagcatggtgcgcgtccgcccctcccagcatgccccaaccccgcgacctcatcgccaaccctccaggacctgctgcacgacctttacgacatccccgcgcgctcctgcgaccgtaaggtgaacgaattcgtcaagcgcgtgcgggcggccaagatccactgcctcatcatgggccacctgcgcaagcagatgccctacttcgggcagaagaaggcccaggagaagctgatggacaatctggcaaatgagttccggcaggtgcagcgggagtaccacctccacgcaggcaaggccggggtcggatggggcggggtggagtcggggttgactggtgggagaggggtacattggggggggggaagggtgtgggtggggcgggacaggccaagacaaggcgatgcctgcggcaatgtgcaaattgaatagggattacgatcctgcatctggatccaacaccccgccgacgccatcgccaatgttgttcaccccgccgacgcaggcgacttccctgacgtgaatcggtaccgggacatcctgtccgcctttgacatttccaaattccccaagctggacaagagcatgatcaagcaggtgagcatgcgccgatggggtggcagcagcgattcatcgaggggaggacgtgttggcgtcctttttgagcgcagggnnnnnnnnnnagcagcagtgattcattgaggggatgacgtgttggcgtcctttttgagcgcagggccctgcatcacttactagaggcgtcccaatggctccctgccctccccctcaacctctggcagatcgacgactcgctctccatagacatcccccagctggtccggcagatggacaacccctatgtctgagagctggcgcctgtagctcgtgctccttgcccaggaaagcagtccgcccccgttgcgtggcgagtgtgctgcacttgtaatcaccccttgcgagcccgaaccagctggcgccgagacggtgagatgccnnnnnnnnnnctgcacttgtaattaccccttgcgagccgaaaccagctggcgccgagacggtgagatgccctcctccgatctggtgatccctgtccccaatgtccagagcacaccttgtttacatgtggccaaatgggtcatcacccggcaaagcatacccaatgggactgctcagggcccaagcacacacaagcaaaggcatgcatgtgcatgggggggcaggtttggactgcaccaacttcaagaaggcagggtccattggcctcctacggcctcatgtccgcgctctcttgtacctccccccctttcctgcctggcgcaccgcctgcctgttcttggacttgtagtccagggtcnnnnnnnnnncacggcctcacgtccgcactctcttgtacttccccccctttcctgcctggcgcaccgcttgcctgttcttggacttgtagtccagggtccaggcctccttgttcactctccaagtcgcctccaccatcgcaagcggctcgctgcgaaagaaggtggcaccggcggggaaggcggcggccagccagtcgggcacgctgtcccgctcggtcacttgcgccgcggcagggcgggggctgccgggtttgtcacacacagcacctgacgcttcggagtcgctgctgcccgagtcgccactcgccgcgctgccctcgctgccactcgccccgctgccctcgctgccactcgcctcgctactctcgctgccactcgcctcgctactctcgctgccactcgccgctcctgccctcctgctcccgtcgagaacctcgccgccaggcgtcctttcctgcgtgctggtgtgcatctcctcctcatcactgctgctgctctcggccccggtcgacggctcctcgtcgctgctgccgctgctgcagtcctctgagccggacgacgaattccctggggccgccccatccagctgcggaatggtgcgcttcggccatggccccgggccgtcctcatcgctgctggcacccccaaacctgccgaggtctcggacgctgcggccggcaggctccaggtctccaccgtcctccaggaaactgaccaccccgggcagctgcacggggtgcggtggcttcggcagggcggggttgcccactcgctcaaaaccccgagggcccctccctctcggctgcgcgccaacaggcgtgcgcctcttgggggctggcgccgcctgctcctgggtgtccgggtccctggagcccgaccccacctcctcgcccgccaggaactcggcaagctcgctcgctccgctgctgnnnnnnnnnnccgcagtggcttcggcagggcggggttgcccacctgcttaaaaccctgagggcccctccctctcggctgcgcgccaacaggcatgcggctcttgggggccggcgccgcctgctcatgggtgtccgggtccctggagcctgaccccacctcctcggccgccagaaactcggcaagctcgctcgctccgctgctgtcagaggccgagggcaggaggtccgcgggatcaaagggcatcctttcctcctcgtcgctgctccccgcaaacttgtccagcaaggcatgcacgtttgtgacttgcggcgcagctgccttgggagaagcggcggatgggacagcctgggcggcaggtccagttgcagcagcagcaggcccagctgccgcagcagccacccttgccttcttgggggccggcttcctggcgccagcctgtcgtggtgcgtcgcgggcctccagccaagccgtcagcgccgatgcgcgtgcctctgcacgatcaaagacagcaggcatcagcatgaaggctgataaggcattgccatgccttcaagcagtcacccatgcccacctctcccactcgccttcctcggtctcctgcggggcaggggcctgccgaagaggagccaggtgtgcaaccttggccaggtgtgcctcgaacgtgtagtttgcgccagcagggacgggcaagggagcccacgaggaggctgctcgcagctcagcagcgcctggcgatgcatcctcaccctccagggcccggtgggatccattcccagcgcttgctatcgtcacaacctccccatacgtctggcccttgagccgtagcactgctgggctctcgggttccagctcctctgcgcctgatggatccacagatgcctgtgcggagtacaatggtagttggggcagggtttctcttggccctatccagcaaggaaagtcttgctccacacagctagacccctggacaactgcaccagctccttgacactctcgtgctcccgacacccctccctacatcggcttcgaacagcttcacctcatcgnnnnnnnnnncccagcaaggaaagtcttgctccacccagctagacccctggaaaactgcaccagctccttgacattctcgtgctaccaacacccctcccaacatcggcttcgaacagcttcacctcatcgctctgcatcatacggagtcgttcgcggtagtctggacaggctggtgcacaccggaggacgccccctcgccacttgcagccattgtacactgccaggcaattggccagggcagccgggtccttgggagtcagggtgacgtaggcgagccccctatggaactcaacactgtcatacaccttgggcgctatcatctcgcagctcagcacggacccaaaggggtggaatcgggcctccagttccgatggggtcacccccggcgccaagccactgacacagagccggacagggtccaccatggactcaaatgtatatttgtgtataatacatgtatatgactcgtttgaattgccttgcgtgctcagtttcggatgagctcagtccgtctcgccnnnnnnnnnnattgtgtataacacatgtatatggctcgtttgaattgccttgcgtgcacagtttcggatgagctcagtccgtctcgccgccaaggcgcgaccttgcgccctatcgctctcggattcgtaccagcgatgggcacatggaaatagcgtccttccaatcgaaatagccgatgcaagggggaattcatacaaccagatatactccatgccgaagctgnnnnnnnnnntagcggtgggcacacggaaatagcgtccttccaatcaaaaataaccgatgcaaggtggaattcgtacaaccagatatactccatgccgaagctgaggctgctgcaaagtttggaagggcatgacgacagggtgtggcacgtcgcgtggtcgcctacaggtataaggtgttgatcggccttctcgacactctaggccgtgctgcgcaatttccataactctcaccaaccactccaatctccaggggacacgctggccagctgcagcggtgacaaaaccgttcgcatctggcgccggtcccagccaggttccgacacctggcactgcaccgccatccttgaggacgtgcactcccgcaccatccgctcctgctgctggtcacccactggctctcatctggcgacagccagcttcgatcgcacggttgcaatctgggaggtcaaggtaggggtggggcagtggactggggtttgggtgcggcgcccactcactcccagatctgcttccctggccactgcaccgctcctggcacacacctggctgcacagggcgcggtctgggagatgaccaccctgctggagggccacgagagcgaggtcaaggacgtggcttggagtccagacggcgggctgctggccacctgctcccgggacaagacggtctgggtctgggagtctgcgcccggcgacgagtacgaggtgctggacgtcaagcatggacacacccaggcgagtcccctggcgcaaagctggtgggatgccaggggtggagatggaaccccaactgtctaatgtgcatccctcgtgccacactggagcaccctgcaggacgtgaagaccgtgcgctggcaccccggcggcgaggtcctggtgtctgccagctacgacgacagcatgaagctctgggtcggggaggacgacgagtgggtctgcgcacagactctgtcaggtgcgggggtggtggatgggagggcgctcagacgaatggttcacacgcctgcccaccaataccagcctgcagctgccccttgcttgccaacgccgcannnnnnnnnnnnnnnnnnnnnnnnnnnnnnnnnnnnnnnnnnnnnnnnnnnnnnnnnnnnnnnnnnccgggcatcggtcacaactcgacggtctgggatttgagctttgagagcaccgggaagttcatggtgtcctgcagcgatgaccgcacgctcaagatctgggcctgcaagtctgcatcgcgccaaggcaggttctagattggggtctgccttgggacggggagtgagtgtgctcagcaaggtggattcagctccaccatgtgcgtccagggagacatgctgtgcctggagcacccgcggtcaggccggtgactggtatacagtggctctgatggaaccgcctgctcgccctggacctctcacagacgggccccggtggcagctggccaccaccctgcgaggcgatcactcccgcaccatcttttcggtcgactggtcgcgctgcgcgccgctgatcgcgagcgggggagctgacaacagcatttgcatacatggggtgggtgaggctgcaagcgccagcccacctcaagccgacgcgaatgccatgccatcgccacctgggagtgattccgggccgggatccggccctagcctggcgcctggcctgaaggtgaggagcctgttcatgcctgagcatgggttccaggcgccgccggtggaaaagctggcggtgacgctgtcgcataaagaggctgcggcgcacgcgagcgacaccaactgcgtgcgctggcacccgacgatacccggcctgctggcttcggcgggggacgatggcattctcaagctctggcagtatgaccaggaggctgaagacgatgcctcataactgcattgccacggcctggctgcaggcgacgccccctcctgcaacacctagcccgggcagtgcctctcggtattaaaccatgatctgcatgcaagctcagagcttaggatgcgaccagggtcacgggttctcaacaggggtcacgggcgtgagcggggagggcatgcagggcatctccgatacgcagcctaaccaggctgaagtccgcagcctcgcatgcggcttgcagagccggcaggnnnnnnnnnngtctcaacaggggtcgcgggcgtgagcggggagggcatgcagggcgtctccgatacgcagcctgaccaggctgaagtccgcggcctcgcatgcggcttgcagagccggcaggtgctcgatgtaccccgactcctccctgaaacatagcgccacgcagccgccgctccccgccaggctggcctcagcgcggcagctccttgccagcttcaccatggccaatgtgcggcgaccaatcgcctcgtcgccatacagccgccgccgggcctcgaagctgcggtgcatcaggtccggcagcgcggcggcgccgatgcgcccccgcaatgccccccagccctcctgtgcgcattcggctacagcatccattcccgccctgcgcggcgcgagtgtgcacgtcggtcacccctgccctccaagtccgtcagagagtgcattcagagcgcccccgcacctgactgcacggtctccnnnnnnnnnncgctacagcatccattcccgccctgcgtggcgcgagtgtgcacgtcggtcgcccctgccctccaagtccgtcagaaagtgcattcaaagcgcccccgcacctgactgcacggtctcctgcgagccagcgctccttgatgagtgcatggacctgtccgctggtcttcccggtgggatggttgtcgatgatgaggaacaggggcggcaggtgcgctgtggcagggtaggtgggtggaaggtgagggacttgactattgcctggtcgccgtgcaacacgcagtgctggcgtgcgttatgttgacggtcagcagacctgtcattcccacgaatcccagcaagctggcctcgatgccctgataataaggcatccccacctgggtcgatcgccaggtacacgccctggccagacgaggacaattcactaaagtccatgtacacacagccgccaaaggtctggacgaccctgtcctgcaggccggcggcgattccaagggaagtctccactgcgagcgccagcgagggcaggtcgaaggcactgatcccgtcctccacgctgtgcgcttctatgaggcagcgcagcgtcgccagcaccagggctgacgaccccgagagccccgcttggcgagggatgttggtggtgtaggatagcgcaaaggtgatgggcgggagggggatgccggcggcatcgcagtgctgctggaactggtggcatgctgcctgtggttcccgggttggaagggagggggtgacgtggggcagttcacctgggcaacgctgcttccaccccccaggaatgctcattgatgcgcatgatcgggccaaatnnnnnnnnnnagggtggaagggagggggggacgtggggcagctcacctgggcaacgctgcttccaacccccaggactgctcattgatgcgcatgatcgggccaaatgctcaccatgaggagccgcactcctccattgcagccataccctgccgcatggtgggacagctgtgctacgctgccaaaggaggttgggtcgtgatccggggagggcagaatgtcgatgcgtggactgggggaggccgtcacttccgcccagaagttggccaccgacactgcgatgactgcgccctggaagccatcgctggggttgccaagcagccccgcccgagcatgcactcggtgcgtgacgggtgccttcagaggcggcatgggggggggactggggcgatactcacggaaataaatccatgccggcctatggtcacatatgtcaatggtatctcagacaatctcgcgctgagagttgtcatccgagctctgtcaactctccgggcatgctaacaccggaccggagttccactcaaacaaacatctggcgcacggctcacatcaactccaggtggcttgcaggcctccttgtnnnnnnnnnngtttccgggcatgctaaaaccggaccggagtcccactcaaacaaacatctggcgcccggctcacagcaactccaggtggcttgcaggcctccttgtgcccatcctgtccctagcttcccggcttctatgcatgattgctcgtattctgaatttcatggcaacgtacggggtgcaggtcggcaagcccagccagacacccgctgctgtgctcagagcagcatggacgcggggttctccaggtaccccttgaaggcctgcagccactgcgcgcccagcgcgccgtccacaacgcggtggtcgcaggagagcgtggcctggaggaactgcgcctcctcgaacccgcccgcagcgccgcgcacgacgcgcggctcggccgcgcccaccgccaagatgcaggcctggggcgggttgatgatggcggagaactggctgacgccgtacatgcccaggtttgagatggtaaaggtcccgcccgtgaactcctctggccgcagcttgccctccttggccttgcccgccagccgcctcacgtcggccgcaatggctgccaggcccttggcgtcggcatcccgcacgatgggaaccatgaggcccgccggggtctgcaccgcaatggagatgtcgacatcgtggtactgccggatgtagtccgcgtgccagctggcgttgaccgcagggaagcggcgcagcgccagcgcggaggccttcaccacaaagtcgttgacggacagcttgccgccgtcggccttggccaggtcggcgttcagccgcgcgcgcagcgcggccagctcgtccacgcgcacgctgtcgttcgtttttgggggagggggaggacacagatttattcgattataaacagctgggcctgggacgtgtcatgccgggccggagtggggagggtgtggccgtgaagattgctgtgttaccaaacccatgcctggccttgtggcagcatccccatgtctaacaagttgaggaccaagacagccccagaggaatatggcccaggatctcaaggcagccacagcctcacttcccatcccaccttctcccccccccaccccccacnnnnnnnnnnagttttggggggagggggaggacacagatttattcaattataaacagctgggcctggggcgtgccatgccgggccggagtggggagggtgtggc

SEQ ID NO: 46515 - DNA, 22619 bp, Chlorella protothecoides
  modified_base (736)..(745): a, c, t, g, unknown or other
  modified_base (1245)..(1254): a, c, t, g, unknown or other
  modified_base (1543)..(1552): a, c, t, g, unknown or other
  modified_base (1655)..(1664): a, c, t, g, unknown or other
  modified_base (2440)..(2449): a, c, t, g, unknown or other
  modified_base (3184)..(3193): a, c, t, g, unknown or other
  modified_base (3671)..(3680): a, c, t, g, unknown or other
  modified_base (4258)..(4267): a, c, t, g, unknown or other
  modified_base (4804)..(4813): a, c, t, g, unknown or other
  modified_base (5184)..(5193): a, c, t, g, unknown or other
  modified_base (5665)..(5674): a, c, t, g, unknown or other
  modified_base (5739)..(5748): a, c, t, g, unknown or other
  modified_base (5875)..(5884): a, c, t, g, unknown or other
  modified_base (8599)..(8608): a, c, t, g, unknown or other
  modified_base (9175)..(9184): a, c, t, g, unknown or other
  modified_base (10306)..(10315): a, c, t, g, unknown or other
  modified_base (12435)..(12444): a, c, t, g, unknown or other
  modified_base (15376)..(15385): a, c, t, g, unknown or other
  modified_base (16754)..(16763): a, c, t, g, unknown or other
  modified_base (17184)..(17193): a, c, t, g, unknown or other
  modified_base (17631)..(17640): a, c, t, g, unknown or other
  modified_base (18928)..(18937): a, c, t, g, unknown or other
  modified_base (19604)..(19691): a, c, t, g, unknown or other
  modified_base (19858)..(19867): a, c, t, g, unknown or other
  modified_base (20534)..(20543): a, c, t, g, unknown or other
  modified_base (21184)..(21193): a, c, t, g, unknown or other
  modified_base (21436)..(21445): a, c, t, g, unknown or other
  modified_base (22213)..(22222): a, c, t, g, unknown or other
ttgcactgccttacccccccacccccccccccccaacacacacgaaccactccccccttttccccctccacccccccacccacctggatgctgccctccttggtgcgccaggccttgtcctccacaccctgaagcagggcgggcatgactaatcgcacgccctgcgccgacagctggcccatgatggtcctggctgccgcggaggctgcctcgcgcactgcggcggaggagtctccaaagcaggacaggaggctgggcagggtggagacgacatatggctcaaacaggcgccccagcttctccgacaggcactcgtacgccagcagggcgcctgggttggttgggggggcaggggtggtcacgattcattatggggggtcggggtcgttcagggatttgggacctttgctggtaatgcacatcatacttcatagggagcatcctgtaccacgcactccccccgctttccacaaccccaccccaccccaacgcaccttccttgccgtcggcgccgcccttatcctggacggcggccttgagcgtgtccagcacaccaaagttcttcaggcacccgatgccaagacccttgaccacacccgccagcccaaaggcggcgccgcgcctgaaacggtgcgatgatgatgcaggttctgagctgggtactcggggtttctcatgatcctccaagaaagctgtggccaccaagaatgccaccatggccgccacaacactccannnnnnnnnnctctcatgatcctccaagaaacctgtgaccaccaggaatgccaccatggccgccacaacactccatcgaaacccccgtccccaggcagcccagaccttgtgacctagacatacgcacctctcgccgtagctgcgggccttgaggcagctgcccagcagctgcttggtcacgccctcgacatacgtccggtcctgctgcaggacctgcatgaggggcggcaggcagtcggagacacggcgctgcacggcctctgagggggtgttgagcacctgcagcagggtgcccacgatgtcccggatctgcaagtgtgtggttggtttgaggaggggttgaagaacagggggcctcagagcaggcaatggggaggcacagagggcgtcttcagtatcatggcgtcgcgcatctcgtctgttgccacacatttggggcactcatgtgccctccttaaacccgacaaccatcgcaatcgtggggtaccttgggattctcggccggcaggnnnnnnnnnnctcagtgtcatggcgtcgcgcgtctcgtctgttgccacacatttgggcattcatgtgccctccttaaccccgaaatccagcgcaatcatggggtaccttgggattctcggccggcaggtgccgcgcaagggtacccagcagcaccaccacgccctgtcgcatgtagtcagactgctcctctgacagccccggcgactacggtggtgaaagatgggtgaacgggttggggcggcatggcaggtacatggcagctcaaaagcatggctgcccggttggctggagagccgtnnnnnnnnnngcgcatgggcacagggatgctgcactcacgtgcacagccccacacatctgcctccccgtgcccatccccaagccagaagcctccgcaccttgcgcgccagcgnnnnnnnnnnctggggcggcatggcaggtgcatggcaactcaggtgcatggctgcccggttggctggagagccgtgccagcacaccaccccacaaggtggaacctcgtcaccaaggcgaggcagagcgcttctccctggtcacatggaaacgcatgggcgatgggatgccgcatggccttgagtgcacagccccacacatctccctccccatgcccatccccaacccagaagcctccgcaccttgcgcgccagcgtctcctcaaacaggggcaacatggtcgcggccgcgtgctttccgtgcgcgttgaccagggcaacccctgccaggacgacggcgccctgcacggccgggacgggttccaggaggccacgagaaagcaggaagtccagggcctggggcagctcggccacggtcagctgcggcgcgatggcctccagcccagacacggcgcctgaggggtggggggagatgggtgtgatggggatgacaggaagccggtgtgggctggcgagaagtttcgagagggggtgcaagaggagaggtccgctcccaaaggcactgcgccaagaccaagtaccagccctactgcgccccccgggacggcatgccggccaacctcccacccacaaaacaacccagagcacaagatacccacctaggcgtgcggcctcaggggccgcgccgtcccggccatacagccccaagcatgcctgcatggcctccggcgcggcggcggggcactccagcaaccctgcggccagagcggcggccgcggctgcgcgcnnnnnnnnnncacaacccagagcacaagatacccacccaggcgtgcggcctcgggggccgcgccgtcccggccatacaggcccaggcacgcctgcatggcctctggcgcggcggcggggcactccagcagccccgcggccagagcggcggccgcggctgcgcgcacctcgccctcgcgcgacggcaggtaatcgcggacgatcgccctgacgaaccccgcgggcaggctggcacccagcaggtcccagagcgccagcgccgcggcggcgttgcgctcctcgccgtcgctgcgggcgacccacagcgcgcagagcgtgggctcgtcgcgcgcgccgccgtcagcgatcgccggcacgtcgcgcagcgcacgcagcgcggcgccgcgcgtggccgcgcgcgcggagcgcaaacccgccagcgccgcgctcatcgcgtccccgtcgtccggagagagggaggcgcacagcgtgcacagcagaggctgcacccgctcgcgcatgacgggcagcacctccagcgtgcggtacagcagggccagggtgtccgacggggacaagcctgtgctggcccccacatgcagacccagcacgtccagggcgatgccgtgcaggggcgtggcctcgcccgcgctgcggcagaggatgtttttttggggggggcggggattttaacattcgagactttgccatagggatggagctgaggccgaggggcatcatcccctggacatcaggagaacgcttcnnnnnnnnnnggggggggcggggatttcaacattcgagactttgccatggggatggagctgaggccgagggggatcatcccctggacatcaggagaacgcttcatttgcaacccgattcgcatttcaaaccaacccctcccccaccagtcacctgagcacggctcgcaggatgggaaagcagaagcgggcagaggggcccggcagcggcgtgtccccagggcgggcttcggcgtcctcggaggccggctcgccgcccgtggcgcgctgcagcgctgccagcgcagcgccaaagcagggctggctcagcaggggctggtagtctggggttgcagactgcaagaggggcggtggggtgggatagcgcactgaaagcctgaccatgtgggcgacagcagcaggaagcgactgcatgtgctctgctgcgtcgatgcatcctggccatgaactgggaggtgcacaggatgcacgtccgtcttgcgctacgtcnnnnnnnnnntgactgcatgtgctctgctgcgtcaatgcatcctggacatgaactgggagatgtacaggatgcacgtccgtcttgcgctacgtccgccgccatcgtcgtgctgggggcatgcacgcatgcgccctaggccctccatgctccccatgccaccccaaccagagcacccaccagctcagcgtaagccaccaggcgccggcaggcagccacgtcgccgcccatgcgcccaagcccagcgggcagtgcgtgcgccatggaagaaagcgcgtccatggctgcgccgtccccgaccagcggggaggtgagcagccggaggacgggtcgggacagctccgtcagcagggccgccgtggcggtgtgcgacgccgcggcgcccgcgccgagggccgccagcgccctggacagccgccgggcgatggcgcgcacgctggcgcggacctgagggaggattgagggaatggagagattctgggcaccagcgcacggctccgcagttggcgtggggaggttgctcaggaattgagcgcgaatgtcagatgtcatactgcgttgagcctcatgaggcacagtggggtcaaacnnnnnnnnnnagcgatggcgcgcacgcaggcgcggacctgagggaggattgaggggatggagagattctgggcaccaacgcacggctctgcagttggcgtgcggaggttgctcaggaattgagcgcgaatctcagatgtcactgcggtgagcctcatgaggcacagtggggtcaaactccggcatgaggcattcaggccagccagcactcaaaactccagcacaatatcacagcagacaagatgtgcacccagtctgccctctctcatcacgaaattctacaagcccttgacgccaccccgacatcaacaacacacgcacctcctcctccacggcgagctgcttccgcttggcttccaccgcagcgtccttccccgccccggcaccggaccccggcctgggcttggcaccagccgttttggccgtcggggcggcagacggcctcgacccgacccgggacccattggcggtggctgatgaggccggggaaggcgtgggcgtcgcagcgctggcaacgtctgggctcccagcagcagggtccaggtacnnnnnnnnnncgacccgttggcggtggctaacgaggccggggctggcgcgggcgtcgcagcgctggcaacctctgggctcccagcagcagggtccaggtaccaggtggccggctggggactgggctcggccccgcccgtgcggctgctggccaggaccctctgcagcacctcggtgggcatgatgctgccgtcccgggtctcgctggagaggcggcctgcgatgatttgcgccggtgggacacacgtgacgcaggtggaaagggcatgggtgcctcggcgggctcatatgagcttggggcatggacgccccgcaccactacccaaccacccacacagttcccttgccccacccccctcctccttcacctggctgggtgaannnnnnnnnntacgtgacgaagggtggaaacggcatgggtacctcggtgggctcatatgagcttggggcatggacaccccgcaccaccacccaagcacccacacaattcccttgcaccccccctcctccttcacctggctgggtgaagtaggtccgaagctgagaggcgctgagcgcgtcatggtcggtggcgtccagggcgggccccagcgcgcgcagcagggtcggcagcaacaaggagggcgccagcgcgatcagggagcgcagcgcgcccagcgcggcgcggggctgtacggggtgggcctctccggcggcctcgaacagcggcgccaggacccggtcgagcgcggcctgggccgcgcccggcctctccagcaaacgctgcagcgccgggcgaccgcccagggcgcgggccactccagcccagaccgccgcgccgccgccacgccgtgcggctgctaggggggccgagtggctcagcnnnnnnnnnnggcagcccagaccgccgcgccgccgccgcgccgcgcggctgctaggggggccgagtggctcagcnnnnnnnnnngtttttttggtataagaggtgccctccgcacagccgaccgtggcgctttgtcatccccattccacccaaggaacacgctttcagcagccctcaccagagagggcgggggacaggtccttggccagannnnnnnnnncggcgtcggggcggaggggagcagagcgaagagggcgtgcacatagcgcgcgcctagggcttgcgggcctggtccgctcgattcagggtcggcgttgggggccggcggggaggaagccaccgtcacgctgccgggggcattggcgtatcgctgcaggctggcggccagttgacctggagggacaggggagatgggctgggtggacgggataggttgttatgggagcacgagggtggtgctcaggtgctgagtctgcagcagaggcacccaggcctgagtggggaggatgagtccccacagattgctgctgggtgtcagaccggaaagaggctggcctttcaaattttttttggtataagaggtcccatccgcacagccgaccgtggcgctttgccatccccattccacccaaggtacacgctttcagcagccctcaccggagagggcgggggacaggtccttggccagaccagcggcgtctgacgcggctttccgcgtggcggcgtcgtggtgcagcagcaggagcaccagggtgtcgcacagcagcgggaccacgtcctgcgaggcggccctccccagcaggagctcctgcctttccagcagcaggccagcgagttctgcggcggcagcggccgcggcaggtggcagcttggccgccgtcgctggctgcagcagggggctgcccgcctccagcaggcctgacttctgcagagcggcccgcgcgccggcgtcgactgaggccaggcgcgccagcgccagcgccgccaggaccccatcctggcgcaggacggccttggcggcgccgtcggccacgacgcggagcagggccggcgccaggccggcggccgggggcacgcagcgtgtgcagcgcagcgcggtgaccagcgcgaccaggtgcgcgcgacgcggcgcgtcgcgctcgctcagccccgcctcgaagcgggcgaggagggcggggccgaatgcggcggcgcccgccgcgggcgcccaggcccggaccgcctccagcaggcccagcctgccgtcctcgctggcctcgccggcgtaggccgccacggcctcggccatcacgccagccgcctccaagtcttcgtcgccgtcggtctcattcgtggcaagaactgcaagatccgcaaaggatggcgccagcagcgcagcggcctgcgcgaggcaggcgcgctccggcacgcccttgatcttgccctccgccgcgccggagaagagggccagcgcggcgcgcgccgcggccccccgcgccgcgtcgtcggcgggcaggcgggggcccagcgcggccagggcacgcagcgccgcggcgcgcgtgctttccttccccgcccgcgccgcgctgaccagctggggtaggagggcgccgaaggcctccgaagcacgggctgagccgggcgcgaagccgggggcaagcgccgccagcgtgcccagtgtggcgtcgggcgcacggcgcagggctctctcgaacgcgggggccagggtgcctgggagggagttgggagaagaggggaggggttggtggaagggtgatgggtgggtgggtgggacgcccacctcacttcaaacccaggctatctacacaaactgaacagaggctccagaacacgggcatgaaaacgtcatgaacagcatgagcaagtcgttcaacgaacttgaacacaaaccctccctccattccacccacccgccagctctttggggccccaggcccggctggcgaggcgccaggccgccatcgcctccggggtcggggcctcgcgcgctcccaggccccgctcgctgcagaagagccccagcgtggcagcgcccgcggtcccctgttcctcctttccggccacggccagcatgatggccgcggcgaggtgggcggagccgccggaccgcagcacctccaaataggcggggaggagggccggggcgcggcgcagcgccctgcccacgatcgcggaggcagcttcgcccctgcttccacgtgccagcttggccaggagcgacgactgagggggttggtgggtgtgggcgcggagagcttggagtgtgcccagccatcgcgctctggactccaggcccggagcggacttccccctgccttctactccggacccacctcctttgcactcatcacaatctaccgtcgatccccactcacctgaaactccaccaccttggcgatcgccttggcgccgctttccagatccaggctcgcgatcaacagcccgctccattgcaggaagatgagactggcctgcgcagggcgaggcgcagcgagactgggtgatgttgggatcgctgtatgcatgtaaatacaacgcccttgcgtgtacccagcgggccagactccatgtccccggtatcgatcgacggcgccgcctgcaagtgcagcagagacatcgacgactgcaattcctcctgtggtgccatgccatcggctccccacatcacctacccttggagcaagcttggacgtgtcgctgcgcagcagggcggcagcaaaggctcgcctgaacttggggttgccaagggcggtggtgatgacaggggtgctgctggcctggagccgcgggctgaccgccaggcgatcagctatgccaaatacgaggtccaccaatgcctcctctgaacctgtacgagggtggggggctttcgtgctccttgtccacgactccggcacagcgcttcccacactgtgcacttggcacccagccctcnnnnnnnnnnggcctcctctgaacctgcacgagggtggggggctttagtgctccttgttcacgactccggcacagtgctccccacactgtgcacttggcacccagccctcgcctccacccttgtggggtctctgcaatggatgtacaatatcggatggatccagacgtaccctccttctggaggaggccgggaatgagcctggtccagagcgccaattgctggttggcatctcgactgagcgcggcgcgccagcactcgtccacggacgagttggacatcagaggcgattcactggcccgatctatgcatgcttttcgaggctttagaagcctactttgatgttgagggttgtatgcagttgatatggtcatttccaggcccacactctcgcttgacgctgtcgtcgacatcctactccacccggccagggtactgggagcggtactgaatcccaggatggagagcctgggcgagccctccctccccaggcccaggagtggcaggtggaatggacgtcctctgattttgaagaacaaggctggaagagtgcttgagggctgctgatctgcgcattgnnnnnnnnnntgtccgctggttttgaagaacaaagctgtaaaagtgcttgagggctgctgatctgcgcattgcactcgccagaactctgcaaaagtgctgcgactagtgagtgcacctccttgcgactaccaccatgaatcccactgtggacgagctggagaagaaggaggaagagctgtttcggacgggccccctgtcagttctcaccactagcgtgaagaccaactcccaggtagcaaggctcgtagggccgtggcctgtctcagtgatgctcacccagaacagagcctcgcggtgtgagcaacctgctcatgcctccctctccaccccatggacaggtgctgatcaactgcagaaataaccgcaagctcctgggacgcgtgaaggccttcgacaggcactgcaacatgattcttgagaatgtcaaggagttctggacagaggtgagcatcagtgcgggtccagggaggcagatgtcggatataacaaggcgatgtgcgggaaattcaaggtccccctcatcgccatcggggtccagtgtgcggggtggcctttgggtctcacactttccggccgacaccctgcgcccaggtaccaaagaagggcaagggctctgctggcagcaagccgatcaacaaagaccgcttcatctccaagatgttcctgcgcggcgactctgtcatcatggtccttcgcaaccccaagtagacctcgtatggtcgctcccctcccctccctgctctccgttgctgctcatccctcctccgctgcacatctttcgctgtaccattgcctgctcgccagacactgccgctgcacgacgcagggtccatgggacgagccatgcaggcacggctccacaagagcaaggcagcagctggcgcaggcgggccggctcgcacaccgccctctcaggcctgggactcaagggtgcaccccatgcagatcgaatgccaaggcttctggtgcccgagtgctccatgtgagacacacccacggactcctggcgtcacgccgagggcaggaggtcctcgaggaaggcagcaaactcgtcggcgtcgtcccccgcggggttcgagtggccccgcacctctggcgcgggggccccctgggccgccacttcctggaaannnnnnnnnngcccgcggagtgcgagtggccccgcccctctggcgcaggggccccctgggccgccacttcctgggaagacggaccgggcgacgcgtccctcccccgctcctcctcacggccacgcgccacccggccttcgccctccgaccccgccctgcgccgcttccgcgccctgccggcggccgcctccgcctcgcgctgcttgcggtggttgagctgcagggcgtgcttggggcacagcctcaccttcaccagcgccacgcgggaccgccccgcctcacagtacgcaaagggcacctcgaacgaggccaggccacgccgctcctcgcacccctgcgcggcggccgacgagcatgtgggcttgagggtggttgaaacgccagcacggagcaggcgagccaggcgacatggctccaatgctacccacggcacacatgtgcaggcccttgcacgactctgtgcaggcccgaggagggcgcggcgtccaaaacatccccccccctaccccgtctcaccacggctccgcaggagaactggcccttgcccgccaccacctcgcgctgcgtgcgccacctcaagcccagcctggactcgcggtggcgggacaggtcggcgatggcgtactctcggtacagctgcgcgtagtaccgccgcgccaggcgcacctcccaggggtcgcccgccgcgtcctccgcatcgctgcggatgaagcggaagctgtcgcgcagcacgtcggcatcggtgcggctgggcaggggcgcgggggcgggggggtcctgtccccgggcgcccgcgccatagtgcgccagtgaggccagcaggcgcctgtgccgctcgtacgcgcccatggccatcagagcggcctgggaatcccggcgctgctgggcagcgtgcggcgcggaggccatccggcggcggcctgctgtgcgcgctgggcgggggtcgataacggaggcgcctcactcgggccttgtgggctggcggggcgcttgcttcgggcttgggggtgcaccgtgaggtcgggcgctcagcgtctggatcccggcgtggaagggaggggtctgcggatctgcgacgagggggttgggcatcaggggtcaggagtggccagcaagtggaacagtctggagggagtgggtgggagagccagtgcactttggatggggcggacctccatggcggcaaggcccggcatcgttctttagtgtacaacactgcagcctccttacgagccaaaacaaacaccccactcctcccgccaaactgatcacctcggagaggcgtaaagtacaggccagtaacagtcatgcgatagtcgacgtacagctccaggtaggtgcgcgagagttcctcctcggcagccgcatccatgcctctccggggcaggggcgagctcaggtctgcatgtcgctctcgtcgatgtcgtcctcaaaggaatcgaaaaagttggagtcggcccaggaggcaggttcgcgtagggcacgctcgaccacgttggctggggtggacagccccacctccgccacgccttcgatatcgcctgggaggaggtatgctgatcatgacgctgaggctaccaggtgttgcaaagacgcattggtcgttggtcacacatcgttcgacagccctccctttctctctgctcgcttagaacaccccgataaaacttaccctgcaagaacagagaaacttcctctccactgtcctccgtgttcgttcgcatggtgccggaatcactctattctgacggaacggggtgcataaaattggatcgcaggttccggacatgctttccaggtgcggatcctgcagggcgacgacgtccattccggcccctcgtctccccaaagtccgtgcgtaattgttgcccttcacccgcgcagcgtcatgccaggcagggcaaccatcagatgcacattgccgcggtcggcatcacggcgagttggggattccggtcccagcatccacagatcatggatcccaagttccccatactcatcacccaggccatcctgccctccccgctcgcacacacccgcacccttctgcctggaggcgccacatggcatcccctcctcctcacggctctgctggccggcctcgccctgatctcgacgccacgcctgctnnnnnnnnnngcacctcctcctcgcggctctgctggccgccctcgccctgatctcgacgccacgcctgctgcgcctggcacgcaacgaagcctgcctgcgccgcctccccatccccccaactccctcctggctgctgggccacctctccgacttcgcccacccccagcaccacctccggctctttgactgggcgacccagctgggaccggtgtactccctgcgcctgctcaccagccggctggtggtcctgtcggaccccagggctgcggccgccgccctacggctgggcggcggggcggagaagcctgacgtcgtgtatcatgttggcaacatggtgcgtgattgttgcgtggcatttgtgttttcccgcaagacagaggaggggtggtgggttttccaggcgctggtttgtcgcctgcatggacccgtgagcacccagcaggcagaccctccctcgcaaccacatgaaccctgcgctcccacagttcaactccgagtgcggggagcccaacatggtgtctgctcgcacggcctctcccctgtggagggccgtgaggaaaggcacggcacccgcattcagcgcctccagcctcaggtgggatgctggggcccacgggcaggcgcactgtgcagtatgaggctccttgtttcccttcttagcaccgcagccttatgtatggacgccgagcgctgagcttttccagcgcacctgttctggcttagccagaacatgtatcatctgcccttgggagcggccagatacccaggctatttcgcaaacctccccgaccctgggcaggcagggcttcccggagctccgcccagtgctgagggccttgcatgctgtgctggcaagccatgcaacagatggcgccccgctggacgtggcagacctcatgctgagggctagctttgatgccgtgggccatctgggcttccaccacgcatactgcacggtggaggtgagatgacgcctgcgggggctgggtcgagggacctgccttgccctccaccagctcatcacatgcacccgatgctcccccatgcaagccgtcctggctggaactcatggttgacgcaccttgctctggccacaacatcagcttccatggatcgtaccatccatgccaccatgcagacccccagtctgcgcgtttgaattccctctgagtcccatccccatgctcgcgccatccttcaggcatatggcggctccccttccatgcacacaaacgtcatcatgcgagcctttgaggccatgatgcacgaggtgcccaaacgcagcgcaaaccctttcaggcgctatgcacgctgggacagggtgaggatgtgctgagtggtgttgccgctcgtcattcatacacccagagacatgcaggccacggaacgtcgatgaatgattggcctgagacgtacagcgcacccctccctctcctctttgggcagtctgtgcgggaggccgatgcggccacgagggtgttccaggccgagatgcgcgccctgctgcgcggcttgcgtgcggccgacctgcccccttactcgctggggtccctgctcctgagcaccctggacccgagcaccaagggtcccctgtctgaggccagactcctgtcagagctgagcaacatgtttgtggcaggggcagacaccaccggcaacaccctggcttgggcgctggtgagggagaggggaagggggagggagaggggggtttggtcgagcaccctgggcacgtgccatgccccgcccccccttgctgtcactccaggagtgtgcctcaccatgcagctccatccagtcatgcctgccctgtgctcgcagtacctggtgagcctccaccccggggtcgaggcacgagtggaggaggagctcaaggggctgggtctttgtggccccggcgcaaaggagctggaggtcggtgacctcggcaggctgcgctggctcagtgccgtcgtcaaggtaggatggggggcgttggggggtgcaggcaatgggagggtgaagaagggcatgcatgtggcaagggagatgctgacccgcaggaggctgctgaaggatgcgtggcatccaaactgagcagattcccccgactccttccctgtcgcaggaaactctgcgcatcatgcccgtctccgcggaaggcacggcagtcgagtttgacagggacaccgacatcctggactacaggatacctgcggggaccctcatttggtgagcccttgggtatgctgggggctgatgcaccaggagatcctgtgcctggcatcatggaaggaatgctttggaggccgctcaagttgggcacgggaggtgagagccacccaacctccccccttccaccaccctcccaccaaccaggatcccatttttcatcatgcaccgctcctctggcctctgggatcggccggaagtcttcgaccccgaacggtggttgacgccggagtgcgaacatgtggaggggcagccgggtcaagccctgcgcttctgtcccttcagccaggggacacggagctgtgcagggcaggccatggcggagatgaactaccgcgccatcctcgccagcatctggggaaggttcacctttacagccgtggatgaggtaaggtcagggtttccaggggcatggaggcactgttgaggcagtgaactcaacatgtgcgcacatgtagaagcagggtctgcaatgaggtaccgagaagctctcccccttcgtcaacctggatcagtccgcagtccctctggagacggttctccgatcaggagtcatacggctaaccctgcaaccggaccatgggatacatatgaagtgcacacgccgcgtctgagcttggtggtcgtggggaaggaggtaattgacagccttcaaatctttccaattcttccatcaaattgctacggatctcaccggtctcccggacaaagagaaatagggcacgggtgnnnnnnnnnngattgccacggatctcaccggtcccggacaaagagaaatagggcacgggtgaactttgtctcccacgtgggggcggtgagtcactgttcgcactcgatgccgaggtttttggctatcgcgatccacagtctgagtggatcggactccacgttcctgtggagaaatcctgattcggttgcgcgatccgttcagtgcgggaggagagctgccgaaatgcgctgcacgactccgagttaaaaccctccgggaccctcctggggtgaagggcacgggtgtggcaagaggaacgctgaagatttcccaccatgccaagcatattcgacaagctacatcacaaaaaattagacccgttcaagggtcagcataacctatgcctgctgaagcatttccatatcgtcaaggagttgggttccggctcctactctcatgtgtgagttgcgagtgggtgatccttgccggcgcggtagccacggtagtcacgctcaccaattggatactattgctttctcgtgcatgcgcttgcaggtatcaggtgcagcgagtggacgatgggcgggagtacgccctgaaagccaccgacatgtccaagctgagcggcgtcgagcggatcagtctagtagaggagattcggtacctggcgtctctgtcccaccccaacatcgtgcgatactacgaggcctttgtggaggagcagtggctatgcataatcaccgagctggtgttgggaggggatgtggcaaccctgatcgagtgagatggcaaggattttaccgcagtggtgtggtgtatttgatacttgccctggacgatatgcatctgaagagcattccctgacggcatgcttcaggcttcaccaaacaagtgtaattataaattgcacccattcgccatgcaggaatacgcgcaatgcgcactcctttgtgcctgaggacagcatttggagcatcttcctgcaaacagctctggccctcgaagagctccacaactgcaagatcctgcacagggacgtcaaaccagcagtgagcttgggtgaggaaaatgctaatcagacatgtatgattggggaaaagaactaacatctactcaaagtaagtgcaagatcgcatggagctccccatgggcatctcgttgccgcctgagccctccaacctctttgcccaattgcagaacctcctgatcaatggcaacactgtcaagctgacagactttgggatcagcaggatcctggagcgaatcttcacccgcactcaggtggggtgaagcgcgagcaagagtataggatggtcttggttgccatgccaagcatttgacaccaaccaaacacctgacaaccccttgtcttgacccatagattgggaccccgtactannnnnnnnnnggtatgggatggtcttggttgacatgccgagcatttgacaccaaccgaacacctgccaacccctcatcttgacccatagattgggaccccgtactatatgagcccagagatgtgggcgggaaaggcttactccctgtccagcgacgtgtgggcgctcggctgcttgaccctggagctgggcaccctgcgcttggccttccccggcgagaccgacgccgaggtggagcgcaacgtcatgctgaatcagccccccctgctgcccccgcgctacagcgacaacctggatgccgtggtgaaggcaatgatgaacccctgccccatccagcgccccaccatcaccgaggtgtgagccagaagagggaaaggagagcgggggggggggtgtcttgacagggaggtggagggcagaagggagggacgnnnnnnnnnnggggaaaggagggcggggaggtgtcttggcagggaggtggagggcagaagggagggacgccgagcgtgtcgggactggggaaagaaggcaccacgactgcggtggtgaaggccacagcgagggaatgagggagtggaagatatgtcctgcccctgcccgacgatcgacccccatcctcatcccccagatcctggccatgccagaggtgcgccgccagtggagcatcctgcccgctgcccttctttccaagctgcactctcacaacgacggtgcgccggcgcatcacatcctgcagccgatccaggtggggcgccctggaacggccgcaattgcttccggcccaagtgtttggtgccatgatggggagggccaagtggaaagtgatgtttcctccacagcaggtcctgggagtggcgcaccaggcgtggcgttctcgcnnnnnnnnnncttgcatccagcccaagtacttggtgccatgatggggagggccaactggaaagtgatgctttctccacagcaggtcctaggagtggcgcaccaggcgtggcgttctcgcctagaggagcctacgccctttctacatactctgtgctgcgtatttgtcaccctgccgaaggatgactgaccccctcccaagcccccctcccccagctgcccaaggagctgcgcctgctgaactcgcgcctgccccccgcccagtatgaaactggcgagggcatggcgttcctgctttccaggcccatgtcctccagcgccggcgacctggcggggatggacggccagagcggtgagcagcctggggagtttcaggctgccttttgcaatgccgtgtttctcgctccatctctccgtcgagcgcaagcgtgccaggcacccagttgctcttcctctgcacatttccatgaggctggtcactcagcaagacgattccacaccctcaggagcggcagatcccccctccggcctgacgcgttccaattccatcagcaattttgaggcggtgggccacggaggctcgaccgaggggccgcggtgggcagacctgaggcgcaagagcgtgcaggtcggcagcctggcctacagcctggcacaattggcgacggacccggaggagcaggagaaagggttagggtttgacgaggcagggcctgtgccagaccccttgccaaccacacctgcgtcccctgagaaaagcagctccgggaaagcgcggaggaccctacgggcctccgtcacctttgccgccccggaaggcgccggcgcggggtcaccgcgccgaccccgctccgcagcgctgatgcgtaagagcgtggtgctggcggacgtgcagggcatgcgcacgcggtcggagcacgacaggcgcgccgccctccgtgacgccccggccccagagatcggcgtaggggcgtttggcggcgggggctttgagctgtgccccgtggcccgcaagagcttcgtggtgcccaccacctcgcgccagcccgtgctgggtgaccacccggagcgcgcgccgaccggggccggcggggagcggggcggcgctggtgtgcgtacgggggcggccgcggaccagcgagccgcggtggcctggcccggcccggccgagaccgatgccagcatgcaccagcccatggggcctgcagcagcagggaacgggtatgcatgccctgagagcgcccagacctcgagcgccgtaaagtcacgcaagcagcccaagaagggcagcttcttcaannnnnnnnnntcctgagaacgcccagacctcgagcgccgtgaagtcacacaagcagcccaagaagggcagcttcttcaagaggctgttccactgatacggcctggtgtgtcggggtgagtgtctgccagcaagaaccgagacttccggacggaacgagtacctagctgattcaagacccaagatatgtagccaacaccaaccagagcaccctcttggccccgacatactcatgtgcgacgtccttttagcagtgagttacaatacagtgtctgttcagaacctgaccttttgttagccttgccccattttaccagtgccctcgagtcctctactctccagaggttgtgtgcatttctggaaacggatcacaataagaatgcacacgagcttggcccttggcaccctttcctcgtaagtggatgctcaggacgggccagtatgatggaggagacatgcaagcacaccaacgatgcacccaccagccagccacactgagtcacaaagggaaccctccacaatcactgacagttgtcgagggcaacgcgctcaggtgacgtacagggatgcagcaaagatgacgtcgcgcttgatgcactccgacgcggcctccatctgcttgaaaaggtccacgttccccatgatcctggctgcatcccggaactccctgtgtgtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnaaggggcatgctgaactggccccttgacatgcgtgggcaacgcccccagcggcgttgccgttccttgagtcctgcgtctgccatgagccgcagcagcaggcgcagtgcctgccaacaccccaacagaagtgaagaaccccctcacctgcacgtctcatccaggcggnnnnnnnnnntagcggcctgctgaactggccccttggcatgcgtgggcagcgcccccagcgacggtgccgttccttgagttctgcgtctgccatgtgccgcagcagcaggcgcagtccctgccaacaccccaacagaagtgaagacccccctcacctgcacgtctcatccaggcggacgatggcccggacaatggtcccctccatgacgtctgtcagctcgcagatggagtgaaagggggtcccccgtgcccactcgtacaccacctggtcggtgggcgcttggtcgatgagcagggagtcacaatcactgcagctgcgcatgtgcacctcgactgcaatcacatccgcggcaccaaatcaagctcctgccggtcgccgtctttgaagcccaggtgcgccgttgcacccctccccgcaccgacctctgcgagcccgaagcggagcaccgaggccgcccactccatgggttctagctgcaggccagcttccgcctgcgcgacgccggccgcctctgccaggtccatcgcccggtccctggcctctgccaagcgtggcggcagggtcacctccacctgcgtcttctcctgtgcgtggtgggtgggtgaccggagcgggtcggagcgccgtggtcggggactctgatatgcaccagcatcctgtgcctccttcccgcgcnnnnnnnnnngcctgcgtcttctcctgtgcgtggtgggtggatgaccggagcgggtcggagagccgtggtcggtgactctgatacgcaccagcatcctgtgcctccttcccgcgccccccctcaccccccctcccccttctcatctgctcgccaaccccaatgccttgcctggaagaccagggccgagagcagggccacggcctcctcgggctccaggtccgtcagcacgccgccgtacaccagctcggtggcggccagttcgtccccggaattcagctcgcaggccacccgccccttcagggtcactatgcgatccgcgtccaggtaccccaggcgctgcagtacccccacgcgctggtggaactcgggcagctgggccaggctgtcgttgctcagccgcttgaccatgacagataggcgctgggtcagcaccttctcgctgcggatcatggcatacctgtacttggttatttgaagaaggaggccaagggggaaatgtgggaaagggagtttgagacggataccatgaatgtgtaaatctgagcccatgcaggagtccacggcttgcccaggtcgctgagctatggaatgagccaacgggatccagatcgtccggcctttcagccccaggcggcctgacgtctgccagnnnnnnnnnngaggaggccaaggggggaatgggggaaggggaggttgaggcggataccatgaatgtgtcaatctgagcccatgcaggagtccccggcttgtccaggtcgctgagctattgaatgagccaatgggatccagatcgtccggccattcagccccaggcggcctgacgtctgccagtcaaagcccacttcaaatcgccctggaccctccccctcaactcacatctctggcagcaggggatcggagtnnnnnnnnnncatccccctggcccctcccactcagctcacatctctggcagcaggggatcggagtgggctgccatcaggccacgctgagcggccagcacagttcgctccctagcggccctcacgacctctgtgggtggagaatatacgcagatgatgaaagcaaactactaactccagcccttagcttcagacctctggagcgcttgacaacataacatccagctggagccagatcgctcaaggtgcagttgcgtcaaaaagcaataaattcacggggtgaatgacccgaaaaccctcactcccaacccacccctccctcgccactcctcagacccccccccctctccatgctcaccgtagctctggagcttcaagtctgtggccgggtccagcgtctcaggctcgccggacggcccggcctcggcctgggcacggagcagcgccgagacggccgtggaaagcgcggcgggcgtgccgtgcaacacccccgggccgtccacatccgccagccgctggcggcagatgccggtgatgcagcgcagcggtacctccgcgatgaggtactgcgcgccagcgacgctgccgcggtggggcagcacgagggccggggtagcgagggctgccaccggcttcttcttccctcctttcttcccacccttgcccatgagcagcaggtcgtcgtcgtcgttctgggtcaagagatgtggtgggacggggaaagaggaaggtacacgagggagcagcgtaagggagggggggacgggtttggagggggtnnnnnnnnnnagtgggatggggaaagaggaaggtacatgagggagcagcgaaagggagggggggacgggtttggagggggtaggtgaaggcaaggcccacactgtaaatttgcagagcctcatcagatttgagcccccatgccacatcaattgctgcatggcaggccggtcacttccctccccccatacacaaacacaggacacagccccccaatcctaccacgacccccacctttttcttgcccatcagcttcaggccgggagggggcgccggctgcgcagccggtgcaggttcggcagtgtctcgttgcacctcccccgccccggcgtactcgtctcggggtccaggggagtagagcatgagcatggtgcgggcgggaccctccgcctccgcaccaccgccggcc

SEQ ID NO: 46516 - DNA, 66 bp, Chlorella protothecoides
tccccggggtggtagatcacggccgaggggggtgaaatgtgggggctcttggcgtgctcggtccag

SEQ ID NO: 46517 - DNA, 89 bp, Chlorella protothecoides
gtggctgaatgccctcccggagaggtgggcatgaggcaagggaggaggggaggaggggcctgattggggtactcaagcccttgaaagtc

SEQ ID NO: 46518 - DNA, 61 bp, Chlorella protothecoides
ggggatgggggtcacgtcctcgatgcgcccaatcttgaggccagcgcgggccagcgcgcgc

SEQ ID NO: 46519 - DNA, 72 bp, Chlorella protothecoides
ggcagtccctccgagcccaggcacgatggggagacgggggtattttgtgttttgctgtggtggagatgcctg

SEQ ID NO: 46520 - DNA, 66 bp, Chlorella protothecoides
agggcgccggggcagatgtcgcagccgcactgcacatccacatcggtggcgttggacgtctgggct

SEQ ID NO: 46521 - DNA, 61 bp, Chlorella protothecoides
ccatgtctgcccggctctgccgtaaggagattgggaagagcggccgtctggggctcctgca

SEQ ID NO: 46522 - DNA, 61 bp, Chlorella protothecoides
ggaggtatgccgcgatggaggagtggccgggggaggacgcgcgaaaccccgtccccgacag

SEQ ID NO: 46523 - DNA, 11446 bp, Chlorella protothecoides
  modified_base (2966)..(2975): a, c, t, g, unknown or other
  modified_base (3062)..(3071): a, c, t, g, unknown or other
  modified_base (3148)..(3157): a, c, t, g, unknown or other
  modified_base (3345)..(3354): a, c, t, g, unknown or other
  modified_base (3820)..(3829): a, c, t, g, unknown or other
  modified_base (3930)..(3939): a, c, t, g, unknown or other
  modified_base (4510)..(4519): a, c, t, g, unknown or other
  modified_base (5453)..(5462): a, c, t, g, unknown or other
  modified_base (5950)..(5959): a, c, t, g, unknown or other
  modified_base (6203)..(6212): a, c, t, g, unknown or other
  modified_base (6816)..(6825): a, c, t, g, unknown or other
  modified_base (7102)..(7111): a, c, t, g, unknown or other
  modified_base (7175)..(7184): a, c, t, g, unknown or other
  modified_base (7563)..(7572): a, c, t, g, unknown or other
  modified_base (8418)..(8427): a, c, t, g, unknown or other
  modified_base (9226)..(9235): a, c, t, g, unknown or other
  modified_base (9634)..(9709): a, c, t, g, unknown or other
  modified_base (10458)..(10467): a, c, t, g, unknown or other
  modified_base (11016)..(11025): a, c, t, g, unknown or other
  modified_base (11103)..(11335): a, c, t, g, unknown or other
ggggggggggggggggggggggggtcgcaatgagtggcgacggggcggggctcaggaggtgcagtgtggaagcccggggggttgtccgcaaggcgagccatcgccggcggggttgtccgcaaggcgagccatcgccggcgcacacccatcagctcccagccccgaactccgccaccccacctggcggcccgaccagcagcgcgccgcgcgggatcttggcgcccagctccttgtacttccccggcttcttcaggaagttgacaaactccatgatctccagcttggcctcgtcgcaccctgccacgtccttgaaggacaccttggcggccgcggggtccatggcgcccagcttggccttgcccacgttgaagatgccgcgcgcgccgcccgcgccgccctgcccgcccagcatctggcccagctggcggcgcgtgaaccagacgtaccccgcgatgagcaggatggtgggcatcagcttccacagctcgctcgaccacatcacctcgtccacgtacgtcacgtccacgcgccgatcggcgggcacgcccagtgcgtcctgcgcggcctccagcgcgcgctcgaacgcgtccacgctgccgatgttgaaccagagcaccgtctggccgccgcgcttcccactggggggggacagcgacggcggggcggggatggggtcggcggcgccgccccccgaacccacccccgcgccgtcgccagtctccatggtcgcgtgggcgtcgcccgtgatgcccagcccgtcgcccggcgcggcagacatgtagacacggaccttgttgcggttgaccacctccacgcgctgcaccgcgccggtgggcagcgcgtgggcacggaaccactggaaggacacctcgcggctggtctgggtgctggggctgggcagcaggaagagggacaccaggaccatgatgagcagggggccggcgttggcgcgcagggcctccaaaaagtccaccgtctccttcttcccagggggaacctccttgccggacgcgcccttgccgggcgcgcccttgcgcttgggataaaacttgctccagcccttgggcgggggcgggtcggtgctgaacaggcgccgccccagctgccgctccacctgcagggattgagaaggagggcaggacagagagattggatggtttgacagccataacaaggctcaacaagcaggcctgggcagagtgtcggtaggggctgcagttccacatgcgcggcccacacacgatgcagggtgtagagcaagcacaccacacgatccgtgggcccgcccgcagcagccgattacgctccaccccacccaccttctgcagctgccggctaaactgtcgggcagacatcaccggggcccccgcctgctgctgggaatgctgcaccaggctgcggaagcatcggactgccgtctgggctgcctgggatgacgtggtggtggggccagaggccacggcctcgcccaccagcgtcgcgatcacggatccggcatggcttgcacctgatgtgacggctcccgactgcgaactggattggaggatgcgctgcagctggcgcagcgcaccactgcgggacagcatcctactttaccagcacgaactcgggctgggtgatgaaaatgcacgagacccctcacgcattcaatgtgcacaaaagggggctttgcacggctgcgtgcgatgatgtgagaatatgcagacattttggacgtgtctggatgtgcccaatgatggttgtccagtcagcacgatccctctgcccaaaatttgctttctatgctgaacagctatttggagcatttcggacacgtcatgttacagagacccatcaggggaagatgcatgagactatagctcggcatgctcttgccatgtaggtgcctgacggtcaagagaggggttttggacagctgggccaacctgggtggccctcctgacctcctccctggctacagctggggaggcagccggaagcccaggctcctggatttgctcccgcgcctgcttgaccagaggggccgatccgtctgagaagattacctgctgggccggtctccctatgctgttcacgtcagtgaggccggtcggcatcccaggaccagggtcctccgccagtctcgcctgagtgaggggttgtgcccccggccctggtctaccagcaccggccctgtgcctcagcagcgcgaggacgtttcctggcttcagcgacccggggacaaagtaggacacacgcttctggacgatgtataaggccacggcaccaaaaatgatgacgccggtccacaggaggatgttgtcctgatgggaggtttgttgggatgggggcttgcactgctggaaggcgcgtacatgggcagcatcatgggtagcgcctttcctccggttgtcgcaggatcccgtccccctccatgtgagcagaatgtccctgccgcaacagccacttttcagcatgtcccccggcaccattgtcgagcaggcaggcagctcccccgcgccccccggaccgcaccaggttgctctgccagttgatggtgcgcagcaggcgccgcgatctcttgagcaggggcgcctggccgacgtactcgtctctcgccccgcgcagctggccgtggctggagtccagggcggccaacgtggcagacgtgtgctgcagctcctccgccagcacctggcgagcccgcttcagcccctgggtcacgttctgggaggtggccagacggggggaggccgccgcggcccgctgcgccgcggcggcagccgagagtccctgggccgaggccgcgcccagcagctcgcgtcgctgggcggcgccggacgccgccagagccgctcgacggcgctgcgcggcggcggtcagcgcattctgcagggcctcgtgggtggccttgtgccgggtgatgaggccagcattgctctgggcctcggcctccctgggagtggggatgcggcaggtggagggcnnnnnnnnnnaggcgccggacgccgccagggccgctcgtcggcgctgcgcggcggcggtcagcgcgttctgcagggcctcgtgggtggccttgtgcnnnnnnnnnnagttccaggtgaaggggtgaagagtgtctggtggaacagtgcacgaccataccctgcaggaagcgagtgtgcttgcnnnnnnnnnnacgtctggtggaccagtgcacacccataccctgcaggaagcgagtgtgcttgccgaaaaccgcatggatgacatgcccctggcgctgtgacccgactcctggctaggaagtgtgttcatcgaccttgcaccacgcaccctctgccttcctcgctgaggagctcgagatcacgcatggcctgcctgctnnnnnnnnnncggaagtgtgttcatcgaccttacaccacgcacccgctgccttcctcgctgacgagctcgagatcacgcatggcctgcctgctctgcgacatgacggcatctatggatgctttgagcgcttggattgtgtcgggagacaccaggtctaggtcgtcatattgattgatgaggctctgcgcggtggcctcctgctcgagcagggcagtgtgcttgggatgcgcctccagcagcatcgcaggtatccgaccgcgatatgcgaatgtatcaacccacggttacaactcgtctgccgatcactctctggaacgaggggctctcttccctgctggatccaggatccgagatgccctttcggcatgctggggggtgcaccgtttgactactttacaggttgagtgggaatcaacgcgccgagggatcgcatgtgagatttactgttgttacatacacctttgttatgtcacannnnnnnnnntggaacaattgacgatgagtatcccaagagaccccttgcacgacggcaggaagcaacacgtttcgacaaacacttccctctcccgagcccctctccactgnnnnnnnnnnagcttgactagtttacaggttgagtggggttcaacgcgccaagggatcgcatgtgagttttaatgttgttacatacacctttgttatgtcacagaagcctccagaccaggggctgggtagcttgttcagggtccagcacattcctcattactcactggacccggtggatctgaggcatggtggagaggggacaattgacgatgagtatcccaagagaacttttgcacgatggcaggaaacaacacgtttcgacaagcacttccctctcccgagcccctctccactggcccaccatatggaatcatggccgacatcttctggaagctgtggatgacctccgggtcccgtgccattgctgcacgcacatcgtatcccggcaagaggcgctcggcctcgcgtatggcatcctgcaccccctcgacatccagatacacagggaactcggctatcaccctgttgtttggggggcggaggcgcggattacgtgcttggcaagtgcatgggagtgcgccaattattggtgacccgactactccatcatcccaatagtgccgcagctacgctccccacnnnnnnnnnngagtgcatgggagtgggccaattattggtgacccgtctactccatcctcccaatagtgccgcagctacgctccccacaggtccgccccacttcgaattcctcgcctgctcatcccagcccacctctcaacgtcgatgccgggcagcagggcctccagccgaagcaccgcatcctgcagccccctggcactccagctcagcaccacgcccggatggtcggcaagcatccggcccaggttggcgcgcggcaggacctgccgcagctccagcacgcggccggggatctcgtccaccctttccaccagggcctgcaccagcggggcccgcatgcgtggcagcttgtgcaccaggtccggcaggtagcaggtcagccgcccgagcctctgctccacctcctcctcctccaggcccagcccggccgccaccgcggctttcaggaggcgagcggtgaggtcctcggaccacactaggttcctctctgccacctggtagtagaagccccaggggtcctcgccggatgccgccttcctctgaaaggactgtctcatgtagatgtatttcgggggggtgagtcttcaggtgtgggcttcggtgggtgtacagcactttccttgtttatctggagaccctcaaagccatgcttgcatctgacaaggagacctcaccggtccagctgcagctttgaggcgcccatcagagctacggtatgtcgccaccgattccggtatttccggagagccgccctctgcgcgtggggtcgcatggacagcgacgcggcgcccgtgatgacgtgcatgacccgggctccaggcgccgggtctgggcagcgcatgattgagtcgcgagagctgcatggaggagcaggaggggctcacatggcccactaaactcattttgagttcatgcagagcatcatcggtggcgtctgtgacgtnnnnnnnnnntacatggcacactaaactcattgtgagtccaggcagagcatcatcggtggcgtctgtgacgttcgtagagagttgttgctgagtgacgcgagaatcgggtgggggaccgacttgtgaagggagcacgcatagcacgggaattcaagtccgggcctgctagaggtaggaacacagcgtgtgcacgaggtggcgacagtcaaacatcacatcccttgccctccaaaatctgtcgttggaggcatatccttggcgcgagcctgagcgtttggtggaagtacgaccgagagcgatcgaccagagtagcacagctcgaccatccatgacgacattctacggagcagggaacggtggattcgatgcctccgcctcgcagtttgcgggcggtggcttcatgcccaggtggggctgtgagctgggcttgcgcttggatttgaatgccggggtgtcgggaatgcatctgctggcagggggagtatgaatgacgcgtnnnnnnnnnnagatttgaatgccggggtgtaggtaatgcacctgctggcagggggagtatgaatgacgcgtcccattcccgaacatccacctccagccaaggcgcaaccgctggtggcagcgcacagaaggtgtgctgggttgtggaagggtagactgcctgctatggggttggaagggcaccgctgcctgctgtgtgtggatctctgcagcccgtcggccgcgcctggcgctcatccattccctccccagcannnnnnnnnntttgaggaagaatagaccgcctgctatggggttggaagggcagtgctgcctgctctgtgtggatcgctgcagctcgttggccgagcctggcgctcatccattccctccccagcacctccccaccccttttccccccaccccctagcgctcgacgtacgacagcaagaaccagacgctgcgcgccttcaccatcaagcagctgtacgacgcagcctccgccaccgccgacgaccagctgtcggtggatggccgggatgtgaccaacgtcaccctggtgggcaagatcacggccgtggaggagcagaacctggtcagcatctacacactggacgatggtacggggaccatgctgactaagtactggatcccagaacaagacgacgccctggtgaggttttgatgttgttgttgtgcggcggagggagggagggtgggggtgtcgaggagctgtcgaatcgttccatgctgcggctttgcgctgctgcgcctcgatcctcgtttgcgcatgtgcagcctatcgtgcacatgcggccaaggcacatgcaggtctcctgtggcctctccacatcccaaatgtgtgatccccgaccgcgattctcgtgcnnnnnnnnnnaggagtcgaggaggtgtcgactcggtccatgctgcggctctgcgctgctgcgtctcgatcctcgtttgtgcatgtgcagcctatcgtgcccatgcggccaaggcacatgcaggtctcatgtggccactccacacactacatgtgtgatccccgaccgcgattctcgtgcaggagcgccagcaccgcgccgagtggcgggtgggggtgtatgtgcgtgcgcacggccacgtcaaccacttcaaccgcgagaagatgctggtcgccttcaacatccgcnnnnnnnnnnaggcatagaacacttgactggagtctgctgcaaggggcctggactgattgggcgttgccagcannnnnnnnnncgtccgcgcgcacggccacgtcaaccacttcaaccgtgagaagatgctggtcgccttcaacatccgcctgatcaccgaccacaatgaggtgggtgagaatcgatggtgcaggctgaagggatgtggatggctgtacttacctgcattgcagggcaggctgcttgtcctcccttagcatagaacacttggttggagtatgctgcaagggggcctggactgattgggcgttgccagcagagcatcaacaggaccctcgctgagaaaggtttcgccaaggctgtagctcgggtgatcttttgtttgtgtcagtaccagtgttacactcctgactctcttcccacctccatgccctcccttcacaggtcacctaccatggccnnnnnnnnnngggtttcgccgaggctgtagctcgggtgatcctttgtttgtcagccccagtggtacactcctgactctcttcccgcctccatcccctcccttcacaggtcacctaccatggcctgcagaccatcttccagcacctccacctgacccgtggcctgccggctgccgatgccgcggccccggccggcgcggccgggggttacggtgccgcggcaggacccctgcccggcgcaaacgcagtggctgggctgaccccggtcctgaacgacgtcctgggcctcttccatgccgtaggcgggcagaacgagaacggcgccagcatctcagatgtgagcattggggtggcgagggggtatgatgccaggttggggctgattgaggagtttcctccaaacggcacgctcttgatcttcgctgccacaagcgcgttctggtcccatttgtctttcatccaggtggtggcgcggagtggcgggcgctacaccgtgcagcagatccaagacgcggtggaagccctgcagaacgacgggcagctgtactccaccaaagatgaccagcactacaagccctgcaacgccctctgagactgtcctactgccaggctgttggatggcggcacaagggctgtctggagtttgccctaggttgtaatgagcatcaatctggaagtcacaccgtcacgagagtacagacaccctccattggatgctgcctctgaggcgtgactggataacaataggccagtttgcatgagagcatgatagtgatggcaagatcaggtcccaaaagctggcataggagtagagatgggatggccaacagaggccatgcacagcggtttgcacaagcnnnnnnnnnnactggataacaacaggccagtttgcatgagagcatgacagtgatggcaagatcaggtcccaggagctggcataggagtagagatgggatggcccccagaggccatgcacagcggtttgcacaagcctgcagcagcgcacctgctgtctctggccatgagcacctggaaaggagcgcgctcaaacgcgccggcctcagaatcgcaccttgcgcttccgcccggtgtactttgtgtccggcttgatgttctcgtggccccgcccccgctgctgcgccttcttcttcacgatccactccacgcccttccccgccttcccgcccttgcgccgcttggtccgccgctggccaacctggaccgcgccgtaggcctcctcctcgtcgctcggatcctcaccgtccatcccacgggacgcagggagcgcagcgtggccccccacctgcacatgagatgggacaaggggggaatatggacattggcgacgggatgtgccaccccaagtcggcattagaaccaactggcatctacagaatgcctctgcaccaggcacttgacctaccagcaggaccaggaagtacttcttggcacgtgtactgtgcgggaagtccaccaccagaccccccgagaagccaaccttcatggcagcattcgtcagcagcgcagcctgtcaaacggacaaagaatgttggggacttcgggggtggcttacaatggaagctgacgaaatcgtgcatcctactccttcaggatggcatcatcttccatccattccatctcacgcttgctgtacagatgcagggannnnnnnnnnattcgggggtggtttacaatggaagctgacaaaatcgtgcatcctactccatcaggatggcatcatctcccatccatttcatctcacgcttgctgtacagatgcagggagcctctgcaccctcagcacagctctgctcagccccgcacctgatctgtgctttccggatagatttgtagtacagccctgccccctttggccaagcatcgatacaaggtttcgaagaagcgcttcatccgcttgcgagggtcatgggagctgcgatcctgtgaggggacgaaggggaggggtgtgctgaacaggcagctcctaggaggcatggatgctcaattgtgcaggggagggatgcccattttcgcctctggatgcaagaccgtaaactaaggtaatcctccacgannnnnnnnnnnnnnnnnnnnnnnnnnnnnnnnnnnnnnnnnnnnnnnnnnnnnnnnnnnnnnnnnnnnnnnnnnnngccatccccgcaccgcattgcagagccactgcacggcagagatgctgatggcgccgtcaaacatgccgggccttagaggcagtccgtggccgagatcctggaggcagatgtccccctccacttccctttcccgtgcaatccccagcattgaagggctgatgtccataccctgtgtatgaagaaaggagaaggtgcattcatgcaggtgaaaggctgccttgctgtggagagcccctagaagcaaagtgggacaccaagcacggtccctccatgacaggggagggaccaacagtctggagattgacctagccagacgagacatcttccgtgcaattcagcgtcgagacttcaaatccagaggctggtactccagcaccctctcaccagccagacatggccggcatcggtcagcgtctccccactcagtcccgagccgcaacccagatccaggaggtacttgggcctgccatcatcgggcagcgccagcaattccagggctctttgcgtcagctgtgtttgaatgttgaccatgcgagtattgtctgtgtacttcctggcctcctcctcattgtagaacacgtccggcggtgccgtgagctcgggccggtcggagcgacccatagtggcggggcagagccgcggggattggtgagggaaaacactttggggatgtatattgtgatatagtcgcgtcgacgagctgtgcgtgatgaaaattgtttcgcgaacacatgcatggatgctccaannnnnnnnnngtggtgaggtaaaacactttggggatttatattgtgatttagtctcgtcgacgagctgtgcgtgatgaataccgtttcgcgaacacatgcatggatgctccaacactccgcgcgcctccaacgctgccccttcgcgcgcggtggcaggatatccatccatccggaccccattcccccgttttctgataaacattcctgccatgaggatcccattaatgtacagtaggcaatcaagttctgggtggacaactgtcccaagggttccagcaggacgggcgccggtgggagggcatgcctgcgactctcatgctgcaagctccgcctgcagctcttccagttccaactcctcagccgtctttgccacggcagcgggctgcaggatgggggatgtgtgggggttggtcaatgggtcttgcggccagagcaaagggttgggacgtccagtatgacgactgtatggcatgccctgcccggtgcgaggcatttctcctgcccgcatgctaacccaggtcgacataacgtaggcgcacagacggccacgccaaggcnnnnnnnnnnctggcaggatgtccatccatccggcccccattcccccgtattctaataacattcctgccatgaggatcccattaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtccagtatgacgactgaatggcatgccccgcacggtgcaaggcatttctcctgcccgcatgccaaccctggtcgacatgacgtaggcgcacagacggccacgccaaggc

SEQ ID NO: 46524 - DNA, 62 bp, Chlorella protothecoides
cggagcatcgcgggacgatcctacagtgtactgcccccccccccccccccccccccaaaccc

SEQ ID NO: 46525 - DNA, 71 bp, Chlorella protothecoides
aactctcggtggcgttccccagcccgacagcgatgcctctgcatcaccctctctcgccctcaaatttcagg

SEQ ID NO: 46526 - DNA, 61 bp, Chlorella protothecoides
ggcggccacgctggccgcgcggtcctcgccggggtcggcgtcgtagccgcccgccaggaag

SEQ ID NO: 46527 - DNA, 75 bp, Chlorella protothecoides
actgcggctgccaaatgcatgtccgcgcctcccaactttgctccgcaccacaccacaccacaccacaccacacca

SEQ ID NO: 46528 - DNA, 74 bp, Chlorella protothecoides
tcgcgttcatgagcagcagtgcctgtctgagggcatgcacaccgacccaggattgcctgcccggtgacaccatg

SEQ ID NO: 46529 - DNA, 5306 bp, Chlorella protothecoides
  modified_base (341)..(350): a, c, t, g, unknown or other
  modified_base (2212)..(2221): a, c, t, g, unknown or other
  modified_base (2296)..(2305): a, c, t, g, unknown or other
  modified_base (3190)..(3199): a, c, t, g, unknown or other
  modified_base (3706)..(3715): a, c, t, g, unknown or other
gtgtgtgtgtgtgtgtgtgtgtgtgtgtgcttgtgccgccctcgactggagggaggggggcatgggagctcgggttgttgggcggctgcatggtgcgagggactagggtgggagtcgcatcgtagcctaggaaccagtctgcggcccggtgcccggtgccaaggcacatgccggaccgcgcccggcaccacagcccggcatcgttgcgtcgagtgctaggccctctacctcgctgccccgtggatgccctgtgccctgcatggagaatgggccctgccactgtggctcgtgcccggtacctcgctgtgccccacccacatccccccccccccccccccccnnnnnnnnnntgcccggcaccacagcccggcatcgtttgcgtcgagtgctaggccctctacctcgctgccccatggatgccctgtgccctgcatggagaacggtccctgccactgtggctggtacctagctgtgccccacccacatcccccccccctggatcacgaacgcactctgcgcaggacctgctgacggcgctggaggagctgggccgggaggagggcctgcggctgcgggcggccgacaagcggcgcgagaaggagctgctggcggggcacagcgccgagctggaggcccggctggcggcctgcgagccgggggacgggcccgcagtcctcgccgtggccgtgcccctcctcctcgccacacacgccagcaagtgagtcgcgcgagcggaggaggtcgaggtcttgcgcaccatggtcggcgcggggtcttgagtggtgaggtgccatgcacgtgcacgtggctgcgaccctggccatgggtccgcagggcccccccaccctccccttcaatcctcatgccctccctcacacaggctggtcaacctccccggacgcgcgctggcgccagcgctgcgggccctggaggggaagctgatgccggaggccgcggagctgctgcccaccctacatgccgcggtgctcaccaggctgcaggggggtgaaggcggcgatgagatggaggaactggcacgcaggacgcgcctgctcctgctggggaaaagggagggaatgacggcttgaaaagaagggtctgcagtgaccctgtgtgtatgagaggcacatagatgcagaggctcctgcccaagctccaactccaagcagagatggggagagcagccttggcgcccccgacattcaactcgggcgcgtgatgccgggccttacacccgatcgccctccgctgcaatctctgaaacacatgcgtgcccttgccctccaggggaatcgtgccttccatccattgatcgcctcgctatagatcgtattgcgcgagtgggggctcagtctgagggctccttgaaagtgtgcctcagtacggtcctcagagcagggcgattttatacaccttcccaggcccatcgcgaggatccacatcgtcgaggttcagtccgcagggatccttgcccagaatgaccagagagccggcctggaacgagctgctcctgcagagcgagcagctcattcgccaggtgcgtgtggatcgctgcctcacgagcatctgcgcctgtgccccttcaagtacacggcgcccatgttctcatcggtctatatttctcctgcttccatgtctgcagcaagaccaggggctcccactgcgcatcgagagggacatccgccaggtggagcagttttcccagcggctgcgcgcaaagtcgatccgaccgggaggctctgactacctgcaggatgccgatcgactcctggcacaggagggattggaccccgcgctgtgcgttgggagtggggaagggagcgcttggagtgctggctgggcagggcatcacttgtgcaggagcaagggtcgctcggccagtgccccccctgccacaaacctcccctcacctgcttcgctgcaggctgcgccgcacgatgcagagctatgagctcaagcctcgacccgaggacctgctggcgccggaggctgcacacagcgtgggccactatgtggagcgcgtgggccaggccctcaccgtggccgggctacagacctccctgcgcgggaccagcctggcctttgacagctacatggacgagcgcatggaggcacggtggcagcaggtgagcaggggggtgcgggggcgccgtggaggcaggactgccgctgagccctgccgcacactgtcctcccccgctgacctgctccnnnnnnnnnntgagcgtgggcgcggtggatgcaggactgccgctgagccctgctgcacactgtcctcccccgctgacctgctccnnnnnnnnnncccacacacacaggagcgggaggccctgtttgagtggacagcgccctacagcctccctgccctgcccctcgtcgggcctggggcgcgcggctctgccgcggagcggaccccgctggggtcggtggccagtggcggtgcggcccgcctgcgtggcagggccgcacagtacgctgaggtggcgcggcgcctgaaccgggcgcgcgccgcaggggaggagttccccctcgcggccgagctgggggcagcgtgccaggccgaacctggcggtgagattgtgtggagggagtctcccgaggggtgtttcctgcccaaagtaggccgaacgcttcagaacaggcagttgatcgtgcactccaccacctcaacgcacgcaggcacggagcgacgcaccagcatggcacgcgtctggaaggtcctgggcagcctcctcccggcggcgcaggtttagaaggggggtgggggggagttgctgccctcctgctcacccaaatgcctgccagctgaccatgcatggcgcagggtggctgagaggctgctgtgtgctgccttgaaccccgcgtggggctgaccagcccttcgctgcccctccatccaccgcgcagggggtcccggtaacagccccctcccgccgagcggacgccttggtccaggcggccaggcgctgcctggaggaggaattcgaggcgcacatgcagctcacaatccggaatcacaggagcaaggtgggcgcggtcggttcgtggttgtgcgttgggggggcagagaggcagctggccgggcagcagagaggcagctggccgggcagcagagaggcgtgtgcatgcttcatggcagcttttcggacattgcagggagttttttgggggggggggggggggggggggnnnnnnnnnnctcggcgtgtgcatgcttcatggcagctttttggacattgcagggagtttttggggggggggggggggggggattgctgctgcagcggccccatgccgcaccttgccgccgccgggcgccatgttactggccgacccgtcctttccctcgttgcctgcaggctgccctgggcgcctcgccctccaaactggcgctgatcaacgcctacctgcgagtcagcctgggcagtcgggagcagctggattttgatgagcctgggggcatggacaccacgtggcaccgcatctacacggccttacgtgccggcctgacggccgaggcgcagcaggcaagggctaggcataggggccgccggtgttggcgggtggtgaaccctgattccagggtcagcatgtttcatgtcacttagcatgtgatctcctgcctgtccatgacatgcaatgctggggggcagcaatctccaggctacggcaccagcacatcattgcccctggccctgccccatcnnnnnnnnnnccacgcagcatgtgatcttccgcctgtccatgacatgcaatgctgggggggagcaatctccagactacggcaccggcacatcattgcccctggccctgccccatccctcctcctgggcggcatgtggggcgcagcaccagccccagcaaacgccatgggtgtgcctgcggcttctcacaggcaacactccccctctctcaatcctgccaggtggcggcaacttcccgcacactggccggctctcggcccacggcctccgccttccccgccgcgctcaaggagtgggtggagggcgggcgccgccccctcacggtgcgtgcaggcagctgtaccaagggtcgggggctgggggctccatgcgacgcaggctccgcagttcaagggagcgggcaggagggactgtgacgattactgtcccttctctaccgtcgtatgcccagcgtgcatccacctgtccccaatctcaaaacccgctccagggagcgacgggttcgtccatcacctccgaggcggagcgcctgctgcgtgaccgcggcctgcgcgcccggggagggtcctccttcgggcacaggctggcgtgctatgccctgctctccgggcacgcccctgccgccgacgtgctgggccaggtggggttgctggggtgtggcacggcatggttgccaggtgaacagcctgaccgacacatcgagtcgcccaacacaggcgctcattctgcacgtgggtgggtgcagccgctgcgtggcctcgtgctggcctaccgggccatgcatggcatcgattgcgaggagtccccgagctccttcttgcttctctcgatcttcaccgcgtcttttcaccacagatctccccgccggtgctgccgaccatcgaggacttcctgtggctgcgcctgggtctggtcgtggtgggagggtccagccagagcctggggtcaggtggggggcgaggatgtgttgcccggggggacgccctgatggtggggagatgctgcgggtgtttcggcccgtgtcaggcggcgcaagcccgcccatcgatgtggtcgacgacggggcgatctcctcacgctcccctctacccccccccctcggacctccaggctcgcagcagggggaggtgtacggcctgcgggacctgcagcagtacctgcagcagtacccctcctcccactactcgcacgccgggcgcgagccgctgcagtacgtccaggtcctggtgctgacccagcagtggaccgaggcggcggcgtacctggcccaggacccggcggcgcgcgacctgcgtgtcgacgccgtctacttctgcgtggcgctgacgcaggtggggctgctgcgcgagggcgccgaggacgccacgctggccgagggcgccgtgctggcggggcggctggtgcaccgctacgcccgcgagttcctgcccgtggacgcggaggtgaggagggtgttcctggggacgggagtgtggttgtagctgtgtctcaggacagaggggagcgaggtgggggggtgggtgtaaggggcagggcagtggcgtggcaggggctgcgggcctggcctggcaatgcatgggtcagaatggtggttgggggagt

SEQ ID NO: 46530 - DNA, 64 bp, Chlorella protothecoides
gtgcctgaggctcgcgccgctgccaagcaccaggtgctgaatcttggattccccaggagcaggc

SEQ ID NO: 46531 - DNA, 81 bp, Chlorella protothecoides
gccttacgacaggcacgcggtgcgacgaatgatcgtctctctccagtatcgacggccgcacagcggcaaatgtactgttgt

SEQ ID NO: 46532 - DNA, 68 bp, Chlorella protothecoides
acaattctgcaggtctattcatgcaagtcccgagcacccctccccgcccacctggatcaggtagtaga

SEQ ID NO: 46533 - DNA, 61 bp, Chlorella protothecoides
ttcccggagatcctctcgaggcgctcctcctgcgcggctcaatacgcgggacccgagcaga

SEQ ID NO: 46534 - DNA, 61 bp, Chlorella protothecoides
gcatcgccatgggcgtgacggggacggagggggccaaggaggcagccgacatggtgctggc

SEQ ID NO: 46535 - DNA, 61 bp, Chlorella protothecoides
acccaccggatcggtctgcgcgaccaaaaagtaacaacgcgctcggagtataaaggcgaag

SEQ ID NO: 46536 - DNA, 69 bp, Chlorella protothecoides
gggccttgcaaaggtgacgcctcactggagtcagtggaacagccggcatctgcggcggtcttccctact

SEQ ID NO: 46537 - DNA, 63 bp, Chlorella protothecoides
ctcccggggcgatggtggacgtcgaccctggcctgcaacctgtggccgcggacgacgatcgta

SEQ ID NO: 46538 - DNA, 61 bp, Chlorella protothecoides
cacaggcagacttcaacggtattcttcaggaaattcaaccgactctgctgacccaaacaaa

SEQ ID NO: 46539 - DNA, 78 bp, Chlorella protothecoides
cacttggtcagcatcaggatgttcaccgctgcattcacgtcccggttgacaacgttgagggattgtacaccaagcttt

SEQ ID NO: 46540 - DNA, 371 bp, Chlorella protothecoides
  modified_base (90)..(315): a, c, t, g, unknown or other
ctctattgggccccagccagcctgagcaagtccccacacagcaagttgcatgtcatttcgaaacgcactgcactgcacccagcatcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtgtttgcactggggtgatcgatgtcagctgatcaagacgctcagccagccacc

SEQ ID NO: 46541 - DNA, 100 bp, Chlorella protothecoides
cgctgccgaccctcagggcaccatggaccgcggtttcttgatccagggagcccccctccccccccccaccgccccagggcgaggagatgacggtgcgcct

SEQ ID NO: 46542 - DNA, 67 bp, Chlorella protothecoides
tgacaaggtttctggtcaagtctgggcaggcgacgacgggcgcggacagcaggcggtcgcgcaggcg

SEQ ID NO: 46543 - DNA, 61 bp, Chlorella protothecoides
cgacagacagaatcacgcccagaaagcacggccagcccctccagggccacaggtgctgcac

SEQ ID NO: 46544 - DNA, 61 bp, Chlorella protothecoides
gaggcctcccggtaggaggggtggggggggtggatgttgggcagacgcctgtcatcctgat

SEQ ID NO: 46545 - DNA, 61 bp, Chlorella protothecoides
gttcgattccaacacctcacccccatccccaccaaccacacctgttctgagccgccaagtc

SEQ ID NO: 46546 - DNA, 62 bp, Chlorella protothecoides
tccacggatcggagttcgctctgacattctattacaaccgtgagcacatctcacgacgatgt

SEQ ID NO: 46547 - DNA, 61 bp, Chlorella protothecoides
ataacagattgtcgatggcgtacaagaagggggataggcctcccatgttttcccaaaggct

SEQ ID NO: 46548 - DNA, 64 bp, Chlorella protothecoides
actgtgtcgtgcgcgggacttcgcgcccagtgatggatctgacgccagggtcctggtctcggac

SEQ ID NO: 46549 - DNA, 76 bp, Chlorella protothecoides
gttgaggcaggagtgtggccctgcactctccatctagcaatgagccggacctcaggacgggagagagctgcaccca

SEQ ID NO: 46550 - DNA, 143 bp, Chlorella protothecoides
aggccctgtgcttggctggaccgttcatcgccgatagtactcccaatacgggattgaagggccctcacctccgggagatcgacttcgcgaggcgcaagaagaccaatcccagcgcggcccgcacggcgctcacccggtgtctg

SEQ ID NO: 46551 - DNA, 90 bp, Chlorella protothecoides
agggctacgaccccaaggccgtggagaccgcctggtgcgttggatggcgtgtcgttatgggtgttggatcctgtggggcggctgggtgct

SEQ ID NO: 46552 - DNA, 68 bp, Chlorella protothecoides
tatatgcgacatttcaaccatcactccaagcgacggttggctcagcacctgaacggactgaacggctc

SEQ ID NO: 46553 - DNA, 61 bp, Chlorella protothecoides
catgatgaaaggtcgagaaacctgtctcccgtagacatcgtgccagctctacgattcaaca

SEQ ID NO: 46554 - DNA, 86 bp, Chlorella protothecoides
aggcccaggcacacaggctggcgccgaccagggcgctgcccagggtcacgagggtctcccgcccgcccagctggccctcgacggct

SEQ ID NO: 46555 - DNA, 61 bp, Chlorella protothecoides
tccgctgggaatcgctgtccgatgactgggcctcctctcccagagagtggagctcatcatc

SEQ ID NO: 46556 - DNA, 72 bp, Chlorella protothecoides
gccatccggagctggcgacgctgcccatacgcctatttttttaagtctttgttctccctcgagccgaaaggg

SEQ ID NO: 46557 - DNA, 61 bp, Chlorella protothecoides
atcagtcatggagcgcagcgtgctgggcgtaccctcctccgccgggcccatcatcctcgtg

SEQ ID NO: 46558 - DNA, 1714 bp, Chlorella protothecoides
tcctggcctgagcaccacttgggagggctccccgttgattgctgcacggctcgctcttgcgccttttctcctttcgtcaacctgacaggctcgtcatacgaacacacacacccggctgcgtacgcttgagtgtaatgtcttccttcttgtcccgcccatgtgcaccctcgtctcaaaccccacatccccacacccttttccaagtctggatccacctacatgccacatgtgtccacctgggcatttgctgacactctgtgacacatccagtgaaaaccctggacatcaaccaacacgaagttcaaggccctgaccatattctgcacaggagatgtttcagtatggcaggtttccgaaaactgcttgatccgggaagaccggccggaagaactgcggaaagctcagaatccgaggtctcgagcctgaattttcgtgctgacctggcagtaccccgcggcgcctggggccactggcgcacgttgagggcgggataagcaagtgcggaaacaaacactgcaacggaggcagtggtattgctctcgtatctgcttgggttagcgcttactcgaggcccactccaggcatcgaggattctcgaggggtcttgttccgtaagaggtgcagcgcgaccccaaacctgtacagaatacggtcgttaaagcgttacttagagttgtattcattcagatcccctaggacaataaatctagctcgggactagatcaaggggagtgctgtgcatgtggggcaacccccggtttcgcggatttccgccccggacacttcaaatgcgtacagctcccaaagcggcaacgcggagtggatatgttgttacacggtgccaggatcctatatatacgatcaagccgctcgggaattaggtcagatctcgaccgcatcgtagagcgaaggctgcttcccctctgaacgcagacaaagattatccgccggaccgtgagttggccgcaaagtgcaaaatgccgtcgatggtcaggatcccagccatcctgagtgcactggtgctgctactcgccagatgtgctgttgcggtgagcctgggagcactcgaaggtatgaagactccgcgtcacccatacccttctcacccctgaatcaatacttccccaccacatgcgtcctcgataggagggcaactgcagctccacattcatcgcgctacccagtgtcatgtgagttgaggtttgtgtccatccggggaatgcgtgcaactgtggcgatattcccgatccgtcgagctccctctcgtccaaggcttcggctgacggatgtccgtcctcccacactccaatgggaatccgcaatgttgctccgttaaacctgcccttgcacactgatttttcatatattcgaggagtatctgcattccttcgcgtagttcatttacccgcacatgcacgagtccttgcagccttggaccccatgtgctttttgtgacggaggacagcgcgcgcagatgccgtttgcatgtgagtaaccctcgtgatgctgctgtgcaggcatgtgtcggccggagatcgctgagctgggctacgttcttcacgatggaggcaatccgacttttcacgcacacccagtcatgtgccactcagtccatgcaccaaccccctccttggcatgcaggcatgaaggcttcagcaaggcggggtccgcccgcacctccactcttcacgtcatgggactgtcgatgtcggcg

SEQ ID NO: 46559 - DNA, 63 bp, Chlorella protothecoides
ccagccctccttccaggtgacccccccccccctcgcaccttcatccagcaggaggggggccag

SEQ ID NO: 46560 - DNA, 114 bp, Chlorella protothecoides
tgtatgcccaccaacccacgcatgcaaaccctttcacgccgccccacgctgcacactggtcaatgagtcgggagagggtgcctctgcccagcaagctctcgctcgttgagtgtg

SEQ ID NO: 46561 - DNA, 70 bp, Chlorella protothecoides
agctcccgcacgtggcaaagcacgccgcatccgctcccatgttgagaggggaggcggcaagaggcggcag

SEQ ID NO: 46562 - DNA, 102 bp, Chlorella protothecoides
cacaatggtacccgtgactctcattgaccactccctacaaccatggcacaagccctctctgttgctagcttcactgccagccaaatttgtgtcacctgacct

SEQ ID NO: 46563 - DNA, 61 bp, Chlorella protothecoides
caggcccagcaggatgccggccaacaggataaatccggtccaggacagcgctgccttggag

SEQ ID NO: 46564 - DNA, 61 bp, Chlorella protothecoides
agagcgcgcgcgatcttgacttccgtgccctgctcaaacgcgttgctgatcacagccgatg

SEQ ID NO: 46565 - DNA, 95 bp, Chlorella protothecoides
tgtgggacctttggccttctcagcgctgctagaacatgcacccagcccccttcccacctccccttcctgcccatcaggtgcggctgtccctgctg

SEQ ID NO: 46566 - DNA, 96 bp, Chlorella protothecoides
atggagagcatgagcgcggaggacatggcacgcatgatgagcttgatggggggcggcgcgggcctgggcggcgcgggcggccctcccacgccaggc

SEQ ID NO: 46567 - DNA, 101 bp, Chlorella protothecoides
ggagttctcctccttgctacaccgggtcacttggaggcggggcattggccgaggaaagggccgacccccgctgcggaactggtgacatggcgtggcaagct

SEQ ID NO: 46568 - DNA, 12935 bp, Chlorella protothecoides
  modified_base (599)..(608): a, c, t, g, unknown or other
  modified_base (883)..(892): a, c, t, g, unknown or other
  modified_base (1914)..(1923): a, c, t, g, unknown or other
  modified_base (2893)..(2902): a, c, t, g, unknown or other
  modified_base (3152)..(3161): a, c, t, g, unknown or other
  modified_base (3462)..(3471): a, c, t, g, unknown or other
  modified_base (3794)..(3803): a, c, t, g, unknown or other
  modified_base (4258)..(4267): a, c, t, g, unknown or other
  modified_base (5222)..(5231): a, c, t, g, unknown or other
  modified_base (5818)..(5827): a, c, t, g, unknown or other
  modified_base (6913)..(6977): a, c, t, g, unknown or other
  modified_base (7738)..(7747): a, c, t, g, unknown or other
  modified_base (8711)..(8720): a, c, t, g, unknown or other
  modified_base (9116)..(9125): a, c, t, g, unknown or other
  modified_base (9606)..(9686): a, c, t, g, unknown or other
  modified_base (10176)..(10185): a, c, t, g, unknown or other
  modified_base (10858)..(10867): a, c, t, g, unknown or other
  modified_base (10934)..(10943): a, c, t, g, unknown or other
  modified_base (11809)..(11818): a, c, t, g, unknown or other
  modified_base (12002)..(12111): a, c, t, g, unknown or other
  modified_base (12262)..(12271): a, c, t, g, unknown or other
ccccccccccaaccccctccacgcacacacacacacaggagttcaacctgcacctgaccggggacatccacgccatcaccgccgcgaccaacctgatggcagcggccatcgaggcccgtgccttccacgaggccacgcagtctgacgccgcgctgttcggccggctatgccccgccggccgcgacggtgcgcgccgcttcgcgcccatcatgcgccgccgcctggccaagctggggctggagggcgcggccgaccccgacgcgttgtccgaggaggaccggcgccgcttcgcgcgcctggacatcgaccccgccaccatcacctggcgccgcgtgctggacaccaacgaccgcttcctgcgtggcgtgaccctgggccgggggcccaaggaggctgggcacgagcgcgagtccggctttgacatcgccgtggcctcggagatcatggcggtgctggccctggcggggtccctgccggacttcagggagaggctgggggccatggtgtttgcctccagcaaggccggtgagggggaagggggggagaggggggtgggtggcttactgtctgcgccggcggcggctgggaagggaaactcnnnnnnnnnncgggggggaggggggggtgggtggcttactgtatgcgccggcggcggctgggaagggaaactcgtgagggggaagcagaggatgggtgcaggatgcgacagccttgtggggagtggggatgccttgggccagaggggtttcggtcgcctctctgagcaggcatgtttgagcccatgaagcatgggcggtggccctgggacttggttctccaacaacgggcggaggcgactgctgacggccccaaaccggcttccatttgtttgctgaccctctannnnnnnnnnaacgcgacagccttgcggagagttgggatgccttaggccagaggggactcggtcgcttctctgagcaggcatgtttgagcccatgaaacatgggcggtggccctgggccttggttctccaacaacaggcggaggcgactgctgacggccccagaccggcttccatttgtttgctgaccctctaggcagtctcgtaccctcacctgcctccaaacacctcgccccattgtccgccaggcgagcccctgacggcggatgacctgggcgtgagcggcgctctggccgtgctccttaaggacgccatcctgcccaccctgatgcaggcgagatccctctgtttgtatcaggaggttgaggggtggaaagaagggcggggccgcacaccggactgctcgccggaggagtccattgcgcagctcgtcgggcgaggctcgactgtcctgcctgtcgatcctatggacagcgtgtctttgtgtgccggtcaccctcttgaccccggcaagcctcgggggaggggggcgggcaatgacgaggcgtggcaccttccacccaaccccgccccttgcaaagcccatcccaacaccacccgcccctcctcagaccctggaggcgacccccgtcctggtgcatgcggggccctttgccaacattgcgcatggcaacagctcggtgatcgccgaccggctggcactgaagctggtggggccggaggggtacgtcgtcacggaggtaagggttggcatggtggggtgttcaagaggagggggaagggagtttgagccccgggtacagcgccagaagctgcaggtttgcactgtgagcggggcatgaagcagcccaaaccctttcaggggctgggcccccgcaggcgctgcttcccccagcctgtagtacctccttgttggagtcccccccacctcaccgctgcggacaacccccgaccccaatccgccaccaatccatttctcgggtccacccactcctccacccacacctctctccataaccctcccctctcccccnnnnnnnnnnagtccacacactcctccacccttacctctctccataaccctcccctctccccccatcaaaaggccgggttcggcgccgacatcgggctggagaagttcatgaacatcaagtgccgcgccagcgggctcaccccctccgccgtggtcctggtcgccacggtgcgcgcgctgaagatgcacggcggcggccccgcggtcaccgccggccgcccgctggcccccgcctacaccagcgaggacgtggcgctgacgcgcgcggggtgcgccaacctggcgcgccacgtggccaatgccgccgcctatggcctgcccgtgcttgtggccataaaccgctttgccaccgacaccgacgccgagctggaggcggtgcgggaggaggcgctggccgccggcgcgcgtgcggcggtggtctgccgccaccacgcgctgggaggggagggtgcggtggacctcgcccaggccgtggtggaggcctgcgccgcgccgcggccggagttcaggttcctctacccaccagagatgcccatcgaggtggggagggtgtgcttgggtggggtggacgggggggaattattccagagagtggcgacatgcatctcaagggcagtgagttctgcggcctgctgcataggcagggctcgcgagcaggacaagtggcgtgcgacttcattgacgctctccagtgaagacgcgtgtgtgcctgctcacggacgagtgatcccacccattcccgtgcccccccccgcgcaggagaaaatccgtaccattgcggtgaagacctatggcgcggcgtcggtcagcttcacgccagaggcgctggcctccatcgctcgcttcaccgagcaaggatttggcaacctgcccgtctgcatggccaagacgcagtactccttcaggtggggccgagggaggacggataaggggggggaaaggagggcacacagcagatgtgcgctggcgcatggaggctnnnnnnnnnnaaaggacgaaaagggggggcggaaaggagggcatacagcagatgtgcgctggcgcatggaggcttgtgcaatgacaggccggaggcccgtgctgccagctcgtatgcagctgggatcaagtctggataggagccgccgtgcacacctctcccttcccatccgtcctcttccccccttaccagcaacgaccctgccgccaagggggccccttccggattcgacctgcgggtgcgggaggtgagggccagcnnnnnnnnnnattctcccttcccatccggccccttgccccctttccagcaacgaccctgccgccaagggggcacctaccggatttgacctgcgggtgcgggaggtgagggccagcgcgggcgccggcttcatcgtcccggtctgcggggacatgatgatgatgccgggcctgcccacccgccccgccttcttcgagatcgatctggacacggccacggggcgcgtgctggggctgtcctgagcggcaggcagacgcggggcggtccggacactgcgtgcgccatcttggagcgttgccagggtcccgcaannnnnnnnnnacccgccttctttgagatcgacctgaacacggccactgggcgcgtgctggggctgtcctgagcggcaggcagacacggggcggtcgggacactgcgtgctccatcttggagcgttgccagggtcccgtaataaagtaccgccctctcgccctgctcagcatgcatgatgtcttgatgatacgtaagaaggtatgctctggtgataaaagcatctgggagcgccccgtgtgtcacactcagatcctcgtcgtgcccagcatggcaagggcgcggctcgctgattgattccggatccgcgatctgcatcagtatacgcacaagannnnnnnnnnctcttgatgatacgtaggaaggtgtgctctggtgagaaaagcatctgggggtgccccgcgtgtcatcagatcctcgtcatgctcagcatgggaagggcgcggctcgctgattgattccggttccgcgatctgcatcagtatacgcacaagaaaccactgcaacgctcgtcttgcaatgtctctaagctagatcatgtactgcatctcgaagccgcaatggcgtggaggtctgtcttcacactcctgcgtcgggggcagggccccttgtgccggaggctcagcaccgatgctcccgcggggacccacctcgctgtagagtactggtgggtgccgggcgcggcttgcagggcaccatctcaacttgatcagtatgctatacattctgcaatcggtgccctttcaaccaagcaagaatcacaacaacattcccgccctccctgcagcgtcctatgtgnnnnnnnnnnacatctcaacttgatcagtaagcgatacattctgcaatcggtgccctctcaaccaagcaagaatcacaacaatattcccgccctccctgcagcgtcctatgtgactaccaacctcgattcgacatcctgaagaatgttgtgcgcgcagccttccccaagctccccgtatttgcggacactgaggtatgcaggggttgcagagtgattcccctgcatggctgctgtccctcagaacatgtactgcagatgatgaatgtggcctgcaaccactgcgacacactcagcaactcggcctttctcaggatcacagaccgggctcctttgaggtcatcctgcaccacaaggacgaggagtttgaaatctggtccaagctgttgacaggtgggggggtgctggaggcatgggtctggccatgtgcaaggctgaatgtggagagtggcactgtacatgccggacatccaagggatggcccctatgactcaccctattttatgatcctcactggtctccaggggagcctgccgacgagatggcagcgcacagtgtcgctgagttggtggtggatgagatacggcgggccaaactgtgcctgtgaatcgttgccagctgacgctggcaactcgggccttctgaccagtaacatcggaacccgcatggcagtctccatcgtcgatgggatgccgtccagggttgcacggctttcaccacagggcttgaacctgcacacgtcaatgagcgggccctcaagctggggtgctatctactcaccaccatgccgatagtctagggcatcgacccaatgagtggctggggcgtaagaatatgtatatttacagcgctagcacatccccggcttctgacccttctatacgtttgaaaccctcctcacacagaatgagctcacaagggtatccgccattgtttcctcttttcctgctcctctgcgtgactcgtnnnnnnnnnncatttacagcgctagcgcatccccggcttctgacccttctatccgtctcaatccctcctcacacagaatgagctcacgagggtatccgcccctcgtttccctcttttcctgctcctctgcgtgactcgtgactgcgcttggcaatcgtctggctaacttcattatgacccaacccagagtgtgcttgtgttaaaccacaattctcaggctttgcacggtgaagtagtgaattgccaccctcagtgacaaccccaggcttgctttcagggagagtgtcgcctgggggaatatttgtgggccttctgcgcataacatttcccaatgttgaagacactctcttatccgatacagaattcggatgcaagaataggaccccaagattcacaatctctgtaaggtcggctgccacattttcgaaccctaactctttaaagcggaaatttgagaggtaagggaatgaattttaacgatgttcttctcgtctcttttttacaagcaatgaaatgtatattagaatgtcggaactgcgtgtcgatgcagagctgcactggcagcagcacggtcccagatcacccttgatccggccnnnnnnnnnngtgcaagaataggaccccaaaattcacaatttctgtaaggtcggctgccacatattcgaaccccaactctttaaagcggaaaggtcaggaatgaattttaacaagtaatgaatattaaaatgtcggaactgcgtcgggacatgttgtcgacgcatatgagctgcactggcacggtcccagatcacccttgatccggccgcgggtccgcgccgctcccgttccgtgcatgtattgagagccctttgtgtcttccccactagaccccaaaatcgtttgacacaattatctctataacattgttcggcgccctcgtagtcagagtgcggggatatcaataatgtcgggcattcgcagtgccctgacgtctgccctcacgggagtggcacagacgttcaagcccaaggtcgctgccgacagcgaggcgttcccttgcctggatgtggatactgtgaccagtgagatggagtcgatggccatcaacgctgccaggatcccaagcagcgcccccacgcgtgtcggggcggaccaggtgagccctcgggagccaaccctggccgtcgggaggggccccggcccggtcgccgacacaccgttcccaatcacaatccccccaaattcccatgtgtaggtcgattacaccctcagtccctacggtcggcgctccgggacggaagcagtgccgtcttcgctggtgggtcccactctcctcggtgtagcttggcggggtggggggtgccgtccctgtggcgcgcacggtggtcccagccacctccattcaccctcgtcagcccctcccttcctcacgccgcagagcaagaacagcgtgaagtctaattttctaacccaggacgtcatcggcagcctgcccaagggcctgaccaggacggagaaggaggccgtggcagcgagcaccccgctgtccccctccctcaacctcctcaactccctgcccaagggccaggtcttcaagcgctccgccgcgggggtggccctgcgccgcagcgtcctgcgtggctccgtcatcgtcttcattaccgccggatacactggtgcgggacagggtgcaggagtatcaaggaattgggnnnnnnnnnnnnnnnnnnnnnnnnnnnnnnnnnnnnnnnnnnnnnnnnnnnnnnnnnnnnnnnnncgccagtgcggggagcccaggcagaggttttatgtcgtgtactggtgccgcttgcatgcttatcccaaggccccaactgcgaaacatgccggctgctggcagggcgtgccattcacaccagtctctgaggagtgtcagggaagctctccggtactcattcaggcatgacactccccccctattccccctgccctcccaggcaaacgcttcatcttcgagcgtgccaaggagctgggcgtgcgcagcctggtggtcgacgggccagactcctgggccaaggtaggctcgtctgctgatgtcttgatctgcagttgcctggtgggggcctgaagaggacattgcatggggcctagctctccatatcagatgaagagtgttggcatgcccattgttaagaggtggagtcctgctgactccgtgccttccctccacgccccaccatagaccatggaggaggagggcgtgatcgagaggttcatccccctggacatgtctgactcagacacggtactggaccgagccctggaggccatcctggctgccaagaaggtaagggaggtccacccaaagggaacagggtcgtgaggcgggtagggagggctctgacaggctgttgggtgtttaacttttgggtgagggaagctctgagactgattggaacacaccatgatctcaccactcatccattacctcaatctcacccacccatcagcccatgctagtccggaattcacaccctcactacaccctctcacatcttnnnnnnnnnngaaagggaacagggtagggaggcggatagggagggctctgacaggctgttgggtgtttaatttttgggtgagggaagctctgagactggttggaacacaccataatttcaccactcatccattacctcaacctcacccacccatcagcaatgctagtccggaaatcacaccctcactacaccctctcacatctttggtaggccgtgggcggcgacctggacggcgtgctttccttctccgaaatggcccagcccctggtggcgcgcctggccgagaagctgggcctgcagggccccagccccgaggtggtggatgccgcgcgagacaagttcgccacgcgcaagtgcatggaggccgctggcctgcccacgccccgcaacatcctgatcgagaaggctgaggacattgagaaggtgggtgaagggggaaagggggggtgaggtgatgggcgatcgctcaatgctgggcagtgggcgggatgtgactgggtggctgctgcctcggtcgtatctggtcccatgttctgctgccgtgggagcctgaccctgtgcctcccttggacccctcacttcctccccaaatggaagccgccacactatgccatctctgaagctctgcagaccctcagccatccctcaacattccctgcccctcactccctcgcaggccgccgagcacgtcggcttccctgcagtcatcaagcccatcttcggcgccgcctccatcggcgttgtgcgcgtggacaacctggcgggcctgcgcgccaaacacgcggaggtgtgccgccagatgtccagcgcgcgcgtcgtggacggcgcgctgctggagggcgacggcgaggaggaaggcgggaacgcggggggctggatccagaccacgctgatgatggaggagtacatggacggccccgaggtggacgtggatgtggtgatgagcgaggggcaggccgtgtacggcgcggtcnnnnnnnnnncgtggtggggatgattgtggacttagggtgcaatgctcggcgctcagcgcggggtggcagtgggggtggttggtggcgaagacctagccctctcggtgcagtgcccccctcagcccgcgtcatggccggttgggggccagcccctctcccgtccgacccccgaccctcgacccctcccttcatgcgccgaaccacaggtggattatgacctgaacccttacaaccctcgtggcgggcgcgaggtggtgcccacctccctggtaggtgactgcttgcattaagggatacctgagggtccatgtaaagtgcgtcttgccataagcgcattaacccctgcccacgccatggcccccctcactcttgccccccccccttcccccccttttcctcagaaannnnnnnnnnggcgcattaacccctgcccacgccatgacccccctcactattgaaccccccccttcccccccttttcctcagaaatcctcgagcatcaagtccaacttcctgaccgaggccgtgatcgggtccctgccacggggcctttcgcattcggagcgtgagttcatcgtggccaacacgccgctgtctccctccctcaacctgctcagctccctacccagggaccaggtatctgccaggtccgtggaggggcgcaccctgcgccgccacgtactgcgcggcgccgtcatcgtcttcatcaccgccggatactcgggtgggcgttggtggtgttggtggtgggcgaattcaaagtcagactccattgcatgggtggaccgagagggtggcagactcccatcggaaccctttttgagggtcacttttgcattcggctgtggtctggaaactggcagtacctctcctgctggtcaggatccctccttgnnnnnnnnnnnnnnnnnnnnnnnnnnnnnnnnnnnnnnnnnnnnnnnnnnnnnnnnnnnnnnnnnnnnnnnnnnnnnnnnngcaaacgcttcatctttgagaaggccaaggagctgggcgtgcgcagcgtgctcatcgacggccccgactcctggagccaggtgggttgggcggagtggtttcatgacagccctggcaccagtggtggccacggcaggcctgggatggacttggatgaagacgctgctgcgtgatgtgagctcgatcattcgctctgtcaatggctacatctgcctgattcctgctatccccctgctcctcctcataccctcgtgagctcccccccccacaccacaggagctggagaccaatggcatcgtcgagcgcttcattggactggacatgaccgatgccgactcggtctttgaccgcgccctggcggccattgagaaggtcaagaaggtgagcattcttgatgtggccagggttggggaagtgctgacggcctggcatggcgtggaggtcatgcctttctttctagatgcagactgcagtgcaatggtcggcgctnnnnnnnnnnagaagtgccgacggcctggcacggcatggaggtcatgcctttctttctggatgcagactgcagtgcaatggtcggcgctgcagcaggaggctcatggaacctgccatttcctctgatcccatgggatggcatcccattaccatctcccccccctccccccctcctcctcaaaaggattttggcgagctggacggcgtggtgtccttctcggagatggcccagccgctggtggcgcggctgatcgagaagctgggcctgcccggcaactccagtgcagcggtggactccgcgcgcgacaagcacgccacccgtcgctgcatgtccgaggcggggctgccgacgccgcgcaacttcctgatcacgcgcgaggacgagctggacgccgcctcccagctggtgggctaccctgcggtcatcaagcccatccacggcgcggcctcgctcggcgttgtgcgcgtggacgaccacgaggcgctcctgcgcgcctacgcgcgcgtgcggcgcgagatgggctccgtgcgcgtgcactcggggatcgtggagcagatggcgtcggacgacgagggggagggcaacttcaccaccacgctgatgatggaggagtacctggacggcccggaggtggacgtggacgtggtgttcagcgaggggcaggccgtgtacggcgcggtcnnnnnnnnnncagcgtgaagagcgtgcaggcgctgggcttcagcgcgggcgtgttccacgtggagtgcaagtacacnnnnnnnnnnaccgacaactggcccacgctggagccgtacttcaacgagaccgggtccaactcgccctccatcctgcccagcgcgcagcagcgcgagctgctggagctgggcgtggcatcggtcaaggccctgggcttcgacatgggcgtgttccacgtggagtgcaagtacacctcgcgcggcgcgcgcctgatcgaggtcaactgccgcatgggcgggggccccgtgcggaacatgaacctcctggtctggggcgtggacctggtggaggaggcgctgctggctgccgcgggcatcccctcccgccccaacgtcgcgtcgcgccccctgcgctgcctgggcgagtacctggtgaacgcacccaagaccggcgtgctgggcgacctcggctttttgcgcgagtttgccgagcgcaagggtgtcctgctggccaagccctgcgtcgcgccggggtcaaaggtggtgtgcgtggctgacggcatgcccacctggctggtggagctgcaggtggaggcagacacgccgcgcgccgccgtggccctggccgaggcgctgagcaaggagatcacggagcgcatccccatccactgaggtggccccaacccgcgggcacggcgttcgagctgacttcgacagaggaggggcacaccacgtagcgcgaggtcacgaacaagttgtccctccgcgtcacgcacggtcccctcccccaaccctccttgtctcttcccctcccctagataatctccataccaccttgaacagaaaaaccctttcctgcgcaccccctttttcgacgctgacactcccgcgcttgtagccactcactcgcttgagtgtttcaacccgagaacccgcactcccatgtcaccactttnnnnnnnnnnaaggggcacaccacgtagcgcgaggtcacgaccaagttatccctccgcgtcacgcacgatcccctcccccaaccctccttttctcttcccctcccctagattatctccataccaccttgaacagaaaacccctttcctgcgcaccccctttttgacgctgacactcccgcgcttgtagccactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacaaatcaaagagtgcactgagctggtcaaggggtagaggggtgggtggatcgccaggtctcgtggatcatgctacacgtgcgagcaaaatgggctctatgccgcggcggcccttcccccgcagctggtcacggcgcgtggccagggcnnnnnnnnnntaaaggagatctggggttgagagatcccaacacaggaaatgcccatgcacgccatggtgcccgacgggctgtgatcgggaggccacaaaaaaatcacaaattaaagagtgcactgagctggtcaagggtaggggggtgggtggatcgccagggctcgtggatcatgctccacgtgcgagcaaaatgggctccatgccgcggcggccttcccccgtcaccgcagctggtcacggcgcgtggccagggcgcgggctccaagtcgcaacgtgaagcccaatgcgggctgttcatcgtcaaagtatagcgcgtgatctcaattgggtattccccttcctgtcacgacttgcccaccatgtcgggaatcaagtccgcactgactgcagcactgtcggggtcccccgccaagccggcacaggctcggaccgccggcaaggtggactccgagtccttcccatgcatctccgagggtgccccgctctccccagagcaggccgcggagggtttggcagccctcgacatcaaccgggcgaccctgcccagtaacgctcccaccctgtcgcgcagcctggacgcctccaggaccgtggtgcgtgtggtgggatgattgtggaccttgggtgcgatgctcggcgcccagcgcggggtggcagtgggggtggttggt

SEQ ID NO: 46569 - DNA, 81 bp, Chlorella protothecoides
caacctgtacaagtgaggggtcgggggtgtctgttgcgattgcttgggcttgccatgaaccctccctggccacagaggttt

SEQ ID NO: 46570 - DNA, 61 bp, Chlorella protothecoides
ctgcgggcatgacggcagggggtggcagggggagccgtgttccgcgtgcatggggcccacc

SEQ ID NO: 46571 - DNA, 113 bp, Chlorella protothecoides
ctgagctgccactcgaacgtgcccccccaaaagccccattgcagtaacccgtgtcctctacgtgccactgttcataggatgcccattccccacttccagcaatctgaatcatg

SEQ ID NO: 46572 - DNA, 78 bp, Chlorella protothecoides
tgggctgatactgcactgggcaccacctgcagtggatgcggggcaaccccaaggtcaaaccacatggccttcagcacc

SEQ ID NO: 46573 - DNA, 61 bp, Chlorella protothecoides
gtcgcaggcctccttgagcaccacggcgtcagcggtgaacaccacggcgtcgttgaccagg

SEQ ID NO: 46574 - DNA, 61 bp, Chlorella protothecoides
ctcaaccgctatgacgtagtgcgcaccatcaccctccctgcatgagcgacacgtgtttccc

SEQ ID NO: 46575 - DNA, 66 bp, Chlorella protothecoides
acgaccacgtctgccctgtcacccctccctgccctgccctgccgacaccgagccatggcacgcacc

SEQ ID NO: 46576 - DNA, 61 bp, Chlorella protothecoides
gaaggcctgcggcctcctggacgcccgcatttgacgctggcaagatggctgctgatgggga

SEQ ID NO: 46577 - DNA, 67 bp, Chlorella protothecoides
atcttgcccagggactgcccatgtaaaaaaacgatcacagaggctgccagggcacccaccattgcag

SEQ ID NO: 46578 - DNA, 12684 bp, Chlorella protothecoides
  modified_base (1885)..(1894): a, c, t, g, unknown or other
  modified_base (3000)..(3009): a, c, t, g, unknown or other
  modified_base (3197)..(3206): a, c, t, g, unknown or other
  modified_base (3927)..(3936): a, c, t, g, unknown or other
  modified_base (5040)..(5049): a, c, t, g, unknown or other
  modified_base (6037)..(6046): a, c, t, g, unknown or other
  modified_base (7788)..(7797): a, c, t, g, unknown or other
  modified_base (11739)..(11748): a, c, t, g, unknown or other
  modified_base (12337)..(12346): a, c, t, g, unknown or other
ggcggcggcggcggcggcgacggtggccgcaggatggactttgtcggggcctcggggagcaagcaacgctgaggtggcatgatgtggtgtgatgtggcgaggtttggtggtgaggggtggagtgcgcggcgcaggtcgggcatggacggtgctttccgccaatctggctggaggggtgtgccaagcttggagaggcacaactccctccaatgcccacgattactaccatactcagcggcctttcagtgctgctctgcaacagaaatcgtacagtgcttcccctctgcccgtccatgtaactctcactgtcatgcgacatggcctaaaatatacagcgagcaacaccaggtcgcccatgttgtcatgaacccccagagccatggtacaattccccactacagccaccctcagtcctccatgaggatgaggggcgcgagcttggccgggtcctcccgcacatgcgacgcggtgcgcgactgggcgcccgccccctcccccgctgctggcttctgaccgcgagaccgccctgcgtccagctctcgcagcacctcaggggtcacgaggtggtgactctgccggctgagcaggcggcgcagggcctccttgtcctccgcccggatctcattcttgtaccgctgcacgaagcagagcagggcctggtgccagaccacaggcagggcacgctcctcgtgcgcgaagcgcgtgaagtggtccaccagcgcgtcgatgacgcggtagggcagcgcgtacttcttgtccagcagcacgcggatgaagaagctgttggtgccgctgtactccatctctatacgtcgtggtgggggggaggtcatcaaagaatgggtgaataattgcggtgggatggaggccggggtccctcccgcaatgggtttgtacgtactacaccctgggtaggcatgtcaaccatcatactcttatagaaaccgagcctcgcaccagcgatgcgcaggagggcggcggcggagtgcaggacggggatgctggtgcggcgcaggacgctggagaagatgacggcctcacgcagggtgcaggagccgtaggagcagaggggcaggagcaggcctttatagaaggcggctgccttgtaggtagccttgcgcagggcctggaagagggcaaagtgcagcttcttgttctcccggatgtcgcggcggaccgccgggagcagcaccaacgctaggaagcgctgactctgcggaatggcattggggttggaggggtgggggcaatgagcatgcagcgtacttgagaatgagccaagctgtgcctcaaacctcattctcatactactccttccctaggaagcggcagacaaacccagcaaagcctttggacacacacccaaggccagttcatgccagcaccacttggacccaggctccacctcgccagaaagaacaattacaacctaccaggcgttgattgaggttggagacaaagatgcgggtggcctggtagatggcgtgcgggctccaggcctctggctcggtcagggccaggacctcctcccagttcttcagggtggggatgaccttgaaggccttgggcagcttgcccacggtgtagcgcgacatcagcgcgcccacgccccggaagatctccaccaaccgctcgtccagccccgcgggtgtgactcgggtgctggggtcagatgtcagcctgaggggcaggtgtgagggggggtaaaggaaggtgaggccggggaaggatggcagggtcttgtggtcattgtccatgctggaggcttggactctatcatactgctcgcaggcatggggcggacatcgccaatgaacaagggggcagggccaaagcgagggttctgagtgcactgtaaacgatgtggataccagggagcgggagnnnnnnnnnntatgggggggacatcgccaatgaacaagggggcagagccaaagcgagggttctgagtgcacagtaaacgatgtggataccagggagcgggaggggggatgctagtagcgttcgcctcctcacacacagacccccatggcacccattcattctcgcaagtccgccacttcagcgactgggcggtgggtttccgcccatgctgtacactaggactgcatgcaggttgaggctgcccacatgcgcgacagcgcagcgcagatcgtgcaattcacttcggcccttcacaggccaggcatctgctattgtattcccactgacccacagaacccaaaataaacgtccccaccctccacattcccaaaccctttcttcctatgccgtcaagactcacccggtgccgccgcctgcctggccaagcttttcagcaacgacatcggccagggtcttctgttttgcgccggcggggcgcatgaaggcggccagcgcggcctcatcctcggggctgatctcctcctgatccagatcatcctcgtcaccccaggcactgccgggacccggggagaagccaccctcatcgtcgctgtcagactcacgcagggctgccagcgaggccgcattggaggccacgccggcgccctcgccggaccccaccgccgccatctcctcggcctgttcacgagccaccctcaggatgcggtggctgatgtcggctggcaggctctgctcaacgtcctcatcggcgctgttgtagccagcagcctcattgtcgccgttctttgtcctcttctggccccggggcttggtctgtgaggggcgtgaggaaggagggatttgcctgggcagagtatgaggctggcatctcccagcaatataggcacgccatcccggcctccaacaagataccctcacagacatacccgcacgccaaagttttctgggttctcgagctcatcgcccagattctgcttgtggtagacgtccggctgcctccgcttcttcaccatcctctacagttgtggaattgcacctcaagggacggggaatggctacttgtgtaccaaggcgggtatttcaataataattctgcctagtatagtcaggagttgnnnnnnnnnngcttgtgtaccaaggcggcgtatttcagtgaataattctgcctagtatagtcaggagttggtggcgcggcagatgtaatcggtaaacgtgcacttggcaaccgcggcgccggggcggtcgaggaggttttgtaagtcagacttcgagagtgacgctattcagaagataatacaacatgatagtccatnnnnnnnnnnggtatgtcagacttcgacagtgacgctgttcagaagataatacaacatgatagtccataaaataaggcacggggtaccatacaaacgcatgtaatatcctttgcatgcatgccacgatggtgggcctgcgagcgcgcccgtgccagcgcgccaaaacctcctgctgatctggtggtggttgcatggatgactgcatgtcaagcaatgctagtgtgcatggggtgcatcgtgcatattatttatccagtgaaatctcgacatcgcgacccatactgacgcatagagaacgccgccgctaggtcgcccatgggccctactgagagggacatggacgcggatgacgaggtccccatggcagtctctttgacggagcaggctggcaccactcgagccacgagggaaatcccatcatatcgacagaatctctccctggatggcccactaaaacctgtgcctgtcacgctcatcaccggctaccttggggcaggcaaaagcacgctgatcaacaggattctgaacacacagcatggctaccgctgcgccgtgctcatgaacgagtttggggagagtgctgatgtagagagggccctgatcaaggagccagaggtatgtttgggtcttgatcggttgtgtttggaggttgctgggtggggtgatgcatgagcatgctcctcaagggacatgctgttagtccatgcttgccagctcatggtgtcaggcnnnnnnnnnncgtgtttggaggttgctgggtggagtgatgcatgagctgctcctcaagggacatgctgttggtccatgcttgccagctcatggtgtcaggcccatttcccaaaattctttacccatgcagggtgaggaggcaagccccctggccaactgggtacagctggagaatgggtgcatctgctgctcagtgaagaatgacatggtcaaggcgctggaggcgctgctccagcaaagggcctccttcgactacatcctgatcgagaccacaggtgtgttgaggtttcagaagctgatggtgtgcagattctggcaacctgaaatcgtggacattgctgataccttacaggctgctccctcgagccctctgtttctgattctgcccacacccattgatcacattcccaccacggccctgcaggcctggctaacccaggcccggtggcagctgcactatggacggatgccgagctggaggcaggggtatgcctggatgcggtggtcaccgtggtcgacgcccgcaatatacgccgccagctggcagatcccccgggggagggtgctgaggtgtgcgaggcggccgctcagatagcatttgccgacgttgtcctgctgaacaaggttggtgctgctgatgtgggttggttgagtgaggcaggggctcacgctggacagcaaactgggccccgtgcctcgcaccctgagtggctgggctcctgtcctgtcagccagccgtgccctggcgtcgattcaacgccggctccccatgtctcctcgcctcgcgccatcaggaggacctggtgagcgaggaggaactgcgggcggcgcacgccgagctggccggcatcaatggctcggccgccgtcctggcctgcgctcgctgtggagtggacctgaagtacatcctggacaccggcatatacagcggcacgggccggctgggcgtggaggaggaccccgacgcctgccgccccggctgcagcgacccctgccaccgccatggcgtgtcacacggccatgactccaagggccagcaccggcgcgggcacgcgcccgacaccgtccacgcctcggacatctgggcggtgacgctgcgctgcgaaaagccccnnnnnnnnnntgcgcccgacacggtccatgcctcggacatccgggcggtgacgctgcgctgcgaaaagcccctggacctgcggcgcctgcggctgtggatggatggcctgctgtgggagcggcatccgcacggaccagacctgttccgggtcaaggccgtgctttccttggccggcgagggtcggcgccacgtcatgcaggctgtgcacgacctgtacgacgtcgtgccggccgcaccctgggccgaaggtgaggcccgggccagcaagttggtgctcatcggccggcggctggaggaggggcctttgcagcgggggctggacgagtgcgtggcgagctgaaaccgagggggttgaccgagctgtggcccactaatatccggtcttcttgctggccgaggcatgccgcgagcaggccatgggctcattacagtgcatggggccgggcaagggagggtaaaagtggggtaacgcgtgtgtgcaaatggccgtgtgcgggtggtcgaggtgtatatgaatgaatgtacatgtatgcaagaccacaatggtcattatggaaggggttgatcactgcatatgcaaatggaaagtagattgtactgactcagcctcgctgcctcaagtgaaaaacagtgcaaaagtgggtggggactactgtgaatccaacacgcctcgctcctcgccgtgcaagatgccccgagggcgggccggggagaagaggaggcggggtctgtcaaagcacgcgcagcgtgccccttgtgcaaccgcgcccgaagcacgcaggatgacaaccgccctgcgtgtctggcgagggagcctggggatggccacgctcagatcctgcgcccccggccttccctcctctgttgacgcgagggcccaggcgagagcgtccactttccagacgtccactgaccctttgactttgtcagcagagggtgggcatcagtgtgacagagcatgcctcaatcctgtcagacccccagagtgcgcctggannnnnnnnnnagaccctttgactttgacagcagagggtgggcgtcagtgtgacagagcatgccatcgatcctgtcagacccccagagtgcgcctggattcacgacatttgcatcaagcgtcggacctccccacccagcatgccatgacctgtcccacctccccggagctcacggttgaggacggggcggtggcatgtgccgtcatccacagccaggcacaccgtggcaacagagtgcggcaccaactgctcctcggagccagcctcgcctccctgcactgccgcggcaaacctgatgcggagctggaggcccagcccggagtcaagaacctgccccgcatcggcatggtccatgccgcacctgcacagcgcctgtgtgtggggaggtgacctcgagcattgatgcattggtttcattgcaacagcacgatctcagcatccatgcccctcacccaacctcgggggcctgaggccgtcagatgcgcatgcctgcaacacaccctagttgggtgtacctgctgcagatcgacctcctgcacacactcgaacgtctctgacaggcagcgaagctgtgtaacagacgagctggaaggggcaccatccacctgggtcggtggctgggactgctgagtctggttggtcactgcacaccagcttgcgtccctgccttccactgtcatccagagcagacatcgcagaagcgtaaagaaagtctcaaccatcacacctggccggtgttgaagctggtgaagcccagtgtacacgtccaggcagagcgggacctgcctcccaagctcctcggctgattgacacgctgcagcgtcggacacatcacacacctcggaccttgctcaggtgtcgtgaagtgtgtgcacctgtcacgcacagctcatcctcccgccactcgcctgggcgtccagtctgaaggatggattgtgcagcacactgttgcagaagaggaggtgtgcgagcctgatgccgcactgggtgcatcccgggccgccgtgagtgaagcaggggccccgggtcagaggctggaggcagggaggaagcaaggccatggcttcctgtgacgccagggtggcccagcccttggagacgagggcgaccttgcaggcccagtccgaaatggataaatttcgaaatacgtgcacgagcacgtcatcgggcagggccatctgcgaggtaccagactcgggattgggccgggattcgaatggggatagcggggatttcaagcaatgggatgtcaatagggatccagacacagtgaatggacgtgtggtgacaacgcatcgtatttgaagtaagacggtttctacaattcgtgaagcatgacgagagatcgtgcaaccctcgtgacgatcaaaatccaaacgcggaggatcttggtcaccgcgaaatgagaccgacccgggtcaatacttgattcccggtctaacgccaccctagcccaaacccgtttgcaaaaaagagaaaaataaactgagcgtcgcttgatcgggctccgagccccccacgcccctgagtgagggcctaatgttgatccttggcgtggcctttcttcggccagatgaacgtgcgaacgtacatcacgagacaaagtgttgtgttgtatcatgttaggagcggtgtagtatcgactgaactgtcttccagctgcagtcggcacacgctggtcgtgccgctgtctctggtccgctcaaggagggaattctcacgtccttcgcgccacagaggcagtcctgccccnnnnnnnnnnccgactgaactgtcttacagctgcagtcggcacacgctggtcgtgcccgctgtccctggtccgctcaaggagggaattctcacatccttcgcgccacagaggcagtcctgccccgtcaccaagcaccctacagatcactaccctccccatctgttccattcgccgccactctcttccccaccagcgggccatccgcctctgccgccctgtcttcaagcggcggcaatgcgccaccttcctaacctatctccctcgccgccacacctttccccacttcgtctcccacgttcattcctcccacatccttgcccatggctgccccacgacccagtggcgtgcagccagcactgactgtcccccatctctcttggaagaagctttattctcgttcgagctcttgccgttaccctcccaaaatgttgcccctgcccccacccaaggagaagttgcctcccacacctatgcaattgccaaaactgccaacaccccaccctaaacccctctctcactcccaaggagtcatcccgttcatctcagtagaagtaatctccattttagaggaattcatctccttcccctgcagagaagtggtctgcttttccacgcaagtgaaaatttcctcccccatttgaagcacggtactctgcgtccactacagagtagagtagagctatggcaaacactatgaatgccccaccttcccaaaaattgagacgtcaagctccagaaagattcgcaaaataggtcgtgatgatggcctgaagccgtttcgtagcgttttctgttgcggcattatattcgtgttctaaagcaactaatggctgggtgtactaacacactcgaccttgcatgtatccttagttctcaccaattagagttaacattgcctccactcaaacactcagtgtcggttagacaagggcgtaactgtcgagtttcccctcggtcatctccactctacctccctctcgctccggatgtccctgatggccaggcgaggcaacgatcatagggcgctcttgccttccgtcttcaagggttcctaatacacttcgctgtggcaatgagcgacgtaagctacagagtatccaggaggaattccgttaattatcgactgagtggttgtttcgtttccagacgagcctgcctccctccttacaagggtggcatgcgcaatggtcgcgccacggggtgaacagtgccgcaggaaggtccaagtaatacagcacgagaggataatggaatagtgcacggcaggactaactgacaaggcagagtggaccaagatgggatatggtttgcatgaccagtgagtaggtcccatcttggcgatcattacgggagctcggagatggcggcatcagagcagtttcgcgctttgtctccacagctgggatgttcatgcagcaaccaagctgttatcccaatgccttttccacgagatctgacaattcgcccaagagttcgcaatcgggtgtatcgtgttgctcctaagcagcgccctaccaccgtttggccttcgcacacccatagatatcccgttctcccgggatggtaaaggaagcttggaaattgaaggcgagtgtgcgtgcctatgaggcacagtgtacttgtagtcgagcatagaagaggacgctcgtcttagattcgagctaataccctgttcctcctcacacagattccggtgaaaatagtcttggcagagtccgatgtgctctccgtcgagcagccaccccccctctatgtgcgtgccagcttcttggagcctgctgcctggggtgtggcgtgccttcactgccgtgctgatctcttctggatgcccagggttgtgttccgccttcaggtctgtgcactccacgcccacacctccctcacagttcatgctgcctcgtgtgagctacctctacaccctcgtaccccaatgcttggcgcgattggaccggtacctgggtgccggaccccacactccttggcttgagttccggcacctccccctgcgctggcaagtgggcgagggttgttgctgtgcgcagcatgatccggtgatgtgattttgcgtcaaaggagcaaagacacgaaaacttgaatcccaacgttgcaggtctgtgccggtgggagtgctctttgaccttctagcccgcccagatgatctgccatggatgctgacggtgcgtggattgctggcgctcccatccgaacgtggctgtgcaatgatgcgctcacccggtcagtcatgcgtagtcacgccaggagcacatgtgcaccagtcagcctgcatcctttcacccacagatccgattctctggctacccgctggctgccatgccgccatgcatgcccgagacatccctcaaagcggccttcctcaacagcctcaaggttgcggggtggcacggggacattggtcagcgtttcagcatcgaggcttggggatgtggtgcagggcgtctggattgcccatgcctgtccagtggtgtgggtgtgggtgcgattgctgccactatcccaccggacacctttggccgagcgcccaggcccacctgaacagcacatatcggcgacggtccctcacctgagacccatcgacatgtctctgatcgacatccacctcctgtcaggaggcgaccttcatcctgcgcggcactgcggggcgcgtcatggagatggcggccgggagccagacggagctctggtccgccgtgacccgggccgacgccgccgcgtatgctgaggccgccgcgtccctgcagctgagcccggggtcgtggagggggcggccccccagcctcccggtccgcatcctggcctgcgaggccgggggggtgcctggcagctggcggggcgtgttctactcctcccgccccgttgccatcagccgggggggtgatgagacggagggggagggggaggatagcgcggggccgagtggcctgtcgctggggcaggcgctggacggcatcctgcgggaggcggacctctgcgagcgcccggggcccgaggaggcagactgttcgccggtaccatccccgaggccatacaccgcaaccgtgtgtggcttgaccccggcgccagaaacgagcctggcgacgctgtactccagctgcgcagcgggggatggcttcctgtatgtcgccgtgcacttggcctgaggcgggctgcactgctgtgtcatacaaggatggccgggggctgtgggaggaagggaatgaagggcgcagagggtactggggaagtgtgtttccaggtgccggaatgcatcaggctcatcctcagccccagctccggacgccgtcctcggcctggagcagcatggccgccgcatccaccagcgccagctcggcaggggtgggcgccttgtcctgccgccccgccatgctggacagcatcgcctccaggcccaggcgcacctgcttcaccagcgcgccggtgaccgctggcaccctgcggcggtgggaggcggaggtccatccaagagcgcagcaatgaaggcgtggcaggggagggtgtgcagtgtgcagggggtggcaaggaggtctgcaggacgagctagcaaggagcaacatcatcgtcgactccctggagcctgcctcgccgcagcaactccacatacaaagcatcctgcgtcactccctggcctggttgccacatccgaccacagatataaaagtgttagctcgcctgatgcggatgtcgccgtccagggtggccgcccccacctcggggtgcaggcgcagcccgtcgccgaaaagcaggaccgcaaggggggagaccaccgtgcagtccctcagaaacgtgcgggacgtccgcatctggcttggttgggtggatgaggagggtcggggcggtgggaattgaggagagtgtcgagctcaccgtgcgcgagatgtccagccaggccctcccatgccgctcaggagcatgtcccagggagccccctggcannnnnnnnnnaatgaggagggtcagagcggtgggaattgaggagagtgtccagttcatcgtgcgcaagatgtccagcgaggccctcccatgccgcacaggagcatgtcccagggagccccctggcaactttccccctggcatcccaagggacagtggcaggcaatcgaattcccctgtctgccgagtgccaccgacactcccctggaccatcaccctcgaaccttgtcgaggaaggtgacaaaggggtggtgcagcgtcgtgtgggtcagggggtggatgacggaggaggggtgtacagccacctcaccactcacatcccgccaccggggacgggcacctgggtgttcaggggatgggtggggtgacgaggcgagcgctggatgtcagggcggggacgaaggatgtgaaagttcgaggacgaggccttgcagacagtccggccatgcccgcatgagcccccaagccagacagctacttgactgcggccatacgtgaccccagccggtgccaccccaacgacctcccccccttctacgcacacacgacccacctgactccgccgtgcccggcggctcggccaccgccagggccggcttcnnnnnnnnnntcgctggatgtcagggtggggacgaaggatgtgaaagttcgagtgcgaggccttgcagacagtccggccatgcccacatgagcccccaaatcagacagccacttgactgcggccatacatgaccccagccggtgtcaccccaacgatcccctcccccttctacacacacatgaaccgcctgtctccgccgtgccgggcggctcggccaccgccagggccggcttcagggcccaggccagcgcggctgccaccaccgccggcttgcgcgcgtggcggttccagggcgcggccgcgtcgtccagccaggtcgcgcggtcgcggcgcgcggcgctgcgcgg

SEQ ID NO: 46579 - DNA, 61 bp, Chlorella protothecoides
gctggccggcatgtcggcggcgcggcaggggcagaccccgccgcctccccgctgccgctgt

SEQ ID NO: 46580 - DNA, 66 bp, Chlorella protothecoides
ggacgctgggcccgagatagaatgcagggggcaggcagactgcacggctgtctttcctgcatgaaa

SEQ ID NO: 46581 - DNA, 36213 bp, Chlorella protothecoides
  modified_base (1144)..(1153): a, c, t, g, unknown or other
  modified_base (1840)..(1849): a, c, t, g, unknown or other
  modified_base (2503)..(2512): a, c, t, g, unknown or other
  modified_base (3278)..(3287): a, c, t, g, unknown or other
  modified_base (3746)..(3755): a, c, t, g, unknown or other
  modified_base (5647)..(5656): a, c, t, g, unknown or other
  modified_base (6032)..(6041): a, c, t, g, unknown or other
  modified_base (6232)..(6241): a, c, t, g, unknown or other
  modified_base (8730)..(8739): a, c, t, g, unknown or other
  modified_base (8858)..(8867): a, c, t, g, unknown or other
  modified_base (9197)..(9206): a, c, t, g, unknown or other
  modified_base (9762)..(9771): a, c, t, g, unknown or other
  modified_base (10420)..(10429): a, c, t, g, unknown or other
  modified_base (10854)..(10863): a, c, t, g, unknown or other
  modified_base (10976)..(10985): a, c, t, g, unknown or other
  modified_base (11054)..(11063): a, c, t, g, unknown or other
  modified_base (11928)..(11937): a, c, t, g, unknown or other
  modified_base (12528)..(12537): a, c, t, g, unknown or other
  modified_base (12818)..(12882): a, c, t, g, unknown or other
  modified_base (13826)..(13835): a, c, t, g, unknown or other
  modified_base (14167)..(14176): a, c, t, g, unknown or other
  modified_base (14264)..(14273): a, c, t, g, unknown or other
  modified_base (14533)..(14542): a, c, t, g, unknown or other
  modified_base (14673)..(14682): a, c, t, g, unknown or other
  modified_base (14804)..(14813): a, c, t, g, unknown or other
  modified_base (14979)..(14988): a, c, t, g, unknown or other
  modified_base (15363)..(15372): a, c, t, g, unknown or other
  modified_base (15874)..(15883): a, c, t, g, unknown or other
  modified_base (16366)..(16375): a, c, t, g, unknown or other
  modified_base (16745)..(16754): a, c, t, g, unknown or other
  modified_base (16821)..(16935): a, c, t, g, unknown or other
  modified_base (17147)..(17156): a, c, t, g, unknown or other
  modified_base (17520)..(17595): a, c, t, g, unknown or other
  modified_base (17721)..(17730): a, c, t, g, unknown or other
  modified_base (17799)..(17808): a, c, t, g, unknown or other
  modified_base (17876)..(17936): a, c, t, g, unknown or other
  modified_base (18836)..(18845): a, c, t, g, unknown or other
  modified_base (18999)..(19008): a, c, t, g, unknown or other
  modified_base (20582)..(20591): a, c, t, g, unknown or other
  modified_base (21601)..(21610): a, c, t, g, unknown or other
  modified_base (21849)..(21858): a, c, t, g, unknown or other
  modified_base (21925)..(21934): a, c, t, g, unknown or other
  modified_base (22911)..(22920): a, c, t, g, unknown or other
  modified_base (23119)..(23260): a, c, t, g, unknown or other
  modified_base (24178)..(24187): a, c, t, g, unknown or other
  modified_base (24572)..(24683): a, c, t, g, unknown or other
  modified_base (24881)..(24890): a, c, t, g, unknown or other
  modified_base (25175)..(25184): a, c, t, g, unknown or other
  modified_base (26088)..(26097): a, c, t, g, unknown or other
  modified_base (26616)..(26625): a, c, t, g, unknown or other
  modified_base (27314)..(27323): a, c, t, g, unknown or other
  modified_base (28723)..(28732): a, c, t, g, unknown or other
  modified_base (30452)..(30461): a, c, t, g, unknown or other
  modified_base (31023)..(31089): a, c, t, g, unknown or other
  modified_base (31238)..(31247): a, c, t, g, unknown or other
  modified_base (31396)..(31405): a, c, t, g, unknown or other
  modified_base (31564)..(31670): a, c, t, g, unknown or other
  modified_base (31881)..(31890): a, c, t, g, unknown or other
  modified_base (32027)..(32036): a, c, t, g, unknown or other
  modified_base (32203)..(32212): a, c, t, g, unknown or other
  modified_base (32357)..(32370): a, c, t, g, unknown or other
  modified_base (32821)..(32830): a, c, t, g, unknown or other
  modified_base (33350)..(33359): a, c, t, g, unknown or other
  modified_base (33884)..(33893): a, c, t, g, unknown or other
  modified_base (34618)..(34627): a, c, t, g, unknown or other
  modified_base (34718)..(34727): a, c, t, g, unknown or other
  modified_base (34804)..(34813): a, c, t, g, unknown or other
  modified_base (34968)..(34977): a, c, t, g, unknown or other
  modified_base (35190)..(35199): a, c, t, g, unknown or other
  modified_base (35501)..(35510): a, c, t, g, unknown or other
  modified_base (35900)..(35909): a, c, t, g, unknown or other
cccccgccgccgcggctgctgccgccccgccctcggctggaaccacccccccggcccctgctagaggcccccccccgtccgccccgcccaccctgctgccgctcccgcatgcgctcgtctagtttgcgctgcttgcggacctgctccgggttcttgatctcgtcgcgcgcccggggatcgtcgccgccggcctcgggcttcagggggttcacccagccgcgcccgccgcgcttgaacctggaggggtggtcaatgggtgttcgagcgtgggttcccggtgcgcgcgaggggttacaatgcgcccgatgcctccgaggcatggccggtgcacagcgggtcgaaggctggcggcctggtccgtggggtgtcggcaaggcaccctctccacagcaccgcagggcacagactctgcgccatccccacaggcactcgcaagcattacacaatcattgctcacagccatgcccttccctcacaactctccctcgcacctttcacccatctgcttggccagggctgccgctccagctgcctccttaggcccagccacctgcatcttgttctttgccgcccacttcttgtacagcccagaaccctcctccttcttgcccttgccaccactctgcgcatggggtgcaggcacttgggatgctggctgatgctcctgatgccgggcggagagtaggctgcccttgaaagcaccatgtctttgccagtatctcgacagaaattcagacagtacagcagccaacccttgagtaccatgtcttccaaacgacatccacccaacacagaatctcacctttgaccctgggatgcggcgccccgccttgaccgtctcgtctgcctggagcttgacgtactttttgctgcgcttgtcccagtggtatttcgacttttgggaccgcatcccggctgcagtgagggatggagggacggtttggggggattgggctgcaggagtcaggggtatgctggtcgcccaggggctgggaattcatcccaccctcccaccccctcaaaaggccttgagccagtcacctctcttaagaagggcatggccagtgtcatggacattttgaatttggtggaagccgccttcccctcactccccctccccctccccaagcaccaggtggggctnnnnnnnnnnttcaaaaggccttgagccagtcacctctctcaagaagggcacggccagtgtcatggactttttggatttggtggaagcctccttcccctcactccacctccccctccccaagcaccaggtggggctgtccccgcctgcttccctccctcaccagccacctgtaagccctcaccctcacctgcatcctctgcggtgaggtccagcacggcgtcgttgaactggccggcctctgctgcagcgtagaaggactcctcccgctccccctcccccggcacatggctcacgtagaagccctcctccctgtaccggcccccggcagcctccgtctctgataccaggctcaggcgcttggaggcgggcgccgtggccagcaccgcccccgcctctgcgccaccgacatcagcggcgcgctcctcggcgtccagctcccgctgtcgcttggtggcggagatggtgctggtgtgcgctgcccgcttcacgcgcattacctccaccagcttctccccgggggccaaggccgacacgccggggatggcagtggcgcctggggggggaggtcgaggcaaggtgggtttgatggggagaggcaggcacatggcagcaagcacacgtgttctggtgtacactgttgctctgagaaggccctcgcagtcatctttgacaccgagagctggaaatctggttgtnnnnnnnnnnaggtgggtttgaggggtagagacaggcacatggcagcaagcacacatgttcaggtatacactgttgctctgagaaggccatcgcagtcttcttttgacaccgagagctggaaatctggttgtttcgacacgtcccagcactggacagcaggccgtcagtgcagctcggcaggtctacgctgcaccccgagcagcccgacagcccacgggttggaactcaccggcgccctcgccgcggcgtgccggcgccatctccgcctcaaagacggtctgtgacggccgatagctcttcaaggcagaggtgaaagctgccagggactcctgcagagtttgacgggaggggcgtaaagcgtgtactggctgccattcctgtgcaaaacgtgtcgccgctcctgattgagcatcagagcgcatgctcctgggcctgccgcgtccttcacccaaccacccctgcctcacctgggcctccatgcctcccagtgcagccgaggggatggccgcagcaagcagggggtgcattccctcctgcgcagagggggccccacgagactgggttgtggtgtggaaacagggatcccggacacatcccctgaaggcaggcctcacacgcactgtcaagtacatcgcatcatcacaagcagcaccacagaatgcnnnnnnnnnnagggtgcattccctcctgcgcagaggggggtccatgagactggtttgtggtgtggaaacagggatcccgaacacatcccctgaaggcaggcctcacgcgcactgtcaagtacaccgcatcatcacaagcagcaccacagaatgcaggtcccgggattgctggttgcccattcctgacccagcgtctcaccctgggcagggtcctggccctcttgatgctctccgggacggcggggggccgagtcttcaggtacaacttgaatgcgttctcgcagggcttctggaggcccgccaagtcgtacgaggaggcgatggcggcgcgcaccctctccacctccaggtccagtgccgtctgttcatgtagggagtggagtgagagggggttgggaagcggcccatgagaacgagggccccctctgaagccttctggagccctctagagctccaataaccgacgggttcctgccgagctgcatccatcctcagaagatcagatcgatgcgcgccacttccagctgccgggcatgcaacccccccacccctgcccagccacacacctgcgggaaggcgcccagcagggagacgctggggtccatgaccgcctcggccgcctcgccaatggcccgcacaggggctactgacaacggccgcgacaggaagaggtggaggtccaggaggtacgggatctcgtccctgtaacacagagttgagcgaggaagggcctcttgagggcttgccacgctcatgcagctggccagacttctggnnnnnnnnnnaggagttgagcgaggaagggctttttgagggctcaccacgctcatgcagctggccagacttctgggaatggctgcgctccaaagaatggtcccaatcgcagtcccatcaagttgcttgactgcatgcactgcacatcctgcgatacatgctgctccaccccaatccccatgctcagcacctggtgaccaaggagtaggctgtgccgggcctccctgcacgagcaacacgccccgtccggtgcacaaacagcttgggcttgggcgggaagtctgcaggggtgtgggtgtgtgggagagagcagtggcagtgacagcttaaatccgggggcattggggtggggggggtccggcacagggcccccgcaagtccatgcaccctcccggcccgagcagggacccctccccacccgcacgccccgcatgcacttccgcggcccctcaccataattgatgacgttnnnnnnnnnnagacagagcagtggcagtgacagcttgaatctgggggcattggggtggggggatttggcacagggctcccgcgagtccagacacccttccggcccgagcagggacccctcccccacccacacgccccgcacgcactcccgcggcccctcaccataattgatgacgttgtccagcagggggatgtccaggccacgcgccgcgacgtcggtgaccaccagcaggttgacgcgccccgccctgaacttggcgatgtggatcttgcgggccatctgatccatggcgccgtgcacgtgcgcgctttctatgccctccgcctccagcaggcccaccaggaactccacgctgtgccgcgtggcggcaaaaaccaccgtgggctggtgcgaggggatgagctccctgaccaggaagagcagggccgccgtcttgtcctccgccctgcaagcggtgtggtgggtgaaatagatacggtgagaagggggttgagagggcatgggagggaatggggctaactggagggtgagtgaagaagaggggagggccagtgtagggcgaggcactgagaggaatgctacgtcgtgctggcgcttgggtgaaagcaaactacaaaccctgctctgcaccccaggcatctcctgaacaacaaaaacaatacctgacggtgaagaaggcggtgcacagctccggggagattttggtgtccgtgtcgagcctgaccagctccggggtcttcagccctgcacgtgcaaactgggccagtgcctttggcatggtggccgagaagaggagcgtctggcggccggatggcatgcccgccaggatctggggattggggggaaggttcaaggggggggggggatgagtccaggtgcgtcgggtcgtgccagacgacttgggcaagggacgcacagacccagcatggtcagcgacggcaggactccaggatgactgctctgcaaccggtgcagactgcagcacgacgcctgcggcccaggcctggcagaggtgcaggtgggccccaggtcaagccttcaccacacagatgacccgcggaggtgcacactccgccccaccaaccgtgctgcacctgcttgagctgctccgcaaaccccatctcaaacaggcggtcggcctcgtcaaacaccacgtaggagatggaggaaagagagaagccatccacctcctgcaggtggtgcatgaggcggcctgcgcttgcagtggggggccggtgggcgcatgagttgggggagggtgtgagccacggaaaggggttggtgccgagagctaggacatcaaagcctcagggtccctggatgagtgccagcccgtgccttctcaatactcccggtccccagtttctcaacagcacgaccatcctgtcgcacctggggtggccacgatgacatccgggaaggatgccagctctgcaaactgggcctccatggagtcgccgcccacgaggcaggcggtgcgcaggtcggtgtaccttcccagctccttgaccaccttgtgcgtctgcagggccagctcgcgggtgggggccaggatcaaaccacgtgtgcccgtgctgggcgagtgggcccgcagcttctccagcaggggcaccacgaaggcggcggtcttgccggagccggtgcgcgccatgcccaccacgtccaggccctgcagtaccagtggtaccgacttgcgctggatgggggtgggcaggcggtagcccttgcgcttgacgccgcgcaggaccgtctcggagagccccatggtctctgtacgggggtgggattgtgggtggggagatatatgtgggtggggaggggtgggggatcctctgagtgccatattgtctggattccctgtccatgagtacttttcagaaggtgcccagccacgaggcaatnnnnnnnnnnggggattgtgggtggggagatatatatgggtggggaggaggggggggatcctctgagcgccatattgtctggattccttgtctctgagtatttttcagaaggtgcccagccacgaggcaatgactctcattcttgacacttcagcacgctcgggaggccccggctcaccaaagctgccgggcttggccttgtgttgcagcttcttgcgacgccctgacaccttacggtcgtcattccagccaaagtccaccgtttcgggctcaggaaacgcttctgcgcccctagatgggcctggctggcgggccatggtcgaggcacctaccggcgactggggagtgcctgtgccccagctctggtcacgccagacacaccgcgnnnnnnnnnnacctggctggcgggccatggtcgagtcacctcccggcgactggggagtgcctgtgcccagctctggtcacgccagacacaccgcgatatgccgacctatatgctattatagctgaaaagcttcttgcagtcaagagtcttaaagctcagttccataaactgggaggaagcagtcgctcgccatgcaaaagnnnnnnnnnngttgcagtcaagaatcttgaagctcaggtccataaatcgggaggaagcagtcgctcgccatgcaaaagtatcccgacgtttgcgcgcgcgctctctaccgcgccctggatgcaaaatgccgatggtctcatcgactacacgactctggtgcggtcgtccagcttggaaaatccgataggtgactctagttgccatccacgggatctataggacaaactcatgttttcaagccctgtcaatagagcgttatgacaccggaaaagggcacagacgcagagtctcccggcttcgccagctccctggctggtcgactggagaggaaggttcgtcgtatagtgccgatagggggatgtgtgactgcaagggattgaggcagtgcttccaccatgtccagggcccctccgttgtcgtgcggaccccctgattttacccctgtacacaggcgagatcggctgctacatcatcgacgccttctgcctccagccctgccatgcggcccccgacaaccttcagtccattgagccgtcccaccccgcgagactcagccggcagcacggtggtacgagccagcaggtatcgtccctttgtggcacccagtgcagcctcggcctcactctggacacctccgcccaaggcgtcccggcctctttcccccgccagcactgcgccaacgtgcacctcgtcagggagcgaagaggccagacctgtgagccggcccaggcgctgccgcttgcctgcccctcccaaagcctccctgcacgacgctgcggccaggcaagggacatccataccgaaggctgcatctgggacgatcgcatctggtgatgcggcaccaaggagttcgccaaacctctgctggtccccttttgtgaagcgatccccttcaagcatagagcacggcgagtcaggcatccacgcatccacagatttccatcaggacccgagccaggcgcggaccgccacagagctccacatccacctccgacgctgcatgccagagctgcaagtccctgaatggtccgagggcgccgcactcagcttgccagagccgccaccacggcaagaagtcaaggaggctctagggcgccttgaagagctgcagaaggtcgcggctgcgctgctgggcgacatggccagggatcgacgagatgcaaggcatggcgggtgggggggggatgggatgggtaattgcttgccagctggggcttctagggttcaagggtccttgcttccttggatctggacttgactggatgtggatacccaggttttggggtgaatgtgcaagaccttgcatcccatgtgcttctccccaaagaccccagcccattgcgtctcctcagaccaagtggtgatgtgcatggtgcaagtggccatcccaaacatgtccattccccgccaaaccccaccatgcagtcccagcaacgtggtctcctcggcgagggctcaggccacgctgggcatgctggaggcccggcagcggggcctagcacgccgggccgagcctgggcccctgatccctccagcggtgcaggccagactgtcccgcctggccgagctcagggcagaggcagccgcgctcctgtctgccccgccccttcccctcatagcgtcccattaggacaggtgcatgtaactaaagagagatcatgcgtggggtgcaggtgggtcgctagaggttgaggctggcgctgtatgcagccagaagggagctatgggaagggggccaggtcttgttgagtccgggcactgggtagtttaaagggtcattcgtgttggaagggctgggggtgtcatggctcgctgggcatggcaagtccggcccacaatccacatcagagtatacaattgaatttggggcctggctgccgcgaaggccaggcgaaggtttcgtgtcagctcgatggacgcggaatatcagcgcagtgctgcctccaaggacttgacctcagaggcatacttgatccggatctttggacggcagggcttcatcgttcgggtcagggtgccatcatccatgctgcatgggttggggggacgagaggtggatggtttcggtcgactgtgggactattgagcccagcaggagcaatccatgcaggtcctgggctgatggtttcaagctaccgtcacaatcacctgaatggatcctgcaggacgtgcacagcgtgcaccttctcccagggagcccggccgacgcaggccttggtcacctctgccttcagcaggctcgtcacaagcttgacgtccagggcacctgggacagggacagggtagagggagttggccaaagcgcaaacgtgagtgctcgggttcacatgtgctccttgatggccctgggctggcaaaactccctccactcaacgagagggccagcctgcagtgccagcatcccggccaccacgccaggagccacgagctcagggagagggggggcggggtcctggccacagcctctgcgcaccctcacctgaatcatcaatcgcccnnnnnnnnnntgtcacaagcttgacgtccagggcacctggggcagggacagggtagagggagttggccaaatcgcaaatgtgggtgcttgggtccacctgtgctccttgatggccctgggctggcaaannnnnnnnnntggagagggggggtggagtcctggccacagcctccgcgcaccctcacctgaatcatcaatcgccccaggcacctcccccagcgtctcgcggttggggaccagcagcgcgcccaaggcacgatggccgtcacccaccttgaatagggaggcaaggtgtggagttattccagatattgggaagcaggctgagcggggagctgggagttgagatggagtagtccgagccggtcatcccgtcagaaatgtggaccacccggagagttgttagctctcggtcaccctagctgcccagcacaacaccatccagcgcccattgctcaccagcacagnnnnnnnnnncgaacaggggggcaaggtgtggagtcattccagacattgggaagcaggttgagcggggagctgggagttgagatggagtagtcccagccggtcatcccatcagaaatgtggaccacccaatgcgttgttagttctcggtcgccctagcccagcacaacgccatccagcgcccattgctcaccagcacagcaaaggttatgtagggcgaggtacagatggcgtcctccagggactggggctgcacgttctcgccattggacagcacgatcgtgtccttggcacgtcctgtggaagaggggagtggcatcacggctcaggcagcctacctggcggcctgagggatgcagctcccagcagtagtgggagcaccgaaccgccgaggtccaggcactgcagcagcacgaccatgcatcacccccccccctcaaaaaagtccttcattccgcgtacagtcccaagcactcaccggtgaggaccagagcccccgctgctgcgcccccagcctccggcaccttccagcctaggtccccggtgtcaaaccacctctggccctggnnnnnnnnnnaccaccagcctccggcaccttccagcccagatccccggtgtcaaaccacctctggccctgggactcgagcacaactgccgcggtgccgagggcatcgttccagtagcctgacatgaggccgggtccgctggccagcaggaggccctgcgtgccgtcgggcacctcctcccttgtccccgggtccaccacccgcacccgcgtcccgggcagcggcctccccaccgacccgcggatgttggggccggttgtcatggagcgacaggccaggactggggacgtctcggtcaggccccacccattcagcaccgggatgccgatggcctgtggccggaggggaggtggagccggctctgaggttcaggcagggaggcaccgagtccagctcgccggcgcccctgtgtgtagcctacgccctcaccaggcccctcaggccgccgtggcaccagcaagttgccgcacctcgtaaaagtcgtccaggtgggcagccaaggaccctccaccggagacgatgcccctgctcactccaaggccggcccggaccttgctgacgaccaatttctgtgccagcctggggcacaggtcgggggggccaaagtgggctggcgcatgtctggggcgctggccacaagtttgcacacagcacatcatnnnnnnnnnnaggggggccaaagtgggctggtgcatgtctggggcactggccacaagtttgcacacagcgcatcatgcgagcaccatgcaatcgtgctgtgggtgtgcccaccacacaatctgggcggcacaccctgttcctgaggcaccctctgcgcagccactcaccagttgagtggcgccagtagcatggtcaccagccaggctctagcaaaggccagcaggggcgtgccagtgcacacatacgccagactttcttcattcacgacccgccgtgcgcgcgtgtaggccagcgcagcggccagcaggctcgtcgccagggtgcgcctcaccaggctggccctggtcagcatgtgtttgaccctggagtacagggtctccaggaccagggggacgcacacaaagtaggtgggggggtgtcgctgcaggtcgtcnnnnnnnnnngagcagccaggctctggcaaaggccagcaggggcgtgccagtgcacccatacgccagactttctttattcacgacccgccgagcgcgcgtgtaggccagcgcagcggccagcnnnnnnnnnntcggaactgcacagggtcagtggggggggaaggattatttggagagggtgcaaatggagtgacgaggcnnnnnnnnnnccggaactgcacagggtcagtgggggggaaaggagtacttggagagggtgcaaatggagtgacgaggctgccattgaggccatggggatggatgcagtgtggctggtcgcgttggaaaggggctccggggcgccaggacgcctcagctgcacgaagctacgccgagccaccgcccggagcgacacggcaagatgcagcgccgagctggcttggcgcactgacctcgcgcgcagagcctgcacagccaagctgtctccccacacccagtgtcggcatgggtcatcctcttttacaaccgccccttccagcgcacatgtcggacggaggtgaacacttgacggcagccgcaggaggcaatgtagtacctgttgttcattttaggggggagcagaagggggtcggcttcgattgcaggctccatctggctcagtcgggccctgacagaggcatgcacacagagcctcaagccacacacaacctcatgcccctgcatcctgacgctgacgattccttgccccccctcccccctctctcgcactggcatgtgcgctgataaatgtgccacggcggcagcaggttcagggtggactcccccgccttcagctccaggagtgtgggaaaggagcgcagctggtacagcaggttgccgtgggtcaacatgacgccctgatgggatgaagatggacacgttgggattggtcaaaacatacagaagctgtgccataatcatgtcagacaacgactgaatatcacacctgcaagcccaaccccccaggctgcaccaggcgcctccctgtccacccttcgccccactgtctcccgcacaggcgcacccacccttgggttgcccgtggtgccagatgtnnnnnnnnnnttgggatggagatggacacgttgggatttgtcagaacatacagaaagctgtgccatgatcatgtcagacagcgactgaatatcacacctgcaggcccgtcccccaggctgcactaggcgcctccatgcccatccttcgccccactgtcccccacacaggcgcactcacccttgggttgcccgtggtgccagatgtgtacaccagcgttgccaggtcatcctctgtcaaatccactcgctgcagggaggtctccgccccccgagccagcagctcggcataggacaacaccgagcagggaagcgctgcacgtgcctcctctgccacatccccccacagctgcaccacaaacttgagctgacgctggggcacaccctgcagagcggtcacggtgagaggcttcctgagaaagagcgcttgtcagtgtaggatgtggggcatcgatgcaagtctgccggcagtattctggctgctgccttccttcaggcacaccaacccagtctcccattcgggaccctcgtctcacctcgcacaggcggggcaggagcgcggcaaggctcgacgcatcctggatgactaatcctgacgcctgcnnnnnnnnnnatctcacctcgcacagtcggggcaggagcgcggccaggctcgatgcatcctggatgactaatcctgacgcctgcgagctgagcactatctgctccagctcctcgaccgggtttgcagtaccacgcacctatgaagaagccatcgagcatgctgtggaggtacatgtggtcatagcacgcaagtaggcatgctatgctgcaggctcggccaaagtcgcggggtgcctgaagactgtttacatggacaccagatgcacaccattttctgcacgaccccccccnnnnnnnnnnnnnnnnnnnnnnnnnnnnnnnnnnnnnnnnnnnnnnnnnnnnnnnnnnnnnnnnnccccgctgacatgatgccctggtcagccaccatccaccgtgagctgccctctgagaacaaggccacccgctcccccttctccaatcctaggctctgcaagccggctgcaaagcgatcgattgtctcagagaactccctgttgtggcacataaattgttgggctggggcttggacaggtgagacagtcataatcaggcatacactgaccatttggatgtcctggtagattgactcagggtttaaccgggcacgccattgctcaactccatgggcgccttgcctgaacgtgatggagctgacaggctgctggtgggggtcaacaaatgctacagcatcgccatggacttcagagagttgctgccacctacacgaggaaagaacagcatagaacatgtttagaggtgggtcgatgttccatcaggcatgcggtgcgctgcaccaacctggcagggagacacatgcgggtcactgacaccgctacctcacaggtcaggcagggaagctgcctcggtcacacgcagcgacggctttctcgaagaggtggtcctctccaggggctgtggggcgggggagtactgtacctcggccaccttcctctgcgcgcgatggggggttgttgaaggctatgctgcaccttcatgctccgagacgcgagcattgcagaccatacagcgctgggacctcacaaaccttgatacgatgtacacgtccgtttcgtgttccttttgaatgagtcatgaaaggcctcgtccgccatggcttcaattgcgaggtgtggcctgtgcccaagggaagcacacgggacatcccaggaaggctgtccatggcgggccccatggtagtatacattgtgctcatttcacgaacacattataattggtcagagcaggtgagctttgcctcaaacttctaattttgctgcgcaggaggcttccggtggcacnnnnnnnnnncggtcagagcaggtgagttttgcctcgaagttctggttttgctgcgcaggaggcttccggtggcactcgcccaattgttcgtaaactcggcatccccggcctggtgccacgtcatgctcgaggataaggtcctcctgacccgccgtgcagcaggctccgattcaggccctctgcagcccctgtactcccctgttgcagtccgacttcttaccgggagggtgcacacaagaatcagatcaacagggctggctttggccagagcggcagaggcaaatacccaggacggcacccgtccctcccatcgcaagctccctctccctcagtagcgacgnnnnnnnnnnaattcaagccctctgcagcccctgtactcccttgctgcagtccgacttcttacgggcagggtgcacacaagaatcagatcaacagggnnnnnnnnnngtcatagcggtcccgatcgtcgtagcgtggccggtcgtcgtagcgggggcggtcgtcatagcgtgggcgctcctcgtatcggggacgctcctcgtagcgtggccggtcgtcgtatctggggcgctcatacccgcggtcatagccccccgacccaccaccatagccgccgccgccaccgtacccgccgtacccgccaccagtgccgccaccatacccgccgccaccgccatatccgccaccgccatatccgccaccgccannnnnnnnnnatagcgtgggcgctcctcgtagcgtggccggtcatcgtatctgggacgctcatacccgcggtcgtagccccccgacccaccaccatagccgccaccgccgccgtacccgccgtacccgccaccagtgccgnnnnnnnnnntggccaccgctgccgtagccaccgccgccgccgccatagccaccgccgccgccatagctggccctaagggagaaggtccatgatacatatatgtcagattgccacataccaaggatgcaaannnnnnnnnngagggagaaggtccacgatatatgtgtcagattgccacataccaaggatgcaaaaggtcccccagaaaggagttgagcaagccagcagcgcgataggaaccttgccagccctccagacaggtctggcacaggtgcgctgatgactgtccatccagcatcccgctcnnnnnnnnnnctgagcaagccagcagcgcgacaggaaccttgccagctctccaaacaggtctggcacaggtgtgctgatgactgtccatccagcatcccgctccaccccacccacccgctccttcggtagcccgctggcgggggccttccgaagcggtcctcctccaccagacgcttgatgatgcccatctgcacgggtcaaggggtgcatgtgcgtgcttggtggcatgttcgacggcctgctccacgccctctctgcgcaagaccgtcaactgcaaccgttcccggcccactctgagctgcggggccgggcggtcgccatatcaatcaccccctacagatgcaaccctcaacacccaccatgaagccctggcgggagcggacnnnnnnnnnngtgcgcaagaccgtcaactgcaaccggtcctggcccactctgagctgcggggccgggcagtcgcctcatccatttacccctacagatgccaccctcaaaacccaccatgaagccctggcgggagcggacccccgagtccacgctctgatcgaagcgcgtgcaggcctcctcgcccagccgctctggcaggtcggccagggcccggaccatacgggcatccacctcgtgcttcccaatcttgtcctgcgcatcgagggacatgggtgggcgcgagtcggccgccgtgcatggggaggggcccaggcgagaaggggctgatgtgggtgcagcaccgagggccgccgaatagcagtctgcatgggacagagcaccgactccctgcccgggggcagagagggacacccctcaaccaggattttcagagcgcacactctccttttttgggggtgggccggccccatgaagtgagaatccccactcccctgcctgccgcttcatcccnnnnnnnnnncccctgcccagggacagagagggacacccctcaaacagggtttccagagcgcacattctcctcttttcggggtgggccggccccatgaagtgagtctccccactcccctgcctgccgcttcatcccacccaccacacctgggcgatcaggtcctctacccggcgcctcacggagcgcggcaggatgtcgatctggccgttcccgcggtcggggccgtcctgccgcacgcggcggatgatgccactgacaaagccgccgatggagtggacgcgcgaaaagtccgactcggacaggcgctggacgacgcagagggcgccctcctccccaagagctgcatggaggtgaggggtgggttggtggagcatcaggggaagacagagggtcccagcaacagggagggcaggcggggcaggggaggtgagcggtgcatggcctggtttggagctcctcaaagcatgccctggagcaccgactgccaccccnnnnnnnnnnagcaacagggagggcagacggggcaggggaggtgagcggtgcgtggcccggtttggagctcctcagagcatgccctggagcaccgactgccaccccatccgctgaggctcccccgcctggcacccctcccaacctctatcccccacccactgcatcgccacccaaactcaccagccatgtctgacatcagggcgtcgtccaagtctgagctcttgagggtgcccttgtcgaagagctcctccagcttcgcctgaacatcgcaagcaccgaggcatggtttagcggctgctcttcccacacagaggcctggcacgccctggcagcatggtcctgcagcacccggcttgctgtgaccctcaccttccatgannnnnnnnnncccccaacctctttcccccacccactgcatcgccaccccaaactcaccagccatgtctgacatcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagcggctgctctcctcacacagaggcctggcacgccccggcagcatggccctgcagcatccggcttgctgtgaccctcaccttccatgatcctgggcgagaagccgcagcaggcgatctgctgcgagaacggccgcggcgggcgggactgcgcgaccccctcctgggtgcggggctgcgcgagtcgttgctgcgagcagggctgcgggtnnnnnnnnnnacgggccggactgcgcgaccccctccggggtgcggggctgcccgagtcgttgctgcgagcagggctgcgggtgttcttgcggcttggggaccgggagtcccggcggggactgcgggaggcagcccgaggcgcggctgcgggcgtggagggtgggaagaagatcacgcttcgcgggcgggcgcatggccgggcggtcgcggcagggagggccggggcggggcagcagacaaataagcggcatcgagggtcatacaggcggcacacgtacggctggggctgcgggaatggtcggagatgaggtcgcggctgggactcctgctcaagctgcgctcccggggagacgcgctcctggacctgcaggggnnnnnnnnnnnnnnnnnnnnnnnnnnnnnnnnnnnnnnnnnnnnnnnnnnnnnnnnnnnnnnnnnnnnnnnnnnnncagacgatcacacctcgccggtgacatggccccagtgacggcactgtgcgccggccttcaaaggttgatccggccccggccctttttgacaggcactcgaggtgtatctctaccgatgtccggtcnnnnnnnnnngtgatacttaaacattgagcattaccgttaccagggaatgcacttgcttcatattgcaatgtcccatgnnnnnnnnnntgatactaagacattgagcatttacgttaccagggagtgcacttgcttcatattgcaatgtcccatgnnnnnnnnnnnnnnnnnnnnnnnnnnnnnnnnnnnnnnnnnnnnnnnnnnnnnnnnnnnnntaaaggttgatccggccctggccctttctgacaggctctcgaggtgtatctctaccgatgtccggtctgcagaataatcgcccttttctcgatgaggctgggctatcacggaagctttgtcgtcgcggtggacttctaactttcttgccattgccaatgagaatgagccttaggggtgcccttgacgcaccaatgagagcgaggcacggtccttcctgcgaggtattggtcagtcaggccaaattgtctttgaagggatgctgtgttaccccacatgcggtgcttggcattacccttgacccggttgaacagacatgtccgacactgctgcccggacccacagagagattcctggtcctgactgacgcaatgctgctttcaagctgctagtccggtcatcaatcttgtttggaggccggatcgcaggtctccagctcaatggcgaaagcaaagaaatctacgctctgcctccccaagctcctgttgcgggatgagctcgtcaaggtgatctgggcatcagggggtcccagggtcgttttggatctagatacaacagagttgaatctccgaaatgccacccaccgttgtgcaggcggctcccgagctctccaagatcctggctgggcaccccaaggtggcagccaaggcagccccgcagggccagaagaccaagtacctcagctccaaacctggatccaccacgacgcgggagttcgagctgcccgaggacgaagtgattgtgagtgtcagcaggggtctgaggagatgccgtgagactgcaggggagctccagggtgggttgccacccagcgcatgggcaggcactgcacagcaaagtggaggagtgatgatggcttgggctcatgcgccgcctcctgtcccatgcccagcgtcgccaannnnnnnnnngtggggcagaaacctgagcactcggtccagtaggtaatcttggccctgcgagcacctgcagtgtccctttctcatgttccatgcctgggaacccccacctgcatcttgtgccgttattcgctcccatcaggaggtgagctgcagcagcaagacnnnnnnnnnngaagtggaggagtgttgatggcttgagctcatgcgtcgcctcctgtcccatgcccagcgtcgccaactggctcaagtcaaggcagagcgccagggtctgctgggcgccctgatcagtctgaagaatgaagttgggaagtcgggtgagatagcaggattcgcaggttttagattgtgagtagccgtcaaccagactgtatggggcacaaacctgagcacccggtccagtaggcaatcttggccctgcaagcacctgcagttttccctttctcatgttccatgcctgggaaaccccacctgcatcttgtgccgttattctcttccatcaggaggtgagctgcagcagcaagacattgcagccttgcttcgggaggtggctgcaaagaaggaaagactcaatgacctgcgtgaggaggttcgcgtgctgcagacgaggcaaggaggtccaggggtcggacagttcacgggaccgcaactcatgcagcctggccggctgtgatgcactacatttggcctcactcgagcagaatatcgcattgttcaagggctttggccgtaacaccccctcaagagccattttccgcaacaggaagaaggaactggagggggagagtctggccatccaaatgctcatgatccctgggccgagcgagaccgaggatgccgccaccgccacgctggcggcgctggaggccacccagtcggagatcacgtccctccaagcggctcggaccgcagcggcagcggcagaggccaaggccaggtgagggacctctgctgagcggtgtctggctcacccaggacagtgtttctaggtccaaggttgctcagccagtgggctcaatgccagcctcggcctcttgaccatgggatggccatcggcatcacgctctgctccccccccccacccccaccccaggcgcgaccaggcccaggcctctgcggcgctgctggaggccactcgcctgcaggaggcggcaagccaggacgaagccaccctggtgcaggcagtgcacgacaccagcattgctcgggaagctgccgagcaggcactgcacaaggcggccaccatgtccgagcaagtcctgacggactggcacaagaaggtcaaggaacgggcaaaagaggtgggtgctctggggtgacgttggaatcgtctgtctggactgggttgtcaagttcaagccagcgggccggtggacacccgatgcacgggcctcgaaccaaccctcgcatcgacaggcgccctgtggccacagcacacattgccccccccccaggtgcgcctgctggaaagggagaatgccgacaggcgcgccagactagaggccgccgtcagggctcgggtgcggtgttggcgccgggtgcaagagtctcctgcatgtggtccccctgggcggggcttcagcgcagcctgcacagccaggcacaccctggtcattgcatgccgccctcgtgcccctcccctgtcgcacaccacgatggtgctccctgtcctgaccctgattctgcaggaagcaaaggagcgtctgctgcgggagtcgtccctggcctccgaccagcgagaggctcccnnnnnnnnnnccgggtgcgagggtggcgccaggtgcaagagtctcctgcatgtgttcccctcggcggggcttcagcgcagcctgcacagcctggcacaccctggtcattgcatgccgcctcgtgcccctcccccgtcgcacaccacgatggtgctccctgtcctgaccctgactctacaggaagcgaaggagcgtctgctgcgggagtcctccctggcctccgaccagcgagaggctcccagcgacggctctcaggccgcagcgcgtcggttcccgccccctgcgccccttgacatcctggagggacagtggaacaggctgcatgctgccaccggagcactccaccctgacggagtcattgctttctggcagggtgagggctggactttggagtgctgagggactggaggctgggttgtgtggcctgcccaccccttccaacccatcaccaaagggatgagcctggtcaggcagtccctctgtgattggcctccacctgcatctcattcttcccccggcacctgacgaaatgtgatgggagagtccaagggggctcggatccaccagctcgttctccacatgctgcgaggcccatccatccaccccccctgtgttcatgcagagctgaaagccaaggaggaggcgatgaaggagctcgcggcactggcagacgtgcaggatggggaggtcagggcggctctggaagaaggcagggcggcgcatgccgcggagctccagctccagcgacaagcatcccgagcatccgagatcggcgggctggggggtgcgagggaggctgctagggtctagatctggagatggactggtgcagcgggctgcactcactcgctggggtaaaggacctcgcttgggatatcgatcagcgggtgtgcagtcaaagagcatgcctgcccaggagacagcttcctgtctgccccccaccatgcagaatcgatcactgaatccacccgcctcaccaatgctgcaggaggtgaggccagcgcggccttggaggaggcnnnnnnnnnnaaattgatcactgaatctacccgcctcaccaatgctgcagaaggtgaggccagcgcggccttggaggaggcccaggtggcgctcgagtccgcacagcaggagagggcggcgcagcgacagagtatgaaacggctcctcagcatcacgactgccgccgaacaggcaagtagatgctgcagtggggcagaaagagactatgctttgctactgctctcaacacgcgattgaaatctgggaannnnnnnnnngagcgagttgctcacccctaacgcaggggctgaggagtatccagaggatcctcacgtccgtggtcgnnnnnnnnnnggatgctgcagtggggcagaaggagactacgctttgctattgctctcaacacgcgattgaaatctgggaatagcaatccaggaaactccagatgttgaggtgtcgcagcacccagagcggcaagcgagttgctcgccccttacgcaggggctgaggtgtatccagaggatcctcacgtccgtggtcggccagcctcagggcacagcaagcatggatgctgaagacaatgtgatcacaccagaggactctcactactcagtcgcgaccttgatgaatgagacactggtcttgcaactctgcactgtgcgtgctggttttggcggtggaatgtgtggacactgcaggggggatgaggcatgctggcttacccaagatcttcgtccctgtgagagccaggtcgaacatcggtgcatccttcacacgctccgcaacccctcgctaaacagggtgtggaggaggggctgcaaaagctgttgcaaaggagggcccgacaacaatacccagagggggtgttccagcaatcagcaggagctgtcgcaggcacagcagaaccaagcaacacccagaccccagagaaggagagtgaggcctgtcaggatggcagtccagcccctggcatgcacggcacagctacggaagaagatggccgtgcgccagcattgcaggcagcggctacagcaggcactgctcctgccgccgtccccgcaccccacgcgagtggcagggagctgctcgtccatgcagccagcgagaagctcctgcggaagggcttcaggcggagcacacacgtgggtcctccctggctcgcctcggctgcagacgcgctggccttgtcggtggtgagtggcagcgtcatgcagacagtggtgggtgcgaggaagtaccctgagttgccactgtttgcacgagttgtgttggggcgatactcggggaatgaatgtctggtaagacaatgaacctgtcgcgcctgggagcannnnnnnnnnttgggaccgaggaagcgctctgggttgccaatgtttgcgcgagttgtgttggggcgatactcggtgaatgaatgtctggcaagacaatgaacctgtcgcgcctgggagcactgctcctctgagccggctgcctgcccttccacccaccacccctgcagagcaagaagcacggccccactctgacggcaaaggccagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgcggggccagtaatggcttcatccactgccaagcacttcccacaagcaatccaccacagggagtacctgaagctgcgcgctgccaagctcaccggaagccggggaaggaagggggcggcgaggggcgacctcaaggacagtggaaccacccctggcataccaggtctgatgctgccctgctgagggcagtcacggcctgctgtctgcacggctttctgatggtgtcgctgcacagaaccctactggggacacaaacctctagcacacaaagtaccagagcgagttccgagagattcagagctgagtgtgcactcaagcccagagctgccactcagatccagggaacatggcggtggatcaatcccggcaccctcacaggcaacctgtttcggggaagggcatggtttcaacacccgggctctctccacctcaggccctctttgctggcacaagcaccccctccagctcagacacatggtccaccaccagatcggccgccggcgccatcatggcgcggggcagggtattagtcacccccacgacaaagcagcctgcagccttggccgcccggcacccgttcactgcgtcctcgatcaccagggcccggctggcgtcggcgcagcccaggcgacgcagcgcctccaggtagacgtctggggccggcttgcccctcgccacgtaggccgcgctcaccgtctgcaagttgcgtatggtttggtgaccagcatcgtggaggtgcgatgctcgaggaggggtggggccggggggtggagccggcatgcggctggcacagcaacggggtgctacggcgcgatgatgcccgacacaggctctcagcgggcgagcacacatcccctctccctctccctgccacagccacgttgctcaccagctcctccggcaccaggccggcnnnnnnnnnncccccccggggtggggaggcggcatgcggctggcagagcaacggggtgctgcggcgcgatgatgcccgacacaggctctcagcgggcaagcacacgtcccctctccctctccctgccacagccgcgccgctcaccagctcctccggcaccaggccggccaggccggaggactggagattccgcgcgatcttgcccgggctgcccgacgaggcgatggccacgcccaagcccgccccccgcgcggcggcgatcagctccttgatcccggggaaggcggcgatgccgccggcggtgagggagttaaaaaggtcctccttggccacgctgagggccgggtaccaatcgtccacggagactccctggttcccaatgctgccatgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccgccccactcacgccgggtaggtggcgtggtagtactccaggcaggtgcgcaggtccatgccaaagacggggaagtagtcctctggaaacgagtggggcacgtcgatccccgtcacctgcacgtggggatgcagtgcaggtcgggtggttgggtggatgtgtcatcgatgagatcagtcttgcactgctcaggcnnnnnnnnnngcccgtcacctgcacgtggggatgcagcgcaggtcgggtggctgggtggatgagtcgtcgatgagatcagtcttgcactgctcaggcacggcttcccttcctgctgcggggcgggtgcctgaaaccaatctgcgacgctgcggccaggccagcagccagccccgatcggcgctggcgtgcgggcagggtgcatggcgaggagtgaagcggcatgacagcagcccccgattcccccctgtttgggtacctgcttcaccgccagccggagggactcgcagctgggcnnnnnnnnnngcctgctgcggggcgggtgcccgaaaccaatctgcgacgctgcgcccaggccagcagccagccccgatcggcgcaggcgtgcgggcagggagcgtggcgaggagtgaagcggcatgaccgcagcccccgattcccccctgtctgggtacctgctttaccgccagccggagggactcgcagctgggccgctccgagtccaccatgaccccgtcgcagtccaggatcaggtgcgtgaaggcaggaaaggacggcagagatgcgggcgggccgattgccgccgtcgccccgccggctggtgtgggcctgaccccggtccccagcccgccttccagcgcagcggccgtgtcggccgcgccggtgctctcaccatcgccgctggcaccagtcgatgcctgcgccgggccaggaaccgcatccgtggcagcgccagggccggcacccccgccgtcgcctgtgttcaccccagcacctccgccggcatcagcggcctcgttcccttcttgtctggccccgcccaccacaggctgcctccgggccagcaggcgcgggacggcgcgggcgatgggcgccgtccgctccccggccaggggcgcctcagtgtcgaccctggagcggtgcagctggaaagcggggaccacccaccgccccgaggcgctctgcatccctgcccagttgtaggtgcccaagcggctgccacagcgcgggcagtacagcttgccctgcgtcgcgccgtcccgcagcgcaggctccatccacgccagcggctccacccagagcgagggctcggccgtagcgccgccgcccgcgcccagtttgtcgcgtttgcgccacgcaaacgccgccggcccggggcccgtctcgacctccaggcaattgccgccgcgggccagcgccgcgcggcacnnnnnnnnnngaacgccgccggcccgggccccgcctcgacctccaggcagttgccgccgcgggccagcgccgcgcggcaccgccggcagcggtgcagcgcctccttggtagaggacgaggcgcccgaatcgacgtcggccaggcccgcgcagtccagcgccccggtctcggcgaaggccagcgcggcctggtaggcccggaactccctgaaccccgcgttgccggagtcgagccggcagcccatgaggccgaacagcgccagctgctccaggaagccggggttgggctgcgcggccgggtgcgcgtgtcgcacggcctccagcgccgccgcgtcgtccaggccggcgctggccatcaggtgggccaccgcgatctgggtggcgagtcggggagggtgggtgcaggggtgcgagggtgtactaacacaaaagactcccgtgcatcgcagcagcgggtggggccttcctggttaccctatgcaacccgcctggacaacaaaaagaggcaggcgcagaggtcaccacccccnnnnnnnnnnataacacaaaagactcccgtgcagcgcagcagcgggtggggcctccctgatacccctatgcaacccgcctggacaacacaaagaggcaggcgcagaggtcaccacccccttcgccattccacgcgtcgcaccgcggcactgcgagagacgccttgggcgcagcgcacgagcacactcccgcccccctgcaccgccccctggatgaaggcggtggcgtcggggaggaggaccaacagatttgctgtgggggaatcctccaagtccagccacaggcagcggctggggaccaggcccaggtcatcttgcgcgccgttcagagcggtcttgttggtgagggagacacgtggtagggaggtttcctcgcagtagcagcatcatagggcaggagcagtgtaccactccagctgcgatggctccagccaccctgcttaccacctcgccagactcaccaccacatgggagatgcccagggcatcgatgtccttgatgctgccagcgcctcccacccacacccctgcgccaggcgaatcgctgcacacgtcaatctcatgcaatggtcatatcagttctggtgagcaggtccaacgtgatcccccgcgcacctggggtgatctgaacgggagcgacggcagccatcgtggtcgcctcaaggtcctctagggggagcagacggggcatccagaatcgannnnnnnnnnacgcacctggggtgatctgaacgggagtgacggcagccatcgtggtcgccttaaggtcctcgagggggagcagacggggcatccagaatcgacgctacaaacctagaaagagcatgcaagttttgaacaaggccatgtccgtctgcagagaagcagcgttgcctggatctgtcgaggtaggggtgttgggagcgctgggcatctgtgtcgcaccccatcaggcgcgacccctcctgcttaatgcttacaatggatcgggaagagcagtgctggatacagagatggtgtcaaaaagacttccatgcatgggagagtcatgttgaaggttttgtggcttggcgccagtcattggggtcgggcagcactcccacactatccaagcattgcgttggtcgcgttgggtgcgaccaagctggcgatctgtgcaagaaattgctgccgctgcagcctgatgggcgagacggagggtgtcacggtgaggtttctgtacagtccagcaccgcagagtgcggccgccatgattcccaggaggaccagccgccggcggcgggtgggagcgttcttccccagcccctgcgtcatccagcccaagttctggaaggaagcgcccgagatggggaagagcattattgggatggggtttggaggccttgtgaagcagtgcaccggtaagaccacaggagcgcatgtgggggaaggagcctgacacatcccacacgcggcaaacggcacccaggtcggccagacgcgatctcctccggccagggcgaccttgctgacacgaggaaatcaccgcctccaccgcccccacccacctgtgcaaggctggccagcatggtcccctggctgggggtgtccagcacgccagagtagagggagacagacagcaggatgaggccgacacccagcaggaaccaggagcttggccactgcacgggagagaaggagggaaggggggtggaggagggtgggtgcacgcaactgcagctaggtgcgcatgaggtgggcgggtgcatgtgcttagggttaagggggccagggccagggctcgccggagtggccgtgcagggagggcaagtgaaggttcacatggaggtgatgctgactgcaagccagccatctgcagtgcagcagcattctgagttggccccatgtcgacgaaggagggcaatacacaacacaccctgccatcccaccctgatcacgaggcgaagctgcatacgccctcaccatccccccagttttgtgcctcccgagccactgtcactccctcgcggccgtgcacgacactccagccctaccgcccctcagacccctccccaccgacgccctcccacaccccttcaccccctccctgcaccgactgcttgcctgtccaaacaagggaatggccagtgccnnnnnnnnnnttactccctcgcggccatgcacgacactccagccctaccgcccctcggacccctccccaccgacgtcctcccacaccccttcaccccctccctccactgtttgctcgcctgtccaaacaagggaatggccagtgccacggtgagcaccacggaggcggccagcgcaaagttcttgatgatgttgtcgcagtgcttgaccaccgcgcccatggccaggccgccgaagacttgcagccccaccacggaccaggtcgcggcatcgaagccggtcagcgggccgcgcgccgcgagcgcgcgcccgtcccgcgccgccgccaccgccaggctgagcggcaggccaaaggcgccgagctgcacgttgcgcaccgtcagcgccgcgccgcgcccgcccttgaggtgcttctcgaagtgcacgcccgcgtaggcggagctgagccccgaggcggcgcaggccaggctccccgccacccactcggcgcgcgccgcgccgggggggcgctccgccggggtcgcatcggctgcgccccgggtcagcgtgaccagcaccacacccgcggccagggcggggatggaggcccactgtgcgggacgcaggcgctggcccagcagcagccaggccagggctgcggtgggcaccagcttgaagctctggttgaagacctggaaggacacggcgtccagccgcgaggcggcgtacaccagcagcagctgcggggggggaggcagcgaggggtaggttcatgaggggttcaaggggaatctctatgggtggcgccatggccgatggcgggatagcgggcaatggcaagagacccctgggccatggaagtggcaagatggggaaaggcggcatggcgtggggacttgttatttccaagggccatggttccctgccccatcctgcctgaagccccgcccgaccacctgttgcataacgaaacagcaagccggcacggccatggggagcccgttgcggagggtggaggccagcgccgtcccgaggtgctgccgtctgctgtgcgcggaggccagcaccgcccccgtgcacagcgccagcttcagcccctccgtcagcaccactgcatgaatgtggggggtccatgtgcatggtagagccgtggcagcggtatgatagcggcggcgggtcggcgcggtgcaacctcggaatcgcctcagggcgggtgccgtccccacctccctcccccaccaagccttacagcaacaggtgtcacggacacccgtgacctcaggacgcaccggagacagaggccaggtacggcgtgccgttcttgacccgggagaggcgcagcatgatggacagggccgtggactgggcgatgagcagcaccattgagaccaccgcctgccacgtccacctgtggctcggcgctggcgcgtcaaggacctgaaccttggcctccatgacctgtaccggcactcaacactcgtccatgcgcgctttcgcaggctccgcggcctccgtgcccgctgagcgtgcctggtgcaggtgacgccctgtgcacatagctaccgcctcgatccgatgcgatgtctgtccatctccacaaacaaaacaaaacttaatatcagatcttcaaagatattggggagtgcaagggccggtgcctcctgctccgcatcgtcgtgatcggacacgccctggcattcccatgcgaacatcagagcttgctttcctcccgaatgctcatggcacaccgannnnnnnnnntgccagtgcctcctgctccgcatcgtcgtaatcggacatgccccggcattcccatgcgaacatcagagcttcctttcctcccgaatgctcatggcacaccgaccgtgcgcttacaaaattacgcaaaaccggcaaaggcgaggtacagcgcaatctggcacatggcattctcaacaatacttatctcgccccatttacaaggttgtcaggactgggccgcgccactaggataatttgctgcggttggtccccgactcacgacaggggtccccatgcgaaggacctgacgccgatacagcccttgaacgaatccactgcaagtaatgacgcaatctaacatcactgcccaatccctgccgtcggaagccgagtcgccacaaagtgccctcggcgagtcccctgcggtacctgtgaaaggtgagacatgcagcgtcggctcgcccctgatcgcctgtatatcaaggactcgggcttattggatcgtcctcatacattcaggcgagtcacttgcaagcctcagcaagctgtctcccgaggggctgccacttcccctggaggtcgnnnnnnnnnnnnnnnnnnnnnnnnnnnnnnnnnnnnnnnnnnnnnnnnnnnnnnnnnnnnnnnnnnntcctagatgtgagcatctacactggctacattgctctggatgacgattgcgaaggagagtcatgctgacgccccagcaaatgaatccgcgctctcccgtacccatttcaaccccccccctctcccttgcatgggcgatgtagaccctcnnnnnnnnnnacctagatgtgagcatcatacactggctacattgctctggatgccgattgtgaaggagagtcacgctgacgccccagcaaatgcatctgcgctctcccgtatccccctcccccccctgctctcccttgcatgggcgatgtagaccctcnnnnnnnnnntatcatcctcatacattcaggcgagtcatttgcaagcctcagcgagctgtctgccgaggggctgccacttcccctggaggtcgccgaagaaaggctggccgccatgggcgcacacaaggtcttcgagaaggtgggcctcaagggggatggggcttgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcccaccgatgctacgcccgccggcctcggtcgcatagtcatcccaaaggtgagggtcacgtggctgtgctcatgattcccacttctgtgcctgcaatgtttggtgtgggaatgctccttgcaccccgggctggtcaatgcagccaagagggctggcgccacctcgggagctccgccaacgcatcgccacgaggtcacccccccacccnnnnnnnnnngtgtttcccacgtctgtgcctgcaatgtttgatgtggggatgctccttgcaccccgggctggtcgatgcagccaagagggcggatgccggctcgggagctccgccgacgcatcgccacgaggtcacccccccacccnnnnnnnnnncccctccatcccggaccagacccccgtctccctggaggtgcatgatgccgcctgcccgggcatggtccactccctgcgcatgcgctactggagcaacaaccgcggccggatgtacctgctggaggagaccgcgcccatggtcgccctgcaccgcctcacggtgcgcnnnnnnnnnnctgcccctcctcccctgtcgactcatcgcagcgctacgccgagtcctgctttccctccatcccggaccagacccccatctccctggaggtgcacgatgccgcctgcccgggcacggtccactccctgcgcatgcgctactggagnnnnnnnnnnnnnngggccgggcgtggcgggcctcgcgctcggtctgggcacattcccatcggacgtccatcgtcctgctggcccgtggcatccaacccgcgcgcacgatgcccaccctgccctgccctcccttcacccccgctccaggtgggagacgtggtcgtctttgggcaggccaaggacggcaggctgtgcgtggtcgggcgcaagggcctgcccacagaccgcatgcggcgccgggtgtcgtcccccgtgcccccccggcccgcagtccccagccccaccggggacaaacgggcgcatggcgtgggttcaggcagccgggggctgtcctccaagcgtcaggcgaccaggaaggtgagggcctggggccccattgggcggccctcgtcttcactggggcatgggcaggcagtgcaccaggcgatcaggtaaatgtaatcttcagccgggctcacttcatnnnnnnnnnncggggccccagggggcggccctcgtcctcacgggggcatgggcaggcagcgcaccaggcgatcagggaaatgtaatcttcagccgggctcacttcatcccccctggacccccgtcctccttcccacttccagatgaactccctgtatgactactgggccggcttctctctgcccccgcgcaccgacggcgtgtttcgtgctgtgtatggcggagcgatgggcggaccccaggacaacaaggcaagacggttcccggaagtcacacatgtgtggggtcggtggtggggaacttgggatgcagtttgactcggtcatggtcaccactgagcctgccctgctacctctgcaggtgtcggctcagcatggagcctggtccgtgaccgtttccgtcgccgacgaagtgttccaggtgggaagacggaggaaaggattggcactctgatgtgtgactctgactgtccggtagttggtctcggctgtcacccaccccgggaggtcccacctgcctgccgcctcgctnnnnnnnnnncggaaaggattggcactctgatgtgcgactctgactgtccggtggttggtctcggctgtcacccaccacgggaggtcccacctgcctgccgcctcgctcctctcaggcattcttcgaggactacgacacggcctgtgcccagttcaacgcctctgtccagggcacatgagggctccgcggcggtcccccgctctctacgaaagccgatgcggcactgctccacaggtggtggatcgtgcagccacccgccatcctccaaatgaatctctccagacatgaaccttccagacagcgcagcacgggccagccacaccgcaatgcagccacgctgcccataacagtacgccctacgagctagccttttcccagccacccccaacgaacaaacgcgcacatactctcaagcccactcccatgtcgctcgcctttggagcatcttgtggcacgtacctagaatgttatcttgctcctccatgtccccctcaagcgaaggtcccaaatgcaccccttgtctctaatacatcnnnnnnnnnnctactctcaagcccactcccaggtcgctcgtcttaggagcatcttgtggcacgtacctagaatgttatcttgctccatgtccccttcaagcgaaggacccaaatgcaccccttgtctctaatacatccgctggcgtgtcgtctcccctgccagcctgcttgaaatcgaatccttgacattcagttgcagagcttctgcccctgcactgcaagatccgaacggtcacggtatacagttcagagtcgcaggacgtcaagtcaacagggctgggggtcatgtgtgtgtgtgtgtgtttgcaatggacaggtcacgcaggaacttgccaggcgctttctcagtgatgcagagcgcccgtcacgttggctggtcaccgggagaggactcaatccgagtcgtacgctgcgaggagtgagaccaggccacttgcatccccggcctccccctgaccggggtcagacccttctgtccttgcttgacctccgtcttccccctttcctactccccctcctgtcagctcggccagctcctcggaggtcaggtatctggagatgtcgtcctcgccagcctcggcggcgccctcgtggcccgcggagccctggggcccatgcagagcgtcgctcgccccgtcggggggttggtccctgtcctggtagtagtactcgtcccagccgctgtaacctggcggcgggctgtcaccatactggtcgctcgtgtctgcatgatgnnnnnnnnnnaccctcgtggcctgcggagccctggggcccatgcagtgcgtcgctcgccccgtcgggggcttggtccctgtcctggtagtagtactcgtcnnnnnnnnnnagtgaacgggacggtcgaaagtgctggagggaggtgggagggggtatacagtgggttgcggatgcgagggaggcacnnnnnnnnnnggtgaatggaaaggtcgaaagtgttgaagggaggggggagaggggggttacagtgggttgcggatgcgagggaggcacataagaatgcaggcaccaggatgagtgaagtaagtagtacggcggatggcccaggcgaatcgcttcggcctgcaccnnnnnnnnnntcaggatgagtgacgtaagtatcgcagcggctggcccaggcgaatcgcttcggcctgcaccctgctctgttccaatcgacagggaccaacgtgtaacaagctccccaccatggcagggatgcatactgcaaggaacaaggaaatagccggcgcctgtcccctagaccgcccgcccgacctcttccacacccatccacccttgctgacttctcnnnnnnnnnngttgccggcgcctatcccctagaccgcccgcccgacctcgtccacacccatccacccttgctgacttctccgccgcccacctgggtatgctgctgaggcctcacccggcttccacatggccgccaggtgcagctgctggagcctggcgcgcttcgccaccgggtctgcagtgttgacggcctgcggattggatgggggtgtcgggccgggtgtcgggccgggagtttgagggagggggtgcagcagaagtcgacaatcagtcgccatggcatggtcccttcccatatttgcctcatacgtcnnnnnnnnnnaagagggggtgcagcagcagtcgacgatcagtcgccatggtgtggtcccttcccatatttgcctcatacgtccactgaggcggcgctggtgatccccgggctcatgcatcgtgggtggggagtgggtgtccccttcatgcagggcggtgctcctgtcctccacggccctccaggagcctcgtgacggggcactcttgcccaagaccccagcgcacctgcacatacgcgtcgcgcatggcctcctcacgctcgcgctgcaccctcctggccgcccgcgggttggggtcgtcattggcccaccgaacgtccagcacctcagcgccatgcacacctggaagcaggatgtgttcgagggggggtgagcttgaagcagggcaggcgctggccagnnnnnnnnnnggcacacctggaagcaggatgtgtttgagggggtttgagcttgaagcagggcaggcgctggccaggctgcagcatcatggcccgggccgtgccagggaggcgccgactggccgccgcggtgtcctggaagcccggcttgcgtcaggcaggggtgttcagaaccgcgtcttgagcggccacaatccacgtgcacgcactgcaaaggtcgtaccgcacctggtgaatgctgagcgccggcctcgagacaccggtgccccatgccctccccctcccccaccctccttctctaccctcccccaccccc

SEQ ID NO: 46582 - DNA, 77 bp, Chlorella protothecoides
cctggcagctctggcgctgccaggacgccttctccgcaagcgatggtcgtgccagcgagcgcctcgcatgatcggac

SEQ ID NO: 46583 - DNA, 61 bp, Chlorella protothecoides
cagcccgcgcggccccacgggcgtgacgatgcgcggggagagcacggcgtggcccgcggtg

SEQ ID NO: 46584 - DNA, 61 bp, Chlorella protothecoides
gacacggcctgctcctcctccctggtggccgctcacttagcctgctgcgacctgctggcgc

SEQ ID NO: 46585 - DNA, 80 bp, Chlorella protothecoides
ccgccccctcccgccggagctgaagggcgccctgtgcatcccaggtgggtcccgccactctgtacgtgcgctgaggcaga

SEQ ID NO: 46586 - DNA, 64 bp, Chlorella protothecoides
accctaaccctaaccctaaccctaaccccgcccgaccgtctctttccacgagccccaactgaga

SEQ ID NO: 46587 - DNA, 62 bp, Chlorella protothecoides
gagaagcccctggtgctgtggagttttgagggcagcccattctgcaaggtgagcgagctggc

SEQ ID NO: 46588 - DNA, 61 bp, Chlorella protothecoides
atcctacctacttgtgattgtaggctttataattgtataaatgttttgcaaggattgacgt

SEQ ID NO: 46589 - DNA, 69 bp, Chlorella protothecoides
cctccaccaagggtgctgttcctcaccgcaccgcaacaccccaacatactcctgacactgcagcactgc

SEQ ID NO: 46590 - DNA, 2406 bp, Chlorella protothecoides
  modified_base (570)..(579): a, c, t, g, unknown or other
  modified_base (1033)..(1042): a, c, t, g, unknown or other
ggcggccgccgcggcctggttcctgctcccgcccgcgctgcgcctgctggggtcggggttccgcgggtatgcgggcgagatcgcgcccgccgccgccctcaacgagctgtccggctggcgtgacggcgtgctggtggacctgcgcagcgaccgcgagaagtcggtggcgggcgtcccggacctgcccagcgccgggaagctggtggaggtggagtacgcggagatcggggaccgcagggcgcgcggcgccctgcgcgaccccgggtcgctggaggcagaggtcactgccatgcaggtggcggggctgaagcgcgccaagcgcggctcgcccatctacctgctggacaagaacgggggcgtggccaagacgggtgggtggaggggtgtgaggggtgtggagggaaccggtgcctggcgccatgccgggaaggctcttggagtgatttgtcaggcggtcattatgacaccccagtgcacaatgctgatctcttccagtagccttgccacactgtgctcaccctgcacttcacaacccttgcccccaaacacgcagttgcaaagaacctggcnnnnnnnnnnagcgtggccaagacgggtgggtggagggttgtggggggtgtggagggaaccggtgcctggctccatgccgggaagggtcttggagtgatttgtcaggcggtaatgatgacactccagtgcacaatgcagaactcttccactagccctgccacactttgctcaccctgcgcttcacaacccttgccccaaacacgcagttgcaaagaacctggcgcggcaagggtttaagagggtgtacgtcgtgtctgggggtttccagggctggcagaacgccaagctgcagatcaagccctcctccagcgtgcgtcgcgtgtggtggccggcgggggggtagcaggcctcgaggatggtgctcagcgcagcgccatttgttgcttcagtccatggttttgtttgctgaagaatgacatcgcacttgtctggcttgtgtatctggttggtcttctccacagannnnnnnnnncgttgctgagcgcagcgccatctgttgcttgagtccatggttttgtttgctgaagaacgacatcacacttgtctgtcttgtgtatctggttggtcttctccacagagcgacatgcacccctggtgctgccgttcatctgaagggcccagtgtgtgaaacatgccgttcttcattgctgctgccctaataactgcccaatccctttcctcttgctttcatcaggtgtctccatttgacatcctgctgcccggaaccggaaagtacagcgccaggcagacgaccagcacccggccccaggtagtgcagcgtggctgaggggggcgtgggtcagcatgccactgaatgtgcatcatagcgtcattacgtgagcaatcagctcaatggtgtgtcaaagagcccaataaacccaacccacgactacacatccaccataggggcgccgtgcactgcccagtggtcggtagagattacgtcccccttctccagaatgtgctcgcaatttctgcatcgttgaacgtagctttgcgtgcacccttagggcgcaccatccttgggcaggtcccgggccgatttgatgatctttggcattgccaggttgtaagacaagttgaagggtccagcgaacgcggctgtacctctgcccgtaggcgtggcaagccattgtcttgttcagtaggcggtccaatgggggcaccgggtcgatttgcccccgcccccgcccagtcttgcccgcagcttatcttcgcagcacgaccacagcgcgtgcatagcacagcaggccccgtataaaactttgaatccggacttctccacctcgagtggccctgaccagaccttgcgcatcgcggagagcgcaggagcagagactcccacgccccagccttgcacgcgaagtgtcgcaggatcgcgagctgggcagggggagacgcagcgacgcgcacatccggcttccccgttcccatcccgtgacacacggcttccaggtcctctcccgggctccaacccggcccgtcacccccccgggcgactccagcatgtctacggtgggcagtgcccagttcgagcagctgcagagcctgctgcagggcggtgacaaggcgaaccccggtcgacgaggcagccccggctcccggtccaagtcggggtccgggggccagcccctccccggccccgaccccacccaggtcgcacctgcgggggccgcgcccggcaggcccgcgggctacggctcccacgcccccggcctgagccagctcaccgacctcctgctggagcaggacaaggcgggcctgggaggggcgaagggagcggcggcggccactgctgccgcggcggccacggccgcggcagccgccgccaagtcc

SEQ ID NO: 46591 - DNA, 80 bp, Chlorella protothecoides
gcattggctatggagcgtgggcgacacagcgcgcatgcaaccttgctgggggggatggttctgggggcatcgacgccgct

SEQ ID NO: 46592 - DNA, 61 bp, Chlorella protothecoides
tgggagttgtcgtagaaggaccggcaggggggcaaggtgcgctcaaccatggtgtggggag

SEQ ID NO: 46593 - DNA, 68 bp, Chlorella protothecoides
caggaccgcctggtgctggacctgcaggcggtgcgcgtggagcgcgcggacttccaggccgcgctgcg

SEQ ID NO: 46594 - DNA, 74 bp, Chlorella protothecoides
ggagcggacgtcgccagaggcgaagccactactaccggcggagtcgctggcgctggcgctggcgacgccacaga

SEQ ID NO: 46595 - DNA, 69 bp, Chlorella protothecoides
atacacggtttaaatgagagatacacgcttcgagcaagtataactacccacagagggccgcggtttcta

SEQ ID NO: 46596 - DNA, 64 bp, Chlorella protothecoides
gggttgggagcccatcattagcagcacacccaacatatcatgctgtgcacccaccttgagcact

SEQ ID NO: 46597 - DNA, 61 bp, Chlorella protothecoides
cacccataggcccctgacttccagctcgggaatcgaggcagaggacattgccaagcgtctg

SEQ ID NO: 46598 - DNA, 61 bp, Chlorella protothecoides
cacgcagctggcttcctggcggacgccatcgtgggcaaccagaccccctcggcgctgcgtc

SEQ ID NO: 46599 - DNA, 61 bp, Chlorella protothecoides
cagactggtcttgcccagccgaagggataacacccctgggaggcagtctctcgtatgcaag

SEQ ID NO: 46600 - DNA, 86 bp, Chlorella protothecoides
gagatgggcgaagccgctgtgggaaaatgcttgcgccatgcatgggggcctccatcccctgccaaaacacccacctcctctagcca

SEQ ID NO: 46601 - DNA, 70 bp, Chlorella protothecoides
cagtgccggagccgttggtggggtggctggcgttttggagtgaaggagtttggggagaatgaaaaaccgg

SEQ ID NO: 46602 - DNA, 91 bp, Chlorella protothecoides
cctcagtggcaggatcacgtccagtcctcccgcaatcaacatctttccatcctgtcaccccgacacctgctgcagatgcgatggtaagtct

SEQ ID NO: 46603 - DNA, 94 bp, Chlorella protothecoides
actgagcaggctggcggtgggaaggggcaccgggtgtgcgtccccggcgtcccccacgtggccactctcccccgccgcggaggcgggcgccgcg

SEQ ID NO: 46604 - DNA, 66 bp, Chlorella protothecoides
agcaatggaggtgctgactctccggcagacaaagaggaggagggagttggagcgggcctcggcagc

SEQ ID NO: 46605 - DNA, 61 bp, Chlorella protothecoides
gctgcgggctgcgtcctgtacgagctggccaccctggcccggcccttccagggtcagtcgg

SEQ ID NO: 46606 - DNA, 61 bp, Chlorella protothecoides
gcggttcatgccgggtggggagtacgagcagtttgacgaggacatccggccctacatggtg

SEQ ID NO: 46607 - DNA, 65 bp, Chlorella protothecoides
gagtggagggacgatctcagcaaggagagtactgacacaacaggtggacagtctgcagcactcat

SEQ ID NO: 46608 - DNA, 97 bp, Chlorella protothecoides
gccgcaacccacatacacctctgtcagccttacctccgcaaactttgtgaccatttcaccccccgatcgacccctccctcctcacccctcctcccgc

SEQ ID NO: 46609 - DNA, 61 bp, Chlorella protothecoides
gatgtggacaacaaaacgtgggtggagaagggatgcgccagtctcctcagtgtatttgcgt

SEQ ID NO: 46610 - DNA, 76 bp, Chlorella protothecoides
ctcgtcagccacttgggctttatgggaccacaggcgcacctgcagtactcgactgacaaccagtcctgtgcgtgtg

SEQ ID NO: 46611 - DNA, 77 bp, Chlorella protothecoides
gtcgcggatcaggcccaggagcctgatgccacaaatcaggggatccccaatcagagagtgcacccgcccgccctcac

SEQ ID NO: 46612 - DNA, 86 bp, Chlorella protothecoides
agactccttcatgcagtcgccttgcgagcatggcacacatgtccccgtccactgcgccccccccccctcgtccctgtcacccactc

SEQ ID NO: 46613 - DNA, 79 bp, Chlorella protothecoides
gctcgataccactgagagcatgccccagatcccccccccccagacccttacagcaccccacctgcaaagaggaactcca

SEQ ID NO: 46614 - DNA, 76 bp, Chlorella protothecoides
accgatcgaaacggactgctttggaggtaccggcttttatataggagcttgggctgctattgggtctgtaacaggg

SEQ ID NO: 46615 - DNA, 61 bp, Chlorella protothecoides
tcaatgatctcttcttctcatcctacacaactttaagaagaacacctctggcctcctccac

SEQ ID NO: 46616 - DNA, 73 bp, Chlorella protothecoides
cgcgggtgggtgttgtcaaggggtgggttcggcaaaaggggtcaaaagggtccagagcttggggcgtgtatgg

SEQ ID NO: 46617 - DNA, 62 bp, Chlorella protothecoides
ccgtggcgccggccccagcgctcatgtctcgcttccccccttgctctcccgtctaccaggcc

SEQ ID NO: 46618 - DNA, 61 bp, Chlorella protothecoides
gggggagcattctgaccgccatgctcttgatatcgcacactgccttcgacagaccagatgc

SEQ ID NO: 46619 - DNA, 61 bp, Chlorella protothecoides
ggtgggtgcagagtggtggcgtatcggtggtggcgcctaaagtctgcgccgagggattcca

SEQ ID NO: 46620 - DNA, 73 bp, Chlorella protothecoides
catcgctgggtttctccaaaggagcgggcccaccatgactccgtcacgacgtgccgcaggattacgtcaagtg

SEQ ID NO: 46621 - DNA, 61 bp, Chlorella protothecoides
ccagactatgaagaatcctgctatgtggagggtcatgaacgacaccttcatggtaagcctc

SEQ ID NO: 46622 - DNA, 65 bp, Chlorella protothecoides
gcctgtgtcagtgcgtggattgttgattgcttcagcaccttggtgtgggtgagtagcattggagt

SEQ ID NO: 46623 - DNA, 61 bp, Chlorella protothecoides
cctgggtggaagaaggtcgaggggggggggaggggacaaggtttgatcacaaggaggaggg

SEQ ID NO: 46624 - DNA, 80 bp, Chlorella protothecoides
aggagcccatcacgttgaacgccttgttgatggggctggccgacagaccacccacagacccgaggtggttcttggctacg

SEQ ID NO: 46625 - DNA, 110 bp, Chlorella protothecoides
cctctcgatgccccttgacccctgccatttggagcccgtgctgcagtactctcaccttcacgccatctatatatgtatcaagctgcgtcccggaggtggtgaaggccacc

SEQ ID NO: 46626 - DNA, 78 bp, Chlorella protothecoides
tgccaccgtgagcagcctgagctctagttaatgcaagttgtggcctattcagcaaccagggtctcacctctccacccc

SEQ ID NO: 46627 - DNA, 150 bp, Chlorella protothecoides
agacagactccctcgctccccgcacggcaggtgcatgtaagatgctctccatacatggtcatggaatctaccatggggggggtcggaacagccaatacaattatagtgcctcggcgagtacacctccccgcattccccttgcccacttgc

SEQ ID NO: 46628 - DNA, 75 bp, Chlorella protothecoides
gtggaaggcggcggcgtacccccccatgacaatgaagaggaagatgaggagccagctggtatcgcagatgacctc

SEQ ID NO: 46629 - DNA, 96 bp, Chlorella protothecoides
tagtgcttgtacacccgcaccatgcctccaaacgtgaacctgtgtgggtggggtgtggggcggggaagggcgggtggtgggcatcgtggcgctcgt

SEQ ID NO: 46630 - DNA, 120 bp, Chlorella protothecoides
gccctacgccccccacattgcggaggagctgtggcaggtggggattttgcgtgtttgctgtaggggtcccctggggttgggtcacgagatggctgggcgcgcaggacatgcgtgcggtgg

SEQ ID NO: 46631 - DNA, 61 bp, Chlorella protothecoides
ggagtacctcgcccccatcatcacacaccatgaggccatgctggccttctccccagactcg

SEQ ID NO: 46632 - DNA, 61 bp, Chlorella protothecoides
ctcgtcgagcggccggggcgcggggttggcccgacatgtctgcatcactgcctggctgggg

SEQ ID NO: 46633 - DNA, 61 bp, Chlorella protothecoides
ccgcgatggccgtacagggatatgggagggtacttcccagcccacctctcctcagatctca

SEQ ID NO: 46634 - DNA, 63 bp, Chlorella protothecoides
tcccagctccctcacgcgtacctttcatctatcccagggccgccgtgcgtggtgccgtcttga

SEQ ID NO: 46635 - DNA, 83 bp, Chlorella protothecoides
cctggagaagctgcacgccgcggtgtggtcgagtggggcggtagaaggggaggatacatggggtgggggacagaccacctctc

SEQ ID NO: 46636 - DNA, 76 bp, Chlorella protothecoides
gtggccatgggctgccaggtcgcgttcttcaacgggggcaccgtgcgctccgaccaggtcagcagaggggcggggg

SEQ ID NO: 46637 - DNA, 65 bp, Chlorella protothecoides
gctctgccgccatggcatagtctgtgtgtggggggggatgactgtggtcggcacggacccgctgc

SEQ ID NO: 46638 - DNA, 61 bp, Chlorella protothecoides
ggagcaggaagctgtgttgtcgagcactgtcatgcatgtggctgtgggaaccccaaaccgc

SEQ ID NO: 46639 - DNA, 72 bp, Chlorella protothecoides
tgccgggcgtctgccacctcgcgcgtcgccgcctcgcgctctgccatccctgcggcggtctcggcccgggcg

SEQ ID NO: 46640 - DNA, 61 bp, Chlorella protothecoides
ctgagccatgtggtgtcggttgccctcaggaagcagtcccaccatcccattcccctggccc

SEQ ID NO: 46641 - DNA, 78 bp, Chlorella protothecoides
ccaagggtcgtcgcccactcagcgccacgccgatgtgcaagggggaaacttggatcaggccatgctctgcgcctgcct

SEQ ID NO: 46642 - DNA, 61 bp, Chlorella protothecoides
cccctcgatcacccggtccgggttctgcccgaatatctccatctggcgccggtgagcgtcc

SEQ ID NO: 46643 - DNA, 145 bp, Chlorella protothecoides
ccacgatgacgcgacacattcgcagcttggccagtctggctcggaggtctaggctagtcctcccgagcccggttctgcagccgccagctggcccaaatttggagtttgtaggaccccatgcgcaagcatcatcctccatcccctg

SEQ ID NO: 46644 - DNA, 63 bp, Chlorella protothecoides
cccagccccgacccccgccgccgcctcgccactcaccccgccctgccgctccccgccgcacgc

SEQ ID NO: 46645 - DNA, 78 bp, Chlorella protothecoides
cgataagctaggggcacttatgtgctctgccgtagtgcacgggcaacaccccgccctggctgcaacacgaccctcgag

SEQ ID NO: 46646 - DNA, 110 bp, Chlorella protothecoides
gtcggcaggtgtcgtccgggaagagctgatcccttgcgccggtttcattccaagggatctcacatcgcccagttcggagaaaccagaccgcctcggggactagggacgcc

SEQ ID NO: 46647 - DNA, 61 bp, Chlorella protothecoides
gaacaagtttgtggaggaggagtgacagtcaggatgcaccatggtgttgtggggcaccctc

SEQ ID NO: 46648 - DNA, 76 bp, Chlorella protothecoides
ctcagaagcagctctgattgaggatggcctcgatgtctataatgctggcgcagcagaggccgccagcttcttgcgc

SEQ ID NO: 46649 - DNA, 67 bp, Chlorella protothecoides
cccacgccggcacgtggttggggagtagggggtaactatactgcaggggcgggtcgtggagccgggg

SEQ ID NO: 46650 - DNA, 70 bp, Chlorella protothecoides
cacggtggtgaagatgttgggcgggatggacaagtaaaatactcgatccccccgcttgaagcgcttctcc

SEQ ID NO: 46651 - DNA, 61 bp, Chlorella protothecoides
tcttgcgcagcatcaacgacggccagcgacccgcctagaagcatccgcgccattgcatgcg

SEQ ID NO: 46652 - DNA, 83 bp, Chlorella protothecoides
ggggaggacgttctttgacagtcacaaccaatctgtatcatttggcagcaagttgagagttgtggaccattgcatggcctgaa

SEQ ID NO: 46653 - DNA, 168 bp, Chlorella protothecoides
cgtacacggaaagggacggaagggttacgggcaggcaggtgaatggggacgccatgatgctcccacgggatcgattgatcggtgtggggaggcgcagtcggcagccaggcaagcgcagcgcccatacatgcgccgccacatcgggctgactcggccagcagggcctgg

SEQ ID NO: 46654 - DNA, 61 bp, Chlorella protothecoides
aaaaagaaaatagccgagaggggacaccagcggtgagggcaagaatggctccccacaccac

SEQ ID NO: 46655 - DNA, 79 bp, Chlorella protothecoides
tccatggcctccagatccacagcgcctaatttcaagggtgttgggggtaaagaggttcagcgattgcagtcacggaatg

SEQ ID NO: 46656 - DNA, 61 bp, Chlorella protothecoides
atgtcccaggggagaagggtgccagcatggctgccacactgctgtgggcttggaaaggtgc

SEQ ID NO: 46657 - DNA, 92 bp, Chlorella protothecoides
aagcacctctctgcgtttggcgcttacgatattcctggcaccgagcaggatctctcgtgccactctcttgctttgcagtgcgcttgcgctgc

SEQ ID NO: 46658 - DNA, 62 bp, Chlorella protothecoides
gctcacagatgaggatggggctggccttggtaaccttgcccacgtcctcgtccgactgcatc

SEQ ID NO: 46659 - DNA, 74 bp, Chlorella protothecoides
gccccctcagcgccgcccgccaaagatgctggtgtcgactacgatgcaggcctcgcgcaggtcggccagcaatg

SEQ ID NO: 46660 - DNA, 77 bp, Chlorella protothecoides
tctgagagcaagcttcatcagggagtgaagaatcttcccccattccacccaccgacctgcattggctggtaccccag

SEQ ID NO: 46661 - DNA, 92 bp, Chlorella protothecoides
ggtgtaacctccctgttgtaggaggagatatgcattcatattaaaaggtaaaccgagcatccgcttgcatcacctgaaaccttgggatgcaa

SEQ ID NO: 46662 - DNA, 6619 bp, Chlorella protothecoides
  modified_base (293)..(302): a, c, t, g, unknown or other
  modified_base (530)..(539): a, c, t, g, unknown or other
  modified_base (622)..(631): a, c, t, g, unknown or other
  modified_base (968)..(977): a, c, t, g, unknown or other
  modified_base (1371)..(1380): a, c, t, g, unknown or other
  modified_base (1927)..(1936): a, c, t, g, unknown or other
  modified_base (2205)..(2214): a, c, t, g, unknown or other
  modified_base (2738)..(2747): a, c, t, g, unknown or other
  modified_base (2836)..(2845): a, c, t, g, unknown or other
  modified_base (3594)..(3603): a, c, t, g, unknown or other
  modified_base (3681)..(3690): a, c, t, g, unknown or other
  modified_base (3832)..(3841): a, c, t, g, unknown or other
  modified_base (4475)..(4484): a, c, t, g, unknown or other
  modified_base (4691)..(4700): a, c, t, g, unknown or other
  modified_base (4919)..(4928): a, c, t, g, unknown or other
  modified_base (5435)..(5444): a, c, t, g, unknown or other
  modified_base (5881)..(5983): a, c, t, g, unknown or other
  modified_base (6357)..(6366): a, c, t, g, unknown or other
  modified_base (6440)..(6475): a, c, t, g, unknown or other
gttggaggaggtggcacgctggttggtggcaccttggggcttggtgatggactgtatggtgtcatgggaggaggcacgctggagggagacaccttcggggatggactgtagggtctgcaatagggcaaaattttaatgtttggtccgtttgaatatttgttgttgaataggatggacgacattcacgtcgttgatgctcgaattccgcttcttgcatattaagtcaacctacctgggagcgatcacttcttctgccagtgctcttccatattcattgcgggcctgagcaaggnnnnnnnnnntggaggaggcacgctggagggggacacctttggggatggactgtagggtctgcaatagggcgaaatttaaatgcttggtccgtttgaatatttgttgttgaataggatgcacagcattcttgtcgttgatgctcgaactccgcttcttgcatattcagtcaacctacctgggagagatcacttcttctgccagtgcccttccatattcattgcgggcctgaacaaggnnnnnnnnnnaatctgttacgctgaagatatatgtggtgatcagccgatagtcctgaacactggagcatggggcagaacaccccaccaatgtnnnnnnnnnntggtagagttcggagtcattccataatggcagcaaacacaatattgcacagtgctcatgcaacgatctgttatgctgaagatgtatgtggtgatcagccaatagtcctgaacacgggagcatggggcagaacaccccaccaatgtaccttgagatgccgccactcagctgcagagcctgtctggcttagcactgccaggcacaccagcaccaggacctgtgttttatagaaaaggccgtgacttgcagttggcatagtctgttgtgacataagcccacctcagagcctgaggcgcacaggtaggaccctggagtcactcttacctgtgtcctcatgnnnnnnnnnnattgtgacataagcctacctcagagcctgaggcgcacaggtagaaacctggagtcactcttacctgtgtcctcatggctgccccacggtccttggggacttatatggttttgaaaccccggacgagtgaagtgtcagtagcgtcgtcactgttcgaggacctgcaagcgggcagaggtgagatgctcagggagatcttactgacggtggccacgcgtggtgcagggaagcacttccaaactacagaagcatatttgtttgtaggcagtgggcaagtatttcccttcgaaatggcccatgtcggggcctcagcgtgggagcagcgccccgctgcctgccttcggccccggtcggcacatgctacactggcagtcaggcacactgacccgccactnnnnnnnnnngaatggcccatgtcggggcctcagagtgggagcagcgccccgctgcctgcctttggccccggtcggcatatgctatactggcagtcaggcacactgacccgccacttgcacctcacccaaacatgacatgcggttgggcaagcacgattacatagtcggccgcacaggaacgccagagctcctgtgcccacccactgtcacgaccgaagggggggaacaagacccgactcacctagttcgcgttgaggccgagtttcgtcctctgctagcaggtttaaagatcttatcccgtgcaggatctctcgacgtgaagcgaaacggtgattcctggagggttgctcccctagtcgtgctctcacagcaaagggaggcggggctaatcaatcgacccgggcttaatgccccccaccccgggacattcgcacgcgccccatcgccaaccatggtaggtgcttgtactgtccgcctgaaccacaacaaggcacaataacgcctaacccaacacccaaatatatgtagtacatgtgggtttgtgccaagggagtgnnnnnnnnnngtgaccgtggtaggtgctcttactgtccgcctgaaccaccacaaggcacaataacgcccaacccaacacccaaatatatatagtacatgtgggtttgtgccaagggagtgtggccgcttgacaaatcttgttgtctgagcgtcgatgcacattgttgtgtcggctgacatagccctcggattgaaggttcgaacaccttctattcccacttgaatgtcacaatgcctgccaaaggcatcgtctgatctctgatgctccccactgaagtnnnnnnnnnntgctgacatagccctcgaattgaaggttcgaacaccttctattccgacttgaatgtcacaatgcctgccaaaggcaccgtctgatctctgatgctccccactgaagtaatttcggtcggatgccatagtacagacatgtcagagggctggcagacatcgctgctatgcatctacatgccggtccagattcaaaccagggcagaactcgtattcaaaactcgaggctttcttcacaatgtgccgagcccactctgctggtggttgctcagctcacttcagcttcagcaccggcaggttcacatcgctacactcatgggagagggaatcggatgttagcgtgatgcatcatccctactatggcacctcgcgttctcctgcgtcccagacacggcaccctacctgttgcactcgcccggggcctttccctgacactccagtgcaagatcgtcggcaatgtatttgacctctccctggtaggggcccaggtcgcaaccaatgatgttctgttcatgaggggggggggnnnnnnnnnncttgacctctccctgataggggcccaagtcgcaaccaatgatgttctgttcatgaagcgataagggggggggggggggggggggggggnnnnnnnnnnaggactgcatcgtgcagccggagatgcacagcgcaggagatagcagcacaagcggacagggccagcaccttgtgccagtctttgctgctgcggccggcgctgctgtccacggttgaaggtgctgcacagcgggacccagctgcgccctcccacgctttctacattcccagaccttcccgacatgccaccaccctttgacagacctttgggaatttgcaggtcccgtcggacacagtgcgactcctggcgaggttggcataggaggtggcaaggcgtttcttgtcgttcagctccttgttagcctcggagcgggccaggagatctgaggtctgggtgggtgggggggggggagggaggagcatggacggatatgtgcaagacttctaggccttaccaccacaggaaaggtgctgcgacatccaacatgacctgtccagcaccccaggccaacagctcccgggactacaagcatcctccctcctcacaaattctatccagcatgcccacggctgctcaccaggtccgcccgggccagggggctcagaatcatggagcccgacagcagaatcgcagctcccatcatgcccctcctgctctgcaagctagcatggcaaaccagtctgcttcccctcctgcatgccgtgtctccagggacccgagagagctcgcaggtgcccacgtgcctgcatgagcggacgatgtcgtatgcggagaggggatgggctgacacggtacacgcttgccttctnnnnnnnnnnaagaccacaagcatcctccctcctcacaaacccatccagcatgccctcggctgctcaccaggtccgcccgggccaggnnnnnnnnnngtggcagaccagtctgcttcccctcctgcttgccgtctctccagggacccgagagagctcgcaggtgcccacgtgcctgcatgagcgggcgatgccgtatgcggagaggtaatgggctgacacggtacacgcttgccttctnnnnnnnnnncacgagtgaagggaccctacaggagcccatgagactcgcggggtggaggggaagcgtcccatgccgatgacgctcacctggtgcttgcgatgcgtgacatcatggtctcaggcttctttcgggttccaggttccgagtacggaggcgttgcgttactagggtgtgttccggggatatacacccaaccttcgcccggccggatgttgagtagatcgcgatggattgtgcacgtgggggtctctgaggatctatacattttcaggccacctctggctctcaagtgaacaatttcccagagcaatacttttcatgtcgtccagagatgcgtgttcgaggtgttgttgtattgcaccgatgaaagcgatctaccaagatggtcttgcagcttgcataactgggtttgggatgcagacatgctcagtattctaagccgctccttctcatcgttgcgaggccttctttctaaactctgccagaccatactcccagttatcggatgtcatcccatggggggtgtatattgagaccaccccaagtctcgaaacctcctgagcagcggaggggagcacgtcatcaggagagggcaccttggcagccaagagtgcatggtaatctcagagatcatacatagacnnnnnnnnnnatggctctcaagcgaacaatttcccagagcaatacttttcatatcgtccagagatgcgtgttcgagttgttgttgtattgcaccggtgaaagcgatctaccaagatggccttgcagcttacataactgggtttgggatccagacatgctcagtgttctaagccgctccttctcattgttgcgaggccttctttctaaactctgccannnnnnnnnnagaccaactgattaatccggcgggggagagggggtgtttggcatgtcttcaaacccagctagcacaatgcatgcaggggtagggggttgcctgccacctgagacgaatctctggggtccacgccagcaactgatcctggcacacatgcagcccaagtggtttgcgggtggagcctgtgtgctacaccttccctcagctcaccaccctcctgcagaaatnnnnnnnnnntgcagcccaagtgatttgcgggtggagcctgtgcgctacaccatccctcagctcaccaccctcctgcagaaatctgtcaagaccccccccctccccaacctttatgttccaggactcgttgtcaaagaagagcatgtccttgaaggcaatccccgtggcagcctgtattcgcttgaagtgtgtgaccttggacccgacgtagatctccctgattgaggccatactgtgcattgtatgggccccacagactttgaagagctgcagagcaagcaaaagatggaaccagtgggtatggatgggggtctggaaactgaagaggggtgcaggaggaggaaatactgtggatgcacatgcaaggtaatcacgcaggcagggccccagcaggcgatgtgcagcacccccaccttgaggcatgcattggcccactgcgggtactcagtcctggagacatacgcaacctggagggagaggtgcacggggtagctctagcgctggaatgtgtggagnnnnnnnnnnacaaggtaatcacgcaggcagggccccggcaggcgacgtgcagcacccccaccttgaggcatgcattggcccactgcgggtactcggtcctggagacatacgcgacctggagggagaggtgcatggggtagctctagcgctggaatgtgtggagcaccatacaatcacaccatggaggggtcacctctgagtccagcacagagggaggcgactgtgtccctgctctcccaccccatgtcacagacctccgtgttctgccactgaggctgggtggccagctctgccaggatctcccgcgaggagcccatgagttccacctgctcgcctcctctatccagcacacactgagggtcgtcggggtcaaccctgaatggtggccccgatagcatgtacatctctggcagcctggaatggaggggaagtatggcaggggggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgtccagatcaaaagccaccagtcgtgggtatggtgctgcttgcgtcgctgtcatggcacgtgcccggcgcagtccaagaggagaacggggcaggtctgcacgcgatcgtccaatggctgagcaaaccgatcccttcaatttgtcaaaagaagacatcagcgtgtgggggcttcttactgcttccttccaaggggaagagagtcagtgagggaagaagttttccgcgcgctgggcacagaatgagatcagtggaaaccagggcctttgcatggggagcaattgctgcatggacccaccaccacgaattccacggcaactccctcattgcttccattcaataatatcgttactctcgatttctgtggcagacnnnnnnnnnngtcagtgagggaagaagttgtccgcgcgctgggcacagaatgggatcagtggaaaccagggcctttgcatgggnnnnnnnnnnnnnnnnnnnnnnnnnnnnnnnnnnnnctaccacacgactgcatggcgagcgtgctcgctcgcggctctcgccggctggtgtcctcggggaccctgggcgccctcagtcgctcccttcgaaccgtgaccactcgccgcccaacctcgctcgcgtccagcggcctgccctcc

SEQ ID NO: 46663 - DNA, 107 bp, Chlorella protothecoides
ggtggcagtgagtgtcctgagaagacacagctgacgaacagtcctccaggataacgaccaatagtatatgctgccagtacttaccatcaagcaggagcactacacgc

SEQ ID NO: 46664 - DNA, 80 bp, Chlorella protothecoides
cctggcgcttcccagcaccgccttgtgctcaagtggagccaccacaccccctcccacctccctcgcaggccctcctggat

SEQ ID NO: 46665 - DNA, 61 bp, Chlorella protothecoides
catgtccattcattcatgcgtggcggctctttccatgtccatgcacgtccatccatgcgtc

SEQ ID NO: 46666 - DNA, 61 bp, Chlorella protothecoides
cactctgggccaggttctcgacatggtgacggacaggtgcgacagtgtttttaccatgagt

SEQ ID NO: 46667 - DNA, 64 bp, Chlorella protothecoides
tcgatgaagtccgccacctcgcgcacggacgggtagtcgaagaccagggtgcccggcagctcca

SEQ ID NO: 46668 - DNA, 64 bp, Chlorella protothecoides
gcccagacgcttctcccccaaggagacgacctgcaaggcacgacagcccagacgcctcgcctcc

SEQ ID NO: 46669 - DNA, 10784 bp, Chlorella protothecoides
  modified_base (1392)..(1515): a, c, t, g, unknown or other
  modified_base (1627)..(1636): a, c, t, g, unknown or other
  modified_base (1748)..(1757): a, c, t, g, unknown or other
  modified_base (1911)..(1994): a, c, t, g, unknown or other
  modified_base (2579)..(2588): a, c, t, g, unknown or other
  modified_base (3241)..(3250): a, c, t, g, unknown or other
  modified_base (4343)..(4352): a, c, t, g, unknown or other
  modified_base (6255)..(6264): a, c, t, g, unknown or other
  modified_base (6644)..(6653): a, c, t, g, unknown or other
  modified_base (7512)..(7521): a, c, t, g, unknown or other
  modified_base (7908)..(7917): a, c, t, g, unknown or other
  modified_base (8933)..(8985): a, c, t, g, unknown or other
  modified_base (9129)..(9138): a, c, t, g, unknown or other
  modified_base (9198)..(9207): a, c, t, g, unknown or other
  modified_base (9267)..(9276): a, c, t, g, unknown or other
  modified_base (10313)..(10322): a, c, t, g, unknown or other
cccgccccgcccccgtgcaccccatgccgtacccgcccacggcggcggccgcgccggcgcccgccgccgccgcgcccggcaatgagtactgcgcgctgttcgtggcgctgatcggggagggcgaggcgccgcagggcgtgctgagcacgggcgaggggcgtgtggtgcgcgccttccaccgcttcacgctggtggaccagaccgggcgcggcggcgacgtgtccaagggccggcgccgggaccagggcgcggtcaagatctcctgttcccgcgccgacccccaggcccgcaactgccacggctaccgcaagttcgtcaagcgcagcgtgctggaggacccggggcgcggcctgctggtgggcgacaccatcgtcatccgctaccacatccagctggtggtgtccacgggcggcgcgctggcacgcgcgggcgcggcgccgcgccgcggcgtggtcgtccccccgccctcgctggggccggagctggcctgcctgctggacagcggggagggcgccgacgtcagctttgaggtggagggccagaccatggccgcgcacaagatcctgctccaggtgcgctgaggtgggggaagtttcttgcttttttgttacggggggggtcattggtacccttgccgatcctgcaccctgcagccacagccccccccgtgtcgtcatgccacacccgccatcccccctcgtccttgtttgaaccctccaccctctcacacgagcactgctccaggcgcggtccccggtgttcaaggcgttgctgacggggccgatgctggaggggcaggggctgaggccgcgcgtggatgttcagggcgtgaagctccccgtcttcaaagtccttctgcactttgtgtacgccgacgacctgccagaggagctgcagggtgcgcgccggggtcggggcgggggtgtgcagtcgtgactgtatgagggaggtacgtcaaagccctgctccgtcctggccatgcgcctcctcccatcccacctcgaccccactcttcctcactttcctgttcccccgcagacaaccgcatggaggtggccatggcccagcacctgctggtggccgccgaccgcttccagctcatccgcttgcgcggaatctgcgagcagcgcctctgcgtcagcatcgaggaggagacggtggccaccactctggccctggccgagcagaacaacgcgctggagctgaagcgggtgtgcctggagtacgtcgccctgcacctgaaaaaggtactgcactcgtgtgtgagatctggttgtttgtgtgtgcgtgcgttttgcagggtgtttagtggggtcgcggtgggcttgctcgtcggcggtgatggaagcgccccagggatttagagaatggcgatgactcatgccgttacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatgcctgggacaacaaaaacttccaccctaatgttgccacctgccctcaatacttgtcgtccaggtcatggccaccgaagggtaccagtaccttatctacacctgcccgnnnnnnnnnngcatgcctgggacaacaataactcccaccctaatgttgccacctgcccccattacttgtcgtccaggtcatggccaccgaggggtaccagtaccttatctacacctgcccgnnnnnnnnnnccgggcttgccccgtcggcggtgatggaagcgccccagggatgtagagaatggcgatgactcatgccgttacgtagcgaaccggccctctatcccacgggttgctgcagcgcttgcatggatgggaatcgccacccaccttgtctggcgtgagnnnnnnnnnnnnnnnnnnnnnnnnnnnnnnnnnnnnnnnnnnnnnnnnnnnnnnnnnnnnnnnnnnnnnnnnnnnnnnnnnnnncaagtccagtcagagctcctgcaggtattgtgtctggattgtgggggtggagttgctgttgcaaacatgaacagagagggtgaaaggccaggcttcccaatcttctgcactactactcaccttgcttcactccccaccctctccaacccacaggtcatctcggggctcaatcggtcagcgggtacagcgtatctgcccgccggcctggccccagtgagggccggggaggacgaggcagacgtgatggaccagctccaccacaacctgggggtgggcggggagtcgtctacggagggccacatgcgccgcgttcgcgcacggcacgactgatgggcctctccagagcagcttgccgttgttcactcaggcaaaggaccgcggacaagtcagcactgcaacgcgcaatactctacgtggcatgcagttcctagaagttgcgcgccagccagtttcttggcaggccgccggcgcatgtagggccccctccctttgggagacaccaggctctgccctggtcggcaaggccccaaaactttgcgcaggccctctgcagtactctttgtcgctggcagtcgaccagcgtgnnnnnnnnnngggctctgccctggttggcaaggacccaaaaaccttgcacaggccctctgcagcactctttgtcgctggcagtcgaccagcgtggcttccaagacgcacgttgcgtttgctcagccttcaggggggttgacaacctcaatttgctgctcgtcccagaagccgccgtgcccgcacccaggtgtgccagtactgaatgctgtttacattccctttttaatacgatattatatggtgctttgtgcgaccaggcggggggagcagtgtcggaggaacaacgatgcatgcacccaactgctataagcagtcctccttgccccaccctatgagccggctgatggaccgacaggcttcacgcggctggagggtacatgcagctgtcgcatcgccctctgctgcatgctttcttttgcgggggcctgcagggggagcacctttctccaggcaaagtccaggaggaggaggcgacccaggatgatgccagccagaccgatgagcgtgatcttgagcccaaagttaggactgcatggatgcggggtgggaggctgtcagagagaactggggagtcgtggctgaggccgttcaaggctaacgtgtggaacagaaggctgagatggccgtggggacccagaagatgtcgctcatctatctcccannnnnnnnnnggaggattggggagtcgtggctgaggctgttcaagagtcacgtgtggaacacaaggctgagatggccgtgggaacccagaagatgtcgctcatctatctcccaggcactcacgtcttgttcctcctggtgtcgacaatccacttggcgatgccgagcaacagtagagccacaggcaccgtcttccacaacacctccaccccgatcggcattttgccctggcaacgggggatgagggagtggagtcgttgccgggaggctcatcaaggtgtcacagggtcccgagtgacatgcaccaggaatgccggcagtcaaggagcacctccaacaccgtccgtcactcacggcatgaaacatgtttgcagccaggggggtgtcagggaagaagaggatgaggagcttcagcaccacagcggcagagatcgtgacgcccgcaggagggacagtcaggggcagagagatctgcatggttttggggtgaaactgtgtgtcagcactacataccaggacggaagtttctagcgacgcttgctggttcctagatggcccccctgggacctacaatcttgcgcgggttgggagaaggtcctccagcagcagcatgaataaagggctgcgtcactagatggaaggtggggtcagtgaagtagcaaatgatgcacatgagctcgcacacttatgcctgcatgctgatcattcatgtggtgctctcaccctgcggctgcgcgatggtgcccgtcgataaccatccccaggtgtagagaataacctcgctccaggcggcagcggtctctggagacaccaccccctcacatggacaggggaggtgggacagacgcgccccagaccggctggagtacagcatgtgtgcgatgagatcatggtaccggatgcaacatccaatgatggtatttctaagttttagagactggggatgccctttgcgccctttgaactatttccctgtgcggtcgacatgcatacacatcgcgattcggtgctccccccagaacttgaacaccgcgcgcgcagaaaactgtcatcgcgacccttcctgtttcgccgtatttctgcatataaacatcacgctacgcnnnnnnnnnnacctatgaactatttccctacgcggtcgacgtacatacacatcgcgattcggtgctccccccagaacttgaacagcgcgcgcagaaagctgtcatcgcgacccttcctgtttcgctgtatttctgcatataaacatcacgctacgctacaacctgaagagaattgtgtggaacttctcaaagtgcaagccgcttgagttttccactctctcatggaccatgctcttgtaatcatttagtagaaccctgtagttggcaaacatcaccatgctggccctcccagggccccagcatgtttttcaatacacgggagacttcacatgcaatggagttcccatcgtcctccgccaagagggcggcatgggccgaggcacaggatgggccgtctgggatgcatccgtcaccctggcgcactggctgcagcacatttcagtggagcagaggctccagctcctgcctcctgggaaagccttcctggagctggggtccggcacagggattgcaggcctgtctgctgcagcgtgcctagaccagggctacgcccacctgtcagacttgccttcggtactgccagccctccggcataatgtccagctgaaccctgcggtgggtgtgttgttgtgaaaccagggggcagagggagagagagctggatgggttgagggcaaagaggcccctcacccaacccacaatcatgggggcgtggttacatgtcctccatggagagctgtttcctgccacacccgctccggcacccaggtctcctcccgtgtttcagtggtgccctgtgactgggagtctgtggggcgtgaagctctgcctgcggcgccttatgcgcttgtcatcgcagctgactgcgtctggctggaggcactggtgcagcccttcatcaacgccctcctcaccgccaccggccccaagagcaaggtgcgccctgggatggtattttttcagaagtcattgtaattttggaatgcttttggagacgtcggcgacccacatgctgccggttggtctatcgatgcaagcaccttgcgccgattctctgccgctctggagctcgatctcacctactgtcacctgccatattccatcgcacaggtcctgctggctcaccagtgccgatcacagcgtgtagatgatgccttcttccccaggcttgcagcggcattcaaggtcgagtccgtctctcagcgacctggtgagcccgaacggggcgccatcgacctgtacatctgtgagcgtttggaatgaattcttcctgggcctgttgcattccaggcgtcgaccttcctgctctgcctgcttgcactctcgtgccccttgcccaccttcctgctaccgttgctaacagcaccttgatttgcctgtaaactagtttgaattgctcagaccgcaagcgtacaggcaggggcttcagtgcagcagcacttcacggtgattgccttagcgtcattcaagagaagccgttcagtggcgctcacctcacctgccctccctgttgggcttgcagatggcgaggcccgcctccgcacccccccgactgcagacccctctcttgagcaggggccggagcgtggcattgagcagggcatgcaccccgctgtcgatggggtgcacgatgtaggggatggtggccagccccaccgcggtgggcagcgacttggtcagcaggggcagcagcgcctcctcgggcgtgttcagcgccgaggcgagcagcgctgtcaggctgtggcctaggctggtggcctgcatgggtgaagggagagaggggtgatatctgtgtgacctgagtggtgcagggttctgagactgaagcgggtcgaggctgatgccgccgaggatgaagggggtgaggacggggccattagggccctgtgcatgccacccatgctctgaagtannnnnnnnnntggaggacagggccatcaggaccctgtgcatgccacccatgctctgaagtaggccagggcacttcgtggcagggttggacccccagtgatcttccccctttccacaggagcccgcatgcgtcccacccacctcagcggccacgagcagctgcgtcaccaccgccaccagcgtgtggatggtgtacccgggcgccgccacggaggcgatgagctgccacaccagggtgtccaggccccggtccagcgcgatgaggtgcaccagcctgtgtgcggttgggtgggtggaaagtgaggcatatggaggggcagggctgaaacgtggggaggagggtgcccggggtccgcagggaaggaggctgggcgccgaggctggctggcannnnnnnnnnaagagggtgcccagggtccgcaggaaaggaggctgggcgccgaggctggctggcagacgggccgcttcccgccaagagcaccacgtcttgctgagggtgagggcttggagggatatctccgctcgccttggactgcccaaccacagccttccacgcccttcaaggcactcacagtggcacgtccacgctgctggggacactctccccgctcagcttggcccgggcgtccctgtaggtcgcttgccacttgtccacggtgtcgaagaggacgtaggagatggcgatggcataggacaagggcacgccgccggagaagagccaggcgccaaaggcctccccgacctcgttggcatatcccaggtagcgcaggggcccgtcccggagcgggtcgtactcggtcttggggatgccgtcaaaggtgccgggctccgaccagtccacactctccagcagccgggccagggggtggaggttgggcgtggggatggaggggtcccggcgcccggtcgtgtcctcctccgttccagcaggctcaaacaagtcgatgtctatgccgtcgcctcgcttctccggcccactgctgctcgggggggcccgaggtggtggggtatgaggtagggtgggcctcccattgtcgccaccctgtgtgctgcggcatcgtcccacagccctgcgacaggatgggggacgatgtactggtgccggcaagagtgccagcatgctgctgaggcgggggccaggtgggacctgtacgggaagtgatccaccaactctggcgacgtgttatgatttaccaagcaaactgcagtccgcgcgctgtatgatgctttacaatccagcacctccctcgttttagacnnnnnnnnnntcaggcaaactgcagtccgcgcgctgtacgatgcgttacaatccagcacctccctcgttttagacaggcgcccgcttttgtgttgttttgttttgctttgggtcgcatcgcggggtcggcattgggccgcatctcagggcgccagatctcaggctgggctcgacgaccatctcccacgctaatacatcttagatcacataccaatcaccatccaatagtttcagtgttggtcactaacctttggtataggaaatttgcttttgaaggtcgggttctacgccgatggccacccacgtttagggtgtcatctgcctgcgcacgatgcagtgctgatacttatggcggacaagcaggattgccaggaagaggtagatcgcttcctcggcnnnnnnnnnngctcccacgctaatacatcttggatcacataccaaatacctactaatagtttcagtgttggtcactaacttttggtataggaaatttgctttcgaagggcggttcctacgccgatggccacccacgcttagggtgtcaccggcatgcgcacgatgcagtgctgatacttatggcagacgagcaggactgccaggaagaggtagatcgcttcctcggcgacctttcctgggctttggatgccgcggatgaggctcgcgtgctgtcgatgctacgatcgctggtccccaggcctcccatgctgggggatgccgtggtgcagggcatggacctgctgatccgggccggcctgacccatgccagctccctgcagctggtggctgatgtgtgggacagggctgcccagcactgcggcgcgagggacctcatccccatcttcctggcagccaccgggtatgcaaggggagagcggagtgcatgtcaactgatgcgcctcgatctgggggcggcgcgtccatgggcagcctccacatggcccctgccaccaccacctgcagaaaacctgcccatgaccatgctctaacccacatggtaggaccctggcgggcgagcgaggcgacgatccccaggaccccggcgtcctgttgctcacgcatgcgcttcgcgcgctgggcacgctggcaccccgcgtgcatcgcggcggcacctgggtcgcccgtgacgtggcagcgctggtcacgcgcctgctgcaggactgcggtccgctgcccctccccgccctggaagcctgcgagggggtgctgagcggcgcccggcgcgccaccgcctcagggccctgcgacctccagaccgagctggcgctggccggcgcggcgctcacgcatcacacgttgaggggccttccgagcccggcgggcgctgcgggaccggttgcccccgagtactgggccgaggccctgtcggcagcctggggcggggatcacacaaatctactcgctcggctcctccaggaccccccnnnnnnnnnnnnnnnnnnnnnnnnnnnnnnnnnnnnnnnnnnnnnnnnnnnnngttcgggggacgccggcgctgccgtcatcctcgccctgagcagccgcctgtttggcagaatcgcagggccccccacccatgccagcacggccatcccctttgacgctgtgctcgcggcagcagcgcgcctgctgcgcccgggcnnnnnnnnnncgggggcgtgccggccctggtcagcctgtgcatctctgagatgtcgggttccaggaggcnnnnnnnnnnagggggcctgccggcccttgtcagcctgagcatctctgagatgtcgggttccaggaggcnnnnnnnnnncccccccacctatgacagcacggtcatctccttcgacactgtgcttgcggcagcagcgcgcctgctgcgcccgggctgcggcgcgggcctgctggcgctggcgtgcctggccctggcccgggctgtcgcggggaagggcaaggccgctgatgtgccctggggagggacccaggatggctgggcggtggcatgcatcaccgccctgcactcccccatggccccggccctggcgcccccggcagcccacgcctcgagatcgctgtggtgccgcattccgcagccgcaccaggagccggtcctccgcaggctgctgcgccaagacgtgaggcggcgtgcccggtgctggggttccgttcggcatcgatgcgggagcagggggtggtggtttcttgacacgaatcaccctgctctgagcattggccatgcaccaaaccacgcagtgcacgacctccaggggggcacagcgtcgggatgcctttgcatgggccccacgccgacctcacgccacctgatccccacctcccgccaggcacctcccgaggcagttcgcggcggtctgaccctcctctccagcgccgagcacccctccctgcttcccctggccctgaccacggccacaaacgccagcctgaccgaagcattcagcgaagagccctgcacctggctggagctcgccacgctgcaggcctcgctgctgctgcgccaagccctgcgtgtgggccggggctcgcggcccgagggcccgacgcttgaccccggcgcggcgcggcgccatatcgcgcacctgcggcgccgggccgcctggccgcaaggaaggggcggcaggctgcctctggaccgcctgcacgccacgctggattgggcgctggaggcgctggctcgcccgcaggcctgacggtggcgctcagctgggcatgcatcatgctgaagcttcactcccctacccgcctgccctcgctcgcagcgtgtgacaccctgtgctctgaagccacgtccctcgccccccgtgaccggtctacgtgggttcaaaagcacannnnnnnnnnccccctaacccgcctgccctcgcacgcagcgtgtgacaccctgtacgctgaagccacgtccctcgccccctgtgaccggtctacgtgggttcaaaagcacagaccggggcggcgcgaccccggcaagggggccctgggcgcgccatgcatacaccaggcaagtctgaggatcgcgtttctgagcgcgcatgcgaggtcgagcgcgtctctgccaggctgcccctcactccttcttcagcgacaggctcacattggtcttgctgtacagcagctccgtgttcctgccaggaggttgatgaagcaggaggacttgagcagggcgagtgtttccagggcgttgcatcgaggggcggggagatcggccccctggcacctgtccccccatactcccccggtcattcctcaaaccccgtcaaattcccccctctccctccccccccacacacacacataacatccccc

SEQ ID NO: 46670 - DNA, 61 bp, Chlorella protothecoides
ctggggttagcttcagcaagagatggcaccgtacaccagctggagatgccaagtacatgtc

SEQ ID NO: 46671 - DNA, 1071 bp, Chlorella protothecoides
  modified_base (414)..(423): a, c, t, g, unknown or other
  modified_base (922)..(985): a, c, t, g, unknown or other
ccggccagcgccgccctcgcccgcgccgcgccgcggcctcccccgtcgcccagggcccgcagcgcggcccccagcgcctcggcggcgcgcgcggggaaggtggcgcgcacgattgtaccgggcgggaggagggccgccacgccccggtaccgcgccagggcctcggccaggacgagcgtgcagtggccgcgctgcgagggtggtggtccaggagcatcgagggactggccgctggcccagggtgcggggcggtggtgtgtccacgccccaccgcatgactgcttcagctccggtcacgtgcaggtcccttgcccatatttcccacctgtttatgacaacccctgcatgcccttcctcccgttcttctccccccatactctgctcctcctgcatcctcaaccccccctactccannnnnnnnnntcaggagcatcgagggactggccgctgccccagggtgcggggcggtgatgtgtccacgccccaccgcatggctgcttcagcttcggtcacgtgcagggctcttgcccatgtttcccacctgttcatgacgacccctgcatgcccttcctcccgctcttctcccccaaaccctgcccctcctgcatcctcaaccccccctactccaaccccccaaacccaccctgtccaagaggcccgccagctcggcatcggtccccgccgcctggagccgggcgcgggcaagggcgtcgggtggcacgccccgccaccccgcgaccatgggccccagggccagcgcgggcgcggcgcccggatcgacggcctggacgagggccgcgacgccgccgtggctcggtcccagcagggagtccagcagctgggcgtgcgccgctgcagcgacctcgctctcggccagggcggcctgcaggcgcgggtgctcgcaggcgagcgccgcgcccgnnnnnnnnnnnnnnnnnnnnnnnnnnnnnnnnnnnnnnnnnnnnnnnnnnnnnnnnnnnnnnnnctcagcccgctccctggcctttgcggcggcggacctcgcggccgccgcggctgctgctgcggcgcccgtcgcggtggctgccgcgg

SEQ ID NO: 46672 - DNA, 91 bp, Chlorella protothecoides
ggtgtcatccaatcaggcatgcgtggcgacattgcgcaggatctgggaaggaaagtgtgacacctgagattgcagggagtgccatggccat

SEQ ID NO: 46673 - DNA, 71 bp, Chlorella protothecoides
cgggggacggcgcggggtggagctatgcgcacgccgggccccccacggcccggcctcccagcctgcagcac

SEQ ID NO: 46674 - DNA, 63 bp, Chlorella protothecoides
aggatcactgcttgcagcagcaaaagggccgtgcatgcatgcatgcatgcatgccttcagcgt

SEQ ID NO: 46675 - DNA, 61 bp, Chlorella protothecoides
gtccgaccccctgggcctgccgcgcgccacaacggagacggcgcgccgcatcctggccacg

SEQ ID NO: 46676 - DNA, 61 bp, Chlorella protothecoides
tgccgggtgcagcgctttgccgctccggacacccctccgcgccagctgctcctgcgcattc

SEQ ID NO: 46677 - DNA, 168 bp, Chlorella protothecoides
catgtccctcacaaaactgatacaacatgggtcttttcaagcagcatgcttcattcaaaatcaaccagcctttaatgctcgaaattggaggttagtgaactgcatggtacctccacatagtgcacctcccgaccctctggagtggtctgggtaattccaacactggca

SEQ ID NO: 46678 - DNA, 11321 bp, Chlorella protothecoides
  modified_base (1606)..(1615): a, c, t, g, unknown or other
  modified_base (1806)..(1815): a, c, t, g, unknown or other
  modified_base (3186)..(3195): a, c, t, g, unknown or other
  modified_base (4908)..(4917): a, c, t, g, unknown or other
  modified_base (4993)..(5020): a, c, t, g, unknown or other
  modified_base (6499)..(6508): a, c, t, g, unknown or other
  modified_base (6759)..(6768): a, c, t, g, unknown or other
  modified_base (8437)..(8446): a, c, t, g, unknown or other
cccccgggcgcgcgcagccacgcgctgctcctggcgggggcgctgcccgacggcggcctgctggccgtgcgcctggccctgggcctggaccgccagcgcaacgtcgccatgaagctggcggtgcgcgcctccgacggcgacctggccgaggccgtgcacgccgtggtgcaggacgcgtagggcaggcgtgcccggggggatggggggttggaggggcggaggcgggcgccgaagcatggggcggcccctcagcgttcctggcaccatgggcaccccaccccaccctcccggtctgatgatggtgcgcgcgctcctcccttgtcttggccgcgcccgggagacgtgcgaggcatccccacccgcatgccctgccatccaccatgtgtgtgtaagcgcgagtattgtcgcaaggctggtggcgcacgacggagttggggcctaggatgtgcgaaacaggggcggaaaccccacgaacactcccagtcaggcgacccgcacgccactgtcggccacgacagggggctccatgcgctgcacgctgtgcacgctggcgtacaggccacgcaccgcaccctccagcttctccagtagcgcatcggtgtcggggccgggggcgcgcatctcgtgcacaaaggcacacagctcggccaggatcgccgcgcgcgtggcttcctggggtgaggggggagagtttttggtggttgggtccgagaccatgtggcgaggtcaggggccatgctttacccccccccacatccgtccagtctatgtgatagcatagtaagcaaagggcactcctcacctcgtcctcggcgaggttggccgacggggttctctgcaatcaagggggtgggcatgggcaggcgcatggcataaaggtcaggcgatttggtgcagtagaaaatcgctgtcagggagacggatgattttgtgcatgacacaacgtcgtgcccccatccaagcaagcaaccaccttcaggtaggtttcgatgagtgcgtgcacgctgcccagcccatcagccacgggctggatggtgtaccgctggatctcccgccagtcgaccttgaggctggaggggatgatgggcagggactgcgggagagtgaaggttgaggtagtggggaacaattcggatgctcatgggaaactaggggtgggagacatcggcgatccttggaaggttgattgatctcagatcgtaaccaccgcatcccgcgctcacatgccccaagctctggagctgggacaggagtgggtcggtggcaggtgtcgcgcaagatgtcggggcgaagacggtggtgatctgctcgacctctgtgtcctctggagcgtaggcgagcttactcctggacgctcccatggcagtacatctggtctcaatgctgtgccgtcatgcacgaatgcttttggacgaccaacctcagagatcctgctaagcccagcatttttgcgcgccctgccgattccgacgcaatgttgaacgccgagtcggaatggtgactttgtgagaccagtgcatgacctttccagcatttatccaatgtaaatgacatttttgattgcatatagataaagagtttcctgagcgacagcgacttgctccannnnnnnnnntatgatcgttttgattgcatatagataaggagtttcctgagcgacagcgacttgctccaggctgggcacgctcatgctcagacgcctggtggcgcaggcctgcgctttgggcctgcgttctagcgcttcggtcggtacaacacatccaaacagactttttgaatctctaaggatcaatgctgcattctccnnnnnnnnnnttgcgttctagcgcttcggtctgcacaacacatccaaacagacttttggaatctctaaggatcaatgctgcattctccagcgcggggatcgtggaggaggtccagggcgagcgggacttgaatgtcgtgcacctgcccaccgaccttcgaagcgtcgcacgcctgaaccctgcgctacacgatgcgatcgtacgggctagcgcatactctaggtaagggcctgggtaccgggagcgcggcctgcaagggaaggtacgcattcccatcactccctgttgccgcacatcacacggtttgtactccactgctctcacgtcctcatccttcccccatccagccaaggaccggagcggcccctgcatgcccaccttgcggcggtgctggctgagcgtggcctcccatgcaaggacaccctgtcgccgggaaccattggccgcctccgcgtggccgacctccgcgccagcctggatgccgtgggcggggacacggcggggaccaaggacgtgctgacgcagcgcctcgtgcacatgctccagcaggagagcggcgggctggcccagactccacccgaggccatgccctcggcccccctcgccagcacccccgcggggtgcgtggtcggggagggggttggatgagcgggcctctcccagggacaaccctgccgggcgatcgcccgccccgccctgccactgtcctcaccatggcccccgcctcagtgcctctggtccctgccctttgcaggcgcttcggtgtggccgccaaggtcccgcaccggcccaggccctccaccgcccacctgccggccttcaggccggaccccttggcgctggccgccgcgctggccgccgcccacgcctcgaacgtggtggtgctggacgtggcggggcgctgcgccgtggccgacgccatggtggtggccacgggccgatcccccgcccagctgcggggccaggccgaggccgtggtggactggctggagaggggggcgcggggggcggggtgtgcgccgccggggtgccgggtggagggcggccacggcgccgagtggctgctggtggacggcgggcgggtgatcgtgcacctcatgctggagggcgcgcggcgcgcctacgacctggaggcactgtggggcgaggaggggcgcagcgtgcacagcgtggaggcagcgccgggcgtgcagaccctggacggtcttatgccgggggccggggcctgacggaggagcggagtgaactggtgcttgggcgtgcgagcatgtatcgtgcccgtgtttcacactctcccaggcacgtcaagcgggtcagcaagatgggggaatggagggtgcggtgtgtgatacgggcaacataatgcatgccccgctcagcnnnnnnnnnntggggtatggagggtgcggtgtgtgttacgggcaacataatgcatgccgcgctcagcaccccgccatgtcagcggtgacggcggccaggtcggctgccagagagtcctcgtcggccatgagcgacatcatccaggcagccaccaggcactggccccgagcctccagggctgccgtgctcaaagcttttgctgcatctgctgccaagggtggcaggcttgttgtcaacacgtcctcctgacccaaccgccccgccaacgcttcaaactcacgcaggatgccctgcttgatgggcagctccgcgaggtgagcagtgcaggccttctccagcagtccacctgcgaatgaagggcaccgggcatgggtttcgggttgtttgaaatgttcaaagtctgacatctcacagcctgtcgctacccgtacgctgtcacaactagaaccaacaccaaacaaccgtcaaccaggaatccccttacatagttcggtcagggaactggtcttgaacacaggtgccagtgcaagacgggggaacgcctgctgccactccacgagctcacgcacaggcgtcgtgcaggtcctgcagtgttgtatcgagcgagcatgtgagaagggaggtcatgtaggggtacccccctggacagctgatgaaccatcctgttgaaaaaagagctccttgcgaagcagctttccagcttgtaccaagtctttacagctcaacaaacgcgtcttacctgaagctttccgccagatcggcaagctcctgggtggctgcggagaggccttccaactgttgcgcctgtcgggcgacgagcttaccagttgctgctgccctcaagtccggcatctccctgtacaactcccctaggggcagcaccgccaggtgtctgtggcggcatggacgacaggaggatttgcttggtgcatgtattggcacgtttgcggggggacgttggcaagcacatgccttgcaatgatactcaccgacataggccagcacactcacctttctgtgaggagcgcattgctcagtgccagggcacatgccctccctctgctgattgcagcctgcaagcaaggctggaagtaaccttggcttgctgcagatagaaaaccataaaggtgccacatcaagcaagctcgttggcacattccctagcagtatacatgcgtcgcaccttccatgtgtccatatatctgttgacatcattcaacgcaagtctgacggctctctgcagcagatgacgggaaatgacatgactgaggtggtcgggagtaggtgtacccagccacagaagccagcaatataggtacctgggcttgtctgtgatgctggcgaatgtcatgaggactcaacgctggtgcgctcatcccaacgcgagacacggctgtcacataatcgatgtctgcatggaggtgggctcactctacatgcgcaatgcccatcctgattcgtcgaggtcgggagccccggcccctggggtatgccactggaaaatatccagacagccagcaactgaggcaggaacggtacaattggcagatcagtcgaaagggaggtctgagtgtatcgtgaacatagattacagagtggccgaccctcctgtgtgtatatacaacatgcgatgttcgtatccgaaggaggttgtggcctcaatgccacgtcactaggtgtctaagccaagctatccgcagctggagctgcaaacacaagtgannnnnnnnnnttgtatcgtgaatatagattatagagtggccgaccctcctgtgtttatatacaacatgcgatgttcgtatccgaannnnnnnnnnnnnnnnnnnnnnnnnnnnctgcgtaacatcgagttcctgggtgtgcctgggtcctcggctgtggcctgcatgctggccaggcccagccttcgactccatcatgccgtccatgcaggtgggccacgcggaccattaacccgctaaatcaatcttcacaatacatagtttagaatgtgatgcttacattcaaactccacaggctccctgcgaggctcattggggttgacatctctggccgcacctggaccttgtttccaccatcatgggatctccctggaagcctccgcctctcagccaatccctatggcacggagcaagcttcggctacatgccatgagttcctccctagctcaaaacagcgtcccagcatcgcagcctcgtcagctacctccccatacatccatccccccgccctctctgccaccggggattgctgcctgggaaagtgccgtcgtgctgatcgacaagcctcaaggatggacgtcttttgatgtgtgcgccaagctccgcttcgccctgtccagaacactggacaagaaggcacggaccatcaaggtgctgagagcaggccccttgcagcactggcagtgaattgtacgggcaagcacctcccttgatacctaatcagcacctacacagcaccatcaccactccctaaccttcatcctttctccaaaaaggtggggcatgctggcaccctggatcccatggccacaggcctgctggttgtgtgtgttggccgggccacaaagctggtggagagcctgatggccgcgagcaagcggtacagcggtacgatgaggctgggtgagggcacccccagcctggatgccgagacccctgtgcacgagacaaagccctggcagcacgtcacaggtgtgggtgctattttttgggggggggggcagcaggcttgccacctcagccatgtccatgcctcaggcgcagcgtcccctctccttgcgcagaggccagtctggaggcggcagccgaggctttcctgggggagcaggagcagataccgcccatgtactctgccatctccgtcgacgggcagcggctgtatgactctgctcgcaaggggctggaggtggagaggaagtccaggcgcatcacaggtgggaatggcggtttgagggtggaccgtggccttggatagattctgacacccaccttcatcaacaggcgtagtatagcccattcatctggtgacgcaaggggcgagctgtctgtggccatcgccgcccgttcactctgacacctccctgtacaacctcgttgcagtgcacagcctgagactgcagaggtctgccgaagacccgcagggcgtggactttgtcgtgagctgcagcaagggaacctacgtcaggagcctggccgccgatctggcggcacacatgggcacggtggcacacctcaccgccctaaggagactgagcagtggggagcacgatgtggcagctgcttggcagctgcccgacctcatctcccagcttnnnnnnnnnnagtggcacacctcaccgctctgaggagactgagcagcggggagcacgatgtggcagctgcgtggcagctgcccgacctcatctcccagcttggcgatctcaagaaggaggatgcagcccaggcctgatgggaacttggaatgaaatggtcatgcctggcacccagagtaaacaccgtttgcaccctgcatcacgctagttgcttgagccttggacgccgcccaatgcactgctgcagcgccatgaactgannnnnnnnnnaaatgaaatggtcatgcctggcaccagaggaaaaaccgtttgcaccctgcatcacgctgaatgcttgagccttggacgccggccaatgcactgctgcagcgccatgaactgatacttgtatacctccctgctttgctttgctctcgttctgtgtccagctcgattacaagatacgctgaggtcctgcccgtcagtgggaacccaacatgccgccctggagatgcagagacgatacatttccggcagcggttttgcgcctcattctcaggcgcatgacagggctgggtggactggccctggatgcaaggcatgctacagccaaggatttggcatgccccatggtggattttgtttgagattggagctttcaggtggtaaccatgacggggttgtatggccgcctcctctcccacgactcctgcgggagacacataggatgcacttgtcaagagtgagcacagtgtgcctcagtgaatcactctgcaggcccccactaaagatgcacttgagttccaagtctgcaggtcctgcaccactgcctcctcgtcaatccacaccagcaccgcaccacaccaccccattctcacctgtgccatcatcgtcagcgccgacctggcctccctctcatccgacacaggcctcaggaaggtgaggcgcagggtctgaggctcgttggggggcagcaggggtacagtccgaatgtagaaccccaggctgtccagccagacgagctccaccgtggcaagatcatcggggctgcagcccatcgcatcagccctgcagcgatcgagagattgggggatttggaatgctgatgcatgaaccttcacaattatgaatcgcgtggaatggtcctgcccattgcatcaaaaaatcccttggggcagcctgctactcagtctggccgaacagctccaggcctgcccgactccagccctcacccgaggttgagcaggtcctcggtcctggaggcattcatgtaggtcaccaggccggcggcagggccacgcagggcgtctggcaccccgcccaggtactcctccctggtgaggcgctgcgcggcggacccccctcccagctggtccaccaggaagcaggaggtgacatgaaggcgcatgtagacgtcggaggggctgggtgcgtccacgccctgcccgcccgccgccagggtggcgtgcacctcggccacggcgggaaggagattctcgggcacggcctcggcgtggcccaggagggtgagtcgggccagggcgcgggcgggggggttggctgggtgcacgaagaggctggtggcagggttggcccggaggttgtcggtgtgcacggcgtgggccctcagacgcaggatgggctgtcccgtgccgtccagaacgtagctcgtggcggtgcccaggggggtgccgtccgggagcagggtggccaaggtgccgtgggaggtcaggtccaccagggtgcgggcggtgttagccgggccggggcgacctggggctgcgcagagcggggcgacgcagctctgtcgacatttgaggtgggtgaggggcctcttgctgggttggaagcaggcaccgcgaggacagggggcgcgcaggctggtgagcatggcactcgcggtgggtcccgttctcagagcaatgctttgggaccagcctcagtcgagaattggtaaatnnnnnnnnnngccccgttctcagagcaatgcctagggaccagcctcagtcgagaattggtaaattaaatcaacatatatattttccaatgcagcgatgaaatcggatgcgagaggatcgatggaaacaactcgacaagattggagtacaagaaaggaaacccccgaatctaatcccatcgaggacagcggggcagggggtggagacgggggggcccccccacatggcgcggcagaatatttgcagtcctggcgaccagaccaacaagtgacattcaaaacaataactcccgatggattcaaataaagcaagatgccaagcagccaatgaacattgttggagctcacaactacacatgtgcagaagaagccatctgtactgctgacgttctgcgaccagggcaagcacttggaccaatgaggcacgtgcagtgagcttaaagctgcagactcaatgcattccagtctcctgcttccatctcctgccatgtctggcagttactgtgcccagcgtcaacaggtaagctcaatccactgggggtgatctgttcaggtacacctgaatattacaacattgtgagatttgcaaacatcgaattcgccctggcagatgacactaatcttggacacaatccatgagtagtcgccgaaacccttgtaaagtgtcgggcagttttgccacgtcagcctgattttctcgcccgggggaggaggagcacgacgtactcccttaacgttccaacacccaacgacatcatcgagagattaaccaagcctactttgtgggtgaatgctgggcccggacccctgccgagcctctgcgattaccgaggcctgcgaggagcattctcaaagcccactcccggtgcgtttcctccgccttcttggatcatcattctccgcatttctcggtataatgcaccaggctacgccaggactgagttgaagaaggcgctgtagacgggcacgcttactttgacgcgttaaggagcgtagctcacgtgcgcttcgaattccggtgccgacgacgaccgccgtggcgcaccgagctgtggccgcccgcaagcagtcgttcaaacttggtggcttggtcgctctccgaagcccaccaccgcttcgcgtacgcccatgccgccggagctggcctctcgtcaggccgtgcagccatggatgatcatcatgtctgtcttcctggcgtccgggtcgggcctgtggtaccaactgggcaccatcgggggcggagcgggtcagcagtcggccagcttggcggcagacacgctgagcagggcctggcaagaggggtgagaggcgatggtggtgtgtcaatgcacttgagtgggctctggggttggccagctacttcggttccgtaatccatcctgctattattgatcgaacttcccctcacaatgtacccctgcagcaccgaccccggtgtggcgtttgacgaggcccgggcacgatcgagcgaggtgttggaggacgtgctgcagagccagctggggctttttttcctctgcagcctcttcctctccacctatgcactgggtgccctggtcacaaaggtatgcggtggggtttggtttggtcatagcaaagttacttcatttcaggcatcatgaggcaccttggctctgtggtcccaaatggggcggacgctctccctagattattgggcaaggtccctttgagctaggggttgacctcagcactcccagccccaaatttacatccctgtccatcccacctgcaggccctcttcctgggtcagctgaccatcctggagacgacgaaactggcggagcgcatgctcaagtttgtcatgctcaaggtcgtcttcctgggtgagttgaccgtgggtgcggcagcaggcgcacggtgttgttgactcagaaggggtgtggagaatcctggcctgcagtgcttgtcgagcagcgtgacaatcctgccttccactgcagcagcttgggccgacttcccaaggacccaaatgaccagtatctggacacacactcaaccttgtggcctcaccatgcctcccccctccctgtcgcaggcgcggtggtggacccggagccgcacgagctgggcacctggctgctctggttctcggtcatggccttcttccgcgcctttgtgggcctggcccgcgaccgctgcgaggcgttgttgtcctccccccgcgccacgccgctgcagcacgcgcgctgcctggtgctgctggtgggcatcctgggccaggccgggtcctgggtggcttcctacgccgccgccgccgaccccagccgccccagcgccgcgctgtcccacgccctgctctggctcttcgatgcggtctgcgtggccatcgaggccgcccatgccgtgctcaagtacggcgtgcacgccgtggagcgctggaaggcgcagcgcgccgaggccgccggcgccgacccggcgacgggctgggaggggcgcggccccttcctctaccacgtggaggtgggcgtggacctggtgctgcacgcgctgaccctgggccactactgccacctctggtggctgcacggcttccgcctccagctcatcgacgccgtgctcttcctggacgtgcggtacctcgtgatgggcacgctgcgccgggtgcgcgggtacgcgcggtaccgccgcctgacgcaccagctgcagcacagcttcccgcccctcccgcgcgagtgcctggcggggcgcgactgcgccatctgcatggagcgcctggcctccgcgcgcgcgctgccctgcggccacgccttccacctgggctgcctgcgcgcatggctgcagcaggcgcgcggcggcgacttcacctgcccgctctgccgcgccagcctggagatggcgccgcccgggcgccgccgcgcgctgggcc

SEQ ID NO: 46679 - DNA, 72 bp, Chlorella protothecoides
gttctgcagctgcatgaaggacagcgactcgaaggcgcccggctccgcccaggaggcgggcagggaacctgc

SEQ ID NO: 46680 - DNA, 20415 bp, Chlorella protothecoides
  modified_base (127)..(136): a, c, t, g, unknown or other
  modified_base (432)..(441): a, c, t, g, unknown or other
  modified_base (903)..(912): a, c, t, g, unknown or other
  modified_base (1112)..(1121): a, c, t, g, unknown or other
  modified_base (1868)..(1877): a, c, t, g, unknown or other
  modified_base (2199)..(2208): a, c, t, g, unknown or other
  modified_base (2935)..(2944): a, c, t, g, unknown or other
  modified_base (3872)..(3881): a, c, t, g, unknown or other
  modified_base (4182)..(4191): a, c, t, g, unknown or other
  modified_base (4512)..(4521): a, c, t, g, unknown or other
  modified_base (4610)..(4619): a, c, t, g, unknown or other
  modified_base (4708)..(4717): a, c, t, g, unknown or other
  modified_base (5387)..(5396): a, c, t, g, unknown or other
  modified_base (5611)..(5620): a, c, t, g, unknown or other
  modified_base (7594)..(7603): a, c, t, g, unknown or other
  modified_base (7991)..(8000): a, c, t, g, unknown or other
  modified_base (8474)..(8483): a, c, t, g, unknown or other
  modified_base (9035)..(9044): a, c, t, g, unknown or other
  modified_base (9414)..(9423): a, c, t, g, unknown or other
  modified_base (10022)..(10031): a, c, t, g, unknown or other
  modified_base (10590)..(10599): a, c, t, g, unknown or other
  modified_base (11225)..(11234): a, c, t, g, unknown or other
  modified_base (11776)..(11785): a, c, t, g, unknown or other
  modified_base (12274)..(12283): a, c, t, g, unknown or other
  modified_base (12606)..(12719): a, c, t, g, unknown or other
  modified_base (13204)..(13340): a, c, t, g, unknown or other
  modified_base (13411)..(13420): a, c, t, g, unknown or other
  modified_base (14808)..(14817): a, c, t, g, unknown or other
  modified_base (16811)..(16820): a, c, t, g, unknown or other
  modified_base (17196)..(17205): a, c, t, g, unknown or other
  modified_base (17889)..(17898): a, c, t, g, unknown or other
  modified_base (18660)..(18669): a, c, t, g, unknown or other
  modified_base (19106)..(19115): a, c, t, g, unknown or other
  modified_base (19525)..(19534): a, c, t, g, unknown or other
ttcgtggccgacggcgcggtgctgccgcgcaccgacggcgccagccaggcgcccatgcctgcggcgtgggccgtactttcccgcgcgccggagtcgcaggcggtggtgctgacgctgccccacgctnnnnnnnnnngccgacggcgccagccagctgcccatgcctgcggcgcgggccgtcctttcccgcgcgccggagtcacaggcggtggtgctgacgctgccccacgctggccgggtgcgggggctgggcatccgccgcggcgtcaccctgatcgtgggcggcggcttccacgggaagtccacgctcctccaggcgctggagggcggggtctacgacagggtgagggggttgtgtggggacgagggagctgagagggagaaagggggggagtgaaggccacatgcaaccgatgaggagaggtgcaggcnnnnnnnnnnagtggggtctacgaccgggtgagggggttgtgtggggacaagggagctgagagggagaaaggggggggagtgaaggtcacatgcaaccgatgaggagaggtgcaggcctctgtcgcgtcgcaggggagcgcctcggagctcagcatgccagggcgccatgcctgccgtcgagggtggcacccttgacgcttcaacctcctcccgcgcctagcccgctgccaacctctcccttcccgcaaccaccctaaatccagatccccggggacgggcgtgagctggtggtgacggacccgcgggcggtgaagatccgggccgaggacgggcggcgcatctgcggcgtcgacatctcgcccttcatcgggcacctgcctcgggggcgaggcacgcgcgccttcctcagcgctgacgcctcgggaagcacctcccaggcagccaacatccaggaggcggtggaggccggcnnnnnnnnnngggcacgagcgccttcctcagcgctgacgcctcggggagcacctcccaggcggccaacatccaggaggcggtggaggccggcgcgactgcgctgctgatcgacgaggacacctcggccactaattttatgatccgcgatgcgcgcatgcgagcgctggtgtcgcgtggaaaggagcccatcaccccatttgtggagcacnnnnnnnnnncaacttcatgatccgcgatgcgcgcatgcgggcgctggtgtcgcgtgggaaggagcccatcaccccatttgtggagcacgtgcgccggctggcggcgtgcggcgtgtccaccgtcatggtcatcggcgggtcgggcgactactttggcgtcgcggtgcgtcctagagggggtctgctttggagtctggggcggggtaggggggaggggaagggacatttgtggtgcccggcgggtagtctcccaaggaagggaagtctgtgtcaggattagcacctcagcagcccggctggcgccctcccagatgctatcctgccggtgtagatcaaccgcagcaagcacatgtcaagtcctgctctcccccactctcatcaggacacggtgctgtgcatggaggagtacgaggtacgggacgtcaccgagcaggccaagcgaatagcgacggagtttgctgccgcggaaggcggggcgggacgcgaggagggcagaccgccgcgcgagtggtcggcgccgccgcctcggcagctggccggcctggcggccgccgccagtggtggtgagcggggcggctgggcacatgcaagggcgccggccagagggcgcgggagggctggtgcatgccgcgaggaggggggctggtgcgcagtgccagcgcatacgaccgatgcaagaggagagtgcgcacctgatacttgcgatgcttggaatgattgctgcccggcgcatgatcccctcctccccacctttannnnnnnnnnccgccgaacagagggcgcgggagggctggtgcacgccgcaaggagggggtttggtgcgcagtgccagcgcatacgaacgatccaagaggagaatgcgcacctgatactttcggtgcttggaatgattgctgctcggcgcatgatcccctcctccccacctttaccctccagccccacggctgaagctgaagaccagggcaaagggcagcctcactcttgacgatgaggaggtggatctcaggtacgatgcgcatgcttgaggcagacccccaggtctcagaatgccgaggggtcatcctcgaaatggatggagggagtcttnnnnnnnnnngtgcgcatgcctgaggcagaccccataggtctcagaatgctgaggagtcatcctcgaaatggatggagggagtcttgcaagatggatgcccgccagaacatcaggtcaccaacaagatcttgtctccctgcagtgccgtggagcagctggtggagatctcgcagaccagggcggtgggggagagtctgcgatgggctgccaggatgctgtcccagggcccggccctgaccctccctcaggtgcgaggcagaggctggcaggggccggcagaggcccacctcggtgctccacgagcaacacaaggcagtgctggttcctgcacgagtcctttccggctgtgcagcacggttgagtttgtaccctcgacctggctgcgcatcccctgcatactgcagtggtatctctcaaaaccccagttctccccactctcccccaccctggacccagatgctggatcggctggatgctgagatggaccaggagggcctggacgccatcacccactccggcgagccggctggagacctggcgaggcccaggaggtttgagatcgcggcggccatcaacaggtggcgatcggctcacctggagcaatgcactggctcatagggccttgcagcatgagtttcagtatatttttccatctctcacccccgactcctgaccttattcacacattcactgctttccgtgtctagcctgtgcggcctacatttttgagcctcgnnnnnnnnnnctgcagcatgcgtttcagtgtatatttcccatctctcaccccccactcctgaccttgttcacacattcactgcttgccgtgtccagcctgtgcggcctacatttttgagcctcgtgatgtcatcccccaccagctctgggctacaaagttacatgcagggtcgtggtacacacctctaggggtggctgggacaggggcaatgcgctatggtacaggaccaacgaggggagacgacaggccggccagggatacgtggtgggggttggtacagagctattggcaagggcgacacactttgagagaagcggggcgcttccgagcagtcctggacacacaggctgcaaacgcttcctgattccgctgcgcaggcatggggagggtacaaccccacgaacggtttgcgcgtggggcaggggatgggacagccaccttaggaggggttggggaaaaataagggtgggagggaggcattggtacactgcaggggtctgcgaggacaaggcgggctaagattcctggccaggtgaggctgctgcacagtgaatggagggttgggggggaattcctggtatacatggcgtgtgctgcctgtcaggctgggatctgtgctgagcgcggatctgggctatgtaaaaggactggggcccccttctaccagggcgactcatccagggtgcaaaggcccaggtacctggtggacggcaaggggtggtggagcgggtggggaggggggttgagcatgctgccaccctcgagcttcccgacatggggggagggcctgctcaggccggcgcccctgccatgggccccctgcactctacatggatttgctgtgcaagcgcaaccctacacagccgcagggcccccgtttcctcccccgcccccgtttcctcccccgccacgcaccgcgagtctgcgctggaggcgnnnnnnnnnncgccctccacgtggatttgctgtgccagtgcagccctacacagccgcagggccccctcagaccctgcccccgccgccgtttcctcccctgccacgcaccgcgagtctgcgctggaggcgtcccgcgccgagatgatgcgcaggagctcggcacggtccacgcctcgccccacgccaaaggcatacaggcagacgtggccctgctcgtcggccaggcgttgcgccatgtcgtgagcctcgcgagcctgcaagaatgggcggcgggcgggtggggggagcctgcgcatgcagccaggcgcagnnnnnnnnnnctgcgccatgtcgtgcgcctcgcgcgcctgcaggaaagggcggcgggcgggtagggggagcctgcgcatgcagccaggcgcagggtcgggggcggtgcgaggtcggccggtcccacgaatcggcgcgaccataaaccctgagccacggccggcatgcatggcgtggtgctgcatgccgcccccgcccctctgatcaccgtctccctcgctgcagcccacagccgctcaggccaggtatcggctggcacagggccgcacctcctttcctcagacgcaaacaagacccccctctcctcccacctggtgcgagtcgatgcggcnnnnnnnnnncggtgcgaggtcggtcggtcccacgaatcggcacagccatgcaccccgagccacacctggcatgcatggcgtggtgctgcatgccgccnnnnnnnnnnaacttcggctggggccccactccacagagcacagagtaacagacggagcacagaacagggcacgactccactgcaattgcacgccaggnnnnnnnnnngccacctcctttcctcggacgcaaataaagcccccctcctcctcccacctggtgcgagtcgatgcggccgtccgtgaggaggaccagcacgcgccgcatctggggcgccatgggcttgagcagctggccggcgcgctgcactgccaggctgatgttggtacccccgttcatgcggtactgcagatgatcaggagagaaaggggtcggcgttccagaggagggatgcgggtggggaagcccaaccagctcggctggggcctcactccacagagcacagagggacagacggagcacaggacaggcacgactccactgcaattgcacgccaggctccgcccgaggtcgcaactcaccatgccctccaggacgtttgtgatttgatccaggacgatgggcgagggtgccagctccaatcggcagtcgttgctgaactggaccaccgctacctggcacaggggcatgtaggaggaggagatggagagcaagtgagcgggcatggcggagtcccgatcaggactgcgtcctgagacccgagcagggacctctggagacaccagaaacctggtcggggtcatcctcagccatgccccgccacccgtctgcacctgggtggctgtctcctgggtgttcaggtgttcgatggcctgagtcacaaagctggtcatgcacnnnnnnnnnnaggtcatgtaggaggaggacatggagagcaagtgggtgggcgtggcggagtcccgatcaggactgcgtcctgagacccaagcagggacctctggtgacaccagaaacctggtcgggtcatcctcagccatgccccaccacccgtctgcacctgggtggccgtctcctgggtgtccaggtgttcaatggcctgagtcacaaagctggtcatgcacnnnnnnnnnnatggagatggctgattcctcgagcatgcgcaggaacgatgtgacatctgctggatgccgaggagctggtggcacccacgaaaacaaaaggggtcgacatgatggagtcactctaaaccctcatgccagggcaccttcggtgacgctccccgagccatcgatgaggaagaccacacaggcctcgggctctgtcttggggaccaggcggcgcactggacagagggcggaggggtggaacgcgtgagcgcgcaggcaagtatgagcgccccccccccttcctgttcaaatagtaagcgacatcggtctcccacaaagagacagttgcaagaaggccagcattgatatagtacattatatcgcaagggctagaatgatcaaagaagctgcctgcccaaagaccgccaggcgcaccctcctttccccagcatgaggaccagagcgacattacaaaatgaccttcacctgcgacctggacctcgaacgggctgggcttctgccagggcgcgtgcgtcctgtctgtcgcggcacgcgaggcatacaaattcttccagctgccggccagcttggctgcttcgccctgcagttcggtcaacccgccccatcgctcagcaaactcgcctcgccagtatgcgtcggcattctgcagggtgcgcatgggtgtcgaatgggagatggacttgagggatggccatcagaggctgaaatttgctggcaccacataggccgtccacaagccatgcacgaccttggcagtctgcccctcggacagaccagtacttgcgacccagcgcgatgtcatgcagggcagggacggtgggtcggccccaaaaaacatgatcgagccccgggccagaattccgtccgaacgcccgctcccgcgccctcacatcgctgattgtgcgcaggcgtgtagagcactgggcaatagcacaaagatcccggggggtcgtggaatagagcagagctcgttccagaagctcctccggtaattccagcaaaggacaggcatcggcgactcgacgccgcttggaggattcgatggcctgggtgggggtctctggcgccgagacctcaggggcgtgcggtcgcttcgacgagccgcgagccctggagcggccctccatgccgttcaaagcagctctcgcggtggatatgagggaggccagggtaccgatcattacaggagacgctctgcgtgtcggaggagaggagtgtcggcaattgggagggacccgaccataggatccccgggacagagggattttgccccgaaaccctttcgttttagccagtcacctgcattcaaactgagcaaacgcagcccgcaacgactacccagagcgtggcagggtgtacgttggatatgattaattgtggatttgtgattatcttcctgtatcaccgtgtgtcgtctcgacccgagcctgctggcgaaatgtcaggctcgggaattctggcatggacaggtcgaaaccaactcttcgtgatctgaggcggatagcaagtgctacatgtcggaccagcgtcccattgaatgcgggagaaatcaagaatgtcttcatctcacacactgtgagatgcgcggggctgcggagcggcgcgctcgcacacgggaggtctcgatgattccggcccccctacttcttggagaagagcccgcccagccccttcttgctccagctccctccactgggagggcctccagacgagtaggacttatccggcatcagttccacacccgtgtctgcgtccacgggcagattgtcggtggagggggaggggaaggatgcggtgtaggtgggcggccccgccaccgagggggagggggtgctgcgagcgctccggctgctgaacagcccccgtgcgctgccgctgcgctgcggctccgcggaggacggcgcaagggacgatggcgtgacggctgggccctgggacactgacccgggggtggcggtcatgggggtggctgcctgcnnnnnnnnnntgcaatggacgatggcgtgacggctgggccccgggacactgaccccggggtggcggtcatgggggtggctgcctgcgaggtgggccgcccggcagcgccgagcccgtagcccgtgggcggggcggcagggggcggggtggcccccgccatgcgtgcctggcgtgccttctccagcgcctcccgcgtcaccgccccacccgcggttttccccctcttgcgctcgttcactgcgatgggacgtggtaagggggttggcgcagggcccaggactcttgctcgtccctggggcttgaaagccaccgacaccacacgatgaatgtgaccaagggaaagaaaagggaatgtcaaacctcctgcctgtggccccctgctccccctcggcagcgcnnnnnnnnnngtgaaagccaccgacaccacgcgatgaatgtgaccaagggaaagaaaaagggaatgtcctgtctgtggccccctgctccccctcggcagcgcaccaaactcgcgctccagtcgccagcggtgcgccatcatctccgcctgcgtctcctcgcgcttgtgcaccttgcggtgcctgcacaccgcaaagcctgcatcgtggtgatgcttgggatgggtcagcggccagccgtaggaaggcggggcccaccccggggcgccatggtacaagcatccaagctgcttatgtgggtagattctccagcaggaaaacaatgagagcaccacgcaaagctgccccgggccgcatggggccccagcgcggtctggcgcagcccatcctcaatctctccctgctgtgtggggcttgtgcggggttttagggcctgctcacacccctcacccccaacgctcaccgaggaggagcaggatgatgagnnnnnnnnnnaccgggccgcatggggccccagcacggcctggcgccgcccatcctcaatccctccctgctgtgtgggggttgtgcgggggtttaaggcctgctcacacccctcaccccccacgctcaccgaggaggagcaggatgatgaggccgaggatgcctcccaccaccccgccgatgatggccgccttcttgctgctggtggtggcgggtgcgcccgggggcgggggcggcgcgtccccggcgggtgcgcccgggggcgggggcggcgcgtccccgacgggcgtcggcgagggcgagtcggtggacgggggcggcggggaggccgcgaccgccccgggcgggggcgggggtgcagtgtgcaacatgcagatgcagcacaggttgccattgtctgtcagggggcgggggtggggcagatgagtggcttttactccgaggctaagcaaggggggtctggcattggattgttgaggcaaggtcggcacacacacatggccgtggcactgccacagtggacgcaaacgatggagggcggggtggggtgaaatgcagttgatnnnnnnnnnntatggtcgtggcactgccacagtagacgcaaacgatagagggcggggtggggtgaaatgcagttgattccgtgccggaaccaatactcccaagaggaacatgggcttgaagggagtggtccaaggcgcactgagcagggagctgctcgtcggaatgcccatatgtccccagaaagtgttgtctttcagattgcatttcggtcctctaacactcccgccatgcaggccaggacccctacccaagctctccgccacccactcacatgtgtatgtctgagggtcgatagtcatccctggggacagcttggcagtgcaggccgtggtgcaagctgcagcatcgtccaccacaaaatgggtggactgacgacacnnnnnnnnnnacccatgtctccccagagagtgttgtctttcagattgcattttggtcctctacgactcccgccatgcaggccagaccccctatccaagctctccgccacccactcacatgtgtatgtctgggggtcgatagtcatccctggggagagcttggcagtgcaggtcgtggtgcaagctgcagcatcatccaccacaaaatgggtggactgacgacactgtccggaagatggcgaaggcgaagcatcctggggattgagtgggttggacaggcttactggaggagccaactcagaaactggccctcacacggccatgccccgcaggacagctgccttggcactcacagaaggagcagttcaagcctcgatcgccctgccctgtctcattctcaatacctggagcatgcttcggccgcctcgtcgcgatccggatcccccagcctgggcgcccacggtccccgccagagccagcaagcacagagcgatgctccatttacccagtccttgcatcttcaaagtgtatggtgctgtgtccagtcgcagacgattgcggatcgagtggtctctttcgttcacaaggggcatctggaccgggagatctnnnnnnnnnncagcacagagcgatgctccatttacccattccttgcatcttcaaagtgtatagtgctgtgtccagtcgcggatgattgcggatcgagtggtccctttcattcacaaggggcatctggaccgggagatctcacctctacgagactcctgcggctgcggtagggaaggactctcgcagtcagactccttcttaggatttatttgagagtatcctcaactctttgcgggacctttgtgcagtgcgctgggccttgctggtcagccaggctcgccgtgttggaggagcaagatggcctgcgacagccaggaggactaatgcggagacctctcgtgcagacgtgcgacgacttgggttgcagtgggaaatgcccgcagaggatgttatagactgtgaagtcgccttcgccgagatgtcgcgccttctcggggaccacgtggccttcgacagtagcttccatctccctcaataaagtggagcaacgattgcaggcaggtgtcaatgtcagtgttttcgaacttcaagaacacggacatgcctgcactcctcgatggctgccacgnnnnnnnnnnttctccctcaattaaatagagcaacgattgcaggcaggtggccatgtcagttttttcgaacttcaagaacacgcacatgcctgcactcctcgatggctgccacgcccggagctccacccacgcactgctgcaggtgcggccaatccaccatgcccgcctccacccgctctaggaggccaggccgcaccaccagccacgcgcggcctgcgcccgccttcagcagcttggacatcaggtgaagcgtgaagaggaggtgggaggcatcgtcgaggtgcaggagcatgaggtccaggccagaggggtgggctcgccagaccgcctccaggtggccatccccggcgctgctttccagggcgtgcagccgcagccgctcgatgaccaccctgtggctgttcaattttgtgttggcgcgcaggctgggcaggcaggcctgcgatgatgccgccgcgatcgccgacctgtttcgaatgtggaatgagcagcagaatcctttgtgaaagtaaaggagctctgcacgtcgaagcaggcagagcaagccctgccaagtcacaggaaatgtggaagggtgcactgtgccatgtctccccacacccaaaccaaggcctcagctcagagcacgcaccccnnnnnnnnnngttccttgtgagggtaaaggagctttgcacgtcgaagcagacagagcaagccctgccgagtcaaaggaaatgtggaagggtgcactgtgctatgtctccccacaaccacaccaaggcctcagctcagagcacgcaccccgagggtgggtccaggtctggacccaccactcctcgccctcacctgcaatgcctcagcgcacagagcgcggccaggccgatggtctcgcccgcagaccattccaggacggtctggcctgccagccctggagccagcagcgctgcaaggtcgcccagagcctgtgccgcgctggcgtcgtggcccgccggggtctgtacctcgaagccaccccagctccaggcctggaggggctggggtctgggcgtgccctgcactgcgcaggctccagcgctgtcagtctgcccgtggccttcaccaggcgtgctgtcgttgacaacaccctcgagagcgctggttctattatccacaaagggctgtctcgcttcgccgggctccggcagccgaaacacgccctgtatgaagnnnnnnnnnngccgggcgtgccctgcaccgcgcaggctccagcgctgtcagcctgcccgtggccctcaccaggcgtgctgtcgttgataacacccttgagagcgctggttctttcatccacaaaaggctgtctcgcttcgccgggttccggcagccgaaacacgccctgtatgaagagcctgtgcatggccaggcccttcttccgattctccacgtgccggctctggcaggagagggactcgcagacaaagccagcccccttgaacagcgagcgcatcccctcctgtgggaagagcagggcaaagagcggggtttggggctttaagattaaaacatgtgtgaatctggggaggttcccagatgccggcgacttgcaatgtggcagcctgacggtgcctgcaggcacacgccgtgcgcagatcacctacctgggtgaagtagaaagcacgcgtgccgtcccagcggacgtagaaatcgtccgccaggcgctggaccctgnnnnnnnnnnccgggggcttaaaaattaaaacatgtgtgaatctagggaggttcccagatgccggcgacttgcaatgtggcagcctgacagcgcctgcaggctcacgccgcgcgcagattacctacctgggtgaagtaaaaagcacgcgtgccgtcccagcgtacatagaaatcgtccgccaggcgctggaccctgccaggctccgacagccgcgactgtgccaggtcgcctcgcgcataatccctgacgaggacccggcccccaggggccaaggatggcttcaagttctccagcgcctgcaagggggtcgcggccaacgtcctcatcgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagggcggagagcacgaagaagagggtggcggccgacacctggccctccggcacggccggggcgagcgggcccttggtgatgtcggccacatgtgcagtcactcggcccccgtacagcggatgctgcttcagcacccggatggccgccggcgcaaagtcgcaggcgtacagcctggcctgcgtattggcggctgccagggggaacagcgtgttgcccacgccacagcccagctccagtatgcagggggcggtcaggaggagggggaactcccggtccagatagtgtcggtccttgaagaacttgccggcattgcgctggtagaagaggtcccagtaccgggccgcatcctcttccaggacagctgcggtgtgcatcgggatgggaacgacattgatcctgttccaaaccgtatcgatggtaaatgttgaccacatatcatgctcgaaaagctaggagccagtctgtggcggaacaatcctcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattttatattgcgcatggggttttcctcctcgcagtaaggcggagggcgatgtttgcgcggttgtaacgnnnnnnnnnnagatgggaacgacatcgatcctgtttcaaaccgtatcgatggtaaatgttcaccacatataatgctcgaaaagctgggagccagtctgtggcggaaccatccttactgctgcaccctcgaacccggtacctgcggttgccgctgggacctgcggacacctcgccaaatccatgaccagttgttatgagctgttaatacaaattatatattgcgcatggggtattcctcatcgcagtaatgcggagggcgatgtttgcgcggttgtaacgctgtcgagccggcgagggcgcttgcgcccaaagtgctgcgaaactcctgggcatcccccggtacatcacctccccagtcctaggctcccacatctactttggaaaccatgattcggacgggtcgaatcagctgtcacagtgatgccgtgctctgcttggcgtcctgcgccaacgacaccctcctggtctccggcggagaggtgggagcacctcggaccggggccataggggtgcaagaatggggcacagggaaggtagattcattgccgtagtgaaacgtattgctttcgatttctttgcaggatcataggctctgcttcaccgacccagcgggctcagcaccccagggcagccttgagcttccgggggacatcccggcagtagccgcacatcccagccagcagcacgtcctgtatgcagcaagcgagacctccatatactgccttgacctccgcaaggtgagagaatggacggtggtacagcagggcatgcaccggtggctggtatcaaggggaagagggagggtcagagggtcgcaccaggggtgcactgcgcacacaccctgcagctccgcactccccacagtgccgccggccgccctgacatcccccacacgaccccacaggcgctgggcccggaggcggtgtgcggcagcgtcacgctgaactccgaggaggtgaatgcgctgtcgctgaacgccaccggcggctggctggcggccggcgacgacgccggcgaggtgcggctggtggacctggccgcctggcgccccggccctgcgcccgcccggccccagcagcgcacgctgcgccgaggccacgccaacctggtcaccgccgtggccttccggccccgcagccagtgggaggtggtgtccggcggcgcagactgccagctggtgcactgggatgcgggccgcctgcgccaggtgtccagcgcccggctgcagccgctagagaatggcggcgggtcgccaggtgggaggaggggcagggcaggggaggggctagagtgtgagggcagtcagaggatccttgcgccgcagccgctgcgacccaagggcagggagcgccggcgccacatcccttggcgccggtcgagggtcggtgcgaggcgcannnnnnnnnnacagccgctgcgacccaatggcggggagcgccgacgcctcatccctcggcgccggtcgagggtcggtgcgaggcgcagcctcgcagcattccagccaggcgccacctgcccacccgacgccgcccggccgcccggcccaggccaggcatcgctcccggtggcaccaccagcacccctcacgcctcacgcctgcgcaggccagatgctgaacccgcccatggtccatgcgctcgctttcctgccgggcgaccgggatcgcgtggcggtcgcccgcggggatgggcacgtggcccttcaccgcctggccccggttgggaaggcgccgcgcaggccccccggccaggcggcggcggaggtgggaggcctggccgaacacccggtcttgctgcccacctggcactccgccgccgccacgtcgctcgcctgcctcgccgggccccagccggtgctggtgtcgggcgggaacgacggccgcctgctggtgcacgcccccatcccacacgtggtcggccatggccgcaagctcaacgacctgcatgtcgcgggcggcaggctgtatgtggccgacgtgtcgccccacctctctgtgtatacgccgtcctgatgccgcggccgcatttcctgggaatcgggtgcaagcctggggaaggtaggggggccggcggctcatgcccaccatccctcgctgcgcggcggcgccgctgacgtcaccagaggtgcgacttatcgcccagccaggcctcgccgttgcccagcaggaggggcggggtccagctctggatgcgcatggcggagacaaggtccagtatgccggggtgccccgacgcagcaaacacgtccaggatgcggggtgtgagcctcccttgctgaatgaccctctggaaggtggggcatggcaaggcgtcgatgtactgaggaggtgtcttcatggcaaggagaggaacctgaagggtaggtatggcatcagcacgccccgctaaaggatgttcctggcatggccgtgcagaaacactcaccttgaagaggcagaccacgaggtcctccggaacgtctcgtagactgggaactgtggttatgttcttggccaagcagtctaatgtgacatcaaacaggctgggcaccgaggaggcccctgtcgccatcactttcatcagggggaatcgaccagcgtccgaggagggttgggcccaacctcacccagcctggcgcgtgagagtttggaagagtgacagctcaggaaactgaagcccaactaagagcaatataccgaagacacatctggtgagaagttggaacggtgcccacgtctcagtgccccagatagacgagcacaaagttccacttggtgtcggggatggggaggcgcgcgcgcgactggcctcacacccatgcatgtaccaaaggacggacactactcatctgtccatttgctgtccattgtcaagctgcgtggagctttattacaaccaagtctgtacctgataagtgctgctcaagcgcccgaggtcagcccgtgcaagcgccatgtcgatcaactgggaggattatgaggagcccttgaaaaagccgaagaaccctctcgtcctaataggtgtgttgttaggagaagcttgcatttatatcgcctcaagtcgacctactgttcgcacggagcccggtgccggaccaccactgctgctcaacccttgccgtacagggtgtggggtgactgccggcgtcctttttgctggtctcgtggcgttcaagaagggcaaccagggactgtctcagaagatgatgcgggcgcgcgtcattgcacaaggggcaacagtagcccttatggtcgcttcctcaggggggggggggggtggagggttgaaagtgtgcacatctgcatggctggaggctcgagtgtgtgtccatagtgtcggccatcttgcgggattaggcaactcattcacttgttttttacacagggtatgtagcgctgacatccaagaaggaccccgtcgtcnnnnnnnnnntgagtgtgtgtccatagtgtcggctctcttgcgggattaggcaactcattcactttttttttacacagggtatgtggcgctgacatccaagaaggaccccgtcgtcgaggggcttgctggggatctggacaagcaactaaagtgatggtgttgagggtctggctgaaggatgaccaagactgtcctcttggtgccccctagactcagcatgccggctgtacattacaggactagggtggtgatagagtgagatgacatttgagcgggactcggtgcaggtctgccaagcaatcttttacagaacagccatgaggaaggtgacggggaagaagtgcgttggtgtgtcaggcatgcaaggaagacaagtgtatcagtnnnnnnnnnnttgatagagtgagatgacatttgagcaggacttggtgcaggtctgccaagcaaccttttataaaacagccatgaggaaggtgaccgggaagaagtgcgttggtgtgccaggcatgcaaggaagacaagtgtatcagtaagcctgcaaagatatggatgagggcatcgcaggctcgatcctgcaccaagcagaggatattgggatggtcaagcacctcgatccttgtacaatggcttaaactggggaatgatagctatataaattgtgcggcagctgctctctatgagtcgcctggccgggacatagggcccagtcaagcagcaaataacgagagcatgtgatccacatggtttaatctgtgcagcaagtggcctgggcgtccatggggcggcgggtcgagacctgccgcccaccgtgcgccaggatggaatgctgcagctgggagcccaatgagcaacccccacaacacccctttacctacctgatttgctgctactcagtgctgacgtctccctgctgagactcccatgtcgaaatcagtacctaaaggcaccttctgcatcctcctggtggggacaaggttggctgaggtcaatggaggcacgcagtaaaacagacggcaatccaagataggcagcaacaaggaggagagttgtgcgggatgcgtcttctggactgatcagnnnnnnnnnnagagcaacccccacaacaaccctttacctacctgatgtgctgctatacaatgctgacgtctccctgctgagactcacatgtcagaaatcagtacccaaaggcaccttctgcatcctcctggtggggacaaggttggctgaggtcaatggaggcacgcagtaaaacagactgcaatccaggataggcagcaaaaaggaggagagctgtgcgggatgcgtcttctggactgatcagctgtcacagacagaataggtttgcaaacccttatggtttccccacagggagtggacctcgcacggtgatgagttgctccgcggagggctggataaattgtggggccggtgcggagtgcagccggggtgcaagcatgccacagagaaccgctcaggcaataagcggaaaagaaaaccatcaggaatctgtttgcatagatttcttcacggcggtctctggtggcccatcacaccctgcctggttcatacacagaggttggtagactcaccgcatcggctccggagaagtatttcgatgcagactccttcgtttatttctttgcctcctctatgctgtgatgcatgaggagagcggggcaatgccggccgccgatggtgcactgtgcctgtcaacggggcgggagagtgagggcatactccgcaccaggcggaccccagcgggacttacttgatcatggtgcgtggtatgcggtgggcaagcacaccaaagatgccgtctgatgcctgctatgccagtatatacgtttgnnnnnnnnnnaaagtacatcgatgcagactccttcgtttaattctttgcctcctctatgctgtgatgcatgaggagagcggggcaatgccggccgccgatggtgcacccaccgtgcctgtcaacggggcgggagagggagggcatactccgcaccaggcggaccccagcgggaattacttggtcatggtgcgtggtatgcggtgcgcaagcacaccaaagatgccgtttgatgcctgctatgccagtatatacgtttggctgattggtgtgcggggggctctacggtacccagttctctgacgaggtaccgttctgtgacatgctcagtcaaactcctgatcaaactcaaatttacaaacctacggtaaaagatgacacaaatctagtgataactttcctgtcttgttgtattctgtggaacttctttgagacatgctcggaacgannnnnnnnnnaggctctacggtacccagttctctaaagaggtaccgttctgtgacatgctcagtcaagctcctgatcaaactcaaattcacaaacctacggtaaaagaggacacaaatctagtaataactttcctgtcttgttatattctatggaacttctttgagacatgctcggaacgatgcatggccattgagaacgatctcgcatggatcagcatggtgctcagtgatgtgcctgaattaccaggctgcatgataatgatgacaactcagcaagtcaagacatcttcaggctgaccacaagtggctttctgccatgcgatgatattggcaatgcacaatctgtcaggttgaccatttgggcctccccaggaatgtcttttcgattgattcagaggcctccgtgggctttgtaatgnnnnnnnnnngccatttgggcctccccaggaatgtattttcgacggattcagaggcctccgtgggctttgtaatgcttcgtggccatcaggacgtcatactcccaggtcaggagaggttcatggacaaaatgtgggtgcatgttctgttctcatgtgacgcccaaggccctctatgcagggatttgggacaacagataagatactttaagcaacattaactccactcactggatgattgacctgatcaatcatgtgtgctggtgatcaggtgctgggaattcttgacaacgtacacctagcttccgaaccggccgcacggcatgcccggtagtcagggaggatctgtgatcgcggtgttgcataggccagaaacagcctgcactcgatacgagggaacacacgctttccctttttgtaacatgaaggcagcagctggtgtgtcgcggcaacagacccccctggacttcaggggcatgcctcctctgcgtcgaccgtccagctctgcaccggcgcgagaagcttggctgggaggcagacccgcccccctaccccgcttctccccagcgcaatgtaagcttgtacatcagaaccgaggtttcctgccctgcactcgatccaaaccccgctgcgtgcgtcatccccgggtcgggaccagccggtgcattgaacggtccctggaaaccaccccaccatccctctccacccgcaggctggagacacccgggcaggctgctacctgcagccccccgtcggaccctggactcatactcattgcaaccctgccacccagcacggcaagcacgggcccaggccctggtcttgaacgacccggccggcagcgacacgagcgaggagagccccgcccccaccccctcccccgccccctcccc

SEQ ID NO: 46681 - DNA, 61 bp, Chlorella protothecoides
ccgatggggaaggcctcgtagggggggaggtcgcccaccacaagcccgccctttcctgaga

SEQ ID NO: 46682 - DNA, 109 bp, Chlorella protothecoides
aagctgctgcgagtcactcgcgtggaccccttcagatcatgccatgatgacgtggtacttaccccgggtctccaaccccctgcagacaccgtgaccctggttcgggaac

SEQ ID NO: 46683 - DNA, 26955 bp, Chlorella protothecoides
  modified_base (95)..(104): a, c, t, g, unknown or other
  modified_base (617)..(626): a, c, t, g, unknown or other
  modified_base (921)..(930): a, c, t, g, unknown or other
  modified_base (1496)..(1505): a, c, t, g, unknown or other
  modified_base (1755)..(1764): a, c, t, g, unknown or other
  modified_base (1898)..(1907): a, c, t, g, unknown or other
  modified_base (2119)..(2128): a, c, t, g, unknown or other
  modified_base (2348)..(2357): a, c, t, g, unknown or other
  modified_base (2825)..(2834): a, c, t, g, unknown or other
  modified_base (3005)..(3014): a, c, t, g, unknown or other
  modified_base (3691)..(3700): a, c, t, g, unknown or other
  modified_base (3783)..(3797): a, c, t, g, unknown or other
  modified_base (3859)..(3868): a, c, t, g, unknown or other
  modified_base (4150)..(4159): a, c, t, g, unknown or other
  modified_base (4254)..(4263): a, c, t, g, unknown or other
  modified_base (4616)..(4625): a, c, t, g, unknown or other
  modified_base (5295)..(5304): a, c, t, g, unknown or other
  modified_base (5770)..(5779): a, c, t, g, unknown or other
  modified_base (6188)..(6197): a, c, t, g, unknown or other
  modified_base (6527)..(6536): a, c, t, g, unknown or other
  modified_base (6617)..(6851): a, c, t, g, unknown or other
  modified_base (6920)..(6929): a, c, t, g, unknown or other
  modified_base (7688)..(7697): a, c, t, g, unknown or other
  modified_base (8449)..(8458): a, c, t, g, unknown or other
  modified_base (9286)..(9295): a, c, t, g, unknown or other
  modified_base (9745)..(9754): a, c, t, g, unknown or other
  modified_base (10064)..(10073): a, c, t, g, unknown or other
  modified_base (11173)..(11182): a, c, t, g, unknown or other
  modified_base (11814)..(11823): a, c, t, g, unknown or other
  modified_base (12062)..(12071): a, c, t, g, unknown or other
  modified_base (12360)..(12369): a, c, t, g, unknown or other
  modified_base (12564)..(12573): a, c, t, g, unknown or other
  modified_base (12813)..(12822): a, c, t, g, unknown or other
  modified_base (13664)..(13673): a, c, t, g, unknown or other
  modified_base (13735)..(13744): a, c, t, g, unknown or other
  modified_base (13798)..(13807): a, c, t, g, unknown or other
  modified_base (14216)..(14225): a, c, t, g, unknown or other
  modified_base (14851)..(14860): a, c, t, g, unknown or other
  modified_base (16623)..(16632): a, c, t, g, unknown or other
  modified_base (16933)..(16942): a, c, t, g, unknown or other
  modified_base (18110)..(18119): a, c, t, g, unknown or other
  modified_base (18366)..(18375): a, c, t, g, unknown or other
  modified_base (19560)..(19569): a, c, t, g, unknown or other
  modified_base (20467)..(20476): a, c, t, g, unknown or other
  modified_base (21670)..(21679): a, c, t, g, unknown or other
  modified_base (22124)..(22133): a, c, t, g, unknown or other
  modified_base (22744)..(22753): a, c, t, g, unknown or other
  modified_base (24041)..(24050): a, c, t, g, unknown or other
  modified_base (24117)..(24126): a, c, t, g, unknown or other
  modified_base (24220)..(24229): a, c, t, g, unknown or other
  modified_base (24579)..(24644): a, c, t, g, unknown or other
  modified_base (24896)..(24905): a, c, t, g, unknown or other
  modified_base (25480)..(25489): a, c, t, g, unknown or other
  modified_base (26092)..(26101): a, c, t, g, unknown or other
ggtgggggcggggggctggggccgcgagggagccatttgagcttggccgaggaccctcctcaggccgacctgcccagctctgcgccccacctggnnnnnnnnnnggagccattcgagcttggccgaggaccctcctcagaccgacctgcccagctctgcgccccacctggttggcgcggtggctcctgcccagctgctggatggccttgtcggcggaccagggcagctcgatggtcaggtgcgcgcggcgccgccggttcttcacggccgccgaggcgtgcagggagatgccggtggaggcggcatccgacacgatggccaccagcttggagccctgtgcaggcgagggtgcacgatgatctgtttggtggagcctggggagaatgtctgttgagatgtcgctgtagggggatcaagacgggcctttgtctcccttggcttgccatggcctgaccacagccggacctcttcccccacccaaattccaccccccacctccatgaaggcagccttctcgcggatgttcagggagtccagctcggcactgtcgggcttggcgcgcagggagtaggtcagtgtgcccctcgcgtcccgcaccacacgtgccttgcgtcctnnnnnnnnnnagtgtaggtcagcgtgccccttgcgtcccgcaccacacgtgccttgcgtcctgtgcgtgcatggagcgactgatcatgcgcagtggcggactcagggactacaaggcagggacttggctccacctggagcatgctggctgcaacatgtctcgggtaacttgtagccccgcttggggctgagtactggggactccccagcagactgtccaaagcctggagctaagatccgccatcgcagtgccaccctccacccgccctccatacctttggactccagtacacccagcccaacatnnnnnnnnnnagcagtgccaccctccacccgccctccatagctttggactccagtacacccagcccaacatgccccttgccaacacccacctgtcatctcggccacgccggcagcccctcccagctcatcgatgagctggtccaagaagttgggcgggaggtctgccgagtcccaggcctgttgcagcctggcccgggtcctggaactctctggctcctcatctccagcgcccagcttggcagagccggggacaagactcggactcggcatgtccgggtggcgggcgacctcctctcctgtcgcgggcacaatgtatatggtgtgggatgaatgagctgccctggtgctcagagctattgcatggagcaacatgtgagtggttgaagacatgccagatgccagcatcttatcactgcagtcctcccgtgtccaaacattacaactccatccatggagtaacaaacgcaggaggaggaatgcccagtaccacgcttgaatcaggcattccctcctccattcccaagctcaccaccctcaacccacacacacacctgtctgggcctccaccaggtagnnnnnnnnnnaattaatgagctgctctggtgctcagagttattgcatggagcaacatgtgagaggttgaagacataccagatgccagcatctcatcacggcagtcctcccgtgttcaaacattacaactccatccatggagtcacaaacgcaggaggagtaatgcccattaccacgcttgcatcaggcattccctcctccattcccacgctcaccaccctcgactcacgcacacacctgtctgggcctccaccaggtagnnnnnnnnnntgtctgcgagagtgggtcctcttctctgcccagtccctgttccctgccttccaccggccccccagcacacacctgtagcccaattacgactgcaaagccagagtctaatgcttttcgggcctccgcaacgacannnnnnnnnnaatccccagcgcatctgccgcggcctcgcccgtggactgcagtcccgatcaagtgggtgggatggcgtgcatactttgcgtctgcgagagtgggtcctcctctctgcccagttcctgttccctgccttccaccagccccccagcacacacctgtagcccgattacgactgcaaagccagaatctaatgcttttcgggcctccgcaacgacannnnnnnnnnttcattgtggttgccagagtggttcaggccgccctgcacgccagcagccacgaggaggggctgcatcccatcagaagcaaacagatgcagctgcatgtgtctgaatgaactcaacaagcaaaccggcccggctggatcccagtgcagcctgtcaccgtcctgtcccatctgtttggtcctctcccccggccaccttcatggacaccaggaggatcttgannnnnnnnnngtcattgtggttgccggagtggttcaggccgcctgcacgccagcagccacgagtaggggctgcatcccatcagaattaaacagatgcagctgcatgtgtctgaatgaactcaacaagcagaccggccccgctggatcccagtgcagcctggcaccgtcctctcccatctgtttggtcctctcccccgtccaccttcatggacaccaggaggatcttgaagaacctctgcacggcgccgtagtagggtttccagacatcccgcgtgctcccggtcgccgccagggcttccaccagggcggcgcgggtatcctgccacagggcgactgcggcgtcgtactgcgcgatctgggctggggtcagggggcaggccagctccgcaaactctgcctccctgtgggtggtgagggtggctatagtgcggcagggaccagttgtgtaaggctagagagctgaccaccgcctgtcttnnnnnnnnnnttccctttgggtggtgagggtggctctagtggggcagggaccagctgtggaaggctagagagctgaccaccgcctgtcttcaattggacatgcaccgagcccagctttcctggcaggctgtgtcactctctacccaggccggcacctgaaggacaggcccctggagagatnnnnnnnnnntgagcccagctttcctagcagactgtgtcactctccccccaggctggcacctgaaggacaggcccctggagagatacaggccctggcccttcatctccatggccaacatctccatgaaagtcacgcccctgcagcgaggaatgggtcgttcaatgaatgtgcttcgtctcccagggatgcactcccctgcacacccctacaccccctgcctcacctccgtttcatgctggagaggaaggagtcgaagtctggaaaggaggagccgacaccccagagacccaagcgtgacatgtatgccaaattgcccacctcactcacacctgcgtcagggagtgcacggcttcatgtttgggtggcccttcagcggatgatgttcaactgtgccccatgcctcctgttggctggatgtcaaaactctatggaacgcaaacattaccgcatgaacgccgccccagcactttcctgtggcagagcagtacaccacccgagctgcggggaggagggcctggatttcgagcacatttagtgccacccgtgtgctctgcgcctccttccctgggacaaaattcttggctgcagggtgggggaagaggggtgctttggttccaaggtccagaagggagagcaaggttccttgcagacaattgcgacatcagcctccctgtgtccaccagcannnnnnnnnnatgctttggtttcaaggtccagaagagagagcaaggttccttgcagacaatggcgacatcagcctccctgtgtccaccagcannnnnnnnnnnnnnntctgatgtcagaacagcgcgacagcaggggaagtggctgccatgcaaggcacacccaagaannnnnnnnnnggcggtcccaagcaggagtgaagtcagaatgagtgctccgagggcggagagccttcacctttgtgacctgtagatagactgaatactggcgtcagaacagcgcgacagcaggggcagtggctgccatgcaaggcacacccaagaagtgggtcagctgcaccattgagcccttccttcccagcgcatgtcagactttccccatagcttactctctccacctagctccggccccagcctcacattcatcgaaaacgagcgcgccattgaaggaggggccacccnnnnnnnnnnaggttgagtatgtcctgcggtggtagatggaacctactttttgctagaagtctccaggcgttcacgttctcaacgcttccatgtgagagagaagnnnnnnnnnntcatgtcagactttccctgtagcttactctctcaacctagctccgcacccagcctcacattcatcacagacgagcgcgccattgaaggaggggccacccagccactgaacgacctgctgcagacgggtccgacccttgatgctggaagtcagggttgagtatgtcctgcagttgtggatgggacctacttagtgcttgaagcctccaggcgttcgcgttctcaacgcttccatgtgagagagaagcacctgaatatcagtcatgcaggtgaaaagacgttccacttttcgtaattcgtttgactgccaaagccgctggccccgtctcacatgaacatgactccctcgcggggnnnnnnnnnnggcgttccacttttcgtgattagtttgactgccaaagccgctggccctgtctcacatgaacatgactccctcgcggggagtgttggtggctttgtccagggcctgcaaggcataagggttgctgataggaaggtgagcgacctcgggccctgtgactatcgccaagccgtacagcaaggatcttacactgctggattgcggtgcttgaagtcactgtaaggagagatgcccttagagcactccgacatagtaaaataatgaacttgaaaccccaaaccctctcctacactccacctgcacattctggatgacagggatgtggcatcccaggtccttcaagtctctcacagcgtcttgatacagatctgtcgatgtggagagccagacatgcttcccccggccccgagcatagttgtccagtatgatggcactgatctgcctgcccttgcccacgccggcgccatccccgaggaagaagccttggcctggtggcatgcatgtgtgggaggggtgtgtgatcggtctaggtgtcggcacaccactcatgttaggcatgcgatcacccatacccactctatccctaccccttccagtccctacgcacgttcccccgaagacagccagttgaggtggcgcgcgcaggcgtagcgcatgccctccagctgcaggnnnnnnnnnncccactctatccctaccccttccaatcctacacacgttcccccgacgacagccagttgaggtggcgcgcacaggcgtagcgcatgccctccagctgcaggctactcagttttccagaactgatgagttccgctggcagcgcatccagggggtagtcattggggggtagtgggatggcagccagggaggctggctccgcaatatcccctgggtggggctggccctcagccacactgcagcactgatatgcctggaagactgtggaggagagggcctcgcccccgccgtcatcccactctgcatcttcgggctggagcgagatggaggagggcagaggctccacggagccctccatgtcgcactgccgccgcagggctcacccggcagaactggccctctcgatcagacacctccacatccttctcgatccagggctgcctgcatcgaggcttctcggcacaaattannnnnnnnnncggagcgagatggaggagggcagaggctccatggagccctccatgtcgcaccgccgcagcagggctcacccggcagaactggccctcgcgatcagacacctccacaatcttctcgatcgagggccgcctgcatcgaggcttctcggcacaaattatctcgagatttgcaaataagaatgtgactgtgcacggcagggctccctgctgcttgttgccactcgtgcgcagggcatcactcgacaagtcccatgatcgcatgttttcaaaccactgcacctgtctgtccaggttccatcaactcctcgcatgcggctcgcatcacccaaaacgtatgtaggaactcccagtgcttaataacaacacactctgctgcaagatgcggggcatgcatgcatcatgcaaaacccannnnnnnnnnaaggaattcccagtgcttgataacaacacactctgctgcaagacgcggggcatgcatgcatcatgcaaaacccatggccttcttgtatcgcatctcctcttgccatgtgagacggtcccccgcccagttgcctgtgctcgtccgtctgttcaggttccgaccactgctcttggacgtgtctgtgagcgtgggtggcgaggaaagggtcgggaatttaatgaaggctcggcttggtgtatccggctgggcaggtgagctgctggcatggttcacatgaaacatcacgtaagccgcaagcgatcactgtgcaagctgtgaccaccacatccnnnnnnnnnnacatggcatcactcgacaaggtccatgatcgcatgttttcaaaccaatggacctgtctgtccaggttccatcaactcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtcggggatttaatgaaggcttggcttggtgtatctggctgggcaggtgagctgctggcatggttcnnnnnnnnnnacaaggcctcaaagctacttgaccccctcagcctgccccgcgctcaccgaaaacctcgtccagcgagcaggtcttgtgctgttgctgaaagatgaggtctggatccaggtgtgtctgcaggtattttcaaggggtgaagggtggatgatggggggcatgcatgggttcagtcatgtcaagagagtgagaaaggcagggcgactggtcccgcagccccaacccagcaagagcttggccccgcatccacctgcgagagcagctgcgcttgcagtaccttgccgcgcgcccattcaggcaccggcttctgaggctcctcatcgtcggagctgtcgtcactcctgcgcatagatgcgaaccaggaagccagatcagctgacgtgccgatcggttggatccgtgagcgtgccgtcctgctgcattccatatcagcagtatgggagttcatccctgcgagctcaacgagaaggccagaccatccaccacccctgtctgtcacagtcaaccccacccccggcctcacttgtacggtgagatctcgtagttatggcgagacccggcgctgctggcacggggcaccgctccaggtgaccccggctgcttctggaccagcgtagaggtgccggacccagggggtgggccctgcgcttgggcagcctgtggacccagggggttggtcgtggtggagggcaaggctgccgtcgtggccgtctggggggcaggtggagagggccctcgtggctgcaccggctcggcaacctnnnnnnnnnncgccgccgtggttgtctggagggcaggtggagagagccctcgtggctgcaccggctcggcaacctgtgagttggggggccaggtgccggcaagggtacattcagtggtgcacaagggatctgtacatagcctggaggaaggcagataccagctcagcatcacccaaggaggaccgagtacctgcaccctgacctgtggattgggctcatgagactaaaacctggcccaagcctggtcggcaacccggcatgcactcctggttgggttcatcagaccccaccctccgccatacctggagcaggggtctggaagctgcaggggccagaccctgcgactgaaggttggccccggccgtcagccccacaccatgcggctgcgcaccctgaggcagtgcggctggggccagcctcagcttggcggggcccgcctcgccgtgtacctgctgcccgttgtacaggatcttcttcaggggtttcgcggcgccaggcaccgccgcggcgccggcagtcggtgctgcgcctggtagcgccgtcgtgctgggattggggccctcgttctcctgcgcagttgagcgggtacatgtgtgcagcttaagagacgggacgctgtgatgcacgggggaatggccggcccggccaggcagggcagggggctcgtgcacggtcccagcgtcccaccgccaggaggccccctcgcaaacaatcacccaccctcctgcaatcccctcgcaccctgtcgggtttgtgcagcgnnnnnnnnnnggggtacgtgtgtgcagatgaagagatgggacgctgtgatgcacgggggaaaggccggcccacccaggcagggcaggggcctcgcacacggtcccagcgtcccaccgccaggaggacccatcgcaaacaatcacccactcccctgcaaccccctcgcaccctgtcgggtttgtgcagcgccggcctggcctgctgagccgctgcctgcgaggcatgtctcggcacggcgtcggcggtcgcgggcggcagggccgcgccaaatgccagggccacctccttcctcttggggccggcgccgcccttccccgcctccagctgctgcttccggcgcgcggccgcctcctgctgcttccgcagcgcggcctccgcgcgctcccgcgcctcctccgcatccgcggcctgcttcgcagccaggcgctccgcccgcgccctctccagctccagccgccggcgctcgcgctcggcgtctcgagcctcctgcgcccgccgtgcggcgtcggccttctccagcgccgccaggcgggcggccgggcgcgcggaggacagcgcgggtgcgggcgggcgggagccgggcagcagcgagcgcacggcagacaccaggttgccggccatgctgcgcggcgcaggcggcgcgggcgcggcgggcgagggcgagggcgagggcgagggggaaggcggtgacggggcggggggtgagggtgacgcaccgcctggagcgtcagcagggtctggtgctgcaggtccggaagcgggggagtcctctgtatcgtgttctgtctgcgcggcatgcgtcgggccttcctcgcctggtgtgccaaggatgggtcnnnnnnnnnntcaggtccggaagcgggggagtcctctgcatcgtgctctgtctgcgcggcatgcgtcgggtcttcctcgcctggtgtgccaaggatgggtccaccctgcccctcagccactggcagagcgacttccacgctgggccggcccgtcggctcctcgtcgcgcgtggggtcggaggccggcgaggcctcgactgcgctcggtggaccctccccgtgtcggatgggggagggtggctccggcgccgtggagcctggaagcagaggtgaaggagcctccgagggcgaagcgctgccgctgccacgtccggcaggcgcatcggcgggcagcgcaggggctgcagggctcctggcctctgcgtcaggtgtgctggtggtgggcccaggcacccgctcctccccccaggctccacccccacgcacgctgtcgtccccaatggcagcggctggatcaccnnnnnnnnnngggtgtgctggtggtgggcccagtcacccgctcctccccccaagctccacccccacgcacgccgtcgtccccaatggcagcggctggatcacctatggcggacacagaggcgcccgctgagccgaggctttcgtcctggtggtgcactgctggcgggacggcgggcgccgctgcggtctcggggggcggcaggctggatggcgaggctccagcgtcctccaggctgcctgctgcggtccactccggcggattggcggccctgctcagagcaatggaggcgggcctcacgggatcggctgcaggactcagnnnnnnnnnncggtggtgcactgttggtgggacgcggggcgccgctgcggtttcgggaggcggtaggctggatggcgaggctccagcgtcctccaggctgcctgctgcggtccgctctggcggatcggcggccccgctcagggcaatggaggagggcctcacgggatcggctgcaggactcagcagacggctggggccgcggccgccccgctcgccctgctcgccctgctcggcatactcatcgagggtcggtgctgtgccgtgctgtggcccctcccggccgccgtctggctgcacccgcaccggggaagcagcctgagcttccagcgctggcccgggacccgcagcagtgtctggctcgagggtggcaggcgcctcgtccacgcgcctcctcgacattttgaccttgctggcggtcgccctggggcgaccgcgcttctttgcggctggagcgggggagtccgtctttcctgcagcctcgccggtggtggagggggacaagtcctcggctgcagagggggcaggaggctcagggttcccaccgcccacctccatctccaacacagggtcgcctgatggctcctccccctccgccgatgccgcactgaggactgaggaccgggtcgtccgacctggcgcagcggtgccacctgctgctgaggttcagggatggggattgatgactggggtgtgcaagggcaacaaagtgcacatttcaacataccagggccaagcagttcacccacccttcttggctgtgctctgctgtgcaccgccagactggctccgggcactgcgccgggttggccgggcaggcggagacgccgcatcctcctgctcggcgacagcgaccagcggagctggggcctctgccgactctgccacacgttttcgagtgacgcgcggggctttgacaggctcgggtgcctggttctccactggaggttgctcgggctgctctgcgacagcctcagacggtggtttggtggggaatcctcctttgggtatcctgggaggtcgcccgggcttcctcttgacagcctgtggggggtggatggaagcgatgtgattactacgctattctcatgtgaacccgcgaaagagatagtnnnnnnnnnncgcctgtggggggtgggtggaagcgatgcgattactaagccattctcatgtgaacccgcgaaagagatagtgccggggtgaatctgccggacctggggcggggcgagggcaggcacctcgggctcagccttcccctccctccgacgcgcagtgctcagcgatgtgaaggcctctgcgatccaagccgcgtggtttgcgaccaaggagtcgatgttggccagcttcgcatcggcatatgtgcccagatcgctcagggcgagggcgaggtttgccgacatccttgccggtaccgcacggggaggccagcgcccttacgccttcggggtgcctcagaacatcggtgaattaaattaacgatcaccccagaagccggctgacaggagtcctcctcgcgcactcgtgatggcgccagcagacgatgacaggtgtttgcccgggttttgagtcggtatcgaaaaggcgggaagcatttgccaagagttggaacttgaatgcaacagcgacaatatctcgaagcagacccaccgcgtacacgccgatcaacatgggagataatgtacaaatgtgatgtagagctaagatgatgaaggttcaatatgttgttacaggtgtctgtagcttgctattggggnnnnnnnnnnaatgggagataatgtacaaatgtgatgcagggctaagatgaagaaggttagatctgtcgttacaggtgtctgtagcttgctattggggtagttgtgggaatgcttgtaatcccggaattggtggaggacaggcgcctcggcagacgacgactcatgagaacacccgcgttgtagccgatgcattcgattgcttcaggagcgcatttcaggacgtgattcattctccgcatcctggtttnnnnnnnnnngtcatgagggcacccgcattgtagccgatgcagtcgattgcttcaggagcgcatttttggacgtgattcattctccgcatcctggtttacagcgagctggctgtatggtggcctccatgacattcgaggccatccatttccaggccgtcacatgaggacagttcacacaacgctctcctctcgtcgatgaaccacacttcgtcacactaagcaggccagaataaaatcgaatttgtatggtatgaagtcgggttggccccttgaggctgtcatggccggcctcgggtcnnnnnnnnnnctgtcacacttagcatgccagaatatgattgaatttatatgatatgaagtcgggttggctccttgaggctgtcatggccggcctcgggtcctccctcgaacccctcgagccaaggcgttacggcaacggtcggctccgttccgtccatgccggcattgcattctcatgcttcatcgtcattcacgcattaccctnnnnnnnnnntggcgttacggcaacggtcggctccgttctgtccatgccggcatcgcattcgcatgcttcatcgtcattcacgcattaccctgcatccatggcttcccagagtaccagctggccaccaagtcctcgctcgacgagggcagaggtggggcacggggaggcatgggcgggggggaatggggaggttgatgaactgaaggccgggggccttcgcatggcaacggcttcccaccttgccctccnnnnnnnnnncgggggaaatggggaggttgatgagcttaaggccgggggcctttgcatggcaacggcttcccaccttgccctccacccctccatcctcctgtgcatgcagaggtcagcgcggcgctcaccgccgccgccgcctccgagtccctgctggaccgcctgctgggcacagactgcttcagccgcgcggtggcggagctggaggcgggctgccggggcctggcccccgaggccaaggcccgcctggcgctgcgcctggtgcagtgccaggtggccacgcacggcggccgccccgcgccctgccctgccgccgcgccgctcaagccatgcctggacgcgctgccggggcgggactggcagctgtacgtggagttcctgacccacgccgatgcgatgtgcgtgtacctgcagaaccaggacttcgaggcgcacgccgagcgcctgctcacgcggctggcgcggggcgcgggccaggcccagggcgctctggaccggctggaggcgcgggcggaggccatacacggcgcgacgcgtgggctggaggcgggcgcgcacgccgcgcgcgcctcactggacgccgtgctcgaagggcaggcgcgggcacgggaggcggcgacggcagcgggggaggaggtggggcgccgcctggcgggtctcagggagcagcaggctgagacgttggccctgcaggtggggctttggatggggggaggggggaggggacacatggcgctccgggttccaaacggcggcgggttgttgggagggctgtgtcccagggactgcccaggacatgctggcgacgagtcagtgagttcatctgggccttggctggcacctcctctgcnnnnnnnnnngtggcgttccagggtccgaccggtggcggggtgttgggagggctgtgtcccagggactgccnnnnnnnnnngacggctggataccttgcagacgctcatccacccaggacagcccaccacatgcnnnnnnnnnnaacagctgggtaccctacagactctcatccacccaggacagcccaccacatgcacacattgaaaatgtttgaagttgtgcggattcgccagccaaaggggttacctcatccactctctcacacctaagatttccaagcccacatccaggcggcggccctggagcgtcaggaacagctgcgggacggccaggaggcgatgctgcacagcgtgcacagcgggcgggagctgctggactccgtgctgacgggggcggaggccagggcgcgcgccgcggaggccatgcaggaggaggccgcggccgcgcagcggcggctgactgcagacctcgggtgtggggctgggtgccgatgggggcgggaagtgttggcacgcgggacggtgacctgtcgcgccggcatggggcagcgnnnnnnnnnngtgggtgccgatggggggcgggaggtgttggcacgcgggatggtgacctgtcgcgccggcatggggcagcggggtgtaggctcggcgggcatagacttgtgcaccgcccaggattccaccatcgcttgggtgacaatcccaactcccgccggccatgtcgagggcaagtgtggggaggctctggaagagatgctcctgcctcagtcaaccaccccgctcatccgtttccgctccagggccgtggcggcctcctcggagggcctgcgctccctggtggaggccctgctctcctaccagcaccgctccgaggccctcgtgctcagaatgctggggcacgagactgggcaggggaacgcctggcacctcctggccctgctcgcgggggtgtgggtggtgggcggtttccttggggggcggcgcgcccgcaccctgggcatgctcgccctgggggccagcctggcgaccgagagggccctgctcacgcacctggcaccctacctccagctgggggagggaggcacggtgaggcgtgggccagcgccgggtgccgcccggaatgccgagccggtcccacaactgtcagcgacgacagcaggagtcttcactcggcgcctcgccaccacagnnnnnnnnnntgggtgccgtccggaatgccgagccggtctcacaactgtcagcgacgacagcgagagtcttcactcggcgcctcgccaccacaggtgtacctgggtgcccccgcctggctgagctgggtggtgccgagggcgctgctgctcgacctcagggcggcatccagggtctgctggctgggagcagccgcgctgaagctggcgaggggcgctcgcggccgtagcgctgctgctccccttgctgagctggagaggtgggcggttggtggagacattggtgggctacaccggtccctctgccggcaggacggtgctgaaactaatcgatcagcctcgctttaccggcatgtgtagggccatggcagtgcgagagctcgacgcctgcaggaggcacgaagctgcccagcagctggcactggcccacaatgtggccgtgctgacgaggctggacgagctccggctggcgctggagcggcagcgaactccgcagcagatccagcaccagggaagtcccgctttgctgccaaggaccaaggcacaggcgtggcccctcttgttgcctggcgacacacctgagcaccgtgcggccgtgcgggaggacagcaacctcaggacaggactgcaggcttcagatggcacaggggatgtctgtacatcaagcccacccgcacaagtttcccaagatcaggccctgcccagcccggcctcaaaacaacagccgcccagtgcagctaccttgccgcccaacgtcaccccagagcagcaggaggcccctcgaaggaagccaggacctggtaggaagaggaaggtggctccaaatgataatttgaaagagtcgaaacgcgcgtacacccggaagtcccctccttcgatggattcctagcacatgtattttgcccagcctgcccttcttccctgcctcctttctcggctgcgccgaaagactctgggcgcgcggtcctgccgagatgcgcaacgccatcacctgtccgacggaccggcttgacaccccttccctgcgcgtgcatctaattgagtgcccaggaatacagctgcaatcgccttggcaagcctcacgtgatacggatcggcggcgccggtgtccgaaaacccttgccgcacccaggactctcgtcccccaggccgggaggccacgcgctcccgatgagggcgctgtgcgccgccctgcttgtaatgggaatgtgggatctggcagagccaacaaagtgcggagcggacctgccgctggtagccaacacatgggccttcaccgctgccacggaatcggcctgggaggcaatgacagccgaggacgccaagcaccccgccatggatgccatcgaaatggtgcggaaatggggagttgggctggcgtctgggtgggcgaggttgccgcacggcctgcgaccctggccgaggagctgcgcggacttgctctgtcgaccccccgtggtcgtgcatgcggacggactggtggtcgtgcgccgcaaccctcgccttacaaatgccccattacaccacagggagccacccaatgcgaggatgatcagtgcgatggcaccgtgggatacgggggcagccccgacgaggctggggagaccaccctggacgccatgatcatggacggcgacaccatggacatgggagccgtggggtgagtgctgtgcgccagcattggggtagatcgagctgtggacagtgtgttgagcccgggtagcctgcgttagcctccaagtacagccctgtaggcctgcgccaagtcctggagnnnnnnnnnnagtagatcgagctgtggacagcgtgttgagcccgggtagcctgtgttagcctccaagtatagccctgtaggcctgcgccaagtcctggagcccttgatgtggccgggctgccacccagaagaaactctcatccccgtcaccagtttcaatgcacacgcccctcaagccctgtcccacgcacggtgcaagccgctccttttcctgtaagaccaagacttgacccccatcagcttccccctttcttcctccgaccgcagggacctgcgccacgtcaagcacgctctgtcggcggcgcgcatgnnnnnnnnnntcttttcctctaagaccgagacttgacccccatcagcttcccccttcttcctcctctgaccgcagggacctgcgccatgtcaagcacgctctgtcggcggcgcgcatggtcctgcgcaccacccgccactccctgctgaccgggctgcaggccacccagtttgccatggacatgggcatgaagctggacgacctgtcgaccaaggcctccgcggcgcagcacgccgcctggcgcgccgaccgctgccagcccaacttccggcgcgacgtgtgcccggacccggcccggagctgcggaccttacagcctgccgcgcggcaaggtcaggccgatggcgccgggggcgacgtcgggcactgaccagtgcgtggatgtggaggagctggtgccgccgagcccgccggcagcggcaaccgcggcgtcttcttcgttgacagcagcggcgcaggcagcgacggcgtcgcacggacgaccccccaaccgaaccgccacgcccttcccctcgcccacggcgcacgacaccatcgcgctgctggcgatcgaccggcggggcagcatcgcggcgggggcctccaccaacggcgcggcgcacaaggtccccggccgcgtgggcgatgcggcggtggccggcggcggcgcctacgccgacagcgccgtcggcgcgtgcggtgcgacgggggacggcgacgtgcacctccgcttcctgccctgctaccaggtggtggagagcatgcgcgccggcgcgggcccggcagcggccgcggaggaggcgatgcgccgcatcgctgaccgcgtgccgggctacgtcggcgcggtgctggcggcggaccgctgcggcgcgctgggcgccgcggcagtgggctggaacttcacctacgcctaccgccacgcgcgcagcgacggcgtgcgcgtcgtacacatcgcgccccttcagccccgcgtcggccccgcgccggcgccgacgctggtgggcgccctgtgaaggcctctgtggacgcagggcgcgctcttccttgacctgccgccgcggccatcacgcggaagtggacggccggcccttggccattagggcagcgtcagggggttctcctcggtaggaccaccttcctaggcatggtcatccccgcgctgcccactgaacccagaaacatgacgtactgctgattgtnnnnnnnnnnagtgaaggcctccgtggacgcagggcgcgctcttcctcgacctgccgccgcggccaccaggcggaactgggcggccggcaccttggccattagggcagcgtcgaggggttctcctcctcagtagacccgccttcccaggcatggttatccccgcgctgcccactcaacccagaaacatgacgtactgctgattgttgccctgttctttagccatgttcctcccagaacctccttgctgcttcgctcnnnnnnnnnnagctgcccccggcgcgttcagcgcccgggggctggccgcgattcctcggagccgagggaatctttagccattaaccagcgccctcagagacggacacggccgcagtgtgatcacctgcagtacgacgagcacttgctcccttgcagcacattctaggtcgcctgggtcatccccgtcgtggcgcgagcctgtagcgaatccaaaccttgccgcatacgcacgctctagggctttcgccgcccccctcgctcctgacctcggcctcctcatcgcatggtgggtgactctgatgtgtgccaattttatgtcaacccctgcatgtggctgggcagctcagcatctgggtgccgtcccttgcaggtcgacacccccccccgcccggccctgcccgcggaccatggcttgaatgggagcatgcacaagacctcctccctggccaagctgcgcgaggctgggcatgcagcggtgtaccgggccgcgggcgggaaccgggagctggtgggtctctggctctttgtcctgtccacctttttcgggaccgggatgagcctctgcgccaagctccttggtaagggtggggaatacggtgcaacgaaagaatggggttcttgcaattttggatgctgagtctgggtcgagaggttggggccgcttgtcctgctgttgtcctgctgttgtcctgctcagcttgtagatggaggtgcagccattctctattcgtaggtggggaggggagaggcatgacatgagccacttcaagggtgccctctcccagctcctgtcatggtcttcccatccatcttgcccttgcgatcccctccgcagcccgccagggcgtccccgtcttcgaggtggtgctggtgcgctccctcaccctcctggccttcaccgtcccggtattggtccggcagaaggtcaacccctttggcgaccagcggcgctggctctacgtcctgcgcggcgtcctgggctttggctctgtctccctcctctactacgcaggtgtgcagggtgcaaggggtgtgttaaagcttgctcccgctccgctcgagattgggcttggggtgtctcgcctcggcaatgtgatgcgccgctgaccctcagccatggcatcgccgcggccatgcatcccatgatattcttcccacggctttcccctgccccgccctcgctcctttgatcccnnnnnnnnnngtcgccgcggccatgcatcccatgcttttcttcccaccgctgacccctgccccgccctcgctcctttgatcccctacaaacacagtgttgtcatccgccacccacccacccacccactccttgcagtgacgctgctgaccatggcggacgccaatgtgcttgccttcctggctccactctgggcggccctcctctcccccctcctgctcgccgagtggccctcctcgggcttggtggtggccctgcccgtgtccatcttgggcgtgctgctggtggcccagccgccctggctctttggcctgtcggaggggacggtgagcattctgggactggcggtgggcatcacccagtccctcttctctgccctggccaagatggcggtgcgcgcactgaacacaaacaccgagtccatggccgccatcattttctccatgggcgcggtgtccacgctctgctccgccatcgcggtgacggtgctggggcagtggatgctgccacgcaccgcatcggcgctggccctgctggccgccaatggcctcatgggctatggcaaccaggtgacccagaccgcggcgctgcagcgcgccaaggccgcgcccgccatcgccatgtcctacctctccgtcatctgggggctggccgcggacgtcctggtcttccacgacgcgccggactggctgtccctcctgggcgcggtcatcatctgcggctgcagcttcgcggtggcctactgggagcgcctggagaagcagcggcgcgaggcgcgggaacgcgccgccgccgtgctgctcggggacgaggaggccgtgcagccactgctggatccgcgcccggccgccacggcgacggcctgagggcccagggtccccgaagcggcacctcagagcaccctgacgcnnnnnnnnnnttggatccgcgcccggccgccacagcgacggcctgagggcccaggggggccgaagcggcacctcagagcaccctgacgccgctgcagcaacctgacatcaccatgcaggaggcgccttgggtcaaggacctgcatccatcacgtgatacttgctgagattgggggccggctctaccccggctccagcttgctgctcgctttgtcgaagcccgcctccacagcatgcatgcgcttctcccttgcctccttttcccccttcaacatccaagggtctttccatgcaaccatcatgcagcacagttcacaccaagggctttgtgggcgcttcacatgtctcccattcatgcatgctgcgagagcacacccgccctcaagattgccagtaccataggaaagtcacgtgtgttgatattcgccggcgcccgtgcatccgtgcgcccaaacccaccatcccttcgatccagtccagcactcttcagctgcattgtcttcatcatggctgccctgacaacatccgtgtttgcaggtgtaggaaaggcggcgattgcccagccccgggcgccgacctccgtgcgggtatgctggcgcagggggtggctggagccaggagtgtgctgcggcgatgtagagtatcaaaccacagccatctatcatgcgcaggctctgggtcggtcttttgggttgaggtgccaggtccgggcgccgcggctgtatgccacctgcgtccgctcgagcctggagaccgagaagaaggtgggtgcgcgtctggagagtacgttggatcacgaagctcaagcactgctttttggtgtcgttctgatgccggaaatgccggtgaatcccgcagggcgaccccaccaccccggattaccgggtgttcttcaaccacaagtccaccaccgtgtccccatggcacaacatccccctccatgccggggatggcctgtacaactttgtagcagagatccccaagcagacctcggccaagttcgaggtcgccacggtgcgcgatgatccaggggggttgtggtgtgcggattatatcgtggtgtgcctcccctgacaattctttctgacatggtcatgtgcggttttgcaagccctgaatgcctgcggtgtatggtagcacccagcctctgcactgtcacctttggcttgaccatagactccagtgctgtgtgaaacggctggccnnnnnnnnnnagtcgccacggtgcgcgaggatccaggggggtcgtggtgtgcggtttatatcgtggcgtgcctcccctgacaaatctttctgacatggtcatgtgcggttctgcaagccctgaatgcctgcggtgtatgctagcacccagcctctgcactgtcacctgtggcttgaccagagactccagtgctgtgtgaaacggctggcccaccccttgtcacgccggccctcgaccaggatgagcctcgaacccccatcaagcaagacatcaagaagggcaagctgcgcttctacccctacaacatcgactggaactatggcctgctcccccagacgtgggaggaccctgcacacaccaacagggacaccaatgctgctgtgagttggacgttgctgcccacatgttgatggagccaacgggttgggcatctgcatgctaggctgccattgggnnnnnnnnnncgtgagttggacgttgcggcccacatgttgatggagccgaaggggtgggcatctgcatgctaggctgccattgggagtagatcctcttcaccctccaccaatcgggtctcgatgaaaggaacaacccattcacacacacaaaaccaccgatggttttccaagtgatgaacctaaggtattctgcaaatttgagagaccacatctcgtgtcccgttttttcaatcagatcatgccatgcttctgattacttgcattcatcaaggcgagccaccgcccaaccgccgcacgagcactgcatatgaatcatgatcccagggccccccctctctctgcagggcgacaacgacccagtggacgtggtggagatcgggtcggcgagcgccgaaaccggcggcgtgtacaaggtgaaggtcctgggtgtctatgccatgatcgacgacggtgagctggactggaaggtgatcgccatccgcgcggacgaccccaaggccgacagcgtcaatgacatcgaggacgtcgagcggtgagtgggctggggagcagtttattgtcggtagtggaccaggttctggtgcggcatttgccctgcatgagttgtgctggtccggcannnnnnnnnncgggctggggagcagcttattgtcggtagtggaccagtttctggtgcggcacttgccctgcatgagttgtgctggtccggcatgcatcccgggcgctggccacctacccactgccagcccgagtgtgaacccctgctccctgcaaatgcctagcccatcccttacccccgtaacagcgagttccccggcgagctgcaaaaggtgtacgagtggttccgggactacaagatcccggacggcaaacccgccaatgcctttggcttcgacaacaaggcccagaaccgggcctttgccctggatgtgatcgaggagacgcaccgcttctggctcgacctggtcagcgggaagcgggaaaacaccgaggacctgtccctgttctgattcagcttgcaccaattctttggctcgagtgcctcttaaccccgtgcacaatttttctcctgccttgaccagtccattgcaacaatgtgcgcgaagggaggtgcgtggcatggcatggcggggatggtcggatgggtcgccctgcagtcccaaggtgctcaaccacgttggtgtttgcggcctctcgggagggtgctcggagggtccaaaccatgtggcgacgagtgcgttcaattattcgcatcatggcgagagcatcttgtgcagatgccgctgacagccctctgtaaactcgagaatgaagcttaaattgatctgaagtcagggtcactgtgcatatatcgggcttccaactgcaaaatccatcaggtaagtgtctgcagcgaagcggcgcatgcactgttttgtgatcctggaaatgtcgggcagatctatgtctcacactgagcacctgggacccatgcagacattaccgcgatgccgttgaaccttataatgtccaatcacttccacaggttgccgctatgggtgcgtggaccacgaaattgctggtggccagcatcctcgcatttgccggatcctgccgggcggccgagtcgaccctcgaatccatttcttggggaagcgaggctgatgtgagtaggtgtgatcgatgatcaaggcaatatttcagcgaactacgatactggataagccaagtaccgtcccacctccaccctccccaccttcagggtgaaccggaggaatgggggtatcgcctcttcctgacggccgacaacttcaccgtatccccttggcacagcgttcccctgaacgccggcaaggacctgcacaccttcatcgttgagatcccaaagaacaccgcagccaagtatgaagtccagacggtgcgctgtggttggtgttnnnnnnnnnngtttcagcgaaactacgatactggataaaccaagtgccgtcccacctccaccctccccaccttcagnnnnnnnnnnaagcaggcaggaaaattcttgggaggctgtgcggatcgagaggaagaagcatccacgccaccgcatcacgagccattccacaccccacacatcnnnnnnnnnngagcaggcaggaaaatacttgggaggctgtgcggatcgggaggaaggagcatccacgccacctcatcacgagccattccacaccccacacatcacgacaggaggaggcgctgaaccccattcagcaggacctgacgagcaacggctctctccgctactaccactcggacatcccatggaactatggtctcctgcctcagacgtgggaggacccggactacatcaaccctgatgtaaacgccacggtgcgctgcggctcttaagggtgttcacctgaaaagcagacggtgctgcttatgctcatgcccgtcaaccacatttcgaatgaagggaggctcagggctgcacaannnnnnnnnnnnnnnnnnnnnnnnnnnnnnnnnnnnnnnnnnnnnnnnnnnnnnnnnnnnnnnnnncatggtctaacccctccccaaccatgtcaacatgttgcagggtgataacgatcccacggacgtggttgagattggagggtctgcacttgagactggcagcatccatccagtcaaggttctgggtgagtgatactgcgtctgcattgcgcatgcgcctgctgagaggtcgagtcctttgggactggcagggtagcatggggcttctgcgataaccgcagaacactgcaacccctaccccctccgcatgtcacnnnnnnnnnncagcatggggcttctgcgacaaccgcagtatactgcaacccctaccccctccgcatgtcacatgccacaggggcctacgctctgatcgaccagggagagcttgactggaaggtcatcgtcatctcacaggccgatcccctggccgagagactgaatgacatcgaggacgtggagaggtgagttggatgtcctgggtggatcaagggtggtggagaccgccattgcggcgtacgtagtccaagaaccctacttcgagcactctctattgcagggagctcccgggggaactggagaggattcgtgtttggttcagggactccaagctcctcgatggaaagcctgccaacacctttgggttcgatgaccagcccgtggaccgtgcacagacgctgggggtgatcaaccagacgcatggtttttggctggacctggtcagtggggcacgtgagaacacagagagcaagtctgtgtttggatgagtgggtgcgtgccctccactttgattgcaaggagagagagactccaggcacttgcccaaacatacagtgatccgaggtggcggggcgagcgcgcgnnnnnnnnnncggatgagtgggtgcgtgccctccactttggttgtaaggagagagaaactccagatatttgcccaaacatatagtgatccgaggtggcggggcgagcgcgcgccgattgaaacgatgttgcagagcgaaatggcccaagggcactctgagccaagaattacagctttgcagtgaacaaagatagcatgttggagttacagtagatccctagggtgacgatgtggccgaggaacaggattcactaggatagccaaggagtacgatgttccgggcgcagaccactccaagcgcctgggctcgtctgcagtgagttggcaatggattcggaatgttatacagaccctgagtaccctgcataatcgcctgtgggattgagtgtggcgatcgcattgcctccatagaaacaaaccacttgaaccttcgcattcgcaggcaagagggggctctcgatctagaccgcgtcgcccctgcagaggccgaggagctggctgcccgagtcaccgagctggagtccaaagtaggatcagccgtggggctggcactggctgccgaattgttcgtcggtcaccatggaggtggagtggatgtgcttcatattgcctnnnnnnnnnnagagtcgaaagtaggatcagccgtggggttggcactggctgccaaatgcttcgtcggtcaccatagaggtggagtggatgtgcttcatattgcctgaagccagcccctccatccctcgcacaggtcctggattggcagcagcaatacgatgatctcttcaatgagtatgaaacagcacgcaagttctaccaggtgacaggaggtctatggagggcagagaggttgggtgtttacagtttcacagccagaacccccctggcacagccggtgcttctgttgaggtcagattccatccatcttctgcttcccaaccactcacagggattggagggtcacctggaccaggcccacgccgccgccatcaaggagaagcggcggctgacggcctcggtggcggaggaggctcgccgcgctgcagtggcccagaccctgctggaatcggagcgggccgccaggtactcttcctgggtggggtcggggggcggtggtgtggctgaggcagtccaaccagggtcagattgtggaatcttggctggaacggcacccgcgacggtctcctgctcacctcagcccaccccggatgcgcttgccagggatgaggcggaggccaagctggcggcgctgagggaaactgtggaggagctgcaggcgggcctgcaggtggccaggcaggagagcaaggccgcggccgacgccgcccagctcgccgaggaggaggcccacgccgggctggccagcgcggaggccgcgtcggcggccctccgcagcgaactccaggaggcccgcgccgccgcggaggttgccgaggctgccgccgaggccgtgcggcagggaggccgtgcggcggccgcggc

SEQ ID NO: 46684 - DNA, 80 bp, Chlorella protothecoides
cggcttctccttcctggtctccctcggcctgtctgcgcgagaggaagtgaggggggggggggggggttgggggggggggg

SEQ ID NO: 46685 - DNA, 76 bp, Chlorella protothecoides
gcgttgcccttttactgctgcggcacccccaagggcccattacaggccgggggcatcccctggaattttgtcctgc

SEQ ID NO: 46686 - DNA, 61 bp, Chlorella protothecoides
ctacggccccgcttcgcagggcatggccggtgcaggagtcagcatagcaggcgcgcctggc

SEQ ID NO: 46687 - DNA, 61 bp, Chlorella protothecoides
tacatcatgctgggcgcgttggggacgctggcgaggccagacatcatgctgtgggcgccgg

SEQ ID NO: 46688 - DNA, 92 bp, Chlorella protothecoides
ccaacagccggttgttcccccatgccgcaacggggggtctgacaagcgcccggccctttctctgaaacataccttttctcacccccccccaa

SEQ ID NO: 46689 - DNA, 20420 bp, Chlorella protothecoides
  modified_base (141)..(150): a, c, t, g, unknown or other
  modified_base (920)..(929): a, c, t, g, unknown or other
  modified_base (1551)..(1560): a, c, t, g, unknown or other
  modified_base (1837)..(1846): a, c, t, g, unknown or other
  modified_base (2521)..(2530): a, c, t, g, unknown or other
  modified_base (3003)..(3012): a, c, t, g, unknown or other
  modified_base (3601)..(3610): a, c, t, g, unknown or other
  modified_base (4601)..(4610): a, c, t, g, unknown or other
  modified_base (5416)..(5425): a, c, t, g, unknown or other
  modified_base (6151)..(6160): a, c, t, g, unknown or other
  modified_base (6623)..(6632): a, c, t, g, unknown or other
  modified_base (7277)..(7286): a, c, t, g, unknown or other
  modified_base (8236)..(8245): a, c, t, g, unknown or other
  modified_base (8319)..(8328): a, c, t, g, unknown or other
  modified_base (8401)..(8410): a, c, t, g, unknown or other
  modified_base (8600)..(8660): a, c, t, g, unknown or other
  modified_base (8851)..(8860): a, c, t, g, unknown or other
  modified_base (9539)..(9548): a, c, t, g, unknown or other
  modified_base (9630)..(9775): a, c, t, g, unknown or other
  modified_base (9845)..(9854): a, c, t, g, unknown or other
  modified_base (10600)..(10609): a, c, t, g, unknown or other
  modified_base (14333)..(14342): a, c, t, g, unknown or other
  modified_base (15315)..(15324): a, c, t, g, unknown or other
  modified_base (17268)..(17277): a, c, t, g, unknown or other
  modified_base (17749)..(17758): a, c, t, g, unknown or other
  modified_base (18109)..(18149): a, c, t, g, unknown or other
  modified_base (19891)..(19900): a, c, t, g, unknown or other
ggcggggacgccaggttggggcttccggatctctgcaggaagagtggtgtgagggggacagtgggtgcactgcttggcacggcaccggggttcattccgcggctcgagccctcctcgcacccgccagctcacaggggcacnnnnnnnnnnttctgcaggaagattggtgtgaggaggacagtgggtgcactgcttggcacggcactggggttcattccgcggctcgagcactcctcgcacccgccagctcacaggggcacccttccgcatgcccccccagtgaacatgccacaccacaagcaacccacccttgactcgatcggcgtagcgtagggtgttcagcgtgtgctcgcaggaggaggagcagggggacacattggcgatcatcaccgtccgcgccgccttgcccatgaaggagtcgcgcagaacctccgtcagcttggagccgcggaaggggatgtgtctgcgcagcggcgtggcgggaggggggcgcaggtggtttgtttccgtcagcatcaccccaccacaggctgacaccctagacccagcaggcagggcgtccagaggccaaggcgttgggccccgtgctcggcggtgggcggggccggcaggtcttccccaccctctggatcaacccccatctccccactcggcgcaccgcgcgtcgctgtccagcgcccggatgcactccttcagggcgaggagggacttgttgatctcagcgccctccagccgtgtctgcttgtcgttgtcatatgtgtctgcacatggggcccggggctcgaggtggcaacccccccacgatgcagctcggccctgacgcacgtgatcgcatgtcaagcatgaccacacacgctgcccagtccaacatcaccactgcccttcccacacccaccggccccccgctccgaccccgccannnnnnnnnncgtctgcttgtcgttgtcatacgtgtctgcacaagggggccggggctcgaggtggcaaaccccccacgatgcagctcggccctgacgcacgggatcgcatgtcaagcatgaccacacacgttgcccagtccaacatcaccgctgcccttctcagacccaccggccccccgctccgaccccgccaggtcgatgaaggtgagcttgcccaccaccggcctcttgggctcgttcccgttccgcagcgcaaacaccatgatggagtgggatctgacgagggcatgagggtggatggtggatagggaaggggtgaggcgacccaatggtcggagcttgcacgcggcacgccctggcagacacccacatgaaagcccagagcggctgcctaatcactatcgcgccccttacctcgatgactcatcgttggcccccgtgctgcctgtcgagcgggaggcggcggcgtgctccacgagctgctgcagcacatccacgtcgtgcacatccacctcgcgcagcccaacgacctggatagaaagggtgactggaggaggtgtggcggggcatcggggaggcctcaactttaaatccctggggcccacgcatgaccaacatgggttccttggcnnnnnnnnnnaatagaaagggtgactggaggaggtggggcggggcatcgggcaggcctcaactttgaatccctgggacccacgcatgaccaacatgggttccttggcatcgacagtggtccagggttgagactccatcacaaccgcgatggagcaagtcccccatgacctgtcccactctcgtggctctggcctgaacttctgccccctgaacatcacaaaagcgctgcccttgcgaccgactgacctgcacccgacgcttgccgtcctcccgcacttccagcttgnnnnnnnnnncacttctgctccctgaacatcacaaaagcactgcccttgcgaccgactgacctgcacccggcgcttgccgtcctcccgcacttccagcttgttccgcgcgttcagcaggtcaaacagcttcccgccatagatctcatagcagctaacgtgcagccccaccccgtgaaagtcgggggtgctcagcaccgacagcacgtccacggcggcccggagggggagcggctgcatggtgtacgttttcccactccctgtctggccgtatgcaaagcaggttgccttccctcgtctgtttgggggaggcgtcgatggctgagcattgtaagctactggctgggaagaagaggatcgacagccatacagtgggcacgtccttgcacagcaggatgtgccacaaggtgggcccgacgccatggtcccaaccaactcgcatgcccccccggggatgtgtgcaaaagaaactgcaccgcaccggaagatggtggagatgaggggctggatggcggtgcagtagagggcatcgttgtccacatcctccccaaacacatcgtcgaatctggttcatgttgatgtgaatttaggtggcagagaatgagtttgagaagggatggaacatggtacagatcaaccattccggtgtagaccagtccagcattgcaattgctgctcatgtcacgnnnnnnnnnngaacacatcatcgaatctagttcatgttgatgtgaatttggatggcagagaattaatttgagaaggggcggaacatggtacagatcaattattccggtgtagaccattccagcattgcaattgctgctcatgtcacgcgagctctcttttctgtcttgcaaacaaagccttctcaaacttttcctacctgaaggtgtgcctttcggtgaacttggtgagatccactttctgcttcggctcgttcacatacagcgtcgagatggcacagtcacactccagcacatcagagtcgccacgctcctcctcctgtgctccggcaggggagcagggaggttgggcaccttgtcactgagactgcaaggacatggaggctcacctagacgcagagggccagaatgaaacctcaggagcacccgtgatccccactcagccctcacgtgcgcctctgctcaccttgcgattgaggggcctcnnnnnnnnnnccgaggctcacccagacgcagagggccagaatgaaagctcagtagcacccgtcatccccactcagccctcacgtgcacctctgctcaccttgcgattgaggggcctcttcctgacaatcactcggatttttggcgggtctggagccatgaagatggggtggcagtccagactgctatgctctgacgcaggcgaagcaagggtaccgtcccctggggctgggctcgtcatgaatccctgactcgagaagccctgcagatctatgtcctgcatacacaagcagatgtagcagggtgaggtatccaaagggattggtgagaggtggagcaccaacaccaccaactgcactatctttgtgggaagctgatagaaacaaaggacacaggtcccgcgatccaacctctgtcaggaagtcggagtcatcggcctccagatctacgagggctgtctcccctagtccagcgccatgcctgctggcatgattaaagatactctaagtccagtgttcgttttcatgctccatccaggttctttgctggcgttattttgtactcaagacacaagccagtccaccactttctgcagacattnnnnnnnnnnattctttgctggcgttattttgtactcaaaggcgcaagccagtccaccactttctgcagacattcacaatatcccaggctaccacatgcacaactcacactgccatcccctgtcacaagccacacgcacctcctgtcatccagtggaggggtggccgattcgctggcgcctatggactggatcagtcggaagagcgcctgcttgtcttgcatatcgtacacaccatatttttcgtagtcctgcacgtccgcacggggtgaaagcggtgatctgagcaatgattacacaccggcgtccaagatcatgaggcatcgagtgctgcccgaatgtgtcgcgaccagatcatccctaccccaccgactccggggtgggtctaagcggttgagtacctggatcaggagacatttgaaccgctggtagctgagttcggcaaagcagggggtcaaatggcccagacctgcgtcatggagtacattcttcaccgacattgtcggcagcgaagccgggagggggctgccagggagccagtacttgaaggggcgccccgacagaccgagtccgagcagcggccagatcctctaatgagtgacgggatgatgcggaactcgggctaaaacaatttcgatacttcactggcaggtcgaagccggcatcatgctggatcacgagtggaggacgagggggaggggagtcccagccgcttgagggcgcgaggtaccaaatcagcacggggcactgcacgcgggtgtgcagacgaccggcatgcttccaggtgcacaaggctcggtgttgaggtctccaaatctctctttgaattgcaaacgtcaggcagcaggagtggcgcacattctgctaggtggtttttgagcagcgtcattcagcatggcggaggtcacggaggtgagataggtccaagcccaagatcagcatgtgtttacgtatttcggaggtttgacgattactcatgtatcaatggcgcattgaaacatgnnnnnnnnnnatacgtattttgggggtttgacgataactcatgtatcaatggcgcattgaaacatggtagtcatctgtaaagtgatccctcccacgtcacccccgtcccatcgcgccagccatacaacactgcaaagcgcgacttcttggtgaagatccaggagtcctctcagaagaaatgggaggaggccaagttgttcgaggtagacgctccgagtgagggtaagcgctcggtagaggacggggtgcatgagtcgccaagcctaagcatgaccgtataccaatgagctcctttcatcctgtgccactccctgcaggtgagacagtggagaagttcttcgggaactttccctacccctacatgaatgggctgctccacctgggccatgccttttctctttccaaggtgtgcctgtgggtgctttgagttgggaaagtgcagaaagtggctgcgcatctggccaggtgtttgacagggtgtctcatccttgaagtaagattaccccaggattgcatacttgccatacaaaaagctgacgacgtgccacctccatacaactgcagttggagttcgcatcagcctaccatcgcttgtcagggaagagggtgctcttcccccaagcctttcacctgaccggcatgccaatcaaggtgagcggaggcaggagtaacagctgttcagcggtcagactggaggagcacagagtggggcatgacaactgccataggcgtgaaggaaaacgccccttccatggtctatagccaagtcttgggcctccatgtcacaggcctgcgccgataagctgaagggcgagnnnnnnnnnnggtaacagctgttcagcggccagactggaggagcacagagtggggcctgagaagtgccataggcgtgaaggaaagcgccccttccatggtctatagccaagtcatgggcctccatgtcgcaggcctgcgccgataagctgaagggcgagattgagagagctcaagcgccagaggaagcaaagcctgtggttgctgtcgttgcgaaggtgcactggaggaaggatgcgtgcaggatgaggcaggaagggtcaagcctgcatgatggattcctgctgagcactgatgcggtcgtaggtagtgggctcgtcacgagtcttgcaaatcgatgcactgtacaacgagatgaagcttgccagtgttgcataaggactctgtctcctgcagatcgtgatgacgatggaaatcagtggtgctctgttgtctaggacccctctcagccccttcaatctgcaggccccaacagagagggatgacccttccaagttcacagggaagaagagcaaggccgctgccaagactgggccaggcaacactcagtgggagatcatgcggatgagcggcatccctgaggaagacatccccaaggtagtcttgggttctagtttgagatcaagagcagggggcgctggcacccaagggaggcgcccattactggaggcctggtgcccgagtgtgcctcgatgcgccaagcaatactcgagtgcacgcagctcaagagtgcataannnnnnnnnnagcgcccatcactggaggcctggtgcccgagtgcgccttaacgcgccaagcaatgctcgagtgcacgcagctcaagagtgcataacctccctccccacactgctgcagtttgcggatgccaagcattggctgcaatacttcccgcccctggctgtgcgggacatcaaggcaatgggttgtggagtcgactggcgccgcaggtatgggtttataccgcggggtggggacggaggtcatttgggaattgcaagtgcagactttgccaaggccccaggcaggacatggagtgtgtgtctgtgactttcacacgcagctggggtacaattcaaagtagcagcccagaatgataaagtggcatggcaagtgctgcgagggatggcctcagactgtgctcaggcgaaatcctcctcaaacccgcgcagttttgtcaccacggacctgaacaagtactacgactccttcnnnnnnnnnncagcagcccagaatgacaaagtgacatggcaggtgctgcgagagatggcctcagactgtgctcatgcgaaatcctccccaaacccgcgcagttttgtcactacggacctgaacaagtactacgactccttcatccagtggcagttctggaccctgtacagcaaggtactgcgagccatgtgtgctctgagatgccggcatccgctccagcatcctgcacctgtccctgcatggcttgaggtgctcctggcctgcctggctgctgcacattccactccattcttagttgcaatgcactatcccctgcttactcctgcttacatcatgcaattgcctcccagcaagggcatatagcaatctcagcatacgcccaactccttgcatccttcacctcagggcaagatcgtgaaggacaagcgctactccgtgtactcgcccaaggacggccagccctgcgccgaccatgaccgcgccacgggcgagggcgtgggtccccaggaatacaccctggtcaagatgaaggtgctggagctgcgtggaaagctggcagctctggaaggtgccttcaatgctgttggtggggagtggagtggggttatgcggtgatgttcaggacaccctgatcagatgcgctctctggagatcnnnnnnnnnntgtggagtgggatgatgcattgatgttcaagagcaccctgatcagatgcgctctctggagatccagtgggaagcagacgttcaggctgttgtcgccatgccttctgagtggttgcttttctggcggtgctcctctcaggaaaacccttgcccgagcctgcctctccccaccctaatcctgctgccccccaccccggctccccactcaccctgccatcaacaggccagggagatgtgttcctgatggcggccacgctgcgcccagagaccatgtatggccagaccaacgcctgggtccggcccagcgaccccaagaaccccgactctgaggtcggcaagtatgccgccttcaggtgaggtgcctggaggagcttggagggcgaggccaggccaggcaaattgttggtgtagctgcatgcatgaaagcaagagaaggcaccgtgcatgctcgatgcccccaaaccctttcacacctcccatgcagggccaagaacggcgagatctttgtcctcaccgcccgcgccgcacgcaacatgtgcttccaggacctcacccccgagaacggtgtcgctgagaagttgctggacctgacgggggaggacctgctgggcttgcccctccgggtgagcgtgttgattggtgtcgaatgtggtgtgagaagtgatgggacatgcagtgttgtgtggcgccctgcgttctcaccccctcaacctcaacccttgcttccctccccatagagcccgcgggcgacgcacgagcggatctacgtgctgcccctcctcaccatcaagatggacaaggtggggtgcgcgcatgggggagtgtggtgatccttccggggatcctgcctgtggacaggcgtcaatcagagtttgggacgtcatggtcgtgtgtgcttgaatggtgtgcagcgctgtgtcttgcactcagagtcccctctgccagggatgnnnnnnnnnnaacccccccctactttctgtcccaccgacccacaccctcctgcccccacctcacagggtaccggggtggtgacnnnnnnnnnnttccccccctactttctgtcccacccacccacaccctcctgtccccacctcacagggtaccggggtggtgacnnnnnnnnnnaagtgtggtgatcgttccggggatcctgcctgtggacaggcgttaatcagagttttgggacgtcatggccgtgtgtgcttgaatgctgtgcagcgctgtgttttgcactcagagtcccctctgccagggatgcaaagttggcgccaagcgcctgcttcggttgtttcgcagcttttcagagatctctttnnnnnnnnnnnnnnnnnnnnnnnnnnnnnnnnnnnnnnnnnnnnnnnnnnnnnnnnnnnnncagcgtgcccagcgactcgcccgacgactatgcagcgctgcaggatctggtgaagaagcccaagctgcgcgagctctactccatcaccgacgagatggtgctgccctaccaggtccgatcctgctggggaaggggtgtttgggagggtgaaagggcatgcgtgggcagcttcctgcaggatgcaggtcccnnnnnnnnnntgaccctgccggggaaggggtgtttaggagggtgaaagggcatgtgtgggcagcttcctgcaggatgcaggtcccacggcacgcgccggcaggtgtagcgttggtagcatcagcgcacaggccctccggtgctatgaccacacacaatccgcatcgctgccgcactcactgcccgcgcctgcaggtcatccccatcatcgatattccgggcctgggtgacctggcggctgtcaagctgtgcactgacctgaaggtccagagccaggtatgcacagaggcaggcttcgtaaggcggggcaggggggtggcggggataatcagccaacttgcagcacggtgccttgtgctctggggggcccctgctcgaatcctatggcctgccctcagatgggaggctcgacaactttacccaaagaggctttgcctgagggcctgaccccccttggctcagccttggcctcatcaggtcccccaactgccccaacactgcgatccccactcacagaacgacacagagaagctagccaaggccaaagcggagtgctaccgccgtggctttgactctggcgtcatgctggtcggcacctacgccggcaaaccggtgtgttgatggtgttgggatggagtgtatgggggtggctcaatgatgagcgcgccaactgctacgagcactgcagtnnnnnnnnnntaactgccccaacactgcaatccccactcacagaatgacacagagaagctggccaaggccaaagcggagtgctaccgccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagttgacgatcccgctaccctaacgcccaatcctgatctttcgtaaacatcgtcacctactgaacgcnnnnnnnnnngtagtcgacgatcccgctatcctgacgcccaatcctgacctttcgtaaacatcgtcacctactgaacgcagacgcctgcttctccatcttctcacaggtgaaggaggccaaggacctagagaaggcagacctgatccgcgccggggacgccgtgccatacgcggagccggagaacccggtgcggtcgcgctccgacgacgactgcgtggtggccctgaccgaccagtggtacatcatctacggcgaggaggagtggcgtgccgccgcgcagtcctgcctggagcagatgcattggtacgacgcctccggcccctcgggggacagcatcagtgagtggcgcaaagggggcaagagggaggttgttgaagagtggagaggttgggggctttatgagatgtgaggggaacccatgaggtgtctcgcacaggtgcagagcacagtcactcctccctggtgacctgggcagcgcaactcagtccctgatattgcgggggccgggtggccctgtgtgctcctcgcccatgcctgtctacctacgttgctgttctcgagcaccttgccaccccccctttggctctccagtcccccacaccccctgcccccaaccctccacctcaccaccccaaaacaacttgcagccaagggccagtttgagcacaccctgggctggctgaaccagtgggcctgctctcgctcttttggcctgggcacgctgctcccctgggacccagagtacctcatcgagnnnnnnnnnnccgctcctttggcctgggcacactactcccctgggacccagagtacctcatcgagtccctctccgactccaccatctacatggcctactacaccgtggcgcacctccttcacgagggcgacatgtatgctgtgaggtcgggacccgtggatgtcagggacctgaccaacgaggtgtggaactacatattcctgggcggggagctgccgcgggacacgcccatcccccgggacctgctggctcgggcacgccgtgagttcgagttctggtacccctttgacctccgcgtctccggcaaggacctcatccaggtcagcgtgtactctattctgggagggattgtggggggagttggagggggggcctggcaacactgaggggggtgggctgacatgtgcaggctatgcagccagggctgtgatgaggcagacaatcgctgaaagaaattggcgtgcccctcctctctgcaattcatgcgtctcactccatccggcccctgccttcctcatcccacacagacccctcccccacacacgcccaactccccctgccaccccctctctcctgcacagaaccacctgacctttgcgctgtacacgcacgtcgcgctgtggggccccgacaagtggccccgttccttccgctgcaacggccacctgcagctgaacaacgccaagatgagcaagtccacgggcaacttcaagaccatggagcaggccatcctggagtacggcgccgacgccatgcgcatcggcctcgccaacgccggcgacaccatggacgacgccaacttcgagcacgacaccgccaaccaggccatcctcaagctctaccgccaggtggagtgggcaggtgaggtgccctgagtggtgggtgtgtgtgttttggagattgcttttgggggcagagggtggctggaaagaggggccaatgtgtcatgtggggaggggtaccagtttactacacggagtggcgggatcgccctgcgagaggggcatcgcgagaaaaggtccgttctccagtgcacatcagagaggccaggaggtcgtgcggcgccaaggtgaaagccaaacccatttccccccccaccccccacctctgtacacactcacaaagcagaggaggtgctggcggcgacgcagggcatgcgcgacgggccgcccgccaccttctgggaccgggtttttgagaacgagatcaacgccgccgtgcaccgcaccaaggccgcctacgacgacatgaacttcagggacgtcgtgctcgcaggctggtgagctgtcagcggggggctggaagcggggcgggttacttttcaccatggcccagttgtgctgcaagcccccggacaccccagtgcaaggtgtgcctgcaatctttcttgctcttgcgttcttacttagaacccggttcccacctgcctccctcccccccacttctcccccccaggtatgccctgtccaatgccagggatgcgtatctggtggcctgcgccgtggagggcctcaaccgcgagctgatcctgcgcttcgtggaggtggccgcgctgttggtcgcgcccatcgcaccccacaccagcgagtacatctggggcgacgtgctgaagcgcgaggggctgatcctgaccgccggctggccggcggcgccccagcccgactttgtgctgcaggaggcgtaccggtgaggggcagtgcctcggtttgagatcctcccgccgcctgcgggggtgggcgggaggggcgctgttgtggcactgccctgctgcccatccggcgcccacctcccaccgtgctgtggcgccacctgaacactgccaggtgccccacctgatctaccacccacccacccacccctgcaggtacgtggagaagatgaagaaacccatcaaggacggattcgagaaggccgccgggggcagcgccgggaagaaggggcagccggcggtgcccgccagccccgtggcccacgcccacatccatgtggtcgaccgctttggcggctggaaggccagggccctgcaggtgctggcgggcctgtacgacgcctccctccctgactgcttccccgccaagcccaacgagacggtgctgagcgcggtggccagtgagcccgagctgacggccctgccgcccaagcagctgcgccccacagtcttcccctttgtggcgtacaagacgaagcaggccaaggaggggggcaaggaggtcctctccgtcaagctgccctttgacgaggcgcaggtcctggaggccagcaccggctacatcctcaggtgcggcgcgggctgcgcttgatctgggtgtgcttgcgtgtgtatgtgagatgggggttgggcagcggggatgaaaggggggagacgggactggctgtgcggcgtcaggcctacgccacgctgaaggccaaagcactgctcgcccagcacgtcttcgagaaagcgaccaatcttgcggcaccctcggcgccggctagcgctgccgctgcctgctgccgtagtcgtgccaaaacccttactcctgccttccctcttccgcacagggccctgcaagagctcaagggcctgcagtccatcaccatccacaagctggccttcgacgagctggccactgcgggcgacgagcgcgtccgtgccgctcttccgggcgagcctgtcatcgtgtttacatcgtaggcggggtggcacaacgtcagagctatcggcggggagcggagatgcttttgtgtcgctagctgtaacggccgcaggccttctgactttgaccctccaccgctacctcctgggtttccttgcggctgcacagctgggaattatgcaaggtgaaatatgcacaagtgaggggaactggatacagagctaggggtgggcaggcacccaaaccatggtgatgggcaaacttgtggcggtcatcttgtcagccgctcttgaacaggaggatggcctggggtccaaggtagaagtagataaagtgcttggattcatgagttacataagatcctgcggaagagtgtccgaagggggggtgattgtgaggcgtccccatgaccaaggtcctgaaccgaggtgtccccatacaccgtcacagctggcgacctgttatgtacaaaacttaccgaaattccggcccactatgcagtgccaggtgggcccatacttgctgtcgaaatcctttttaatgtaggccgccatatctttctcgatcgtaaacttttcgaccgcctgcgaacgcagacaggtcggtgtgctcggagggtgcttgggcgatcttgactgtggtgtggaccgcagattccaaggtagcaatttgcattgatcacgataggaagtttccatcactcactgcttgcgaggaggagacggcgtgatcctgcatctcctgtgacatgtcgcatgatttaatgaggggtttctgcagcacgtccgccatgctctcgctcctcctcacttatactgcagcggtttcgagattaagcgctggattaaacgtatcgcatcgagatgcctggatcacaatgagggagtataccacatagatcactttgagcggtttttgcaccggtcaaaagactgctgaagaaagccaggataatttcctgagatgccaggctcgaggtgcttaagactgtattgtcgacagaccatcgtgagcaagtttgtcatcacaaaacgttcaccagatcagcataagaacgcgagtgaaagctgactcctgcaaacgcctagcgctttggannnnnnnnnnatcgacagaccatcgtgagcaggtttgtcatcacaaaacgtttaccagatcagcataagaacgcgagtgaaacctgactcctgcaaacgcctagcgctttggagtgtcgggccatcatacccgaagacaccctctggactctcacaagttgcatatacgagcatgcctcggtattactgtgactactgcgatgcatacctcacccacgactcggtgtgtgcgtggtggtcggcatccagaatatccggtgtgacgctgtgtttgcttgggcaagggccctccaccgcccccccacgaatgtccctttgcagccggttgtgcgcaagcagcacaacagcggatacaagcacaaggccaacgtcaagtcttactttactcagtttgaggagaccatgcagcagcggcagctagaggcacaaattcgtgcgcgcatggtaggaggtttggggtgtgtgttggcagtgcatgcctgagaagactcatcgaggccacacgagcatgccgcgatcagcgctgtagatctcccccgatcgtgttgtcagagtacatccccgctaacctgcagctgggactaccggcaccgcctgctggcctctccaagcctccttccttgcccaggccaggaggtccccccgtcctagcgccaccccggccaggtttgttctatggagatgctggcagccatggattgaatcgacatccatagcatccacaccttgacagtgttcctttttcttcctgtgcgtagagtgcttttatctctttttgctccatcctgcaggtggcccccccgtgctgccacccccccagctggcccagcccggacttgcaccgccccaggtgccgccgcctcttggtgtaccacccccacaaggtgtgctgcgtgggagtctactcgtgctgatcccgatctagtcatggttctttcttccagggctggggttgggagggaggtgggcatgcctgtgcagtnnnnnnnnnncaccacccccacaaggtgtgctacgtgggagtttactcatgctgattccgatctagtcatgtttctttcttccagggttgggcttgggagggaggtgggcatgcctgtgcagttgttgttaattcccaagggagaccagtgcccattgctattccttgctgaaggtgccacctctccctgcatacaggcttggccccgccaacattagcagcatccccacctgcggtggcagctcaacctccaggtgagagtcttgagaagccttgctttggcggggtggaagtgcaagttgtgtcccatccctagccgtaccatgcccccttgtgcctcaccctgcttaggtctttctgcccctcaagccgtccattgatgagcctgacatatgccgccatgccgccaggttagagccagggattactgtctttcacagctacctgacttgctaaccccctcgatactcaatggccagaactgtcgctgcaccgcccggatgagtgtgcggtgtgagcacccgggaggagcatactacctcttaactccctgacatcctgtaacaccaatctcaagcgtacgccattggtcgtcagagcttgagggcaccttgaatgtgcacaacactccactgccctgggcctggtgagaatgtttatgagctcctgctgcccatgaaaacacggcaccgttcaaaccagactctcgcacatggcgagcaagccgggcattacaacatccagccggcaggcaaaaaattagcaagctggaaagaatttgatcctcggattgtctcgtctcggcatgggtggcaaaggtagaccaaaggcatggcagagcagcaggaaggacgtctgcctactggggggcaagggtcacaaacaggggggaagcacaggtaggcagggcggcacgcccctgcctaccaggctgccagcactcccaaggaacgaggtggctcgcgggccgacgcccctcctcctgccccacccccccggggtcaggccgtcaccagccccctgggcgctacacactcccccccagcctttgcgcgcccgcctcagtaggtgtaccccttctcgtacatgcccttggccgcctcctcggactcgttggcagggtcatactgacccctctgcgcggtggagttggcggcggcgcgcttgatcagcgccttctgcgcggcctcgaagttggcctcctcccccttccaggtgcgcagcacggagttctgcagcgcgcgcgcgtaggagaagctgacatgccaggggttgggcgactggttcatggcgttcaggttgagcgtggcctccagctcggactggccgccagagaggaacatgatgcccgggacggcggggggcaccctgcggcgcagcaggcgcagcgtgtagtcggccaccacctcgggcgcggcggggttgccggagtcggcgcccggggtcaccatggagggcttgagcaagattccctcgaacagcacgttgttgtccgccaggtacttgaaggtttccgcccacacagcgctggccacctccaacgtgcggtcgatgtcgtgctcgccgtccagcaggatctcgggctccacaatgggcaccaggcccgcgctctgcgccagcgcggcgtaccgcgccaggccgtaggcgcagtcgcgcaccgccaggggggtggggccggaggggatggacaccacgctacgccacttggcgaagcgcgcgcctgcgcggtagtactccccgcaccgcacgtccaggccgtccaggcctgcgcacctgcagggtttgagtatttgaggagtgggagtgggtgtcggaggaggggcgcatgggaggcggccttggaaggagcagaggagggcacaggaggatgtgagccgcaatcgagtgggtgtctggggagctgggtcccgacccagacgggcaggatggaacagccggcagccacccagctgcnnnnnnnnnnggaggagggcacaggaggatgtgagcagcaatcgagtgggtgtttggggagccggggtcccgacccagaccggctggatggaacagccggcagccacccagctgctcaccagctctcggagttggagccggggagggggtgcagccccttgtcgaccttgatgccggggacgatgccctgcttcttcaactcctcggtcatcttggtgcccttacgggtgtcctggaacagagtctcctcaaacatgatggcgcctgagggggtggggtggcagcgggttcaggagcacatccacgcccctaaaccctgatcctcctttcctcgcctgttaaatgctaccccatgagcagacccaggccagggcagcggcatgaaacagaaccgtttcaacctcatcaactccacatcttgacacccgtcccgtcccgtccccccccacacacgctgcctgggaccataccacccacctgannnnnnnnnnaatcctcctttcctcgcctgtcaaatcctacctcatgagcagacccaggctagggcagcggcatgaaacagaaccatttcaacctcatcaaccccacatcttgacacccgtcccgtcccctcccccccccccatacgctgcctgggaccataccacccacctgagatgtactcgcccaggcccggggtggtcaccaggagctcgcggtaggtctgcctgttctccaccgtgttctccaggccgatgccctccagcctcttgccgcaggtggcgttagactcgtccatggccaggatgcccttgccaggagaggcgatggttttctgcaggagaggcaggggggtggggggnnnnnnnnnnnnnnnnnnnnnnnnnnnnnnnnnnnnnnnnnacctccaaatcctcacaccggggcgcagtcggagctccgaggagctcggtggcgaagcatgcgggcatgcgtggcgcccggggcccccatgctgggcccaatgatggtgtgggggcccccgagtccgccgcgatggcagcagcgcgaaaccctgttatccacatcgatatctcgcagggagcgcccataatcctgcctgcccaagcccatgctttgctaagaactcaccgccgtctgcatgagctcatcgtcgtacttgcctgcccgcacggcaagcgccgaccgacgctgggcacggtggggtcgcccggccacgaaggccgggaagactgccgccttgctgcagaggagctgcgacatcaggcttcgatgccgattttaggacaagatcaggggcgtatgcgtggttcaatggctccccagggccggatgggcgatgtatgcaccctccggaacgcatgaacacacttagccacatcccggggtcgactagggcacccgggtggatgcaccggcgcgctagagcaggacctcctgctccccattccctgcgaaacgtgatcgccactcgggtccacgtatgtcagggtcctccgcgccaggagctgggaggccagggcagccctcggcccaggccaggccccttgttcgctcgactcgtccagtctggtcgtcacgtgctcatgaagcacaccacctcgtaaggtaccctcgcgaggcagggtgtaaccccttccaaggatcccagcgagcctgcctactgaatattacaaaaatagtcaggactgtgtcccgctgatcaggggccctgcatgcaatgaggggcagggcagcaactctgggcgagcaggtgtggtggagcagatggggagctgccaacgaaagaatcaagggaatctggtgcaaggttgggcctggcgtaccccccgggcctcgacgccgtcaggggcaggaggggtgaccgccgcgcaaaggcttgagagaagtaaagagggagtgggaggccatgtcgtgcggccccgtcgtcctcgccacgcaggcggcgcgcctgcgcgcgatcagcgctggggctgctcgccgcccccgagggcgggcgcgtcgccgccagaccccgccgccgccggctgccgcccaggcgcgtcttccccccggcccccctgcgccacccagggcgcctgggccaggaccagggccgagggcagggtggccagcttgcgccacttgggcacgtaggcgcggcgcgtgaagttgtcatacccattggcctcgatggcgtccaggatctggcggtacaggatgagcgcgctccacaccggccagcgcgcgtcgcgcgacagctggcggatgccgacctccgcctcggagaagacggcgcgcgtgcgctcgatctggaagcgcatgaaggccgcccagcgcgggtccacctggccgggcgcgcgcgccagcgtgccctccagcacctccccggggctgatgccaaagcgtgccagctcgtccagtggcagggacacccggctgcgctgctgtgcgtcctcgcccacgtccctgtgcggagttggtggaaagggccttgagggtttgacatgagctttggggtccccgtagggatgcggcagcaggtgagggggaggcagattccacggtgactcccatgcgcggcgcgtcgattggcaggtgcctggctgagggccatgctgtctcagttcccgtaccgtgccgtccctggctctgcctcgcaaaannnnnnnnnncgccaggctgagggccgtgctgtctcagttcccgttccgtgccgtccctggctctgcctcgcaaaatccaaagacgaaaaccccgtcacaacacccctgatgggtccccaccatccaaaccaccccccttcctttctctacctgaggatgttggtgagctggttggcggtgcccaggctcagcgcggcgcggtacactgggtccaggggtcccttgtactgcgtgtcgatgcccatgacgggcgcggacatgaggcccaccgttcctgccacacggtagcagtagtcgtacagctcgtcgtaggtctcgtaccgcgacttctccaggtccatgcgcatgccgccgatcatgtccctggaggcgcaaagtgatttttggggagggatgaggtttggtgagatgagagccgaataggttcagaaagctcttctccagcacccttggcatcactgccggcaatgcttcacgacgaggagcccctgcctccttggacaactacgcctatttaaacccccccccc

SEQ ID NO: 46690 - DNA, 61 bp, Chlorella protothecoides
actccttctggatgttgtagtcggacagggggcggccgtcctcgagctgcttgccggcgaa

SEQ ID NO: 46691 - DNA, 62 bp, Chlorella protothecoides
ctcctcgaaaagaacacccaccagatcctcacctcctgctccttctcgaagaggggcttgca

SEQ ID NO: 46692 - DNA, 61 bp, Chlorella protothecoides
cccggccttgcccctcctgctgagcgcgctaggcggcggggtggagggccaggtcctggct

SEQ ID NO: 46693 - DNA, 71 bp, Chlorella protothecoides
caccccgtccaggaagggggagtcggccgcggcgcgcactgcatctgtggccaggtgcatcagcgcctgcg

SEQ ID NO: 46694 - DNA, 61 bp, Chlorella protothecoides
cgcagagccctttcgaccgtccactcacccacccccgccccattgcccgtgcagtggatca

SEQ ID NO: 46695 - DNA, 100 bp, Chlorella protothecoides
gtccctggacgggcggctggacgggaccatcgagcgtgggtccatgcgagggtggggccggcacaccctggccgcccacacccacatccccatcagggcg

SEQ ID NO: 46696 - DNA, 70 bp, Chlorella protothecoides
tctaatacgaagggagcttgacggcagtattggggcggtaggggacagtgtgcggggaggtgggccagat

SEQ ID NO: 46697 - DNA, 12113 bp, Chlorella protothecoides
  modified_base (124)..(133): a, c, t, g, unknown or other
  modified_base (305)..(314): a, c, t, g, unknown or other
  modified_base (492)..(602): a, c, t, g, unknown or other
  modified_base (1902)..(1911): a, c, t, g, unknown or other
  modified_base (2600)..(2609): a, c, t, g, unknown or other
  modified_base (3183)..(3192): a, c, t, g, unknown or other
  modified_base (3501)..(3554): a, c, t, g, unknown or other
  modified_base (3805)..(3814): a, c, t, g, unknown or other
  modified_base (4248)..(4257): a, c, t, g, unknown or other
  modified_base (5277)..(5296): a, c, t, g, unknown or other
  modified_base (5484)..(5493): a, c, t, g, unknown or other
  modified_base (6443)..(6452): a, c, t, g, unknown or other
  modified_base (6996)..(7005): a, c, t, g, unknown or other
  modified_base (8913)..(8922): a, c, t, g, unknown or other
  modified_base (9330)..(9339): a, c, t, g, unknown or other
  modified_base (10034)..(10043): a, c, t, g, unknown or other
  modified_base (11352)..(11395): a, c, t, g, unknown or other
  modified_base (11552)..(11561): a, c, t, g, unknown or other
  modified_base (11618)..(11627): a, c, t, g, unknown or other
  modified_base (11684)..(11788): a, c, t, g, unknown or other
gagctgtgcctgcgccgggggtctatcggttggtccagtgatgttacctgccgctttccggtttcccccaactaccacccactctctacactcgtgcaacgttcaagttcggggtcacagtctnnnnnnnnnnatgtggggtgggaaggtgcaaaggaggggcaaaggaggggctccaccgacaagccgcgccgccgagcgctgcggctgcacatttttgccggccatccggcgacaggcgccgcgcagctctccaccctcgcgacaaaagcccccgtcgtactcgaccatcctaagccttggtnnnnnnnnnncggtccagtgatcttaccctgccgcttcccggttccccccaactaccacccactttctacacttgtgcaacgttcaagttcggggtcacagtctctgcagtacactccaggggcgagacggtcactgactggcaggcgcttgcaatacggggggaaaggaagaggttcagggtggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttggcgagcagtgcctcgcgcaggatgccggccgcctccttcagctgctcctcggagatgacgagcgggggggcgaggcggatgatgttgccgtgcgtgggcttggtgaggaagccgcggcgcgccaggtccaggcacagctcccaggcggagcagcccttgctctcgtcgatgacgatggcgttgagcaggcccttgccgcgcaccgactccagcagcggggtgtcgatggcgcgcagctgggcgcggaaggactcgcccagacgcgccgaggcctctgccaggccctcgtccaccagcacgcggagcgaggcgacggccaccttggcggccagggggttgccgccaaaggtggagccgtgctgccctcgcccgatgctcagcatcacctcgtcgtccgccaggacggcggagatgggcatggtcccgcccgacagcgccttgcccaggatgagcatgtcggggcggacgtcgtcgtgctggtaggccatcatcttgcccgtgcggcacagccccgtctggacctcgtccgcgatcagcagggcgcggtgcttctgcagcagggccttggccttggccaggtagccggggtcggggacaaccacgccggcctcgccctgcacgcgggtgtgagaggtggaatggctgagtgggggctggggatggtgctgtgggaggggagcatgaacccttcgcagccagcgccagctcgcctaccgagctgaaaaccagggatgggtggcctggcgggggaggcgcacctcctgcctcccactcgccgcacctttggcatccccatgcccctgcgcctttgaggatcgcgtcgcccacaatgcatcccctgttccccctgtccaccccctgcaccacccacacctggatgggctccaccatgaaggccacgatgttggggtcagcctccagcgcagcctccagggcacccaggtcgttgtaggggatgatctcaaagccaggcatgtaggggccgaagccctcgtagctctccgggtcggtggaggaggagatggcagtggtggtgcggccccagaagttctcgcgcgcaaacaggatcttggcctggttcttgggcacgcccttcacgctgtacccccagcgcctgcgcagtgagcatgtggggggcatgctggcgggtcgggggtgtcaagcgagcctgagagcccaggcggcatgtgcggatcctctcctcctcacacgcacacaccatgcattccctcccctggcatacacagccacatcatccttgcggaccccacctggccagcttgacggcggtttcgnnnnnnnnnnacacacacaccatgcacaccccccctggcatacacagccacaccatcctcgcaacccccacctggccagcttgacggcggtttcgccgccctccacccccgtgttcatgggcaggaccttgtcatagcccagcaggccggtgatgtactcctcgtactcgcccaggcagtcattgaagaaggcgcgggaggtgagcgtcagcttctgggcctggtcgatcagggcacggatgatcttggggtggcagtgcccctggttcaccgccgagtagcctgccaggaagtcgtagtagcgcttgccctccacgtcccacatgaaaacgccctcgccgcgggtctgcaccacggggatggggtggtagttgtgggcgccgtgcttgttctccaggtcgatgatctggggagggaaggcgggggatgggtgggctgaatacagggtgggggctatttcaacgtgcaggcatggatcgcacgctgtgaatcaagcagtggacggcaggaggggtcgagtcccagcggtggggcgtgcaggactttggcaccgactggtgcgggccgcgggggggatggcatcccacatgaaccgctcccgacatccaaaataattcccattcatccagatgggtccatgcggacgtgggatggacccgaacacaagcgtcgcacgcactttttgctgggcgggggtcnnnnnnnnnnaatgaacccctctcgacatccaaaataattccattcatcaagatggggccatgcggacgtgggatggacccgaacgcaacggtcgcacgcactttttgctgggcgggggtcggggcggggtccagatcatgggacgacccggccattccgcggaacgcgccgacagaagccgctgcattggcctggccggcgcgtccaagacgggaggcgaggcgggaggcggtggaggtcagcatgttggtgagggggagcggggtgagacctaaggttcacaagccgaaatagtttagaaagataggcgggcagatcaagctctccgctcgctaaactattgtttgttgagtataaagatagcgtcggtggggtgtagggacgggtaacggtctaaaatggaatgggatcgcccgcagacatccattcaagggcaccgggaaaccatccgaaacccacgcggaccgaattgcagtatccaggtaccacaggaagccccggaacgcccattgcagggaaaagactcctaccacccagcggcctgcaagggaacccctagcagtgaaaaatccttcgagttgannnnnnnnnntgaagccccggaacgcccattgcagggacatgactcctaccatccagcggcccgcaagggagcccctagcagtgaaaaatccttcgagttgactgaaggaatcggtgatacctagtttgtattctttccagggggacacttcgagagaaggcaccactgtgcgtcatcccgccagggaactggttggcatggcctgcatgcggcattgaaggtccttagagcgacagcatcccgatggtatgtaatgcctgtgtcgatgtgtcacagttcctgcttcgagagggcgcccgcaaagccctcatcttgcannnnnnnnnnnnnnnnnnnnnnnnnnnnnnnnnnnnnnnnnnnnnnnnnnnnnncacgaccctgggcgacctcaagctggagctggcctgcggcgactgcccccgcacctgcgaaaacttcctggccctggcagccagcggctactacgatggcaccctgttccacaggaacatccgcgggttcatgatacagggcggcgacccctccggcacagggaaggggggcaagagcatcttcgccacggctaccggcaagttcccggatgagctggtggacagcctgaaacactccaagcgcggcgtgnnnnnnnnnntggcgacccctccggcacaggaaaggggggcaagagcatcttcgccacggccaccggcaagttcccggatgagctggttgacagcctgaaacactccaagcgcggcgtggtgtccatggccaactccggccccaacaccaacggatcccagttcttcataacctacaaggcgcacgcccacttgaacggtgcggcaagctggaggctgacggttgcggggacggaaagggatagaggctgctatgaagagtgacagctactggtcgcggggactgcattgtctactgggcaccggggatccgaccatgccaccttgtgcagcgccaatcccctccttcctgaaatgctcgtgcccaggcatggcctcacgccctccctgatgcactccccgcaatatgcaggaaagtacaccgtgtttgggcaggtcatcgatnnnnnnnnnnccactcctcgtaatatgcagggaagtacaccgtgtttgggcaggtcatcgatggcatggacaccctggatcgcatggagaaagtgccggtgggggctgcagaccggcctgtgaccgagatccggctcaaaggcataacgatacatgccaatcccattgcgggctgaccagatcgcgctccctgacatttcccttcaaatcgtatcgatgaattgtgtaaaaccctctagaaactgcggcgcgaggccctgccagcccgtgggtccactgggctctccggcccatgcatttgaatcattgaatccgcgcgggacggcccctgcctacttaaaacttgaacggggacatgcacgacacaagaccggatgatccgctgggcttccctgtcccttgctcgtccactgaatcagcacgtaagtctttgttcgagggcagagggttcggtaggggcctgcgcacgtcctcgccacctcggacgccgcgacggccacgcaggcagccatgttgtagtcgcgggggcgagcgcaggcgaaaggatcgattgtaatactgttcacaaccaggtctggcgtaattacgaggtcaggagactgccgacagacatggccggtgagtatgtggcatgaccgagattttctaggtgcatggtcccgagcggccggatagaggccctgcgcgtccctgctcactgccccccagcaccccaccgcccaggccacgatctgcgtccatcgacaggcgggcagatggagcttctaaacatggcggacgatgggctggcccagtcctccctgccggtgttccacccattggaggcacgcgctcccccgctacgggggacctccatctcccgcatggaggaactgcaacagtacctacgccagtgcgacgatcgccagtgtttcaagatgtatttcaaggcaagttggggacgttctaattggctgtgccaaggtgacccggtggacggcttcacctgtcggtggagtgtccagcacccctgagcgctcccttctccccnnnnnnnnnnnnnnnnnnnngtgctcatggaggagatagcgcagcaacttcgaagaaggtgtgcctggcttgctttcgaggagcagcgagagtacaaggtgggtgcctggtggcagcttgagggtggtggggaaggaggagtctatgccgcaccttgtgctcttgtcgtcgccattcagcagaggtctccggtctgctttccagggcnnnnnnnnnntctggcggcagcttgagggtggtggggaaggaggggtctatgccgcaccttgtgctcttgttgtcgtcatttagcagaggtctccggtctgctttccagggcatgtgtgggtgcagagacattgcctcgtcctccagaacgatctgtgcaacgtccatccgttgtttgtgcaacagcagcaaaagggatcaaccgtaggccaaaccccagctcagccaggacccaccccagcgcccacttgcaatacacatcgcagcgtgccaaggccctcaacatcatgggccgccccgggtcggtgccgcccgcctcgccgggagtggggacgcgcgacggcgcagacgctttctgcctgggcgtcctgcaagacaacacctcccccggcatctttgagacgggtcccacggcagtggcagagccgggtttgcccacagcaggcggccggttgcgagacgacgacaattttgatgaggaaggtacgacccaaatgtcaccaggagggtgcagcatgcagtggaacaatcatctcatggtaaactgggattgccctgcattggtctgttgagggtgtcttgcgtgcacccaacctcctcctcatcacccaacaggcccagcctctcctcgggaagaaggaccgagagaaccggccatgactgcccaccagctgcagagcatgaccccgctgtcgcacgccgcgctctccttcctccccctcagcgcgtcgccagcgctgtccctgtttggcttgctgggctcgccgctgtcatcgccgcagcgccctaaacctgaccacaatgccactgacttgacgttataaataggaacaaggacccacacagccgcctcggaacctcttcaagttcaggcagaccgcgaggcacgaggtagtggggtgtctcatctccaggatgtgcatgcgcacgcaggctgtcccggtctgtcagtgctccgtnnnnnnnnnnaaaccttttcaacttcaggcagaccgcgagtcatgaggtagtggggtgtcatctccaggatgtgcatgcgcaagcaggctgtcccggtctgtcagtgctccgttcgaaagcgcatgctggccctcagcacccgcagcacgggccgaatcggcgcggttcccgagcactaaagcccacgcagggacgatcatggtcactgcagatttccccacaccccaggagctcgccgccatgaaggtcccccaggggatcgagcagtccctggtggcagcggcggacctcttcaactccccacccctcctcctcctcctcgtcgggcactgcttggcctgcgccaacttcgtgcgaggaaaatatggagaccggtggctgatcaacaacctggcaggcttcgccatcgctttcgggggaggctccatgtcggccctccttctccaggcacgcggggcttgttgtcggggccgaggcccagctgtcctgggaaggctgttttttcatccgccgcgctatattccaatcccactcgacgaccccgtgccacagnnnnnnnnnnctttcatccaccgcgctgaatcccaatcccactcgacgaccccgtgccacaggatcctggccgtgtgccgatcgccgtcttctccggcgacgtcctcctgctgatttgggggctcagctggtgggcgctgagctactcccctttcaatgtcgtcggcaggctgatggacctccgccccgttaccaccctggccaacgtgcgtcgacttcaggagtggaaatacttcgaatgggagggtgcacagagatgcaacatggccctgctgcatgctgtaccaaatgttgcccttgctgaggcacccatgtcgatgcagcaaagtcgacgagggctcctctacccttacctacacgatcgctcgacttgaccagacctactctccaacctctacatgtcaccttccaggtcgcgctttccatcctgcgtgctggaatcatcgcgcagcgtgtagactacatggtggcgacatacccagggcacaacatcgccgcgatcgtcatcgccatcatcgcctcctgcgggggcggcatgatcgtggacgcgctggatatcggcgctgggtactccaaaggtgggggctggtcgctttgcgagccgggagtctggagcgtgcgactttggcatgctggggcagatgcacagcccatagctttgctgcggctcacttgtctggatataggagaggtatatactgaagtgggcctccacttgccagacctcctggcccagtaacgatactagaccccactcccagcactccttcccgctcctaaaggccctgctgagctggcgacgcctggattcgtgctgcgctccggcgccttcctggccatcttccacctcgccagcgtgcacctcctggggctgctcagctcccgcgcctcgttgggcgtcatcaccaccctgtttgtcgcacacacgctggcctctgccatcctgcaggcccccctggactacacccggcccctgggcatcctgctccacaaggtcggtggcaggcatggtggagtgggtgcacagaggatgtcgcagtggacacatactcaggtggtggtgggagagggtcctcgtgcaaagtcttccctgctccgctgtttgctttttaaaccctcccctccttgcatctatgaaaaggtgaccaatatccctgtgccggtcgggggaaagaccaaggccccgccgagcaagccggtgacgcggagccaggcagcgctgagcaaggaggtggacgggcaccaggagcagtacccatccacgccctcgtcgagcaagcagacaccgcggcgtaggaccaccgccgggaagcgggagtgagcgtggcgctgcaggggcggccaggcagcgggcccaggcaggagggcagcagcgcagtggcgcaggaggccctgtccagccacacatgcatctcaaggcgcgcatgtttttttgagcgagcgagctgacgaacaccccctggtattgttttgtgtgagtggcatgaccccataggtctctgatgatttccactctcgcgccttgaataagagatctcggcgacgtcaacctaatgcatgtcggagactcaaaccgaggttccaccaactcgacgggccacaagcaactcaacaacgctgggacttttctcggtacagggggacaggatgtaatgagctgatcaccgagcacctcgacctgggacgccgggatgtcggtcttcggagatgcctcgcacagcagctggcgcaccctgatcgcctttggcctactgggtctcttcaacaacataagtgcgatgagatggatatgaaatttgggtgctctccgcacccatgcctcgccctggcgtggcagacaccttggccttcacacctctgcatcactaatcctgcccaggctacgtgatcatgctggccggcgccaacagcatctcgnnnnnnnnnnacatcactccttctgcccaggctacgtaatcatgctggccggcgccaacagcatctcggccgctgccgtaggcctcgtgtacctggctgccgtgggcccggccatcatcgtcaaggcctcaggcccctactggtttcatgtggtggggtatcctccccgcatggccgccgccgcggccctcatgtcaggctccttctgcctggttgccctcagcgcctcccgccccctccagctcctgggagtggcactggcctccttccaggtacgtctcattgaggcaggggagcctgagcgaggttgaagggagtgtggtatgagttgccagggttggcctgcgtttcgtcatgcttggctacccagacccatctgccacccaagcgtttggagcgggggcagtttcctcgatannnnnnnnnncggccgcccagacccatctgccacccaggcgtttggagcgggggcagtttcctcgatatccaacccgacccattccctcgcgcccctgccctccatccaggggggcctgggggaggcctcgtgcctcgccctcagcgcacgctacggctccgaccgcggccccatcacgctgtggagcagcggcaccggtttcgccggggtggcggggtacgcctgggtggcggcgctgcatgtctgggcgggcctcagcttcaggaccaccctcctggccggcaatgtgctggccggcgcctggctggccaccttcttcctgctcctgcggcccccgcccccgcggccagtgcccctgcctacttcagacggcgaggaggacgacgacacggcggccagcgccggcccggcgccgatcgaccccgagagggtgcccctccggcccgcggcagcagtcgggctgctgccgcgctccggcagccgctcggcgctggccgtggaggccggcggcagccatgcagcaacggggcggggcgccggcgccggcccaggcaagccaaagccaggtggacgcacagcagcggcgctgagcatccaggagaggcggccggcgggggcgggcaggggcggcgagaccggccccggcgccgcggcgagtctcccgccctctgctctggggcccttgggccggctgtgcttgaccnnnnnnnnnnggggggcgggcaggggcggcgagaccggcctcggcgccgcggcgagcctcccgccctctgccctggggcccttgggccggctgtgcttgaccctggggctctggcccttcacggtgcccctcttcaccgtctacctggccgagtactccatgcagagcggtgcctggaccgccatcggtgggccggttgtatcagaggggtatggaacagtctcctggtgctcttcgtcagtctgagtgtctgttgccggagggtgcagggggcctggaccctgtttgcagggcgcatgcctgtggaaggcttggcatcgcctgccctgcgggtctcgcgtccagaggctgagatcaggaccccctgtaccacccactcaccgcccctgctaccaacaatcaggtttccctgtgacggacgctgcggcccgccacgccttttacatctacgccaactggtgctaccaggccggcgtttttgtgagccggtccagcggcatggtgtggcagccgggcatggcagcgctgtgggccatgccggccttgcaggcgggcctcctcttcttcttcctgcacgatgccgtggtgcactggtggtacggctggacgctcctcctcccctgcttcctcacaggtgggtgtgcgaagtctgtatggggtaggtgtggtggagactggggggaaggggccatggcatcggcgccgggactgagcagcctcgccgcagggcattaccccctgccgagatggccccccagccaccgcctcacgccctccacatctccacaaacagccgcaccatgtcacctgacgcactccccttcgcactcccctccacactcccctcgcaggtctgctgggcggggcggtgtacgttaacgcgtttgcactgctgtcccgctctgtacccccaatccagcgcgagttctccatggcggcggcctccgtcgccgactcgctgggcatcgcgtgcgctgacgttgcaggggtgctcatccagggctgcctgttcaagatcaatcgcatccccggcgccgactacacgtgttgagctgtggctcacacctcctgggctgtgtgaggcttgtgaggtcagctcgccgttttccagcggtccattttttcgatctctgcatccctgaggacgttgctgacaccagccctcggtgatcttgccaaacctttccagcggtctcatcactctaccgctggggcgctgtggtgaatgccatgctcctttgtcaagcttgtgtacaacactgcggattcgtgtctgaatggggaacccagggtttgacgctgggcagggaagagggtannnnnnnnnnnnnnnnnnnnnnnnnnnnnnnnnnnnnnnnnnnngtccggtatttatcaaggggcaggtggcggctggccagccgacggcgatcgcgcaagggagccgaggctgtccttgagagcgtggactgcatcggcacatccccgccagacagccgccggcgcggaaagcagcctgatccagagccggtgggcgagnnnnnnnnnncgcaccacaggctgcaccgagatgttacactagccattcagcaagcaggcgccaagnnnnnnnnnnagcaccacaggctgcacagagatgtcacactagccattcagcaagcaggcgccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgaggctgtccttgagagtgtggactgcatcggcacagccccgccagacggccgccggcgcggcaagcagcctgatccagagccggtgggcgaggacagcgagcatggagctcagggcgtgtaatccattcagcaaagccgacggggtccgccccacccaacccacagccgctgccaggcggtcctggaggaagaaaggacgcccggcgtcggaggcgcgggtcgcagccgcggccgcccctcccgcatccctggcgtgcatctgcgcccgggcggcgtcgagcgccccacgcacggcgccgtcctgcgcggcgccggcggcgg

SEQ ID NO: 46698 - DNA, 70 bp, Chlorella protothecoides
cagggccttgaccacatgctcgctggcgtgggcctcgatgttccgcatccagttccggatgttgctgaag

SEQ ID NO: 46699 - DNA, 61 bp, Chlorella protothecoides
tggaaagcacggcaggtaggctgggcacgtaccccagccggtccagcagggaccagcccac

SEQ ID NO: 46700 - DNA, 71 bp, Chlorella protothecoides
ggtgggaggtagggatgcgaagggaacaggccccggatcctggggcatgggtgcaagtgagcttcccgacc

SEQ ID NO: 46701 - DNA, 6401 bp, Chlorella protothecoides
  modified_base (626)..(635): a, c, t, g, unknown or other
  modified_base (956)..(965): a, c, t, g, unknown or other
  modified_base (1320)..(1329): a, c, t, g, unknown or other
  modified_base (1550)..(1559): a, c, t, g, unknown or other
  modified_base (1647)..(1656): a, c, t, g, unknown or other
  modified_base (2132)..(2141): a, c, t, g, unknown or other
  modified_base (3511)..(3520): a, c, t, g, unknown or other
  modified_base (4167)..(4176): a, c, t, g, unknown or other
  modified_base (4719)..(4728): a, c, t, g, unknown or other
  modified_base (4964)..(4973): a, c, t, g, unknown or other
  modified_base (5138)..(5147): a, c, t, g, unknown or other
  modified_base (6324)..(6333): a, c, t, g, unknown or other
ggatactcggccgggcgcagggcccggctttacgtgaagcgagggcctggcagggccttatgcacaccttgcggggtggagaaatgtgccttgcacgcccggtcagcgactcactcgtcgatcgggtggtaggttatctgcaccgggccggcgccggttcccggggccgccgcggggggcgctgccagctccagcggctcgtcctctgcaatggtcggcacggtgcctgtggggctggagggcacgcccgacccctcgcgcgccatggccggcaggacgcgcgaggccaccgtggccgccgccgagccggcggtgggctcgagcacgtcagggacggaggaggtggacaggcccccgatcagggcacggctgctgccggcgccggggccccacgccgcgccgtccaggaagcgcgcgccgcgtccgcttgggttgctgctggatttgaggatggtggaggcatggcgcgaccaggggcggttggtgtacgatccctcgctcagctcggcagccaggtaggagccggcgcccgcgcccagcctcgctgtggattccttgctgggcatccactggccgtggtcgtacaccaggtccacaatactggagggggggggaggagggggggnnnnnnnnnngccccgcaaggtgtgtaccaggccttgccagcccctcgcttcacgttaagccgggccctgcgcccggccgagtatccccttcctgagagtccctttccagcagcacccgagcggagcgatgccagttttgaatgaccctttgtcctttacacacgtaatctgagccgagaccaagtgctgtttaaagacggggggtggcttgacagggaggcatcgaggataatcgccttgtggatggcttgtcagagcagggaacagctgcacaccacacagtgccaagccaggacttatgttctggttgacaccagcttgacgatgcannnnnnnnnntttgtggatggcttgtcagagcgggaacagctgcacaccccacagtgccaagccaggacttctgttctggttgacaccagcttgacgatgcaaagactgctcttgagaaaacaacaggaatcctcactggcacttgagcgaggcggagtgtctcgtggtgagctcgatctgtctcccccaccccctgcacatgtgcatggcttctagggaggggagaccccctcacctccgtgcatactacgcatctgatcaaagcaatggaagaggggctattacatgtacacattcacatgtaacacgcagcccttccttccccgtgcacttcacccataccactgtgagcgggaggcctgcnnnnnnnnnnggctagggaggggagacaccctcacccccctgcatgtcacgcatctgatcaaagcaacagaagaggggctattacatgtttacattcacatgcaacacgcagcccttccttccctgtgcactgcacccataccactgtgagcgggaggcctgctgacacctcctaaagttccagaggcgtggggttctcctcacctagcaagccacaagctacccaatttnnnnnnnnnnttggtgtggtcacccttggggctgcagggttggttgagggctctcaccacgagagcttgtcctgccgactgggctcgatgcagagccnnnnnnnnnncccccttgcgctgactagaagcagcagcgtgacggaatatttaaactctggccatgaactggtgtggtcacccttggggctgcagggtattggttgacggctctcaccacgagagcctgtcctgccgactgggctcgatgcagagcccaacaatcactccttacactgcgccggcacgtctacgggggctcagccccacgctcagctgcgtgcatactgggcagtccaggcgcgggcggtgtccatggcctcgacctcgttccccttccagtgcctcgccaccgcctcgtcgagagggtcatcagggtttggcgcgctcatcaaggcttgtatgctgttgaagtggaggaggcgggggagagggggtgagcagaggtgatggaaagacaaaacttgcatgtttggaactgccaaggggtgggagtcgccaatcacacaccacacccctcctctagtactggagtcctcccatgtcnnnnnnnnnncatgccgaggggtgggagtcgcctatcacacaccacacccctcctcctctagtactggagtcctcccatgtccccccgctcccacatctcacctgagcaggactgtcctgatctggagggcagggctccacttgtccttcaaaatgtccaggcagatgcgacccagcttgtccacattggggtggtagatcttggtcaggaagcggaccttgggggccgccatagggtaatcctcagggaggaacagctccagcttgaacacgccgcctggaattggcacagccatgaataaagcagatgaggaggacccttagggtggggatggaggatgcttcctggagacatgtccatgcgcccttcatcaccgccccattgtgaccccagattcacaccttggtatggggaggagtcgggcccgaatatcaccacattgaagtagcgaaggttctcctcggagggtgcagcagagatgccgggcactgcatcgacgggggaaagtgagggatggagcaagataccaaccggagccacaacgtggttgccaccagaaactggtgaccactacttgctccgcagcatatacagctagctcacctggttctgtcagaagcctttgactctcctgcaaatattgtgggagagtgtgaggccggctgagaggttcttaaggaacatatagctgaagtgatcttccacggtgtcgtgcagccaagcttacggcaacccaccttgattatacgacgaggcagctgggcagcctgtgcagccgctgccatgctgctatgcgataggggagctgcggcgctcttggaatggaaggggtgaccaggagggctacaggcgaccccaaccttgggcgatgaattcgatggtggccggatgcacgagacaacgcactgacgattttgagcctatgttgttcttgcgatgggtagagtatcggagggcggagcacacacgggaactcgtcctggtcggggtattcgttccactcaggctggcgggaggccacggcgagagtcgcgctcaactcacccgcaagtgacccacccgagacaacctacacctcacttgggatgcgaccctggagcatcatactattatttggaggacgttgaaatcaaccacatcccctgggtggcatctgtctgtgctcaacagggcagacttctcccggagagggctaactcgttcgcccaagagagcggcacggtcatggggggcgcgtcagacctcaacgtaccgaaaggtatcatccacaggaaggctgcgggagcagcatatccctgcggcctgatgggctccctgtttgcctatgcgttccggtgatgttgccccctacatccgagctcccacacctgtgcaggcannnnnnnnnngctatgcgttccggtggtgttgcccatacatccgagctcccacacctgtgcaggcatctggtcgcccgctggaggatggtactctgaccccaagtactggaaacggaacactgccctcgcaattgggtgagatcaggagcagggcacgtggctcggaggggtggtttcatggatctcacatgaccataaatcttgcctcacatcttccaaccctcgctgaccaacttgggtcgcaggatcatcgtggccattgctattcctgtgttccggacgtctgtgtccaaggagcagcggtatggggagccacaacacgacatcccctcccagaagtggacccccaaggagaacttccatgttgccaagtgaatggatgccagtgggtgcgcgcaaggagctaaagagtcatcatgcatgactcctcgctcaacaaacttgtgatgggggcccaaggccaaatctgcctggcgcccagtagactgtaaaacatacgcaacagcctgaaaggccactgaaaatcttgcatgtacacatgcttggggacaagggaccgtgggatgattcaacactcgaaggcttcccctccattccgccgtggaagtttctggaagttaagtttcatgatgggtctacgatgcgcagagcctcgnnnnnnnnnnaactcctcgctcaacaaacttgtgatgggggtccaaggccaaatctgcctggcgcccagcagactgtaacacagacgcaacagcctgaaaggccactgaaaaccttgcatgtacacatgcttggggacaagggaccgtgggatgattcaacactcgagggcttcccatccattccgccctggaagtttctgtaagttaagttccatgatgggtctacgatgcgcagagcctcgagagagggatctcttgtgcagcaattattgttcacaggcccgaaatcttgaatgagcaacaaatgtcagtacaagcctcgatcttggcttgaacatgggtgaagggcagcagcaaagaggtctcaacaaaaagcaacagtgcgcggatggtttgctcatcgattgttgtacatgtacagccataaataaagctgtacatgtcaagcagtgagaaatggggcgaacgcatgtttttcagttcattgtaataacaacccccagtgtctgaaccaaacgtgcaatgctgttcctaacaccgacccccagctgnnnnnnnnnnctacagccataaataaagctgtacatgtcatgcagtgagaaatggagcgaacacatgtttttcagtgcattgtaataacaacccccaatgtctgaatcaaacgtgtaatgctgttcctaacaccgacccccagctggaggatggtagctgtgcttcggtgccaacatgggatcatgaagcctgggttcaaaggatgtaagcgtctcttaatcatcctagacgaccacagatgccannnnnnnnnnagtgccaacatgggatcacgaagcccgggttcaaaagatgtaagcgtcccttaatcatcctagacgaccacagatgccattggaaggcaagtcttacttcatttgttccatatattcaaactggcccagaggggaccgcgttctggtggggggcgcagccccgtnnnnnnnnnnttattcaaactggcccagagggcaccgcgttctggtggggggcgcagccccgtcagcatggcgtcaaccctcgcccaaagtccgctcggatgagaccaacccgccggtacgatctcctcacctagatcagcctcgatagattgtttccagtggctttgggttttggggcttggcgaattgtgttcgaggcagggcgctcgtattgcgcacaccactgagggggggcacgcagtgtttgtccccacgacacgatccctggcgtgggggtcttgccaatttttcgcaggtccccttagtggcagcgaggtcgtcagcgcccgggaatccacagccgtgctctcgctcccatacacctatccgcctacagtcgcagcttctgcgcctgactgtagccgaggttccttctcgtagcccgtccacagccccaggtcaccgatggacggtccagtcgatagagaggaggccgtgtacctggccaagctcgccgagcaggcggaacgctatgatgagatggtgagcccggcaccctcgagaggggcggatgcactgcagcatttctggcgtttcaacagacctgcggagtagctggggaagggtcatgcggtgcccctgggtgccacggagccggtgccagctcttcatcagtcatcgggatgggcctgcgagctccctgcttttcggggcccgcggtggcttgggtggcagggtcagcgtggagctgatcgccccgacccctcgccccgtcccgcgcaggtggcggagatgaagaaggtcgcgcagatggttcacgaccaggagctgtccgtggaggagcgcaacctgctgtccgtggcctacaagaacgtgattggggccaggcgcgcatcctggcgcatcatctcctccatcgagcagaaggaggagtccaaggggaacgaggagaacgtcaagcgcatcaggaaataccgcgaagtggtgaggctggcgtgttggaaggggtttggcagcgcacattcggttgagggcgaccggagcatgcactttgccttcttggggtggacttccgtgcaccctagggctcctctgtcggtgggctgccccaggcgcgccacccccctggaattcggactcctcccaaggatttcatggcatctccctctccgatcccccccgccccctcctctccggtcccccccgnnnnnnnnnncggctcctcccaaggatttgatgggcatctccccctccgatcccccccaccccctcccctccgattcc

SEQ ID NO: 46702 - DNA, 75 bp, Chlorella protothecoides
accgcgttctggtggggggcgcagccccgtcagcatggcgtcaaccctcgcccaaagtccgctcggatgagacca

SEQ ID NO: 46703 - DNA, 61 bp, Chlorella protothecoides
ctttgcgtgccacttcgcaatggccctctcacgccgcttggaccccgacatggcgtggaac

SEQ ID NO: 46704 - DNA, 61 bp, Chlorella protothecoides
ctacatgaagttgtcctgtggcaagcggagtggggcggggtgggatgtgggtgagtgcagg

SEQ ID NO: 46705 - DNA, 62 bp, Chlorella protothecoides
cggacactcctttgggccgctcgacgggcggaggccccccgccccctggcggccagcgttct

SEQ ID NO: 46706 - DNA, 78 bp, Chlorella protothecoides
cggcagggattttggtcatcctggagtgtatgccggccctggttggccacccaggcacgctggggctcgcatcctgtt

SEQ ID NO: 46707 - DNA, 2618 bp, Chlorella protothecoides
  modified_base (1076)..(1194): a, c, t, g, unknown or other
  modified_base (1422)..(1431): a, c, t, g, unknown or other
  modified_base (2292)..(2301): a, c, t, g, unknown or other
gtcgccgcggccagcagcgcgcctagggcggggccctcgccgcgcggcgcggcgctgacgcgcagcgagcgcccggggcccacctccacgccgtccatcatgtgctcggccagcaccgcggcgcgcgagtcgtggaaggagagcagggcggagccgtcggcggcgcgcgacacgcctgccacctcgccgtacgcctgcgtcacagggattcgagtgtgggagggggttggaagatcgaggaaagagaggcgaggcgagggcccgagcagacctcgcaggggtgccgctggatggtcaagtggggggtatcgccagcgcacacgccatgcgacgcagactccgcccaggcgcggacccccccgtgactccacccagagcatcccgggacctccctcccagccaccccctgcctcccctgcacacctccgccatcatgtagatggtctcctccggcacgggggagccggagctgcaggtcagcctgagcgaccgcgccggctcgcgctgcggcggggcaccggcggtctgtccgccgggcgcgtttgcggccgggaagggcagacccagggcgcagggggccgggcccctcgccggctgcatatgccaggggctgctgtccaggtctgctgataggaactccggcgcccgctcgccggtgccgccctcctccaggatgccgggcaggctggaccggctgctggaggccgccagctgggacagggagccgtagagacgatgtagagtggccgtgtactcgctggtggcatgggggggggaggtgctcccaggcgaggcagagtacccagggaagagggagggctgctccagcgggcttgggccggtgggagggtccgcgaattgatccttgggaggatccatgacgtcagacccggccagagcgtgtcggtgtggtgccagctgtgcggcccgggggtgggctggctccgcagagggtggcaggcgctgacacaatgcaagcgtcccttccagagcagtgccgcctgttctaagacaatgtaaaccggggggccagcgatcggatcctcgtcaatggtggccgacctggctggatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcactcgaatgcatctgaccaagccaagtataatttccacggagaacttgcgttataccatctttgctcatcccacctcccagcgatgtcgccttacgacaaaattactaacaaaggcgctgggccagcagggcgaatatctggaggccctctttccagcctgggctagcacgcccccgagacccggtcgagcgacagtccgcacccccttcccagcgccctcccccnnnnnnnnnnagccagcacacccccgagacccggtcgagcgactgtccgcacccccttcccagcgccctcccccctcggggagcacgtcatgggaagggaagtgggtaacaagcgacagcgcgatcaagcgtcccccagcaactcggcagacgggctcgagctcgacctccttgccgcccttgaggcgagcgatggagacgacgttggcgtcgtgcagtcggcgcctgttgtcaaatggtcttgcgacgaggctaaagccgggcaggtgcatgcggatgagtagtggtggcttgtattcgcactgctgggctccagcaaatacatcatggcagcctggaccctggccagcacactgctgatgccaggaccttgccaccagctgatcactcatcttcgtgccctccaggaaacattccaatccatccctcctccatgcactgctctatgatcactccacagggtgctggtacggcagacagcacccctgacatgctgaccctcccggagcctctcctcctgcgcctggtctgcttcctctcccccgacgacaccctgtccctcgcccagacctgccggcatctggcacgcctggcgggcgaggacctggtgtggcgccggcacttcctttaccgctggcccgatgcgggcatgcaggacgagggcgccacccccgcctggaaggtgtgtgtgtgtgtaaaaagcgaggcggggttggattgcatgcgcgtgtgacagccttcggggtatggccgagatcaattcacccccgagcccagcgtccccgtccctgagctcggccatgtccttgcatggtagacgtgggtttgcagaggtgcctcgatgcctgtgaatgccactgtgtcgcctccnnnnnnnnnnctcggggtgtggccgagatcaactcacccccgagcccagcatccccgtccctgagctcggccatgtccttgaatggtagacgtgggtttgcagaggtgcctggatgcctgtgaatgccactgtgtcgcctccaacccccacctacttcctcaccacatccccgccaggcacgctacatggcgcgtgaccgcgcgggcgtcgccgcggtttctgccacgggcctggaccccgcgctgggcccgctgtaccgccacatggcggtggccaagcgcagcgaggccgtgccgcccgcctggcgcgcgcccgccggcccaggg

SEQ ID NO: 46708 - DNA, 61 bp, Chlorella protothecoides
tgttgtacagatatttacacacacacacactctgttagggagagcggccagtgctaggcag

SEQ ID NO: 46709 - DNA, 91 bp, Chlorella protothecoides
attgattccagcatgaggcaaggaccctgaaggtgctgcgctgccccgtccgaaaccccagcaccacccatcacgagcctcacttgtggtg

SEQ ID NO: 46710 - DNA, 80 bp, Chlorella protothecoides
gcccactccgccagcacctgttcagcggcctgccgggcagctgccgccgcttcatcggcctgctttggggcgccggagaa

SEQ ID NO: 46711 - DNA, 61 bp, Chlorella protothecoides
cgaaggacatctgtcccgatcccgctccctgaccgcgtttggctgatgtgaagggcgcatg

SEQ ID NO: 46712 - DNA, 92 bp, Chlorella protothecoides
gttcttgcgctgcacgcaggtgatgcgcgccgcgcctgcgtggagaggaaagcgtgaggaatgactgaggggagtttctgggagcggcgggg

SEQ ID NO: 46713 - DNA, 61 bp, Chlorella protothecoides
ggtcctcctgcacgaccgctttgggccggaaggcctgcgcatctggcgcctgctccgcgcc

SEQ ID NO: 46714 - DNA, 68 bp, Chlorella protothecoides
gcacctgtgccctctgcaccatgccctcgcacgatctggaccccatgcaaccccgcgctctgcaaagc

SEQ ID NO: 46715 - DNA, 62 bp, Chlorella protothecoides
tgcacgggaatacccttgttcctctaccggacttgtgccggatgctagcagcttgttcccgc

SEQ ID NO: 46716 - DNA, 63 bp, Chlorella protothecoides
ctgttccgggacaggtacagcgagcgtcatctgcgtttcgaaatggcgccagggttgggtgcg

SEQ ID NO: 46717 - DNA, 61 bp, Chlorella protothecoides
cgcctgcgtgcccttgctcaggtggatgagtcccagggccaggccggccgccaggctgtat

SEQ ID NO: 46718 - DNA, 61 bp, Chlorella protothecoides
ccgggcgggatggatggatcctcttggcagccctcctcctcctctgcgggccagacctgcg

SEQ ID NO: 46719 - DNA, 89 bp, Chlorella protothecoides
catggtcctctgagcatcgggtggtcttgtcacagaactcctcactgggtggacagtcagttggtctctcgaccgacacaggctcagac

SEQ ID NO: 46720 - DNA, 159 bp, Chlorella protothecoides
ggtcagcacaaagacggcctgtgcggggtaacattgggagcctcagcaaggggctgtgcacgcacccagatggtctgcgggtcaccctgtgggtgaagactgcagcgtgctgacaagcgtacgggcccggcactcctccatcctccacgcaggcgacat

SEQ ID NO: 46721 - DNA, 70 bp, Chlorella protothecoides
ctccatggcgctcgatgggaggggtgtgggggcgttggcggggccaagagtgctgggcaggctgacgcca

SEQ ID NO: 46722 - DNA, 82 bp, Chlorella protothecoides
taatccttcctgtttccttacacagagaatggtatcacgtacctatgcatgggccggggggagggggcatccattgtcccgc

SEQ ID NO: 46723 - DNA, 78 bp, Chlorella protothecoides
tgcgaataaacagtctgggttgggggtcggcgatctgtcgtgggatttttacaaatttagatcccgcgcgatctggga

SEQ ID NO: 46724 - DNA, 61 bp, Chlorella protothecoides
agatcacgacaccacttgatggggactgtaagtctgcatgtgcgagcattggttaggtaca

SEQ ID NO: 46725 - DNA, 61 bp, Chlorella protothecoides
gagcctacccaggaggccacgccagctggcgcccgccgatgacatgcaggtgcaggtggta

SEQ ID NO: 46726 - DNA, 76 bp, Chlorella protothecoides
tccatgcccctcaccccagtaccggcttgctcatgtacccatgctaaaccggcgtgtcacactgtcccctgccaac

SEQ ID NO: 46727 - DNA, 132 bp, Chlorella protothecoides
tgatgactgctgccctgaatgctggcctgtgggggggggtgttggaggggaagcgctggtggatggtgcatcctatgccccaaattccaggtccgcgaatggaaaggatgcccaatgatgcccctcaccccc

SEQ ID NO: 46728 - DNA, 22363 bp, Chlorella protothecoides
  modified_base (159)..(168): a, c, t, g, unknown or other
  modified_base (943)..(952): a, c, t, g, unknown or other
  modified_base (1412)..(1421): a, c, t, g, unknown or other
  modified_base (1843)..(1852): a, c, t, g, unknown or other
  modified_base (2257)..(2266): a, c, t, g, unknown or other
  modified_base (2352)..(2361): a, c, t, g, unknown or other
  modified_base (2868)..(2877): a, c, t, g, unknown or other
  modified_base (3130)..(3139): a, c, t, g, unknown or other
  modified_base (3865)..(3874): a, c, t, g, unknown or other
  modified_base (4656)..(4665): a, c, t, g, unknown or other
  modified_base (5151)..(5160): a, c, t, g, unknown or other
  modified_base (5415)..(5424): a, c, t, g, unknown or other
  modified_base (5820)..(5829): a, c, t, g, unknown or other
  modified_base (6720)..(6729): a, c, t, g, unknown or other
  modified_base (6964)..(6973): a, c, t, g, unknown or other
  modified_base (7269)..(7278): a, c, t, g, unknown or other
  modified_base (8615)..(8624): a, c, t, g, unknown or other
  modified_base (11256)..(11265): a, c, t, g, unknown or other
  modified_base (11342)..(11351): a, c, t, g, unknown or other
  modified_base (11456)..(11465): a, c, t, g, unknown or other
  modified_base (12022)..(12031): a, c, t, g, unknown or other
  modified_base (12104)..(12113): a, c, t, g, unknown or other
  modified_base (12642)..(12651): a, c, t, g, unknown or other
  modified_base (13061)..(13070): a, c, t, g, unknown or other
  modified_base (13465)..(13474): a, c, t, g, unknown or other
  modified_base (14508)..(14517): a, c, t, g, unknown or other
  modified_base (14601)..(14610): a, c, t, g, unknown or other
  modified_base (15037)..(15046): a, c, t, g, unknown or other
  modified_base (15224)..(15288): a, c, t, g, unknown or other
  modified_base (16256)..(16265): a, c, t, g, unknown or other
  modified_base (18132)..(18141): a, c, t, g, unknown or other
  modified_base (18218)..(18229): a, c, t, g, unknown or other
  modified_base (18600)..(18609): a, c, t, g, unknown or other
  modified_base (19438)..(19506): a, c, t, g, unknown or other
  modified_base (20229)..(20238): a, c, t, g, unknown or other
  modified_base (20334)..(20343): a, c, t, g, unknown or other
  modified_base (21575)..(21584): a, c, t, g, unknown or other
  modified_base (22091)..(22199): a, c, t, g, unknown or other
cggcccatgcggcacagcgccgcctcgaagacgctggcgggagggggctggtggcccggaccgccgcgcctgggcgaggggccggaggcgccgccctgctttgagcccgcggcgcgcgcagggctggtcgcgccgtcggccccgacgctcccgccgggnnnnnnnnnnggcgccgccccgctttgagcccgcggcgcgtgcagggctggccgcgccgtcggccccgacgctcccgccgggggagcctgggggcgacagcacgctgaactcgatctccgcctcggcgcgcctgccctccgccgccccgctccggcccctgcaggccgcggccaccccaacgcgcggattcttgttcagggaatagccaaagggcgagaggatgggcgcgcccaccaggcggcacaggaaggcgttggcgatcagggcgtgcacccgcatgtcggccaggatgacagggtggctctccacgtaggtcaggtcctcggagcccaggtgcgccaggcggatgcaggccttgaacgtctccagcaggtccggggcgcgctcgtcgcggtcggcctcgatccaggccgccagcgcgcggaagacttcggcctcggaggccaccgccacggcgtcgtcggacagcagctctaccaggtgggcgtgcgacatggtcaccaggccggcgtagtcgtgcgaggtgaccagggagaagtgggaggtggacaggcgcagcgcacggcggcgcaggggggcgcaccccgccgaccgcgccaggctcagcaggctcagcgcgttgtggaccgacagcgcgtccaacagggcggccacgcacaggtcgcgcgcctggcgtgcctgcgacgatggcggcaggggtgttggtgaggcacaatgagtggcggaggcctcaaggcttccactgtcagcatgtatgggtctgctcggaggcggccacaaagtnnnnnnnnnnaacgatggcgacagggatgttggtgaggcacaatgagtagcggaggcctcaaggcttctactgtcagcatatatgggtctgctcggaggcggccacaaagttcaggacagtgcaaaaaggcttcaaggtgcaggatctgccaggggccatgctccttaaaaggaccccctaccacccacctcagagagggacgcctggtgcacacatcgcatgaaggcctccttcaggctggcgtacccgaagactgcctcctgtaggcggtccagcacttggatgcccaatgggcatggtgcacatgcaaactcaaagtccgcgacctcaacgttctgtgcaggggaataaaggaaatagggcctgaaagtaagaatatgtttgcgcgacaggaaggatgtcaggccggtgatgtctcgtgggatgatgtggggaagcctcagccaacggacacagctgtcgcgagggnnnnnnnnnntatagggcctgaaagtgagaatatgttgcgcgacaggaaggatgtcaggccagtgatgtctcgtggaatgatagggggaagtctcagccaacggacacagctgtcgcgagggccgcggggtaccccgtacaactccggcgcacctggagaaccaggtcggccacttgcgtcaggtcgctggtgatgtcaggatagtgagtggccccgagacacgcctgtaccgcggccagccctgcaaggtttggagacgcgttgttacgaatatccggaacacagcttgcgcaacagtgcgcgatgctgcactttgcgccgaaacaccgtccataaagtcagaaagaacttgtaaacaacgcgaaattcgacatcagcgggagcaagcgctccgtctcaatgccagccgagtatctgtctcacgcagtgcnnnnnnnnnnggcgatgctgcactttgcgccgaaacaccatccacaaagtcagaaagaacttgtaaacaatgcgaaattcgacatcagcgggagcaccgtcccactgccagccgagtatctgtctcacgcagtgcggtaacaacgcccctccgcaccaagttcctccgactgcctcacccgccccgatgctccgctcgatgttggagagggtcttctgacctccaaatcgcacgaccgcggcgctgagctcccgacactggtatagggcgtggaggtattccacaccctgcgtcatcagccagcgaagacctggcgtcaacgctccacgtcaggtgcaatttggtcaatcgtcaggtcaattaaaagtcagtacaatcattcatgcaccacacgagccggtggctgaccattacnnnnnnnnnncttggatgcaaggaaagggtagtgcgcccgtgaggagcgagtggaaaacctctcgatacagctgcacgatcgtggattttgaccannnnnnnnnncatcactcgttccgaaacatcacccagtgggtcgctccctctgcatccgttggacccaggcgcgtgagagagggcgcgcgaaacacttgctcctgccaacccccatggaagcaaggaaagggtagtgcgaccgtgaggagcgagtggaaaacctctcaatacagctgcacgatcgtggattttgaccagtcctaaagcggatatctagggcgtgagaaggggagctctcacaatgaccacagcacatcgtcccacatgggcacccgcgaaggtgcgtagagggtatagagcatctgtcgacatgtgatgcatcctcgactgagactgaacccaaacactcacggcagggtggagaggagcaaggtggaatgcgcatcttcgcccccagcaagcagcagtcggtcaaggacctgccgtcgcagactaggctgaagttcaggtgcgcaccgtgcttctgtgcttgtctgaggtggaagcggatcgtggaaaaggtcgtgagatgagacnnnnnnnnnntaggtgcgcaccgtgcctctgtgcttgtttgaggtggaaacggatcgtggaaaaggtcgtgagatgagacataccatactcttgcaggcaagatggacagagcaaggcggaggagctttcccagaaagacttgcgggcggagttggaagagaaggagcgggctcactacttgaagaacaaaattcacacctttgagggtatactgtgggggatttgggagagagcaggcggaatggttggcctgcaagccgtnnnnnnnnnnaaacaaaattcacacctttgagggtacactgtgggggattggggagaaagcaggcggaatggttggcctgcaagccgttgatgcagagtttgggtgcccgtgctgtccaaggggatgcggtgcatgtgcgtgtgtagccctccttgctcactcatcctcgcctcccccccattgtggccctgcagaggagcgagaagatgacctgagattactgcagagcgcttcccatgctcgagaggaaccgccgcgaaccctgatacccaaagcggccgatgccgacgacgaggacgactcggatgctgcgggatccagcgacgacgatgatgatgacgaggtgcaggtgctgggtctgttaactttgggaaatagtcctagagactcttgctgcacagctgtttgccagcctgtgtatgcgcctcacgtgccagccgctagtttttctttgcacctagaggatacatgctcctgacccatgtcgccagcctgcggcactctcaccattccctctccacctctgctcgcctaccaggatgacgaggcagagctgctggcggagctggcgcgcatcaaggctgaacgcgctgaggaggctgcgaggaaggcagcggctgaagccgccgccgcggagtctgtcaaccaggccgaactgctgcgtggcaaccccctgctcaaagagaaactgcaggtacgagttggttgacatggcacactgatgaacaggcttgnnnnnnnnnngaaccaggccgaactcctgcgtggcaaccccctgctcaaggagaaactgcaggtacgagttagttgacatggcacactgatgaacaggcttgctgtgcttggtaatgtcgctttctctgtctggctgggttcccacaccctccgtgtgctccggcgttgcaggcggcggccggcggcgacgccagcttcgccatcaagaggcagtgggacgacgacgtggtgttcaggaaccagacccgcggcgagcccagggcccagaaacgcttcatcaacgacaccatcaggaacgacttccacaagcgcttcctcgagaagtatgtgcgataggctcatctcccatgtcaatatttatgcatgtgacggaggagcctgacgaagcgcccgtaatctttcaacaagggattcctctagttttgcaagggcaggaaagtccgctggtttcgtggcatgaaaacgttggcaagcacgggcgcgggccgtagctggcaggcaagagaatctgcgaagggagtttgccggtggctggtggcgtggcacagccgccagggtctactggcgccggggcttggtcgcgctgggcatgcccagccgggaggtggcgaagcccgccgccgctcgcgagatgcgccgcgccttcttccgcacagattgggtgtacggctctgcgtttgtccccggggggcggggggatgttggagggtgtccgaggagtacactggcatcgtggcagaacttggctctcccagccccatccacgccaccatcgacaaggtcaaagtcannnnnnnnnncatgcgccgcgccttcttccgcacagactgggtgtacggctctgcgtttgtccgcgggggggcggggggttgttggagggggtccgaggagtacactggcatcgtaggagaacttggctctcccagccccgtccacgccaccatagacaaggtcaaagtcagcccgacccgccccccacctgcatgagcggcaatggcttcgagctcggcggggcgcaggtggcatcgcgccgccaggccgcctgccagcagcgccgcgccgcgcgtggcccagccggagacgagccacagggccgtcagggctgcgaccagggccagcgccttgtggcggcgggtcagccccagtgccttgctcctggtctgggattggcggtgcgaagggaggtgggagaggatgaggtatgtggcacggcaaggagacttgagtgattttgagagagaggttgtttgggggttgccaagcggatgggggctccacattccgcnnnnnnnnnnggagtgatcttgagagaggggtgtttggggggtgccaagcggatgggggctccacattccgcttccaaacagataggcagcccctctaaaggactgcacgtgtccactaagggcccactgcccgagatgcatgcatggggagctctgacgagcccatggcctggctgtacgggatctgaaccggactcttgaccccacgtccgcgtgcccaccccgtacgccacccccctccccaaacagcacacacacctcggnnnnnnnnnntacagatcggcagccctctaaaggactgcacatgtccactaagggcccactacccgagatgcatgcatggggagctctgacgagctcatggcctggctgtacaggatctgaaccggaccctcgaccccacatccgcgtgcccaccccgcacgcccaccccctccccaaacagcacacacacctcggcggccgcgccgagcgcccgccatgctgccgacaggcgctccgcatgcgctgcggccagcgccggcagcgtgaaggcggccacgaaccccacggtgagcgccgaccaggcgcccagcacctggccgacgcgggtgaggccccacagcgccagcgcgctgcgcagcgccagcgccgggtcacgcgccgtcagcaggcggtcgtgtgcggcgnnnnnnnnnncaggccccacagcgccagcgcgctgcgcagtgccagtgccgggtcgcgcgccgtcagcaggcggtcgtgtgcggcggcggataggtgcacggccgtggccgccgcgtcggcggcgcgcgtggccaggccagagccggccagcgaggcgtgggagtcgcgtgtcagcaggccccgcacgaagttgacgcccaggagggccagggcggcgtgcgccagggagggcagcaggcgcagcgtgtgcgggccggagagcgcgtagtgccccgccgccagcaccgccaggcccagcgcgagggccgcgccgctcagccaggggtaggtgtacaggagcaggtcggacagggtgagctgggaaaagtcgtactgctcgccgggggtgccctcggcgtccgggtccacgcccaggaagcgcagggtgcgggtgccctgggccggggtctcccgggaggcattgtaagcggggatgcggaagctctggctcgcctccgtgatgctcgacctgctggggaggaacatcaaagagatgacgtgatgttcaggcgcggaccatgtcttcacgccattgccccctgggaggagcgtccaggcgagagcctcgatgccgacttgcctgtgcttcaggatctcccggcgcagcgactcggagtccgcggcctcgattggggtcgaatcccagtccatgttaaagcttgttcaatgggcagcgaaggtgcgcctggattcacaattgtaggcggtcctcgctagggactcgacattgatggacagagagggagtggttttgaaatcgcatctcgctttccatctccaaatgaggcaggtaaagtttccatgcataggccttgttgcaatcccaaaataaagtaagaatgctatcaaagcaacagcacnnnnnnnnnntatggggcaggtgaagtttccatgcataggcctggttgcaatccccccaaaaagtaagaatgctatcaaagcaacagcacatccaagctccaagtcttcatgcattctggcttgatgtatcatgcatggactcgtcctcattgatgcccaatttttttgtcaaagcgtccattgtacagcgaaggagtgcgtgctggcgcggttgagtaagcgttgaacagtatgtgtcttgttnnnnnnnnnnttttttttgtcaaagcgtccattctacagcgaaggagtgcgtgctggcgcggtggagtaagcgttgaacagtatgtgtcttgttctcaaaatgcatggttgcatgcatttatctcgagggcgagcctaagcatttgttcgtttcctcttgcctcctgagtgaggagttgaattcatgtgtaacacaaggtaatccactatggagatgaagagcgtgccctgacacctgacaactctgcactgagcaccacgcgcatagattgatgaatgccaatcacatccgacgagccatgcgcnnnnnnnnnngctctgcattgagcaccacgcgcacagattgataaatgccaatcacatccgacgagccatgcgctcaaattgccactccctgcttgtgcagctcatctagattgcctcgaggtgtaattgagagcttgttcatgcacagcatggaggggagcaagtaatgcttgggaccttgtacactaggaatagtatagaggcagttaatcagcttaaggtgtgaagtcagcatatccgtggaaaccatttgagcgacccattcctggtaaaggtgacccctgcgcgtgaatacttcacactcccatccccgacatcattgttggcacccaagcgctgggcgcagtcggcgttaacacggcacccttcgtctcagtgtcggcgcaacaccctccttcccgacacaagtaatctcgcacacaaaaaccattactgtaaatgcacattgtgagccgcatctcccttcctccacccaccccccattgccacgccttcgctcgccgacccttccccactcgttgtacccgtgcccctcatcgaagcccagcggcaatgtctcagaacaccgttgtcagcattggcgagatcctgtatggtgcgtggcgtgcatgcgatagctgttccagatcatggcagggaatggatttccgacagcatgcgcaccccattatcgcgcacccccccactcccatgcagacgtgctggcggatcagcgcggcgttccaaaggaagaggtcacctcctggtgagagttagaagtttgggtcggggtgcctccgggatggaatcgggccacctcgctctgctccgggcgtgaacacccagcccctctcccccctgctcccagggtgccctaccccggtggcgccccggccaacgtcgtcacctgcacctcccgccttggagtccgctccgtgctgctgggcatgctgggcaccgaccagctgggcgacgacttcgtcaacctgctcaaggagcgcaatgtggagaccaagtacctgcagcgcacccccgaccaccccacgcgcgacgtgctggtgacgcgcactgctgacggcgagcgcacctttgccggcttcggcaaggccaggagcgaggagtacgccgactgcttcgtggacgccgaggcgctgcccgccgacgagatcaaggtacttcggaggggggatctgctcgtggggaggggggggaaagggaaggtgctgaggccggattgtcattggccgatggatatcgatccataccgggacccgggattgcttcgatcaaccactcgtcgggctggtcacttcccctgtcatcctgtgcacctcctctcatcgtccccgtgtgaccccggctcatcnnnnnnnnnntgatcaaccacttgtcgggcgcgtcactccccctgtcatcctgtgcacctcacccctcatcgtccccgtgtgaccccggctcatccccccacgcacagtcagcatcggtggtggtttcaggcacgctgggcctggcctaccccggctccgccgccgccatccggcgcgtggtggagctggcgcgggccggctccgccacgctcatcctggacgtgaactggcggcccgtcttctgggaggcccagggcgaggccgtggccaaggccaccatcctggacttcatagccgccgccgacctgctcaaggtgacggaggaggaggcggagtggctgtggggcatccccggcacccgcgcactggagcaccccgaggaggtgctggccaaactgccgggcgcgcgcggcgtgctggtgtcggcgggcgagtacggctcctcctatgccttctcctcccccggcggcaagatggccaacaccggcatcgtccccgtgctcaagatcaaggtctctgacaccaccggcgcgggagacgccttcctgggggggttcatctaccacatgctggccagcggggggttgccggcgctgctggccgacccggagaaggcgcgcgcctccgtcgagtttgccaccgcctgcggggccttcacctgtacgcagccgggcgccatcggggggcagcccaccctggagcaggccaaggagctcctggccaccaaggcctagaggtagaggcaggtggggtctgtgaggaaggtgcgttcctttcggctggagtagcccggaaggttatcatgaatagcttcactgctgctccccatcccacctcgcaccctgcacatggccaacactctgtcaaaacgttctgagattacatgcttgcgctctgaaaaccactggccccgccgttggaacacactgcggagcagctgcttcacagtgaggatggggctgagcagccaagctgggatggtatgtgttgggtctcagagcacggggtgcctatcataataaccatctttgacataggcataagctgccccgaccacgcactccagcttcaagtacacaacgcagtacgagtgccccataaatctttggctataaacaatctccccagatggcaaatccaattcccaatcagggcatacatgtacagcttgcacctcgcagcctgcagctccgtcattctcgccgccctccgggttctagtaccctggccgaagcgaggcaaacagctgcatgatgtcggccgcggtgagtcgcatgttgagtcccgccgcctcgccagaggcgtcctccccaaagctcgctgccaccagggcccgcttcttgttctgtagctccagcattcggaactcgatggtgtctgcagtagtaaaggtggcatcgagggtgcgtacatttgaggaatcaaagcacccttgtccgggtatctggtgtgccacgtcacagatgagttggcatgcttctcagtgggcatgcctcttgaccaccaggatcacagtcagtcccacccttccacacccaccgccaccggcgtgcctttcaccaggtagcgaatgacgtgcagcgtccgggtctgaccaatccggtgagccctgtcgatggcctgctcctccacctgttggtgtgggtgggacatgcggggtgtgacctcacaactttgcggtttggatttgtccatttgacttcctcgcataattgtagaactccaggctgcacagcatgcagatgcatgcttcggcgcctgctgcaccctactcacagtcggattccaccaggggtcaagcagctggggtggaaacagggagcgggagggggagggttcagtaacgtcagcaagggtgaaacttgtgatagaatgatggaataaggcaaggagaaagcctttgaggatgcaggttgggctgcaaacacaccccaaaaccctcaaggctcagaaatactgcgcccctggcgcccttgcaaggcaaccaccagcaggacaaaccatagtttacggcatcacaacagcaaggcctggtttacagattgcttcgacacacggacaagacaccccacttcacaatgccactacctcataaagccacgcccccaactcacgatgacgtggttggcgcaggtcaggttgactcccagggaggcagctttcagtgagataagcatgatctcagtttcaggatcggcagagaacttggcgatggcggctgcccgcgcatcgactgacatggtgccgtccaggcgctcaaaccggaagctgcgcgaggagggtccagggcactcagtgctgtgtgagacacttcgagccggttccagcttccccaacatcagatacatcactggcagtgctctttggtggaaacatgtccccctcattgagcctccctgtcagggacgattcagcctaggcagacacggcagatccacccatctgcatgcttagggtgcgatgccgtcgacccctttccccccagcacacaagaaacatacgctgaaatggtcagaggcccctccagcaggttgagcatggacgtccactggctgaagatgatgaccttgtcccgctcggcggcctccttttcggcttttggcgcggagggcgggaagagatcccacacgtcctgctcctnnnnnnnnnnctcgacccctttccccccactacacaacaaacatacgctgaaattttcagaggcccctccagcaggttgagcatggnnnnnnnnnncgaacttgggctccagtctcaggactggagcagggctgccgctgcatgctcggcccggtctcggctgcggttcagtgccaggctccggctttagctctcgtggtnnnnnnnnnntgaacttgggctccagtctcaggactgaagcagggcagccgctgcatgctcggcccggcctcggctgcggttcggtgccaggctccggctttagctctcgtggtgcttctgcccccggctcaggctttggctccagctttggcagcacccctggctcagactttggctccacccccggctcaggctttggctcgtgcttgacgggagcctcgtggcctgctgcctggccttcatcagcggccagagtacgagttcagcatccaggtgaggagcttgtgaagttcacaggagcaggccccccttcccaagcctacaggtcccaagcccaggatgcggcctgccttgcgatccccttcccaaccatcccgtgacaccactgcctcccacctgcagggctgccagcgcgcagcactcggtgtaggtagcgcatcaccgcccggatcttggcgctgtgcggctgggccacagcggctctccaggcggcagatgcgatctgggcctcggtggcgggcagtgccgcctcgggcgcagtgccctccacctccgcccgcgcctgnnnnnnnnnnccagtcgtcaaaaaagcctggcaatgtcgcagaggtacgatcaggtgcacagctgcagccttctcgaggtctnnnnnnnnnngggagtgtgcgtcgcgctcgcccagcacgctgccgcactgggggcagtgatacgctagctctctctctgcggggaggggtagggaactgggtcataaatgacttccaggcaaagcagagggccggctgctgaccttgcagcacgtccgtggggcagtcgtaaacaaagcctggcaatgtcgcagaggtataatgaggtgcacagctgcagccttctcgaggtcttcctttattccctcctgcaccaccacatacctgcgtggccatggccggcctccgtcaccttgctggcgatgcactggctgcagaagacgtggccgcaccccgatgccaccgggcactcggccaggtcgtggcagatggtgcactctggcgatggatttcgggagggagcgggtgagagtggcggcgctgttgaatgtgcgcaccgggttggaatccgggagggtccatgcctgaggcacgaattcacactgttcgccactcgacgcacaattggggcttctctgtgcggctcacatcctttgtgnnnnnnnnnncgtccatgcctgaggcaggaatccacactctgcgccactcgacgcacgattgcggcttctctgtgcggctcacatcctttgtgaaggctggccttgccggcaaaggctctcgaccgcaagagcacacatgtgtggcgcctggctagagaggctggcggccctccgctctcccccccatcgtgcacactgcctccccagcaggcagcaggcccactgctcgtaccgtgaggcccatgtgacagcagctcgacgagggcaagcctcttctcgctggtcagtcgcacggcagccgctttctgagagggagggcggcgaagtgggacgtagatgctcgctcgagctgggcagggggggtggaaaggggcgcggaccggctcagtccagcagccccatgcactcgagtcccaccnnnnnnnnnnctctgagagggatggaggcgagggtgggacgtaggcgctcgctcgagctgtgcaggggggtggaaaggggcgcggaccggctcactccagcagccccatgcactcgagtcccacctcctccggcgtgtatgtggcgaagtcggagcgcgcgttgcgcacgagctgggggtggtcgcaggcctggcgcaggcgcagcagctgctgcagcatgctcagcacattgaagcgcgtcggatccgcctcgctttgagccctctgttttgggaggaaaagggggcacgggcggggggcttggtgaccgacatcaatgcagcgcaaagagcaagacggctccggtgatgccgctacccattcattgcccgctgcacccacctgaaactcggtcttggcttccnnnnnnnnnnaggagatgttgctccccattcattgcccgccgcacccacctgaaactcggtcttggcttccgcctcgagctgctgataaaactcctcctcctgtttggagaaggtcagcgtcgtcagctcgatgcgcttttcgggcagcgacagcagcggcctgccgtcgatgatggtgcgcttggtccgccgcagcaggacaggctgcgagataggaacatggattcttgcatgagggatgaataagttccagggcgcttgacatatagcatgtagacgatgaccctgccctccatacatgggtaggagcactcgcggtgcatacgccgagggactgcacacctggaggatggcgtggaggtgccgcggagccctggcgccgttctcgggctgcaccgtctccttgatgaatgcctggaaggtcttcaactggtcgtaggggtgataccgctgcaggggatgagtcagagtttgtatggatcgagtgcgagcgagcttcttgaggtcagtgttgcccagggccgaacaacattatgggtggaaggcgggcacgacgagcacgacgtgcacgacagtttgttgcccaagcgaggcacgcacccttcctgcacaccgcactgtcactcaaagggtgcatcccagcggccgcttcccatccctccctccccctcatcaagacatcaccccctatcgcccccaccaggaacttgaagtaggagaagaggtcgttgatggagttctggatgggggtgccggagaggcaccagcgacagcgcgccctcagggcacaggccgcgtgcgccgtcagcgtcttggcgttcttgatgcactgcccctcgtccagcaccagccggtgccagcggatggcaaacaggtccccgccgggccgcctcaccacctgctcctcgccgtcgcggccgcgctttccagcctggcgcgccgccacgacgcagcgggtggggctctcgtgcgtcatgctgtggtaggtggtgaggaccacgctgtaggacgccagctcccgccgcagcacgcgcttgcctatnnnnnnnnnncagcccaacatgctctcgaggttggaaccaaagatgcaccccgtcgggcgcgtcggtgcgctcctgcgcacggtcaaccctacnnnnnnnnnnggggaaaagggtggagccagggaggagcctcatgcaccgccaatgcttgtgatgggagcccgacatgctttcgaggttggaaccaatgatgcaccctgtcgggggcgccggtgcgctcctgcgcacggtcaaccctacacccccaaaacacaaagatcctccaccttccacccaagaatgtcacctgggccatggtagatgtgcactgtgagccccgcctccggggtcgtcttgctcttgatctctgacgcccactggtgcaggacggaggtggggcacaccacgagggtccctccgtgcaggacctctggcggcggctccgcatcctccctttccggcgtccacagcacggtcttcccccgagcaacgcccggcggcggcgccgagggtccggcatcgtcgctgtcacccagcaggtcgacctcgnnnnnnnnnnactttccctcgtccacagcacggtcttcctccgagcggcgcccggcggcggcgccgagggtccggcgtcgtcgctgtcacccagcaggtcgacctcgatcacctccccccgcagcgagggggagccccttgccggcaagggctcccgcttgaccggggtcaaggccctgccggccccnnnnnnnnnnnnnnnnnnnnnnnnnnnnnnnnnnnnnnnnnnnnnnnnnnnnnnnnnnnnnnnnnttgccctgcctcctcccgggaaggcccgcgccgtcctggatgtccgcatgttgtaccccttcctccttgacgaggagggcactggaccctgccggatgctcctccccgcccgctctctcccgtgccgcgctccccctttccaaaggggatgcggatcggcgggcggtgtgcgtcggtagggcggcgatgatgagggcgatggtggtcagcgtcttgcccactccctgcagggaagggcaaacagaaggggagtgtcccaggtgtggcagctcgtgcttcctgtttgagggcggtcagcactagtgcgaggagcagcctgggtgccactgcaccatgccagccaacagacccccccacccccacgctctgacccacatacctggtcatccgccagcatgccgcccatcggcaggcacccgcgggtctcccgcgccaccatccagcccagcgccagccgctgatgagtcatcaggggcacccgcagcattccctgcggttggtcacgagcacatgattcatggatcctgcgcgctcacagaccacgacccagggtccccaccgctgcacccttcccactccctggcagtcacctggggcacatccatcgccacgccctggcccacggcggccagaccatcgatcacggcccgcgcggcggcggcgggcgcgatggcgccgcccgacccctcccgggacgctgagtacgggtgggggtacgcgcgatggaagggccgggcggggtagggcgggccggggccgaagccgccgggcgccggccggtcgaaggccgacggaatggccgcgccattgggccgcccggatccctggcggtccgtgtaccagccgggggaggggggctgctgccgcgggaccagggcctgggggcccgagcgcggggccgggtcctcaccagcctcgcgcggcgccggcgcggggaagtcccgggccccggcgccgcccccgctctnnnnnnnnnnagcccgagcgcggggccaggtcctcaccagcctcacgcggcgccggcgcagaggagtcccgggccccggcgccgcccccgctctgggcgtgggcggggaatagggtgccgcgccggtccccgctcctgggctctggctcggggaccgggcgcgagaggagcatggggttgaagggggccctgccccggtctgcgaagcggggcaggccagggaaggcgccggggcggggggaggcggagggcgccgcggcccgagggcctccctggcccggtcgggtcgtcccggggttgccctcgcggggcggcgccagcaggctctgcacccggtcgcccattgcctgcaccacgccaggcacccaggccctcaggaaggaggcggggaccttgcggccctgctccgcggggccgggtgccgggctggcgggacctgtggggccgtcgcggccagcttgggaggggtctgcctcggctcccacagggttgctttccagctcctcaccctcatcctcctccaggtcgctggacggggcgctcgagcccccaaaggagagtgagagccctgggccagggatgtttggccagtcctccgattcgccagaggtgtaggtttcacttcccatggcgctcagctgtggtgatacagagtggtcaggggtgagtagcagtgcattggagccgagacatgcatgttgtgccatgcactaccattctggggccacaaaacgcgcctgtgtgggcttgctggggagcgcaaggccgttgccgggctggcacccgcgcacaaggagaccctgcccatcgtcaaggacgcgagcccacaatcacggtgccatgacaagcattgggttgtgatgtctaggatgttctgccctcacccgcgttaatctctgcgaccaggacgattcctgtgttttggatccgacatcccagcacgcatggcatgcaggcactcacctggccccctcacctcccagggatgctcgccagaaacagagcacacccggcaagccaatatcatcacgtcggagaactctccatcaggctcaattggagtggctcgagaaggtctgtgacgaccgggcagcttggcgtcaggcttgaaaacacgcagctccgggctctcgctgcataacccagacgcggagccatgggtttcctggcggggctgcgcacagccatgcaccaggaacccatcatcgtgtggtcggtcatcatcggcggcacgggtgggttgtgccctgggtggcaaagcgggtctcgcaccggaggtgcccttcgacgcgaagcaagtgctgagctctggattgtggcgccgaatagcgtcccaaggagctcacgaacccgccgaatggcatgcaccgggtctcgatgtgttctactgcggactgggggacgtgcctgtgcgcccaggcaccctccaaaggaggtgaccccctcccctttcctcacacactcaggggtcatcctgccgctggtgggcccacccatccgtgaggccctggggtatggccgtagctaccctgcagcccctcccccgctcaaggacgtgctggacaggaacgtgaagacccccgccctggatgccaagtgagcactggcgggcgacatgcagccctcaccccgcaatggccatgagagggccactcttgtcggccgcacctcgggcacaccgcgacaccgcactggctccctgcctatttcgattccccaaggctccatgctctgcctgcccggtaacagtacactgctgtaatggtgcctcgacgctgtgtcggcgtagagcacattgtaaatcgtaagatcaaccaagacgcacagtctccagccctgtctggagctcatctagcattcccccttcgtcatcatcnnnnnnnnnngcagtacactgctgtaatggtgccttgacgctgtgtcggcttagaacacattgtaaatcgtaagatcaaccaagacnnnnnnnnnnnntccgcctcctctgccttggacagctgcacctgcggtgcagcgggcgcgatggcgccctgcttctcgccggccgccgctgttgtgccctggcccgcctcctcggcgcgcccaaccccagccgaggcggcggcagcagctgcggcggctctctcgcgcgccgcagctgaagcccgcgcaaactctgcctcctcgtcgacctcccgcaggtagccggaatcgtctgcggcagccaggtcgtctgccgccacaaagccctcctcttggaagatctcgcggcctgtgcacatggcaggggcggagtgttgccaggacgaggggtcaagtggcacagcgcatggcaatttgtgttccatttcagatgcaaagctgtnnnnnnnnnnggtcgccaggatgaggggtcaagtggcacagcgcatagcatttgtgttccatttcagatgcaaagctgtaggatgaccgcttacaggtcaagcaagccaaccaccaaccctttcccacaagttgccactcaccggtgaggagcccctttcttcgtcgctcctcctccttctccgcctgtgcctgcatcttgacagcatgcttcccagcacgccactgcagaaacgtctgttgggatgtgcgcaggggcggaggtgagcatcttctgcgtgacatgctttgccgtcatatcctgaggtgatggatgagaccctttcgcatgccggcttgcatgtgagtgcaaggtaggctcatgggcatccaccagggtccctctgcatacctcattgttgatgggcgtcttggcgtccaccttagcacgctcctcctcgatgatctcctccaccgacggttgctgcccaagaggatgcagggatggggttgcaaagaaggctgtgggtgcgttggtcgccatgtgcagggcccgcaaggatgagcacagcacaagaacagaccactcgacctcccccctttgcctgcagcagtgcactaaccaacgctgccagcacatgattcccatgaaaccaccacagaaatccaccacaacccacattagctgcctcggcctccagcagctccttcatctgagacttcatgatgtagcctggaggcagggcgtgtctgtacttgcactccttgccgttggggcattgccagaacctgcgagcaatttcagtgggatggtgattctgagggtgataatcgaactgggcaccatgcagggacatgtgnnnnnnnnnnnnnnnnnnnnnnnnnnnnnnnnnnnnnnnnnnnnnnnnnnnnnnnnnnnnnnnnnnnnntctggagtctcagttcccccatacagaggcgctcggtagcccagccgccctcccgtctgtgaaaggggacgccatttcgacgcaccagccgtactgcttcttctccacagcgtccaggaagtagcggcagacgatggcggtggggcgattcttgttctccagcccatgcttctcagcaattgccttttctagctgctccatgtcccactcgcccatccccccagactccccatcggcgccgtcgcggctgcggatgaggacgagggtggggaaggggtggactagggggacagactttcaagattccagccagagccatccagtgtccgcaggcagtaggtacaatcacatgacactcaaatggtgtagtctggatgcctattgagcacaccctgcattccagattccctcttccagcaagcccctgccaccctcagagggagcctgccgacaggcacgtcgctcacttgtcggagtagacatctgccttagccgtcttgcgctcgatgttcaggtcgtgagagaacttgcacttgaagcccttggtgcacttgccgtggcggtggaactcacacagcacggtcttggggtccactcctagagaggggagggagggggggggggcgcgggcgtgagaaatgccagcattgactccttcgaaagcctcatggggggctggagagactccagtccgctggagactgcccatgggccgagcgccannnnnnnnnncaggtgtgaatggacgtttcctcaatcgtttacttccctccaaaagcctggtacgactgctgtagccctgcagctccctccccccccccccccacnnnnnnnnnnatgaatgcactcatggcaaggacctgcacaccccagcatcccttcactattccataccttccccgagcttgggctgcttgatggtcagcatgaacaactcgtccagctccttctggcgctccatctcggcctttttcttgtcctgcgccattgtgcgaggggtgggtttattggaggcagcagccaggcaggatgcggctcctccatgggggggcgtccagcttgaagcacaaatcagcaagaggtgtgaatggccgcttcctcgatcttttagtcccttccaaaagcctggtacgactgcagtagccctgcagcttccctcccctcccagattgcaccacccagtcaggagaaccaacctttcgagatggctcctccaggcgctgctgtttgtgactgggctgctgggaagcctggatctgctggacatacttttgtaccacctgaacgggcggaagaggggagggaagctgcttcgttactatctggacgagaggcatgtcctccatcatctcacagcggaagcacttcctccagccaggccatgcaaggtattgcaagcactatcaaatgcctccagccttgcaactgcaccttggacttgctcttgttcttaaggccaaaggtcttgtcctctacgatctgcatggggcggccccgcgaggcttcgggactgaggtgtcagagtggatggccggggatgtcgcggcaatgcacacgtgccgtggtcgccgacatgaccccgtcgccgaccacttggaggcttttgcattttagactcgcccatgcgtaccttctgggtcgccgcagcattcttggtcgtggccttcttgggcggcatggcgaacgtgctgaaaccggcctggcgctgggattggggtgctgccgatgccggcgtcgatctaggaaggggtagggccacactgtgtcgtgcgcaggatgctgaaggggatccccttttgcatgcagcccgagttgccccgccttgtggatcctggcgcgcgcggcgactaggcggatggcccccatgttggttggagcctggcgggatgtctcggtgaccaccccgtcccttcctggatcttcgtgcccatgatggtgtacatgtgccctgctcacacatccgcaaggatcgcacagttctactgccacccccttcaagcatgccacgcagccaaaacatccgcggcgcccaaccccacgcactctcgccgctcaggccgctttgccgnnnnnnnnnnccgaggcgggcgaccaccgccagtttgggcggggggtggccgcctcgcacctggcccagatcgcgagcaccctgggcctgggcgcggcgctggtggccctgccggccggcgcgggtgggcccgtgcgcctgcgcatggcggccttcggcaccgcctacgcgctgcagttgacgcgcctcatcatggcgcacatggccaaggagccgttcagggtggcgggctggcccctggccgccatgggcctgcaggtggccaacgggctgctcccgggcgcagggccgctgctgcggccggcgccgctggccgccgccgtggcggccgtcgtcgtggcagggtacatccactacgtggtcagcgtgatcagggaggtgtgcgcctacctgggcatccgggcgctgaccatcacgcccaagctggaggccggcaaagcggcctgagcggcgagagtgcgggggggcgggcgccgtggatgtttcggctgcgtggcatgcttgaagggggtggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaagggacggggtgatcaccgcgacatccgccaggctccaaacaacatgggggccatccgcctggtcgcagcgcgcgccaggatccacaaggcggggcaacacgggcagcatgcaaaaggggaaccccttcggcatcctgcgcacgacacagtgtggcccta

SEQ ID NO: 46729 - DNA, 61 bp, Chlorella protothecoides
ctcaccgatgttgttgttgccgtcgttgtaatcaccaaagttgttattcccatggttccca

SEQ ID NO: 46730 - DNA, 76 bp, Chlorella protothecoides
cgacggattgtccttgacaagctgtgacccaggacctcaccaatgccttgtcccagacgccaaacggctgcacccc

SEQ ID NO: 46731 - DNA, 70 bp, Chlorella protothecoides
cttgtcccagacgccaaacggctgcacccccatggtggtctttatcgaacgctggtcgtgaatggtgcac

SEQ ID NO: 46732 - DNA, 62 bp, Chlorella protothecoides
acccggcgcgcagtctgcagctgaggatcggtgccgcgcctgcagactactttgggcacctg

SEQ ID NO: 46733 - DNA, 61 bp, Chlorella protothecoides
gtcatggagtttgcttttctaccagaatgcgcccggcatgctcgggaggtcggaggatgaa

SEQ ID NO: 46734 - DNA, 75 bp, Chlorella protothecoides
gggcagcgcgcaggctgccgagcgccgaggctcgccatgccccctcatcagcgctgcctaccatgacgtaccccc

SEQ ID NO: 46735 - DNA, 74 bp, Chlorella protothecoides
cagcagctccgacagcgtggcttgctgcggaaagggggggcgcgttgggaaacgagactcagagggaggggggt

SEQ ID NO: 46736 - DNA, 71 bp, Chlorella protothecoides
gggagcagagcagtgatgtcgtcgtgggcgacaccaccgagaaaccaaacaataaagaggggacatgggtg

SEQ ID NO: 46737 - DNA, 130 bp, Chlorella protothecoides
tcggggcgagctgcgacacagcaggggtctcacagactccgcggagggactccaccgggcgcatgtgcgcacgcaacgggtccccactcagtgcaacgtcgcggccgcctcctgcaggatctcccgggca

SEQ ID NO: 46738 - DNA, 372 bp, Chlorella protothecoides
  modified_base (138)..(316): a, c, t, g, unknown or other
cgccgagaacgagcgtgccgccaaggcagaggccgcgctgcgccgccgactcaaggtgggaaatgggaacaggggtgtcggtttttgcagatcaggcagactcaacggcctgcactaagttgccaggaattgactccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaggacggcgaggaggtcaccgacctgctggagctgccctctggcggcttcgctg

SEQ ID NO: 46739 - DNA, 61 bp, Chlorella protothecoides
ccttcttgccattagggagaatgtgccgggcgcatcgttaggtctcgagtcccagcccgag

SEQ ID NO: 46740 - DNA, 61 bp, Chlorella protothecoides
gcggaaacgaagcaggcctttgtgcgagtagggaccccccaccgaaacctcccgttgtgca

SEQ ID NO: 46741 - DNA, 126 bp, Chlorella protothecoides
tggcaggcagtatcttccggcggggctccttcacaggatgtatcagattgccagtatcggtacaatggagggggaatgcggccgattttgtagtgccatgtccagtgcatcgttggcaaaccgaga

SEQ ID NO: 46742 - DNA, 37109 bp, Chlorella protothecoides
  modified_base (134)..(143): a, c, t, g, unknown or other
  modified_base (1478)..(1487): a, c, t, g, unknown or other
  modified_base (1749)..(1758): a, c, t, g, unknown or other
  modified_base (3760)..(3769): a, c, t, g, unknown or other
  modified_base (4207)..(4216): a, c, t, g, unknown or other
  modified_base (4345)..(4354): a, c, t, g, unknown or other
  modified_base (5197)..(5206): a, c, t, g, unknown or other
  modified_base (5646)..(5655): a, c, t, g, unknown or other
  modified_base (6030)..(6039): a, c, t, g, unknown or other
  modified_base (6351)..(6360): a, c, t, g, unknown or other
  modified_base (6845)..(6854): a, c, t, g, unknown or other
  modified_base (7083)..(7092): a, c, t, g, unknown or other
  modified_base (8071)..(8080): a, c, t, g, unknown or other
  modified_base (8317)..(8326): a, c, t, g, unknown or other
  modified_base (8576)..(8585): a, c, t, g, unknown or other
  modified_base (9126)..(9135): a, c, t, g, unknown or other
  modified_base (9472)..(9481): a, c, t, g, unknown or other
  modified_base (10387)..(10396): a, c, t, g, unknown or other
  modified_base (11215)..(11224): a, c, t, g, unknown or other
  modified_base (11358)..(11367): a, c, t, g, unknown or other
  modified_base (11624)..(11633): a, c, t, g, unknown or other
  modified_base (12628)..(12637): a, c, t, g, unknown or other
  modified_base (13460)..(13469): a, c, t, g, unknown or other
  modified_base (13595)..(13604): a, c, t, g, unknown or other
  modified_base (14157)..(14166): a, c, t, g, unknown or other
  modified_base (14451)..(14460): a, c, t, g, unknown or other
  modified_base (14996)..(15005): a, c, t, g, unknown or other
  modified_base (15350)..(15359): a, c, t, g, unknown or other
  modified_base (15464)..(15473): a, c, t, g, unknown or other
  modified_base (15615)..(15624): a, c, t, g, unknown or other
  modified_base (15925)..(15934): a, c, t, g, unknown or other
  modified_base (16173)..(16182): a, c, t, g, unknown or other
  modified_base (16434)..(16443): a, c, t, g, unknown or other
  modified_base (16662)..(16671): a, c, t, g, unknown or other
  modified_base (16994)..(17003): a, c, t, g, unknown or other
  modified_base (17579)..(17588): a, c, t, g, unknown or other
  modified_base (17959)..(17968): a, c, t, g, unknown or other
  modified_base (18346)..(18355): a, c, t, g, unknown or other
  modified_base (18635)..(18644): a, c, t, g, unknown or other
  modified_base (19250)..(19259): a, c, t, g, unknown or other
  modified_base (19511)..(19520): a, c, t, g, unknown or other
  modified_base (20043)..(20052): a, c, t, g, unknown or other
  modified_base (20116)..(20207): a, c, t, g, unknown or other
  modified_base (20419)..(20428): a, c, t, g, unknown or other
  modified_base (21078)..(21087): a, c, t, g, unknown or other
  modified_base (21508)..(21517): a, c, t, g, unknown or other
  modified_base (21878)..(21887): a, c, t, g, unknown or other
  modified_base (22761)..(22770): a, c, t, g, unknown or other
  modified_base (23603)..(23612): a, c, t, g, unknown or other
  modified_base (23706)..(23715): a, c, t, g, unknown or other
  modified_base (24137)..(24146): a, c, t, g, unknown or other
  modified_base (24680)..(24689): a, c, t, g, unknown or other
  modified_base (24907)..(24943): a, c, t, g, unknown or other
  modified_base (25018)..(25027): a, c, t, g, unknown or other
  modified_base (25539)..(25548): a, c, t, g, unknown or other
  modified_base (25942)..(25951): a, c, t, g, unknown or other
  modified_base (26303)..(26312): a, c, t, g, unknown or other
  modified_base (27390)..(27399): a, c, t, g, unknown or other
  modified_base (27776)..(27785): a, c, t, g, unknown or other
  modified_base (28626)..(28635): a, c, t, g, unknown or other
  modified_base (29078)..(29087): a, c, t, g, unknown or other
  modified_base (29571)..(29580): a, c, t, g, unknown or other
  modified_base (29946)..(30165): a, c, t, g, unknown or other
  modified_base (30218)..(30227): a, c, t, g, unknown or other
  modified_base (30413)..(30422): a, c, t, g, unknown or other
  modified_base (30545)..(30554): a, c, t, g, unknown or other
  modified_base (30612)..(30621): a, c, t, g, unknown or other
  modified_base (31126)..(31135): a, c, t, g, unknown or other
  modified_base (31362)..(31371): a, c, t, g, unknown or other
  modified_base (31515)..(31587): a, c, t, g, unknown or other
  modified_base (31797)..(31806): a, c, t, g, unknown or other
  modified_base (32446)..(32532): a, c, t, g, unknown or other
  modified_base (32587)..(32596): a, c, t, g, unknown or other
  modified_base (32652)..(32661): a, c, t, g, unknown or other
  modified_base (32853)..(32875): a, c, t, g, unknown or other
  modified_base (33395)..(33404): a, c, t, g, unknown or other
  modified_base (34072)..(34081): a, c, t, g, unknown or other
  modified_base (34332)..(34341): a, c, t, g, unknown or other
  modified_base (34465)..(34474): a, c, t, g, unknown or other
  modified_base (35058)..(35067): a, c, t, g, unknown or other
  modified_base (36364)..(36373): a, c, t, g, unknown or other
  modified_base (36480)..(36489): a, c, t, g, unknown or other
ggcggcgcccccgtcgccgtccggcccgagcccaccggctgccacccccccgggccacggggcccctgcgccatggcccgccccttccatggcgacgacgccagggacctgtggcagcactgcctcgcccagcnnnnnnnnnntccaccggctgccagcccccccggccacggggcccctgcgccgcggcccgccccatccatggcgacgacgccggggacctgtggcagcactgcctcgcccagctgccaagagcccgggtggaagagcatggggccgcctatccggaaccgcacgcccacgggggcatagactgggccgccgggctggaaccaggcctggaaggggcgcaggcggatctcctgcaccagcaccagcgggtgcgccaggcgcagggccacccagtctctggaccccgggtccggcgatccccggctggaccagtagctcaggcccaggccaaaggtgacgcgctcctccggcagaagcaggttgatggcgctctcttcgcggtggtcggtggtggaggcgcccagcacgttgcgggccaggctggaggcggggtcggggcccaggcacgaaacaagcgccaccagcctgtggttgcgtgggggtggggtgcgcagtgagtatgcatccccgggggctgggggaaggagggcaggggcgggagagtcgatgggcgggcggagaggaaaggggcgccgccgttccattgccaggatcagggaccagcgctgggccagggcatgatctgagtgctgcaggactgagctggcgagtggcgctgggcggccaggccctcaggaggcagggctgctcgtcgaggcagaccgcagggctacctagcacccaccccagtcccagccccaagtatccctcagcactgcggcccctccgtgcccctcccaccgtttgtgtacccagaggcgagcctgctgcatgggcagggggccagggtcatgcacggaccgcatttccctgtctcccacgggcaggtggaccagtggatccgcgtccgagcgagggtgctccacgaccaggcgccccagcatcagcctgcgagcagcctcagccagcgtggggtacggctgcaggctggggtgtgccagccagacgtctgcctctcggactgcaagaacgcattgcaaggaacaagaaggtgtgacaggcggtcaccacgcagctgcggagcacttcagatcccctccagatggacagttctgaaaacgacccccgctcgaccctcaagctcatcaggagcaggacaggcatcctgaccgacctatggatctccagagacggcacaccagctccaccgcctgcagggcgtctgtgggaagtccagagaacaccctggccagcacctccacctgtttagggtggggcggtgagggagcgatgcactggaagaacggctgggtaacaactcgcatacttccttagtggtcccatgcatgcgacctccatgttgatannnnnnnnnngtagggtggggcggtgagggagcgaagcactggatgaacggctgggtaacaactcgcatagttccttggcggtcccatgcatgcgacctccatgttgatagattggcgcaccgggagaccctggatgtcgagagggccagacatggttgcaggcactgcgcctggtgccgagggaacctcgcttcaatcctactactactacatgcccttcctcaggtcacaggtttagccaagcgagccgtttaaggacctgaaaattccnnnnnnnnnncactcctacatgcccttcctcaggtcacaggttcagctaagcgagccgtttaaggacctgaaaattcccataatgagatgacatggacttgtcgtagatcttccgagagtctctcggctcctccagatcacttctccagcctgggtccccagagcgcgcgcgatgcgacactgaacaccgaaatggcctcgagaggacgcccaccatttccccactcaaggcctggcatactgagtggtgtacatgtgatataaggtctggatcagaatcatcctgatgtctgggcgccagctgaatcgcctgcgccaacagctggctcagcaagagcccgagccggccaccgacccctcctccagcgaggaggaagaagaggaggacagtggtcccagcaacccattcgcccttcttcaggactcggtaggttctgcatgccgcatggaggcgtgcatgtagctccacactttgttggagcctggtgcagcatggtgctttggtatgctgctccattgtgctctacctcctcaatccgcacgagtttgcttatcccagagctctcatggcagcattttcactgccagtgcccaatgtatatacctgcaggacgagtctgaagcagagagggaggcttcctcgcaggaagaggcatcggatgatgatgctgcgacgaccagcgccgtcggcgcgccacccacaaagcttgcccctgccttgcccaccccaaagcagccgtccaagcgccagcaagccagggaggaggaggacatcgacaaggttctggcggagctgggcatcgaccaaccccccacccctgcacataaaagcacgagtgcgcccagccctgacgggtcgcatgccccaactcgccccactgcggcgccggccaagcccctcctggccgtgaatatgcgggcgctgaaggcctccgacgagctgaaaaggatgtttggcgccgccgccgtgcacgaagacgccgaagatgccggcgctgcatacgcaggtgggggggggggcgccagagcctgggttggctttgtgcaggggacaggggtgagtatgagctgaagggagggctggctgggcgaaaatgtgtcaagatgaggtcgcgatcctccatgcacggatttctgggaggcattccagtctcctcaacaacgcctggtgctgcttggcatgtggttgccacgatttccgtggttgacttgcctcagatgttcatcattccacccttcttccaggcgccagccgccgcatccggcggctggctgcgcggggcctcctgcgcacccagaaactgaagcctggggtgctgattgaccctggggagcactggccgccttttgacggcggtttcaccatggaggccaggggccccactggttcccagaccttttcctacgtctactccgccggctaccaggtttgtgattgacccggagctgcctccactaccctgtggggatcaggcgggtatccattcgcgctgtggatgcacccgtacgaaacttgatcctcgccagtctgcttgacacgtggtcatgcttgtccacattgaggaacatggtactgcgatctgtgctacatccaccagagtccatgctttcctcccgacaggctgtccaggagctgtacaagcgctgccaggccagccacgaccccaacgccgtagctgctctgctgcatgtgaggcggcgaggggctgctacctgccttgttcctttttagggtgatccatgcatgcatgtatggagatggcagcggggatgccggccaggcccctgtattagatgttccgcccatgctcaccggcactatgctgcactcgcccaccctgcatcccacagacagcgccatatcatctggatgcgctgctgacgatgtatgacctgaatcgtgccatgggggagaatgctgctgcaggtgggaatcttatgactgcttgtgtcggggaggagcttgggtggagctgcttgattcagcaatgggtgggtgtgatggagtggtnnnnnnnnnngctgcttgtgtcggggaggagctcgggtggagcttcttggttcagcaatgggtgggtgtgatggagtggtgtgcatgcaaatgtgataaacttcaagactacgtcacatacttggatcgtccaatttgtccatgttgtctaccacttcagacatctggcgtgaagtcttgatctcaatccccgatcaagcttgagccctcctggaacccccctctcctcccccttgcacagatgagatgctgcaccggtgcctgtacgcgctggagatggcatggcacccatccttctcccccgcgacaggcaacagccatgtcgactactcggaaggcaacctccccctcttcctcgccctgtcccagtgcgtcttcttgtagtagggaattggtacttggggatggtcccttggtcggcacatgcactcgcccgccggatctgttnnnnnnnnnnctgttcatattgtctaccacgtcagacatctggcgtgaagtcgtgatctcaatcccccatcaagcttgagccctcctggcacccccctctcctcccctttgcacagatgagatgctgcaccggtgcctnnnnnnnnnnccttgtaggaggggattggtacttggggatggtcccttgggcggcacatgcactcgcccgccggatctgttggcctggtgcagcccaggagcgactgtttgtgccggattcaggaagggtgtgatgcttggagccatgcctccggagggtacccctccgacctctatgagcgtccccacccctcattcaaaggaccccctctccaccccctcccccacgccaggtacgcccagtgcctgagccggcggggcctgcaccggagcgcgctggaggtgtccaagctgctgctgggcctgaactcggaggaccccaccggcgcacgcttcagcatagactactacgcgctgcgcgccgggcagcaccggctggtgctgggcctggcggcgcaggggggcgccggcggctccatggccctcttccccaacattgccttctcctctgcactggcgcagcgcgccctgggcgccggcggcgaggccgacgacgcgctgctgagggcggtggccaccttccccaccgccgtgacggcgctggtggctcgcgcggaggggcgggggggtcggaccccggcctgggcgcagacgctgggccgccccttcttcgcgcaggcgaccagcgacagcgccaccctggaccatctggtggaggtctttgtcgagcgccagcacctcctgtggaaggtgtgccgctgtgcagtgtgtgtggacgcaacgcgatgcccctcctttcctgtcggagcccaacaccaggcgatgccctgctggtgtgatcaaccgtcgccttcgtgcaccgacttccctcgcgccgatccgcgaccctccccccacccccaacaccccaacnnnnnnnnnntgctgtgcagtgtgtgtggacgcaacgcggtgcccctccttttctgttggagcccaacaccaggcgatgccctactggtttgatcaactgtcgcctccgtgcaccgacttccctcatgccgatccgcgacccttcccccacccccaacaccccacacaccccctcccgcagccgccggcggtgctggagtggctgcatgggcagtgcgagcgcgctgccacctctgacgcccccctccccgacggcctgagccggggggactgggctgcggcgcgagaggccgcgtacccaccctgcgcagtcagtgcgtaccgcggcgtgctgcgcgcggcggacttctcggatgccgttgcgcgcctgcccccggaggaggtgcacggcctgggactgggcgccggcaacggggggctggaggacctggacctggcggacgtggaggnnnnnnnnnnggcgcgcctgcccccggaggaggtgcatggcctgggactgggcgccggcaatgggggcttggaggacctggacctggcggacgtggaggccgagctggcgggcgcggcgcgggcgggggggggcgggcccgcgccgatccctggggaggagctggcggaggggggcacgctgcgcgccctgctccgctccttcctcccctggctgaacgcgggggagcagccagactacgagggcgcggaggaggaggagcgggagtgagctgcacggggtggttgggcgcgagcaagggtggagctggcaagggtcggcgccgccgccgaccggagtggcgcaaggagggaccccgatctgtggggagcttcatgggggagagnnnnnnnnnnagagcggcgcaaggagggacgccgatctgtggggagcttcacgggggagagacccagccagctggaacgatgcatcccgcctgcttgttcagcgctgaaaccccgggcgcctgtcgtgcgctgactgaggtttccagggtggatgcctgctctgtgctgctgctgctgcccttccaggcattttcgaacccctgtcagaaggcgctccattcagagcccggggcaatgattggcagcggtcggggaagtcaggagcagcatgcagcatgcaaacaggctgcgctcatcgaggggccaaggggcgcccacacnnnnnnnnnntggggcaatgtcttggcagcggccggggaaggtcaggagcggcatgcagcgtgcaaacaggctgggctcatcgaggggccaaggggcgcccacacgctgaccaggcacctcccaggctgcatccctggccctgccgtgcatcaggagcattgacgctcacatccgcgagctcggcgagctggacccccataccacacacgctcactgcgccctgacccccgtgcgctgatgcgcgtggagctgcacaaaggcggcctcgtcgtcgctgctggaggacaggtcgtcgtcgtccgcctggatctgcagggagattggccgacgggggatcagggcgttggatttgaatgtgcagcactgcatcgaaggctcggctccgggctcattgtgtcgaggtccgacgtgcaaaacacaggcaaggaagctcaggggggcgtgcaggctggcggacccctgcgggcctccaggcgcagcgcattccgtaaatnnnnnnnnnntgaaggctcggctccgggctctcgaggtccgatgtgcaaaacacaggcaaggaagctccagggggcgagcaggctggcgggcccctgtgggcctccaggcgcagcgcattccgtaaatctcattatccgttcaagtctggcggctacccacatctttccctcgtctccccctcacccctccttttcaccatacaccatccccccacataccttccagccctcggcgacnnnnnnnnnnagctacccacatctttccctcgtctcccccccccctcctcttcaccatacacaacccccccacataccttccagccctcggcgacgagggcgaggcgcaccgccgtcagctccgcgccggccggcacaccctgctccgtgagcggggttccggcctccagctcccggccctggaacagcaggcgctcccaggggccctcaaatccctccagcgccagcaggtcggcgacgggggcccagccctgggctgccgcggtggccgtcagcacgtccgcgggggtggccgtgacggggtccaggtccagggcaatgtcgtccagcaggtcggtggtggtggccatggtctccttccagtataggctccagcgctcccgctgcagccgggggtgcacggtaaagccccccgccccgccccgcagccgggacaccagctgcagcgtggccccagacgcgatggcataggaggcaagggatgcgtcggcatccagggcgcgaccgccgtggaccaggcgcgcggcgtgggccgggacggagcctgtcgaggtggtggggaggtgtgccatggcttgaatcccgggacgcctgcggagcaaaggacaggccactcatcccctcaaaaccctgccaaataagtctgagtatcatttcagctcaccttcccggtcgcaggctgcctgcagcagcgtctgcacggtggcaccctgcccgacctctaccacgcaggtacggtcaccacgcacgagcagctgcatgctgggggactctcgatctttgatggggcagtgcagtggtcagagatgtggtgggaacgcaagtacgattactctgctcgcttatctttgctctggttgaggctccgatggggcagtcaaaccaggatggcgccctcgttgaccccccctggaggagccttcaacctttctttttcccagggcatcgtgtccctgccgaatgcgatccgcgatctaatctgattcttnnnnnnnnnnttgcaggaaccttcaacctttcttttccccggggcatcgtgtccctgcagaatgcgatccgcgatctaatctgattctttgcacctgcgttcgcggtgcgcgtgtccacaggaagccaaaacagagacaaatctcaggtgcaacctctttgcacactggtagcacgtccttgggacacacggagctccccttcgtcctcccgtggcgacgtgctctgcccgtacatgaccgcgaggnnnnnnnnnnactttgcacactggtagcacgtccttgggatacacggagctcccttcgtcctcccgtggtgacgtgctctgcccgtacatgaccgcgaggccgaccccctacgtcgtctaagcagcagcatgctccaatctcctcgcatccagaccactcgctcacacacggaacatggggtgctgtcccttgtccgccctgatgctacgagacggcgcagcgcctccccctcgccatgccgggccctgcccctgctccnnnnnnnnnngccgccctggtgcgacgagacggcgcagcgcctcctcctcgccatgccgggccctgcccctgctcccccgccggccggcgcctgcgcagacggcggccgactcctcctcgctgcacacccccctggacatcctgaagcatgacctggagtacatggagggggccctgggcgccctggtgacggtgcacgaggacctcgtggccgcgctgaacccccttgcggcgcagcgcatgctgatggaccttcatgccgagatgaaggtcctggaggtccagctccaggcggcccagctccagctggccgccaacgaggcagccctgcaggagagcgtgggcgtgctggactccatgctcgaccgcgtgagcaggccagggctgggcgcaaggcatgggcacgatggcgctggggcgggcgaccgcccggtgggcgccactccgcctgttgctcagtcccaagcacgggctccgggaatcctcgcccgaccacgcgagcaaatggccagcggcagcaacgaagcggcacccacctggcgtgccgtcgnnnnnnnnnntcgggcatgatggcagtggggcgggcgatcgcccggtgggtgccactccgcctgctgctcagtcccaagcacggggtccgggaatttttgcccgaccgcgcgagcgactggccagcggcagcgacgaagcggcacccacctggcgtgccgtcgccagcgccagcgttctgaggaagaagggggccatggccaccgcggaggtcctgggccaggtgagctgaggtgtggtgccacgttccggtggaggactcgatgcctcgaggtgtacacatcattcacagcctcctccaacctgccgccctgccgcggcgtctgcaggtctacctcctgttccggnnnnnnnnnntgcggaggtcctgggccaggtgagctggggtgtggtgccacgttcaggcggaggactcgatgcctcgaggtgtacacatcatccacagcctcctccaacctgccaccttgccccggcgtctgcaggtctacctcctgttccgggacgccagtggggcggtggcatgcatacaggaccagtgtgcccaccgggcctgccccctctcctccggcaagatcgtggacggctgcgcgcagtgcccctaccacggctggcagtatgatggggccggcggctgtgtctccatgccctccaccgtcttccagcaggtgaggccgcaggggtgtcggggaggctgtgcgtgcagccaggtactgcgcagggtacgcccgctgcttgtagtacctgctcctgttgaccgtgcctgaagcacagccagtgacccttccctccagggcatctctgtggacacgctgcccgtaaaggaagctgaggggaagctatgggtctggacctccgaccccaatgccgccgcttccaagtgacctcgatctgcaccccaccgggtgagcgctccctcccccctcccctcctcccgcggccccccttgttcgtccagtgatcgaccggcatttcattcacaccctggccatgcagccacatggcaatgtatacagatctggcaggcgcggctacctcgaatcttttccacccagtgctcttgcaatgctgtgtcacacgaggattccacaagacactgtgtggcaagggagcaggctgcaaggcacggccccagaaaggcctgtggtccgacggcctggggtgcgctcctcgacacgcggagtggtgggccttgcgctggggcagtgtgctgtgtgagcgcccaaaggaagcgaggacggtgcatttgagacaggtcgctaattnnnnnnnnnntacggagtggtgggccttgcgctgggtcagtgtgctgtgtgagagcccaaaggaagcgggacggtgcatttgagacaggtcgctaattcacaagcgtggccaggccgccatggtgccccacctcggcatgtaacggtgaccttcacgacgccgagcgcattctcatcccgtggcctgcgcagcctgatcccgcccgacatccgcatcagcgcgcgcgggctgccccactcgccgcgcctggcgcgccgccaggcgctgctgcagccacatgactgcaaacatgacgctggcgctctttgccaggccctcgtcagccaggaacgcgggaatactggcaagggggagggccagcacctcgatggcctcgcccgccaacctgtgtgacggcatgccatcaatggagcttggaggggatttggggggagggccagtcggagctgcgagtcagatctttgcacccccacctcccttcgggtttggtggaccctggggactgaaaggagtggcctccgacaagtatctcctcgtccagcccccccccccaaccatcaatgcttacccgagcccaccccgtgtgggcagagcctggctgtcgtccacctccgccaggaagagcgtcatgcgggggccgctgatgccgagggccgtgatgacgctggtgatcttctccaggtcagcctcctcgacgtggaagccgcactcctcgttgatctgcggcggggagaaccagggttggagtgcggcagatcaggttgggggaagtggaagggcgggcagagagggagatgtcagaacgcatcgcatgcgctatgaggatgnnnnnnnnnncgtcggagctgcgactcagatctttgcacccccacctctcttcgggtttggtggaccctggggattgaaaggattggcctccgacaagtatctcctcgtccggccccccccaaccatcaatgcttacccgagcnnnnnnnnnnctgccagccacccacctcctcctgcatgatcttggtcaggggtaggccgcgcttgtcgacaatgccggcgcagagctcgtaggtgaaccccacggacattgggggggtgggctcccctgctgcctccgccgcccgcatggcagcagcatacacctggccagtgtacggtcgcagggggcaggggggggacggtggatgtgcggggtctaaacctcttcccaccaagacctctcccctccattccaccccctcacgtnnnnnnnnnncggcagcagcatacacctggccgttgcagggtcgcaggggggcaggggggagccagtggatgtgcggggtctgaacctcttcctaccagcacctctcccctccattccaccccctcacgtgccactcacggcaggtctgaactggcggaccatgatgagcgagtccagacccttgtggagcagcacacaggcgacggaggggtgggactccaccgcgtcccagcgccgtttccggccgtccagttggtacatgatggagtagggcctgacaaacgcgctggactgcatgggctggagctcgacgccgctgctcatcctgccgggtggggtaggggccacaatccggggtaaaaagagggcccttctcgtcccacaactcactgcacctccatgtggcatgcttgagaggtaaggcacagcgctctgaaacccatttctgttccagcaacgcgcatcaggcccagtcgcctctcggcctggagttcattgagggtgcagctcacatcgcaaccctcctccaaggaatcatacgcccctcacctcctcagcgtggcctgcatagggtccccacccaccatcggcctgagaccatgtggataccagtcactgctcacggcatggctaaaactcatggtgtcgacaggaaaccctgcagcacctatttgtagagggagagcgaatgtgggatccctcttggggcactgaccagagaattgagcccgttggagttagcgacttcaattgattttcaatatgcaggatacattgcgttgtgaatctgcacgacaatatccgacagcgtactcgaggaagagcgggcttgttgcgcgcatgtgtggctgagcccggcggggcaccggtggaccgccggcgacaggcacaggttgtgccacaggcgacagagccgtgtagcaggcactctgcccagggacgatgcgagcattgcagccatggtgtttcaggccgattgagaaatgtcagagagggttttggtnnnnnnnnnnaaacgatgcgaccattgcagccatggtgtttcaggtcgattgagaaatgtcagagagggttttggtctcgggatgcaagggagtgactcatcctgacgcacgcaccagacatataccatgtaggacgattgctaacaagctgcacccacaccttggacttcaatctggagtttgtacatataagtactgcttcgatatgtgtcacaagtgcttgacgttggaatgttccgaagtatggggtctaaaagctgcccacccaactgccaatgtttttagtgctctcttttcgtcgcagggagggcatgccggattgaaagactgcgcaagacgtctgtcaatgcgtaacaagctttcatattcccagacggatatcccccaaaagccgcgcatgaagaatagcccccttgaacgtttccctaccttggccatcccggacgatatagatccccgccctgacgccagccgagtcgacccaaatccgaataaaagatgaaaacgacatgtatcgcttgaacgggctccgagagtccaacgccgggcagatccgattttgcgacttcgcatgaccttacctcgacgatggaactgcacgaggcagattgtcatccgaagtaggctgaggaacagtagagtatcgtgcacaggggcgatggaatgcatcaagcacacatcggtcgtgctgggcatgtggggagcgtaatcgggtggcaaagaggcaggccgcgattgctggcagatggcgacgggcaaagcgccgtggcctaggcaaaaagcggcggggggccggcccacgtcaagaagcccgccgccctccaggatgccnnnnnnnnnngttgaggcggtgcacatcaggggaacatgaccacgctggagggcctcctacgacggcatgagaaagttcgccccggcggcgtgagagctttgacgggcctcgacaagcccaccccaggagactgtnnnnnnnnnnacgatcagcagcagcactagggaggattccaagaagccggccgttccgtcacctgtgccgcctgtacagcctgctaccctaccacgaaagatttgaggcggtgcacatcaggggggaacatgaccaggcttgagggcctactacggcggcatgagaaacttcaccccggcggcgtgagagctttgactggcctcgacaagcccaccccaggagactgtatcgatgcgccagtctcctgagtgggccgtctccatgcccgtcagcccctgcactctcacacggccgttatgacacttctcaagctggcgcaacaggccctacagcctggtcagggtccccctacatgcgccgcctcaaatcactggaggtacaaagcaggccgactagacggcagagatgccatagcacgcccggctcctggacctttccatgtggctgcgggtcgcatgacccggggggctggcatcttgacatgggcatggcctccgccgcctcttgcccaggccacggcaccttttggtagcgaccttggcaagaatcgcggcctgcctcnnnnnnnnnnaccgtctcgaatcactggaggtacgaagcaggccgaccagacggcagagatgccatagcacgcccggctcctggatctttccatgcggctgcgagtcgcaggactcggggggctggcatcttgacatgggcatggcccccgccgcctcttgcccaggccacggcgccttttcgtcgcgaccttggcaagaatcgcggcctgcctcttcgccgcgctcttgcgcttcaggcaggtgagcttgtcgctatgtgcgatggcctccggatgagcaccatcttaagcgcnnnnnnnnnngcaggcaggtgagcttgtcccgatgtgcgttggcctccggatgagcaccatcttaagcgcatgagcaggcaaacagggcgggcagggtttgtgggtggccagcattgaaaggaaagtgacaacggtcggagccaaaggatgaagagcagtctgttgcccaagctccagagcggtttgtgcagcccgagtcggatcccacccatgccgccgcctttgacattccgacctcccgggtacgctgcattccgactccttgacgcatgctgggactcaccttaatattacaagagggcaggatggcggtaagggaggcgcggggcaccacgcggtgtggacggggagcgtacgtgcagatgaggcgcacacaccgcgaccaaaagggatggctcctgtttttgtgtacggaatagatgccaagaaaaggctagacaagagcgatcaatcgaaaccccagtctcacggtcttatcaaagaagcgcgggcgcccccccgggtccgtctgatctcgcatggctgccctcagctgcactcagcannnnnnnnnntttatcaaacaagcgcgggcgccccccagggtcggtctgatttcgcatggctgccctcagctgcactcagcatgtccttgcacccagaactcatggtcaccagtcgcgagccggtgtcgcgaccatcgatctagctgcgcgtcatgacgattggtaggctcagatacctggacagccgtgcgatcacacaggacatggaggagcaagggtatgggttgtccttacaagctgtaatgcaatgcctgcatcagaggctgcagtccatacaactcgatggagtccctgctcaaacctgaagctcgctcaggggcgccccctgggccacacccttccagtctcggccgnnnnnnnnnnataggctcagatacctggacagccgtgcggtcacacaggatatggaggggcaaggggatgggtcgtcactataggctgtaatgcaatgcctgcatcagaggctgnnnnnnnnnntccctccagactcatggccatgaggaatctgccctggcgccgcacgttagacgcgtcttcttgagcacagaaaacgtcgtctccgctcgccagacttcccacaccagctcacccctgtagccattcagttctcggtcccacnnnnnnnnnncccctccagactcatgggctattaggaatctgccctggcgccgcacatcagtcgcgtcttcttgagcacagacgtcgtcgtctccacctggcagacttcccacaccagctcccccctgtagccatttagtactcggtcccaccattgttcagagcccctacatggtgaactccaggctggtcggcggctgctcttgccctgattctggcagggctgattccagcaagcccagcgccaaggcctggcgcacccttccccctaaccttgccgaccaccatccgatccgattccttgggtcgannnnnnnnnnacacccctctccctaaccttgccaaccaccatccgatccgattccttgggtcgaagatgggatccatgcatggtgggctcgaccacatgctggcagctgtgcagggagacaaggcggctgcagcaaactgaggtgacctgcgagatgtgcatggtgttgctattcccagcaaagtgccatgtgagctttcatccccatgtaacgcttacactccaatgctactcacccacaccaaggtnnnnnnnnnngttcctagcaaagtgccgtgagagctttcatccccatgtaacgctgtcactccaatgctactcacccacaccaaggtgctgaagcaatcaacaatccacgcactgacacaggcagcaccgtggcatccaaggccggcaccagcaggaggcgcggcaaggagccggtgccagttgcaggacccccacttgatacccctcctgacctggcctcggcatccgcagagcctgacactcaaggactggacagtgccnnnnnnnnnncgccagtggcataacccccgcttcatacacctcctgacctggcctcggcatctgcggagcctgacactcagggactggacagtgccactggcccacaccctgtggacagtagcagcgcacctgcgccgccgctgagcaccccaggcaaccccggccttcacctgtgagcgatacacggtcaacgcgaaatacaagcggctggcggcatgggttcttctnnnnnnnnnncttggtcggctgataccatccccgacgagcggcacatcaaggccaaagcacgccgcaccccctcccatcttgagaagggaggcggcaagagggggcagattgcttcaaagggcacatgaacgccaaggttaccttgttacctgctgcgattctcatgttcataagcgatcagcttagcaaccaggcaggcagagcgtgtgcgtggcagcacttacttcggacgggcgagggagaggacgggaccgccctcctgtcgcacccccccctggggccgcttgaggcctccacgggcgggggcaccgggcacgaccgagacatgcagnnnnnnnnnntttggtcagctgataccattctctacgagctgcacatcaaggccaaagcacgcctcacccgctcccgtcttgagagggggttttggcgagaggcggcagtctgcttcaacgggcatattaaggccgaggtgaccttgcaccttgtgcgattcccatgttcataagtgatcagcttagcaaccaggcaggctgagcgtgtgaggggtagcacttacttcggacgggtgagggggaggacgggaccgccctcccgtcgcactccccctggggccgcttgaggcctccacgggtgggggcaccgggcacgaccgagacatgcagactacgttccatcgtcctcgtactcgataatctaccagtgcactgacaactcaacataacaatctgcatcgcgcggcgcgttcgcaccccagcggggcatggcagagtctcgcagagttcgaaaacctgtcgaccaaacgaggggctctcacaacgcgaccacgcattgaaacttgtagaaaattgctttttaaacgatttttgagggtggagtgttggtacaagtgggagttgcgacttctcccggggggtggnnnnnnnnnnacggggcatggcagagtctcgcaaagttcgaaaatctgtcgaccaaacgaggggccctcacaacgcgaccacgcattaaaacttctagaaaagggcttatccaacgatgtttgagaggggtatgtcggtagatgtgggagttgcgacttctcccggggggtggaacatgttcttgaattgtattccccactgccgtgactgacgtgcacagaggagtcgagggggtctgtgtggtgatgctgaccggatgacttccgcgtggggaagggagatgaaaacgcgcgcttcaggctcatggagatcaatggcttgattcatgtcctatacggaagctggaaacgttgggtttcgtcttccgtgagtggtatggnnnnnnnnnnagaataatattccccgctaccgtgactgacgtgcacagaggagttgaggggtcccgtgcggtaatgctgaccggatgacttccgcgtgggaaaatgagatgaaaaagcgcacttcaggctcacggagatcaatggcttgattcatgtcctgtacggaagctggaaatgttgggtttcgtcttccgtgagtggtatggaccgtgtatgtctggaccggcacgggcgctccggattcccgccacggaacctccgaagccgtcccgctttgccccggcaaaagcgggcaggtcacaatcctttgcattgcccagggttcatctagtatgcctcagaatacagtagaggggcccacggatctgagcgctttctaatacgagnnnnnnnnnntcaggtcgcaatcctgtgcattgcccagggttcatctagtatgactcagaatacaatagagggacccacggatctgagcgctttctaatacgaggcgctgcctcgcactcaatctagaggcgaaccaagttggcggaagggtgttcgtgcctcaagttgaaggatggcttcggcggtcaggatccctgccatcctgagcggactagtgctgctgctcgcaggatgtgccttcgcggtgagcctgggtggacttgaatcgatgccgactctgcgtcagccnnnnnnnnnngtagaggcgaaccaagtaggcggaagggtgtgcgtgcctcaagttgaaggatggcttcagcggtcaggagccctgccatcctgagcggactagtgctgctgctcctaagatgtgccttcgcggtgagcctgggtgcacttgaatcgatgccgactctgcgtcagccgtactgtgtgctcccctgcttcacattcctcaccaccttccctccatgaaagcaggccacctgcagctccacattcgtcgcgctacccagtgcaatgtaagtagagtgctgcgtccaacagttgggaattccgtccaactctggtgatgtccctgcacgtacaactccgtcccgcccaaggatccggctggcgggttatctgtccagagccctccctgcaaacttgctccctcagtcacgctgatacacattgcatccgtgccgcgtcattgatgaatatctgaacacctttgtgatttcatggttctccacatgctcgactcctcgcagcctgggggtgcatgtgtatctcatgacagcagacaatgcagatgccatttgcaagggagtagtgcgtgagggatgtgaatgacagcgcatccgcttacacatcacaggannnnnnnnnntctggggccgcatgtgtatcttatgacagtagacaatgtagatgccatttgcaagtgagtagtgcgtgagggatgtgagtgacagcgcatccgcttacacatcacaggatggacccaggttacgtcataaataacgaggcgtatcattcagcgtgtaagaagccaggcacccctcaggctgtgcacgtccacctcccccgatgagcaggcacgagggctttgccaaggcagggtctatccgcacctctaccnnnnnnnnnngtaggcgtatcattcagcgtgtaacaagccatgcacccatcaggctgtgcacgtacacctcccccgatgagcaggcacgagagcttcgccaaggcagggtctatccgcacctctacccttcacatcatgggactgtccatgtcagccatccgtgtgagcaacttggagatcctgtcagctcgatccacggtgatccttacagccgtcgagtgcctgaagccgggccagaaggcgtgtggcagacagcaatggcaacattggctccggcaacaagggcaagaacaaccttggcacgaagaacgttgggaatgacatcattggtaagcaagggttgggacgtacgaagcatgcaggatgtgcacagccgctgcatgcctaatcacgatggcctgatgtttgaggcaatggtacctttgcaggtaactccaatctgggcactgccaactggggcaataacaacgatggcaagggcaatcgctgcttcaacaaaactggagaccgcaaggtcctcaatgactgcagnnnnnnnnnntgatggcaagggcgatcgctgctgcaacaaaattggagaccgcaaggtcctcaatgactgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctccacccccgcctgccagaaagttcccacccccgcctgccagaaagttcccaccaccacccaccaagatgtccccaccgccgcccgccaagaagtccccaccgcctccctctaaagcgcctcctccgcctcccacaatcatgagccctcatcctccaccaagttccccaccaccttcatcaccacctccacccagccccccctctccgnnnnnnnnnngtcacccccccgcctgccaagaaatctccagcaccgcctgccagaaagttcccaccgccacccaccaagatgtccccaccgccgcccgccaagaagtccccaccgcctccctctaaagcgcctcctccgcctcccataaccatgagcccccatcctccaccaagttccccaccaccttcgtcaccacctccacccagccccccctctccgcctttgccaccacctccaccaagccccccttctccaccgccttcaccaccttcacccagcccgcccttcccatcgcctccaccacctccacccacaagccctcctccaccaccggcgcgtacgatggccacactcgagtttggcgctcctgtcgccggaaaggtatccctcacttgtcgcgtagtgacatcgggatacattcccaccaaggttgaatgctacacttacacagcttactttgacaccacgttttatgacagagatagagccccgactttttccaccatcaccatctcaagcgcatctgaggaggaattggttatgacaagctattcctatggggttgcattgatttatggcgataatactaatctcaaggaaattttgccactgaccatgctcaatcctacaccaccccctccgggaggtattccccctcnnnnnnnnnngggttctatgacagagatagatccccgacttcttccaccatcaccatctcaagcgcagctgaggaggaatcggtcatgacaaactatgcctacggggttgcattgatctatggcgatgattctaacctcaaggaaattttgccgctgaccatgctcaatcctgcaccaccccctccgggaggtattccccctccaccagcgtttgggtccatcaccggaagcgttactaaagctgggcaggacttcgccttgtatatcgaccttggacagctctcaccggaccgcgtgaatcaagcctacttcacttcagatggtgctttgcttgactacacttctgttccctttaccacgagcccaatgacctggactccgcggctacaggcagacttcgtgccttttgcatcctatatcgaagtggtgnnnnnnnnnngaagagcccaatgacctggactccgcggctgcaggcagactttgtgccttttgcatcctatatcgaagtggtggccgtgaagtatggcgtggcaagctcaaactacttgaccctgcactggtaggcctggtggaccactgttcttccatccaggtgtggtttcatgtgtgcatgagactcttgtgattgcctttcttgtaaccatccgtagagagattggtcgatcagcttgccccagatgcaacaagagttggtgtaacagaagcttgggtagatcaagtggcgtacgaggctctcttccctggctgttctctcagaaccggaatgtgaccttaacctggtccgtcaacaaccaacctgnnnnnnnnnnaattgcttttcgtgtaaccatccgtacagagatgggtcgatcagcttgccccagatgcagcaagagttggtgtaagagaagcttgggtaggtcgagtggcgtatgaggctctcttccctggctgtcctctcagaaccggaatgtggccttaacctggtccgtcaacaaccaacctgttggaacggcgagggtaagatgttgcaatagagccttggaggcatggatatccttctaggcggggcagaaattccgcggccctagggtctgctttgcatgagacgcaacgttccgctgccgttggtaaaacccagcgaactgcgcatctcttggcgctttgggcactcgagtgacagcaaagtccctcccaagaatgcacgacaacgatgccggggcatcgatgcggagatggtctcactgaagtggatttgagacgagcagccaaggctgcacgcgcagtgtggaccctgtctaggattccacgagaaaatttgtccagctgccttggcggagggttggagcgcttgctggtcgaagccggttccgcttgccctacaattcactcgccctcacctcacgtacgcctttctttcactcctccaaaagttggcaagatgcaggtccactttcgtcgcgatacccagtttgatgtgacgatagggttgtattcatgggggccatttcttgctctaccgaggagcgccctggcccaattaaaaccccttgcgcattgtgctcgggctggtaccccagcttttagtgggttggcgtacctgccgcctgagacctgcacatgcacaccatctttgagtacgccacttggtcaggtcctgcatcccgaagcttttgcatcattccacacatgttcggctccttnnnnnnnnnnatttgagcactcgagtgacagcaaaggccctcctaagaattcatggcgacgatgcgggggcatcgatgcggagatggtctcactgaagtggatttgagacgagcagccaaggctgcacgcgcagcgtggaccctcttaaggattccacgagaaagtttgtccagctgccttgacggagggttggagcgcttgctggggtcggcgtacctgccgcctgagacatgcacatgcataccatctttgagtacaccacttggtcaggtcctgcatccccatgatgttgcatcattccacacatgttcggctccttggtgtgtaggagcccacatccaccccacgacggtcaacagtgcaggtgccgtttgcaagtgagtgtcgcaccgcaatgtgagctcgttttgttggtctgaagggtggctatcacagccatgtccccgttttcagtgtggggattgaatttcctagctgtggccgggcgatgagggcatggcgccgtgcatgtgaccggagggaaagagagaagggtgcggctggcgtaatcgccagaacatgcagtcctgcctgtgaagaaacaagaccatatggcaggtacaggtgcactattggggaagcttctgtcaaatctttagacagaaagacacgtctagttgtcagggaatgcctctgcttccgagggaagaagggacgaccatgagaagtcgagtggaacaagaccccactcgctgaggcggaggtctctctctggtgaacgagggcaacccctcagtcaagcctgagagtgggttctcaatgcaggtgagggttgactcctttgcaaaaggccgggatgccgnnnnnnnnnnatttgcaagttagtgtcgcaccgcaatgtgagctcatattgttggtctgaagggtggctatcgcagccatgtccccgttttcagtgtggggatnnnnnnnnnnaatcttcagacagaaagacaagtctagttgtctgggaatgcctctccttccgaggaagaagggacgaccatttgaagtcgagtggaacaagagcccacttgttgaggcggaggtctctctctggtgaaagagggcaaccctcagccacgcctgaaaatgggttctcaatgcaggtaaggattgactcctttgcaaaaggccgggatgccgtccaaggaggaaggagggctgcctcctgaccagaggcggcagaagtatctgccttgggcacagagggtgggtatgattgacgggggcgaaggcttctttacaaacggtagcaaagttatcactggtggaggtactctccttgttgagggagactacacctctcttgctgaggggtggggggggctcctgtgggctggaggcagcttcttgannnnnnnnnnggggtgggtttgatttgaggggggcgaaggcttctttgcaaacggtagcagagttctcactggtggaggtagtctccttcttgaggggagattacacctctcttgctgaggggtgggggaggctcctgtgggctggaggcagcttcttgattggaggcggaggtgctggcttgcgagaggggggaggcggctttttggtcggaggcgggggtgcaggcttatgggaagggggtggaggtttcttgctaggtggtggagatgccggcttgcgagatgggggtggtgccttcctgtttggaggcggtggtgatcgactaggggagggtggcggcggcttcttggcgggaggcgtgtgtgttggcgtgggaggagggggaggcagtgatggctggggagaagggggaggcagtgatggcttgggagaggggggcggaggcgtcatgacaggggttgatggtgggatgttaggtggtgggcttggtaccttggcaggtgatggcgacggtggggggtggaataccgagggtggctctnnnnnnnnnncctaggggagggtggcggcggcttcttggtgggaggcgggtgtgttggcgtgggaggagggggcggagatggcttgggagaggggggaggcagtgatggcttgggagaggggggtggaggcgtcatgacaggggttggtggtgggatagtaggtggtgggcttggcaccttggcaggtgatggcgatggtggggggtggaataccgagggtggctctnnnnnnnnnnnnnnnnnnnnnnnnnnnnnnnnnnnnnactcgcttgggccggcacgggtgcaatggctggggagggtgaggaggggtatggggcaggggcaggggagggggnnnnnnnnnnggtaggcgcaggtgagggaccagcagcaggaggaggattgggggcggagggtggacggagaggcgggggggggcggggggctgttggagggctgacaatgggccgtgggctgggtgggtggacaggtggagggctgacagtgggctgtgggctgggtgggtggacaagtggaggggaaggtggaggcatcaggatcagagtggcctccgttttcagtgccgcagtgctgcactgagctccgtcttgagccactaggtcgttgcacgcaatgcttgtcccccagttcccgttcccaatgttgtcatcccccaggttgagattgcctgcatgttgggtgcttgtccggtgctcaggtctgggcagactcggaggcaggccggggcgggatcatgtcaagatcactcacctctgttgtagctgccttggttgctgtgcccaatgttgtggaaacccatattgtcgttgcccaggttcccgttctcgtccattgcacatcgtgccgagcccttggnnnnnnnnnnatcaaaatcactcacctctgttgtagctgccttgattgctgtgcccgatgttgtgaaaccccatattgtcgttgcccaggttcccattcccgtccattgcacatcgtgccgcgcccttggcaaggcactcgaccacagcgagggaaggacagcgataggtcttggttgggttgcacttctccagcgtctcagggtggagcgtgccaatctggaactgactgaatggagcatccggagccacgttgactgactcccaataccctgctcctgcgtatcccttcctcctgccacatatatatgggtgggatggctttgtcagggcggtgttggggagacttgaagttttcggctcaaggcctaaatccctgatggagtgccagacaacagctctccnnnnnnnnnnatatagggatgggatggggttgtcaaagaggtgttggggagacttgaagatttcggctcaaggccgaatcccctgatggagtgccagacaacagctctccaaagcactacggatgcacccgtccgcaaccccctaaaacgttgctagaggcaccgaccggcaatacgcgtctgggtccatggaggagaccaggaagagggtgcccaggtatctgttgcaataagattgtggggatggtgtggtctcatcgttgaacgggggagggtcccctaacaagtttaccaactgcatgtggttcactgcgtccccccacacggggcgcccactcactctattgtgggcagagccaggnnnnnnnnnntgggggagggttccctaacaagttcaacaactgcatgttgttcactgcgtgcccccacacggggcgcccactcactctatcgtgggcagagccaggatggggttgcgggggtcgcacagatttggagggggtggtggtggtgatgggggcggggatggggggggcggaggagagggtggaggaaaggcagccaagggaattgtctcaactgtttttaggttctctatcgggcatggagcatctgacgcccagttgttgcacacgattttatcgcccgtgttattggagcccatgttgaggtatccgctgttgccattccctgcagtggaacagagcggtagacgtgatcaattacacatcacgccaggcattggttaaaggaagatggcactccactgcgacctaccatggttgtaggtgcctctattgttgtttccgtaattatatttgccgtcgttgttgcttcccaaattcccatagtcccagtctgtctcgcaggtatcaactcctttgggatagcacatgactagctcaataaagtagcagtagttatccggttcagtgggtgtgcagatgccacgggtgcttggatttattgtgcttactgtatacttcgggaaagggtatcgggtggacatcgcgtggatcatctcgacggcttgaccatcgtatcccttgagcctgtggggcgtggatggtcgtggggagtgggcgagagccccaaggtgtctgtgccaggcccttggcatttttggcaggccagcaccaaccgtctggatttgattacacactagacaacccctcgtcagcatctacagaggccatgggatcacgtctcaccggcagtaggcctcagattttccagagcctagcagatatacagtgccgagatacctggacgggaagaggagtgagtgttgtgctgagctgctcttattttgggacttcaggagtcaagctctggccggcacccgttggccaacgtgcaagtcatacaaacacatccacacataaattgcgagcacaagggcagtcagaggaaccgggctcaagacatacaaccccccggctcggaaannnnnnnnnngcgtctcaccggcagtaggcctcagatcttccagagcctagcagatacacagtgccgaggtacctggaagggaagaggagtgagtgttgtgctgagcggctcttatttcgggacttcaggagtcaagctttggccggcacccgttggccagcgtgcaaggcatacaaacacatccacgcatacattacgagcacaagggcagtcagaggaaccgaactcaagacatacaaccccccggctcggaaagctcactcgagggtgggcagggcgtagaatccgaccctcgggtcgcagtcagcctgcgtgggtgcagggcttctatttcaatctcaaaaccgtgggggtccgtgtcagccgagattcgagaagcctccgcnnnnnnnnnngtttcaatctcaacaccgtgggattcgtgtcagccgagattcgagaagcctccgccataacgcgaggcaagacactgtcaccccacctgtgcctcccgcacccatgcgccagcgagaagcacgcctagaacgagtgctgtcgaaaagcatcccatgcctagcaacgcatgacaatcaaattacaacttcgagccagtggaatcactccaaggctatacagattggtgttggaaagtgtactgacgtcgagatggcaagtgtacgtggcagcagcccttccgggccggctacattgactcggggtgccggattcctccggaggccggaaaaccttgtccacatgaactaactgctccactcgcgcattcactcaaaatgcgatcgagaacactcgtgacaagggcccagcgctccgcaagcacggcatcacgatctggcacaccatgtggacccggccttgccggccactgcctggggaacgagatagaacagatgaatggtggccttaaccgcatgtgggcagctctgcaggaggacaaggtgatcgcatcaagcagaggtgagctagggatgtgcatggtgtcgctgttcccccaaatggcaatctgtgcttctcctcggtgtcacacagtaaactaatcacttcccgtccatttcatgctcctgaacataccgacttgtgtcacattgcaccaagatctttgccgcatcctaggctaggcccaacaggaggcgcagcaggggtcggtaccagtggcaggccagcgccttgacacctcgaccagttgggtacaatcatctagggagctcgacacctgagaaccggacagtgccaccgccnnnnnnnnnncgacacctcgaccagctgggtgcaatcatgtagagagcttgacacctgagaaccggacagtgccaccgccctgcaccttgtggacagtaagagcacgccttccccactgctgagcatcacaggtaacccagtccgccaccagagggccaatcggtgttcactgatgcagaccaaaggctgtcgccccggagcaccctgaaggcggacaaggcagtgcacgatgaccccgatgccctctcccagctcctgacagcagatgtaaagcctgagatgcccgcctggtcaatcgataccaaaaccatacgggcaccgggtctgaagcagagcatgctgcatccgctcccttcttgaggggggggggggcaaggtgcagcagagtgatgaagtctggaaatgaaggccaggtgacagttcacctgctgtgtatccattgttctgatggnnnnnnnnnntaaggtgcagcagagtgatgaagtttggaaatgaaggccaggtgacaggtcacctgctgtgtatccattgtttttatgggcttgactagcaattaggcaagcagtgcgtatatgggcagcattgccttcggacgggtgaaggctgtggggcaacacccaaccccgttcggccccgacaggggggcgccaggcgcgaccgatatgtgcagactgcgttccatcgcccttgcactcgctactctgccctttctatggtaaactaacagagcattacctctcgtgcggctgacgtgcatcaccgatttgccacagcgaaggtctcgcgaattggcggaatgtggattctgcctaagggggaactctcgaagtctgatcaagcgatgatcaacgattataactcatttgaaaacatgggcgtgctcgagtgccacccgactgggcatttggtagtgttccgggatggcaaagtccaggaaatatccannnnnnnnnncaacattacctcacgtgcggctgacgtgcataaccgacttgccacagcaaaggtctcgcgaattggcggaatgtgaattctgcctgaggggaactctcgaagcctgatcaagcgatgatgaacgattaaaactcatttgaaaacacgggcgggctcgagtgccatccgactgggcatttggtagtgctccgggatggcaaagtccaggaaatatccaaagggaactcactctcaggcatggccctatgcacacgccgcaggcacgagtgcagtacgaagttttgaagcgcatggtataccataaaatcgtcgtcgagagattataagcgcaaatcatgtccgaggggtgtgcgagtctgccgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccccggcccatgagctcacgcctgtgtcacgctgtgtccaggactccattnnnnnnnnnnggcatccaaggatctggcaaaagtacttttgctgagagtctgatgaccgggagtcggctcaagtgggcgcgcgtcaaccaggtgcgggagacgtagccccgcgtgtgttgattcgggtaccgccactccctgccagctccggccatgagctcaaccctgtgtcacgctgtgtccaggactccattnnnnnnnnnncgacagcgccctcggaggccccgctgccctgcccagcgcgccgccccctcccaccacaggcgcactgcgtggtcctggacctcccccacaagacctgcgtggagcgcgtgctccgtcgcacgnnnnnnnnnncgccgcacggaaggccctgcaggcgggcaccagcgtgatcgtggaccgctgcaacccnnnnnnnnnnggccgcacggacggccctgcaggcagacaccagcgtgatcgtggaccgctgcaaccccaaccccaagcagcgcgaggatttctgccggctagccggggagctgggcgtccaggtgggtcccgctgcgcgccagggccgggcgtgcgctgggaggcggaacgtgccctgcagccttggcagcgccttcggaggccccgctgccctgcccagcgcgctgccccctcccaccgcaggtgcactgcgtggtcctggacctcccccacaatacctgcgtggagcgcgtgctccgtcgcacggcgcacgaggggggctttcagggcgttgagcacgccaagcacggtgcggggctggccaagggggagggggccgtggaagggttgccctgggggaggggcaggggcctgaggcgctgtcgcacggcctgggtctgcccgggcagtgggtgctgagtgcctccggatgtgcttctggagttgggagggccagcatccacctgtcatccagnnnnnnnnnncggaagggttgcccctgggggagggggagcggcctgaggcgctgtcgcccggcctggatctgcccgggcagtgggtgctggatgcctccggatgtgcttctggaggtgggagggccagcatccacctgtcatccagctgaagcctgccagcctcgcctgcgacatcgcccccctccttccccctccacctgcagtcggggcgatgcaccgccttctgactgccgcgnnnnnnnnnnggcctcgcctgcgacatcctccccctccttccccatccacatgcagtgggggcgatgcaccgccttctgactgccgcggggcccccaggcccgaaggagggcatgcgcagcgtgatcacctgccgaaaccccgccgaggcggcnnnnnnnnnnnnnnnnnnnnnnnnnnnnnnnnnnnnnnnnnnnnnnnnnnnnnnnnnnnnnnnnnnnnnnnnncatccaccgcttcatgcagacgccccgcggcggggaggcggccggcggggccttgccgtgccgcgcgcctcggacccaggcggcagcccccgggcaaggcggcagggcggtgcctccgctggcgcagcggtcgggggggcttgtgcactccccaatgctccctccctctgggagtgactccgccacacaaaaccctgccccgggtgcacnnnnnnnnnngacgctccctccctctgggagcggcaccgccacacaaaaccctgccccgggtgcacctggcggcggcggcgacggcgagagccggcgggagagcggcaggcccgcacggtcaaccacgccgcgtgggaatgccctggcgctcctcatggaggcctccaggaaagagcggcgcgcgagtgcgcaggacgccggggcgaggggcgtggcgcgggagggcggcgtgcagatcctggtcgccaccccgccccgccccagcgccgagggcgaggcccctggcaccccggcgccggtcccgggccccgcgggtggggacttgcagccgcccgccgactgcggcttcgagttctcggcgttctcgcgctccgcggcgggcagggcgctggtgtcggccgcgcgcgatcccacccggtgagcagggaggcgtgcactccctgattcgggtcgctgtgctgccggccttgtcgctgtttgcagcgtgccctcctggtcaacagagcccggcctggggttggacaagaacggtgagctgaggtgcagggcatgccgaggtgctgctgacggctgcccctcctccaacacgcgacgtcgcccccaaagagccacagggacggacgtcatcttccatgatgagctctgcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgggtgtctaggtctcgaaaagatgacgtcgatctatgtcatcattcacctcnnnnnnnnnntttgggtgtttaggtctcgaaaaacatgacgtcgatctatgtcatcattcatctcnnnnnnnnnngttgacaagaacggtgagctgaggtacagggcatgccgaggtgctgccgacggctgcccctcctccaacacgcgaggtcgccccccaaagagccacagggatggacgtcatcttccatgatgagctctgcgtgggtgtgctcgacaaggtacaggtagtgggaaggggctggcactggaccaagtcagtgannnnnnnnnnnnnnnnnnnnnnngccccgctctcccgccccccacccccaccgcagtaccccaaggccagggcgcatgccctcgtcctcgccagggagccggatctcctgtcggtgcacgatctcaggcagcgccacgtctcgctcctcagacacatgctggtgaggttcgcgggcctcctctgggaggcgacctgggttgaggctgcgacgagcaggctggagttgtgtgaacagatccagaccaccgcatgcgctgaggcacgcacagcgctcgcatgtattcctcgcgcccctgccccatgccatgtcaggagagggcacgcgggtggagtgcagccagggcagccgaggaccccagcctgccggccttcaggtgtggctttcacgcgctgccgtccatgccccagcttcacctgcacgtcatctcccaggtgaggggattcatgtaggctacttcaaggggcgtggtcagggactcaggtgtccatgagcatacttcttcgtcagggagggactcttggtgcgcctgatgaggaattgnnnnnnnnnnataggctacttcaatgggcgtgggcagggactcaggtgtccatgagcatatttcttcgtcagggtgggactcttggtgcgcctgatgaggaattgctaccgggtgtgttgccccttgaccgccaggccagacctgccctctcccacctacgcacccccaggactttgacagcccttgcttgaagaccaagcagcactacaactccttcaccacccccttcttcctggacgcggagcggtgggtcatcccgcggctgcaggcagggggccgtctgagcgcccaggaccttcggggtgcagcagagcacatcaggcgccccctggcctgccaccggtgcgggcagggccttgcaaacatgccgaaggtgaaggaccacctgcacgcgtgccgcgcagcgctggcgtgatcgtgggctgggcgagcttgcactggtgtgctgctgagaggaacaacgtgcacacctccactgggactccctcgagtatctcggttgccactggaatccggtgacgccagtgcaaagcgggttggatttcagtttggtctcaaggcgggatcttggacagctgtatacggcgcagcccggtggatgtgtccatgtctgcatgccagaaagatgcatccctcacattgcggagaccctcagattgcggggatcacacgatccnnnnnnnnnnacgagcttgcagtggtgtgcgtctgagtggaagaacgtgcacacctccactgggactccctcgagtacctcgggtgccactggaatccggtgacgccagggcaaagcgggttggatttcagtctggcctcaaggcgggatcttggacagctgtatatggcgcagcccggtgcatgtgtccatgcgtgcacgccagaaggatgcatcccggacattgcggggaccctcagattgcggggatcacacgatccnnnnnnnnnncacggaggtgagagggaagcgtgcagccccatgccaggcgatcgccgaaagcaagtaccaacactgaggagccatggtctcgccgttcaggcgccttgccagaatctcacccacctctgcctcnnnnnnnnnnttttccgtctccagcagagcacgtttcagatgcttgatctggtacttgagcttctcattctccttcagcagctgtacttggtgggggggcatggaggtgagggggaagcgtgcagccccatgctagacgatcgccagtagcaagcaccaacactgaggagccatgaactcgccgttcaggcaccttgccagaatctcacccacctctgcctctcgcctttccgctggggtgccctggctgccaggctgaacctgagcactggctgctgtgatcaaggagcaggcatcggggcattcttatcgagtacaagtcgcaggcctccaagcacgagaggttcattcgaagtacccaatcgcaccattgattgtgccttctagagccgcaatgcgctgctcggcctgagcagtacgcgcctcgaggctggctagaatggcctcctccgtggccatggcaccacccgtcgcccagtcaccccaggactgatgaccagtactctggactcagaacacgaaatcacgttcaactcaagttcccctgacaatctctgtctcctaaagcccaataagctggtggagagtccgcgnnnnnnnnnntacgaaatcacgttcaactcaaattcccctgacaatccctgcctcccaaagcccaataagctggtggagagtccgcgtcaagggatttccccgctgctgtgactgctgggcttcaccatgaaactcgggtacaggcctgagagcagctgacctgccgatggggattctgacccagcagagcgatgatgtgcaaattgacaagcccccagcgttgcgatgggcgcattgcatacccttccccacgtgagcgcggcatgtcgcggggctcgtcgtcctctcgtgtgtgacacaggctcttgagctcggcctgtccacgaccccattatggtcctgctccaggcttcttgcctgctggcaggcctcctccttgcgctttacatatttagaaggaggtggggcacgatggggcatggagtggggagggttgcgaggcttgcggtgatgtcgtacttatgtcggtccgtcgaccatccgcagggtgcttggctgggtgctgagccgcgtggctcgatccaagcacgtcagactgtctctgggaagcatttactttttcggcatcgaagacctgaagctgagcctcctcaaggtgaggttgagacccagtcaccaccaggcaggagggcgccggttgtttggtcaggtgcaacggggcatggggaggtgccttggggttggggtttctccagctgagggcctgggaagtcgcatctgacgtcgcggattccttactttgacagccctcaccttcgcgaccccttaaacccccaacccccctttccaaccttcaggggcccatccctttgaccgtgaggataggcaagatcgtgctctggccagccgatgccacgtcggagacgggggtgctcagcctcctgactgggggcctgccccgcatcccgctgctcctgcgagacgtgcgcgtcctgctcgaggcgggccaatgcaccgacaggccagacaggagcgcccccgggaccgatgcgccgcccaagccccagccgggcggtggcggccgtggggccctgtcgcgcgccgtttctcttctccagttcctggccatccacgtagaggacctgaccatcagcgatgcggtgcgaggcgtgccggggttggtatagtgctgttgatgcagggcacatgcctcctgcgtctatttccttggcctcggaggggaggtcccaggccgggggccctgacctgggttcatcgcatcggcatggaaggggggaagtggcaccatgccaatgctcccgctcctcctctgcgctggaattcccggtcaagattccaggcttcnnnnnnnnnngcctggcctgggttcatcgcatgggcatggaaggggtggagtggcaccacgccaatgctcccgctcctcctctgccctggaattcccggtcaagattccaggcttcnnnnnnnnnntgcacaggacacgggcctctccttcagcctgggctcgctcaagctgacgctggatggcccgcagcgcctgcagctccagggcctgggtctgacgcaccgcgccctgcccaaggcccccctcttctccctggaccggctcagcctgtgccacgcgcgcgaggcggggctggccgcctgcctggcgcgccggcgcctgggccccctcgacctcgagctgggcgagctgcgactagacgtgggcgacgacgtgctcctgggcgacatccacctgctggaaagcgtggcacggcggctgcaggggccggggaagggcggcgtcgacgcctcgggcgacggcgcgccggcagacacgagacaggcgcgctcgccccctccgcgaaggcatccgtccggccccgccatgctctcctcccccgcgccttgggcgctggacggcggcacggccagcctggcctcgctggaagtccgggtcgaggctgggggcgcggcggcgggcctgcgcctgaccggactgggggccagcgtgcagaccccggcggccatgggcccgctggcggcggcgctgcccggcggccagccccagctggcgctgcgtgtctcgctggcgggcgcgggcgtcg

SEQ ID NO: 46743 - DNA, 506 bp, Chlorella protothecoides
  modified_base (257)..(379): a, c, t, g, unknown or other
cgacgcgccccgcacagcgtgcggcggccgccgcggccgcgctggcggccaagaccacgatcttcccccccagcgacgcggcgcgggccggcgtgcgcgtcgtgcgcgcggtgcagctgcccggcagcttcgtggtgaccttcccccgcgcctaccacgccggcttctccgcggggacgcacctgggggaggccgtcaacttcgcgcttgacgactggtggccccacgcgttgcgggcgcgggcggcgcaccgcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggagcgcggcgagggaaatggacgcggcgggccgccatgtggcgggcgggcgggcggcgacgcgacgctgcgcccgctgcgcgccgcctttctcgcgcatgtgcgcgcgcggcacgcggagcgcg

SEQ ID NO: 46744 - DNA, 67 bp, Chlorella protothecoides
ggttgcgcttcacctgtgcattgtggcgggtgtgggggtaggggggcggatgggtaggtggatgggg

SEQ ID NO: 46745 - DNA, 61 bp, Chlorella protothecoides
gagccgggtctacgcgtccggcttgagaccttgaacaaccctccgacagtcgggatcgcag

SEQ ID NO: 46746 - DNA, 76 bp, Chlorella protothecoides
gtgtcgggcacagcgcattgcgcctgcagatgggagggagtggggatgtgaggctaagagtcatgcggtggtaggc

SEQ ID NO: 46747 - DNA, 66 bp, Chlorella protothecoides
acctcctccgcgtcctgcccccgcccggcgaggacgcgccgggcgggggcaggacgcggaggaggt

SEQ ID NO: 46748 - DNA, 61 bp, Chlorella protothecoides
catccggatggtggaggagttcgagcggcgaaagcaggctggccgggcggacgcggatgcg

SEQ ID NO: 46749 - DNA, 63 bp, Chlorella protothecoides
aggcgctgtttgggacagcactcaagcctcctcaagccgatagcatagacagggagtcctaat

SEQ ID NO: 46750 - DNA, 8742 bp, Chlorella protothecoides
  modified_base (128)..(219): a, c, t, g, unknown or other
  modified_base (624)..(633): a, c, t, g, unknown or other
  modified_base (858)..(867): a, c, t, g, unknown or other
  modified_base (953)..(962): a, c, t, g, unknown or other
  modified_base (1734)..(1743): a, c, t, g, unknown or other
  modified_base (2301)..(2310): a, c, t, g, unknown or other
  modified_base (3223)..(3232): a, c, t, g, unknown or other
  modified_base (5025)..(5034): a, c, t, g, unknown or other
  modified_base (5547)..(5556): a, c, t, g, unknown or other
  modified_base (5919)..(5928): a, c, t, g, unknown or other
  modified_base (6103)..(6112): a, c, t, g, unknown or other
  modified_base (6403)..(6412): a, c, t, g, unknown or other
  modified_base (7332)..(7341): a, c, t, g, unknown or other
  modified_base (7864)..(7873): a, c, t, g, unknown or other
  modified_base (8315)..(8324): a, c, t, g, unknown or other
caccgccgcgacctacaacgcgctgatcggcgcgtgccgtgcgccggggcagtacgcgaccgcgcgcgagtacgaacgcgagatggcgcgcgcggggctgcccgccgacgactttacgctttccgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgacgggcagtgggaggcagcgctggacgccatgcgcgccgcgcgcgccacggggcgccgtccaggtgtgcaggcgcacaacgcgctgctgcgcacgctggccggcggcgcgcagtggcgccacgcgcgcgcggtgctggagggcatggccggcggggaggggccggcgccggacgccgcctcgtttgcagccctgatcctggcgctggagcgggggggaaagtaccaggaggcctgggaggcgtacaaccagctgcaggcaagagggtgtggaagtctatgtgtgggatggtgggtgtgggtgggaggagggttgataaagtggctgcaaggggccctgatgaagctttggctgaactcaggagggtgtctggcgctgtgggtgcctgagtgcacctgcgnnnnnnnnnnggggtgtgggtgggaggagggttgataatgtggctgtaaggggccctgaagaagctgtggctgaactcaggagggtgtttggcgctgtgggtgcctgagtgcacctgcgtgacaggtgctgctcagacgtgaggggatcctcctttcctggccacctgcaccatttcgcttgccgcaaacagcctcgccacccaaaatccatgcgcacaggcgcggggcctgaannnnnnnnnnattcaaccagctcaaggtgagggcgagcttggagtggaagggaggcgtgctctgtagggtcgctacccatgacaagtcctcggggnnnnnnnnnnttggccacctgcaccgtttgcttgccgcaaacagcctcgccacccaaatccatgcgcacaggcgcggggcctgaagccgacaagcgacacgctgtgtgcgctgctgagagcctgcgaggcggggcagcaatgggagcgcgccatcgacctcttcaaccagctcaaggtgagggcgggcttggaatggaagggaggcgtgctctggagggtcgctacccatgacaagtcctcggggccctcactgtcacatctcccccccgtccaacacccactttcccatttccaccccgcgcgcaggcccaggcccaggcggagctgccgccctcgggcatggccctgcggtccatcctctactccatgcccctgctgatgcatgcgctgccgccaagcctggtggccacggctcgagctgccgtggagtctgggcgcaagacgcgagcgctgctggactaaggggacggagggtcgtggggtttggtgcccggcttgccgcacgcggtgtatcgcgggctgtcggtctgatgggatgagccctagaagtgtgcaggccccgagtcacaacaggagcccatgccttctgaccaagtgccgcttggcttttaatggtgctcatgactggttgctcgaatcgcttcggcaaagcagaagaggcaaagcgtaagatgaaagcgagcggggtgagcaacgagcttgtcactgcaaaagcacccggggtaaaaagcacatgcatctcacagccgcggctgtggattggcttgacttcagaaagcannnnnnnnnnctgccgcttggctttcaatggtgctcatgactggttgctcaaatcgcttcggcaaagcagaaaaggcaaagcgtaagatgaaagcgagcggggtgagcaaagagcttgtcactgcaaagcacccggggaaaaaagcacatgcatctcacagccgaggctgtggattggcttgacttcagaaagcatggagaggctgagctccgtggcataggctctgagtctctgccatcgagcagccccacaaaagggacgaagggcctgcaatggcccccctcaacacgatgtcaacacgatgtcagaagcaggactcctggatggcggtgatgacatacagaccggtccagtaggccacaagcaagcccaggcctgctggcccctgggcccacaccaggatcgcagccgcccacacgctcagcacactgcccacgtactgggggtgggacacgacgttgaaggggaagccctccacccagggcaccttgtggcccagcttgaagccataatataccccggcgtgcccgattgcgcggtagatgccgatgttcagcgcctggcatnnnnnnnnnncccctccacccagggcaccttgtgccccagcttgaagccatagtacaccccggcgtgcccgattgcacggtagatgccgatgttcagcgcctggcatgagggggcgggtgggggtggggtgccgtgagccgcctcaagaagggtttggcacgatgcacatcctcctgtacttgaaacagcaaaaaacactacacatgtcgtccctggccgcctaggaatctcccatggcaaatggcatccccccggtacctggccggcagccagcaagaccagggagatgccagccgcaaagggggaaatgctccccaggatgactccctcaggctttttgacgctgtaccagtagatcaccgaggagaattgcagcactgcaagctccagagtgaggtgaggggtgcgcggctgtgagcaggtgaggccactctccagagaggggttccagcaaagtcggccaccactggcctcaccccccggcgacgtacccttgaggagccaagctgctgtctcgaatctttgaacagacttctttccgaacgtttttagccatgtcgagctgttgaaccagatgtaggcatacaggaggtggggaagggctagggtggtgatcacataccagtcctcgggcgtcgcgttgctgatcgacgacatcgtggatctcaggtgatccaacttcaatccaggcttacagccttgcgggttggatgcctctgcctcttgatcaggtgggtcgaaggggtgtatccgaatcagggcgcaggcgccggcggtgagtagaggtggtgaagcggcgcagcaaggagggcaacttcatgcatgctcaggccaagacaaaacaaagtctgacagaattccctcgccattggtttttcttgaatcccatcccctattgtagaggcagcatcgcaaacaaagnnnnnnnnnntcaagacaaaacaaagcctgacagaattccctcgccattgtttttccttgaatcccatctcctattgtagaggcagcatcgcaaacaaagttgtaacttgttgaagtgaggctctggaatatatacaccttactactttgatgggtgaaaatatgcactgcagatgcgcacctcctcgcattgtctggcatacccaatcaaggcatgattgcgtgtgcccaccttgacaggcttcaggtctcataaaaccggcttgctgtcaccagggactggcgggaaggccggtgctgctgtggtggtgagtaagggccgatctcccatcgcaacgtgcagaaacgagccgagagtctgggtagcatctcacctcctgttctatttacatcatccattacaaatgtaatcgcatcgcatgacatccagggaccgccgcacgctgcccacctcccccttcgacgggggaggtccccaggcgcaccccattccgatccgcagtccgggtgggagcagtccaggctcatttcgtagcccacccttcggtcaagatacagcatcagatacagggcgcaatgccgccgggtcctatggcacgcacgccttcctgctgcagggcacggggagctggcacccggcggtgggatctttacagtccaaagtacaggccttgcaggtgggcaaggggcggcacgctagaagccatgggatgcatatgccagaagctggcgtggcacggtgcagggatgcacggcgtgctgatgggaggagtgctgcgccggattcgggggagcagcacaccgagctagggttccgagagagggaggccgggcccggcgcccagcggcgggaaccccagggcattacgacatgccatgcatgcaaatctccatgcctcgtaacccctggcgtacccgcaggagaaggccccggagtcggcgctgacggcctccctgctgcaggacgaggaggcttgccccgccagcccgcccgagggcgcctgggcgccctccagccccctgcaccccgcctccagcctcatgcgctccacgagccgcaccacgcgcctgctcagcaccatccaggaggagcaggccgccgtggaggccaaggtggcgacggcgcgccgcgcccccccccccgccagcaaggccatcgtgtttgggctggtcaacgctgtggccgcggtgcccagcttgatcgcctacgccgccatcgtgttcaaggtggggagggcgtcgaagggtggaggggatgagtgtgatgccaggccctggggagcgccgagttctccccctgccctttgagaggtaacctgcagctccccatcccaagtcttcatcttccattccgactccccacaggacccgatctacaccccctacctggacctcctctgcaagttcttcttcgtttccagtgccgttcaccagctggttttcgtctgcctctccgccctgccctttgccatcggccaggtccaggacgtgggcctcatcttcatgtccgccatggccacgagcatcgcgggcctggccacggcacagggacagggcgctgacgtggcgctgggcaccagcctgctgacaatgaccatcagcaccaccgtggtcggcattgccaccctcctcgtcggtgagcgggaggcgaggcgggagggatccagtgcatgtactttggatgcggtgggtgggatgaaggggttgaggagtgtggatgagagcccacgcaggcgccttcggcgatgggcgcgtcacaggccaccgaatgcaccctgcactgtgcgacggcaattccggcgnnnnnnnnnnttgagggccatgcaggcgccatcggcgatgggtgcgtcacaggccaccgaatgtaccctgcactgtgcgacggcaattccggcgctgacacacaaccctggggcgggcggtgtggaggtgcacctgctcgctgacgcctactctgaggcatagaggacccaatccattcccactcccgcccattccacccagcgcggtacaaactggcggagctggttcagtacctgcccctccccgtcatcggagggtacctcggcttcgtcggctacttctgcattgcctcgggtctggcgctggcatgcagcgttagcatcgacacgatctccaggtgatgccctcggggggaaaaggcgtagcatactctgcacgccttgcttagctctcggcctgtcaagtacacgagaaaatggtgggaaaaggggtcgcatatcccaacgcaaacccagtgtatgctcggcagctggggcatcacattgtcactaagtgggttgcctccctttcaaggcccctccnnnnnnnnnngaaggcgtagtgtactctgtacgcctttcttagctctcggcctgtcaagtacacgagaaaatggtggggaaaggggtcgcatatcccaccgcaaacccagtgtatgctcggcaactggggcatcatactgtcactgagtgggttgcctccctttcaaggcccctcctccacacatcctcgctctcagctgggccaacctggcgagcgtggacgccctcaccaagctggtccccgccgtgctttccacgctggccatgatcatgaccatggagcacttcaaccacccgctggcgctgtccggggtactcacggccatcgtcctcgcgttccatgcggggcgcctgctgctgggctggagcctgnnnnnnnnnngctcacaaccatcgtcctcgcgttccacgcggggcgcctgctgctgggctggagcctggaggatgccatggacaagggctgggtgctgaggccggcggtgagcttgtgggggggggagggattacggtgcgcaaccttcccattatgcatgtggggtgacgctgcaagggaccannnnnnnnnnaggggggttacggtgcgcaaccttcccatcatgcatgtggggtgacgctgcaagggaccaggggcgctgtgggatggaccttcttcttgggtggggtctgccaaccggatttagcagactttgtcgccgctgtgtccttgggctggtctgaggaggtgcagcgccctcattctaacagatgcggtccgtcggacccactcgatccacggatgcacctgaatgataccccccactccttgcaacccaattcccaggaaggtaagcaggagttctgggagctgtggtctctgnnnnnnnnnnggcaggtgcagcgccctcattctaacagatgcgatccgtcagacccactcgatccacggatgcaactaaattataacccccactccttgcaacccaattaccaggagggcaagcaggagttctgggagctgtggtctctgttcaacatccatgacttcaagctggacggtatcttggtctcggcgggtcttgcccagataggcaaagtaagtggggcgagggctgcatgctatgcgcttcgtgatgggttcccatgttccacaggggtcatgaaagtgggaatacgccacagccgggcccctgctccaccaaccacgccgtgcctcgcgcttgccccgcagctggcgggcctgatcctggtggtgtgcttcggcagctgcatggacgtggctgccatccagcaggacctgccggagcgcattgatttcgaccacgagctggtcaccgtgggtgagcaggggattgtgggtagatagggagaagagtgtgggaacacggtcttcttgatggggtattggcagggggtatgggagggggtcatgggcggatgtgggagacagcttggcaataatatcggggatgtatgtgccagcccgaggcatgggccatgccctcgagagttccccggctccaactgccctttcaatcccccaggagtctccaatgtgatcaccgggctgactggcattgggtactgcggcagctacatcttcaggtgaggcagcgtatgtcagaggttcggcttgccctggttcctcattcaggagcctgtccagcctcagatgcccgtcggctcagaatccagcggtggactcgcggcctgctgctgatggatgtatggctaggttcgcatcccagggcctaccccaccacccctcccttccctctgtccacccaacagccagaccatcttcacgatnnnnnnnnnnccagatgcccttcggctcagaatccagcggtggactcgcagcctgctgctgctggacgtatggctaggctcgcatcccagggcataccccaccacccctcccttccctctatccacccaacagccagaccatcttcacgatgcgggcgggcgtcttcagccgctggaacgggatcatggtggcggccgtggagctcaccatcttcctcctccccttctccatcgtccaggtatgcggggtggcgttcttttgtagccaaggtctgcagtgggctcactcctcgcactctgggccttccgccgggatgcatttggagctgcgggttgcatcctgccgcctagttgtttgcattttgtgtatcacgccgaccaactagtcaaggacgcaatgacgacccctcagtgcatttcccacagactgcttccccgccactccccatcagccctcctctcctccaaccctcttcccctcccccacccccccccgcaaccatagtacatgcccaacttcttcttcggcgcgnnnnnnnnnnctttcccatagactgcttccccgccactccccgttagccctcccctcctccaaccctctccccccccccaccgtagtacatgcccaacttcttcttcggcgcgctcctggtctggtttggcgtcgagatctcgcgcgactggctcttcctttctttctacaagctgacgcgcattgagtacggcgtgctctggctcacctttgcctttgtcatgcagctgggcctagaaggcggcatctttgccggcatcgtgctggccacgctctacttcacctacgcctacgcccagagccagatcagcggcctcaggatcttccacaccatgaccagcaacgtcgttcgcaccagtgaggggggcggcggggcctgggggcgcggagggtggggagcgacgggtttgctggattgcaggcgctgccctgcacactgcagcgcatgaagnnnnnnnnnncgcggcggggactgggggcgcggagggtggggagcggcgggtttgctggattgcatgcgctgccctgcacactgcagcgcatgaagcgccacaatcagcccctgcctcatgcagcactctcctccccaagtgccctcccagcctgcaaagagggtgactgctcattgtcctcaaaccatctccgtccactctactccccccccctcccccccaaataatccccctctgcgacatcccacagtggaccagcaggcggcgcttcaggtgtttgcggcgcactgcgtggtcgcccgcttccagggctttgtcttcttcggctccgcccacgcgctcagccggcgcatggacgtggtggcgggggccctggtgtccgaccccggcgcgggggacgccgacgcgccgccgcccgccgagctgg

SEQ ID NO: 46751 - DNA, 73 bp, Chlorella protothecoides
gcaatcctcatgggggtcacagcggcctcaggtgcccttgaagcattctaggtcaagaccgccatgcccttgt

SEQ ID NO: 46752 - DNA, 79 bp, Chlorella protothecoides
cgggtcctgcatcgaggatcatgtgcaacgcttcttggtacaaccacaattacagcttgggtaatgatgatatgccctc

SEQ ID NO: 46753 - DNA, 61 bp, Chlorella protothecoides
cgtaatatccccctcaaatcacccctcatcactccctcccctttgatcgcagcatcccggc

SEQ ID NO: 46754 - DNA, 78 bp, Chlorella protothecoides
agtcggtgacggtgagaccccaggcggcgcgcatgaggaggggaggactgagtcggctgccgagccggcagcggcctc

SEQ ID NO: 46755 - DNA, 61 bp, Chlorella protothecoides
cggcgcggagggtctggaggtgggggaggaagccggcagccagtcgccggaggacgaggag

SEQ ID NO: 46756 - DNA, 76 bp, Chlorella protothecoides
tctggatttcgaccctccctcaccggtgagcctgtgcagagtggtcggatgtgtgtaccgtggccgggtgatgggg

SEQ ID NO: 46757 - DNA, 66 bp, Chlorella protothecoides
aaactgggtgagagtctgtcacaggaatcggcattcacactcgatttgttcctggccagttcctgc

SEQ ID NO: 46758 - DNA, 79 bp, Chlorella protothecoides
tttcgtattctcggggcgcgcgcgcgacacatcagatcggacggttgtagatgtacatgtccacaaggacgtgaagcaa

SEQ ID NO: 46759 - DNA, 61 bp, Chlorella protothecoides
taaactgtgcggtgttgggtgggtggggggtgattccattgcaaccctgactcgagcagag

SEQ ID NO: 46760 - DNA, 14403 bp, Chlorella protothecoides
  modified_base (227)..(236): a, c, t, g, unknown or other
  modified_base (476)..(485): a, c, t, g, unknown or other
  modified_base (837)..(846): a, c, t, g, unknown or other
  modified_base (1768)..(1777): a, c, t, g, unknown or other
  modified_base (1902)..(1911): a, c, t, g, unknown or other
  modified_base (2456)..(2465): a, c, t, g, unknown or other
  modified_base (2552)..(2561): a, c, t, g, unknown or other
  modified_base (2675)..(2684): a, c, t, g, unknown or other
  modified_base (2794)..(2803): a, c, t, g, unknown or other
  modified_base (2871)..(2880): a, c, t, g, unknown or other
  modified_base (3309)..(3318): a, c, t, g, unknown or other
  modified_base (5017)..(5026): a, c, t, g, unknown or other
  modified_base (5636)..(5645): a, c, t, g, unknown or other
  modified_base (5748)..(5757): a, c, t, g, unknown or other
  modified_base (5927)..(5936): a, c, t, g, unknown or other
  modified_base (7295)..(7304): a, c, t, g, unknown or other
  modified_base (7743)..(7752): a, c, t, g, unknown or other
  modified_base (8345)..(8354): a, c, t, g, unknown or other
  modified_base (8989)..(8998): a, c, t, g, unknown or other
  modified_base (9981)..(9990): a, c, t, g, unknown or other
  modified_base (10398)..(10407): a, c, t, g, unknown or other
  modified_base (10494)..(10503): a, c, t, g, unknown or other
  modified_base (11269)..(11278): a, c, t, g, unknown or other
  modified_base (11577)..(11586): a, c, t, g, unknown or other
  modified_base (11891)..(11938): a, c, t, g, unknown or other
  modified_base (13658)..(13667): a, c, t, g, unknown or other
  modified_base (13997)..(14006): a, c, t, g, unknown or other
cttgtcctggatcttggccttcacgttgtctgcaagatggcgagtgcaacaggatggtggccagtccaatgccgcaaagactggagattgacagtccgactccaaaagtttgacacacacaaggccggcaaaatgcttacataagaaacacgaacccgcagctaccgcagaggtgactctcgacctacctatggtatcattcgactcgacctcgagggtgatagtcnnnnnnnnnnctgtgacacacacaaggccggcaaaatgcttgcataaaaaacacgaacccgcggctaccgcagaggtgactctcgaccctacctatggtgtcattcgactcgacctcgagggtgatagtcttgcccgtgagggtcttgacgaaaatctgcatcgtcgctataccttccgcgactgtgacttcctgcaaagacgtaaaggacctatcctaagtcgctcatgccgaactcgcccgcgtcccnnnnnnnnnnctaccttccgcgactgtaacttcctgcaaagacgtaaaggacctataatgagtcgctcatgccgaactcgcccgcgtcccgaggtccaaactgttatcagccaaagagatcaacggcaccggagagtccacccaccttgttccgtgtgtccgagggtgctcgaaacttgcttccgtacccggaaatgaatctctctgtgccttgcacggctgtgtgttggcagttatggtgacgttgccttcctggcttcggagaagttcgaccaatgttcctcgtttcttcccagagatcgaccgcgtcagcgttttcaaacctgtcctagtttggacagcgggatctccggctggtgacnnnnnnnnnnatgcttcaaccttgcttccgtacccggaaatgaatctttctgtgccttgcacagctgtgtggtgggagttatggtgacgttgccttcctggcttcggagaagttcgaccaatgttcctcgtttcttctcagagatcgaccgcgtcagcgttttcaaaactgtgctggtttggacagcgggatctccggctggtgactcacaccctgacacgcccgtgctcgtgccgcggcgctgtgtgcgtgtacaaaaggggcaccaaggggtcgaagatcgacctcgttaaccctaaacagggccagggaaagtggccaggacgccccaggagcagcaatggcagctgtacagtcggcaagcagctgcccgcctcatacataacaagggggatgaagagtggtgcggcgtcccctcgggccccctcacccctcgtcctccagcctgccggtgtgcgcactgagctcccggagctccagccccgggcccaggggctggatcggcgcccccgccccacccccactcgcctcgtgcggcgggcgcggcggcggcggcgcgtcgagcgcccgccccgcccggcccccgccctcctctgcccagcgctgcatggcccccgagatgagctcgaaggaggtgaaggtcaccgccgcagcgggcgtggtgcgcagcaggttggtcatgcagccgcggtagaaggccgccaggcggtcctccgcgtacacctgccggcaggtggcccacaggccggagaacgcccccacgccggagacgtgcatgcgggagcgcaccacctcgtgagggtaggtcaccgtggccgccaccatcttggaggccgcgctggagatcaccagctccaccctggttggaggagggtgggtttgcgaaggggggtggaaataggagcggcgagggtaccatggatgagagtgtnnnnnnnnnnggtaaaggggggtggagatatgagcggcgagggtaccatggatgagagtgtgggatgggggggcaaatgccgatgacaggacgagcggcccatcccccttggcgccccccccccccccccccccnnnnnnnnnncacactatacgccccctcaagccctcacgtagagatgcggccatcctcgccccgccgctccgcaaagtgctgcttcagtgcctcgtacagcgggaactggatgacgacgtgggccacgcccagcaggctcggccccaggccggagtagaggcccgccaggccctcctcgcgcgcgatgcgcagcatggcgtcagccaggccgcgatagggcaccgcgctgcgccccgacccaaagcgcaggcccaggttctgggtctgcagccgcgtcttcaccacccacagcgggttggtgagcagcatggtggcggcccccgccccagccgccgccgccatgtgtacgccgggggaggcggcgtgctcaggcgccacgcgcgcgccgatggccaccttgagccgctcgtaggcggtgaagtagactgcccagttgggcagcagggccaccagcgtgggggccagcccgcggtacaatccgcgcacaccctcctcggccacgatcttggacaggccgcctagggtttttttggggggggggggggggggggggnnnnnnnnnncccgcgcacaccctcctcggccacgatcttagacaggccgcctagttttttgggggggggagttgagggggggggggggggttcatnnnnnnnnnntgtgtgttcattgcccagagagggttccagcacgggggaagggagacaggtcgaggaagacgtcagcgagggatccaaaagcagcctggcctggtcgagggagggagtggcgannnnnnnnnntgttcattgcccagagagggttccggaacgggggaagggagacagggcgaggaatacgttagcgagggatccgaaagcggcctggcctggtcgagggagggagtggcgannnnnnnnnnatcagcagggtttgcatgatggcaccaaatcaggtgcggggaccaccgcgtgggtggaggcaaccctnnnnnnnnnnccgatgccgccgtagggtgaggcgacaaaggccgcccggccctgcacctgcagccgcgtcttcaggacatctagggggcacaccacggtggacgtgatggcgcctgcgggggtgtacagcatagtgtcagcagggtttgcatgatggcacttaatcagatgggggaccaccgcgtgggtggaggcaaccctgcgctgggcggggatgcacaacataggccctggtttaaaatgtcatcctcggctcctacagcaaggctcgaggacccgggccgacacagtgatccatgcagccccagaacctgcctgcaaggccaccggcaagggcattcctcagctccttctcctccttcagtttccgctgcaattgcagaggagggaccaaagctcggtcagaagcaagtacaaaataagcaagttgcacgccagnnnnnnnnnngattgcagaggaggcaccaaagctcggtcaagtacaaaataagcaagttgcacgccaggctccccaagatcaggacaatgcgcagcttgaatatcataaatcgccccaccttcacggcctccaggatcatgacccctggagggggtcgtgggagggagcacggggcgggcagccgtgtctggttcacaggggaagccgccacgcgcgccggtcccggccctctgcaggctgcctctgcagcctctccaatgctttaattacagcaaccagcgtctatggccgatactcgccaggtgatccttcctcggtggacgctggcgcccgttggctgggatgtcgaacgatccgactcgacttatgcccttgtccactaacggtgagtcaatgcggccctggcacctgggctcggtgtgctctgtggtgtgattacgccgcaaaccacctgttcttcctttttcaaggcgagggtccctggcgggtaggcagaatgcacgcttgaatacatggggaaggtcaggttcgcgcgcgctggagcctccctcagcatccacagcacaagaacatccgtttcacatgaacagccggaacccgctctgcccaacccagtgtcaatgcaatcttgatcccccctccatgtgacagctatcctcacagtcatgagcatgaacgtgagtagcgatgtagcgtgcggtgccgcacataatgctcatcatgcacaacagcgcaccacacaaaacaaggaacgtgaagggcgttcaaagtaacgatgccatatatatcaaggatcaataggtacttggcactcatatggactcccgcaggcgagcggcgccgtgctgggccctctgggcgactttctgcacccatccctggggctggccccccgtccccagcagcgcctcggccgtgtgctcgtccgagtgcgtcgcggaggaaaggggttccggctccatgcccccgcccagggaccccgccgaccgctgggtcgaggggggcgagcgcggcacccctccacgctggggactggcgtctggggtgtgcccgcgctgtgcatgctgcgaggacgacgacgcagcggtggctggcgggtggggtcggctcagggcatgggtcccgccgaacagcatgcgagccttgtgcgccgtctgtttgaggggaggaacaagggagaacgaggggttgggaggggccggaaatctacgagtctggctcgcgcaaggcaggcgccgatgggtcgtcacgccaggcgaccgggcccccactcaaggtaatatcaccccaacgagaaactccccttacctgtgcctgctcccccgtcaggggcacggtgctcgagccggactccgacccagacgactgcctgctgtgcttcgacttgcccagccccagggaggcaagcaggcccttcccgtgtgacccggtcttctgcttggcaggtacctcgacctctgcggcggagtctgacaggagctcctgtgcgattgtatggggaggtggagagggaggtttctctgagcggcagggtgatgccacattggcatggatttgtgtggaggggcaagcaaggagcccggaagcaaggaaatggggtggcaggtggtgccatcaggccggccatgggctgggagcctcgctgtcaaacccctgctgctttgggcaagccggtcatgcaccgacggcagatcaccatttgccccgnnnnnnnnnntacccgcgctgctttgggcaagtcggtcttgcaccgacggcagatcaccatttgccccgctgcaagcccagccacaccttgaatttgcggccctggagccccgtgaccgacttggccacgctcttcactgtgtcccacttgatgcgcgccagcaggtcccgccacccaccctcaaagttctcataggtgcggttgtccagcaccagtttcaggtcggtgaatgtcctgcaggtgagggcggggatgtgtgagtgtgggggtggcgggagtgggcaggcgcgggtggtggctccggcccgcggcgaggaggccggcctggcaagggtggtcgatgcaattgtattggtgcaaagtgcagccccgtgcgccccctgaagagcattggctgctcgtcattcccgagcaccaggtcacactcacagggggtacccggcgtaggtgacccggcaatgcatgcggttggtccggaagtgcttgaacctcggcttccgggcggctgctgtggagggccggcgcgcgctctgtggggaagggcgtgggtgcatggcacatgatgggaattcagtccgggttgctggcgggtgacaagcaggtggacagccttgcgacnnnnnnnnnntggcccgcggcgaggaggccggcctgggcaagggtggtcgatgcgattgtatgggtgcaaagcgcagccccatgcgccccctgaagagcattggctgctcgtnnnnnnnnnncgggtgtgtggcacttggtgggaactcagtccgggttgctggtgggtgacaagcaggtggacagccttgcgacggctgcagcccatctgggaagggacgttgcgcagccagtgtgccggccatgggctccaaacagtcgctgctctgacccctgccgcggcatcagccgnnnnnnnnnncccagccatgggctccgtacagtccctgctctgacccctgccgcggcatcagccgctccagaccaggcctcaagcctcccatcggccctcaccttgctcccctccccgcccacgccgcccatgcggcgcaggtagcggcgcgaggtgcgcaccaccgccgacatggaggcctgcctgacgccgcgtcggccgccagagccgaagaggggcgaccccgcgccgcccaccgagttctcgggggagatggtgagatcgtgggaggcgctgccttgcctgctcagcgagccctggccctcggaggtgccgcggcggtgcagcttgctgggcgccgagcgcggcgtggcgcaagcccctgtggagagggggaaaaggggttggggatcgtggggccgtgggaggccagggggcggaaggaggccggggggggcgcacagagagatgagctccttgtgccactgcgaggctgcaccccaggtggccggatctggcaggagcagagtgcaccccttgcacggggtgcagcaacaacagggagccaggtgcatcagccaagccacagggtgactcccaagggacgccgatggtgacaccaggagccacatcgcccacaagcaggcatcccctcacacctaggggcggtggcgtgaaggacccggatccctcgccgtgcgacagctcccccgccaggctcccaccctggagagggcagggaccaaaggggcaggaaggggcggatcgccaccgctgcagtggcgctctggaggtggcacgcacgcccacagcagtccagccagagattcagcggccgtggcaccggtgagacccttccattctttcgtcaacaaggttccttgcccattcctcgcacaaccaagagcatcaccgacccctgagcgcccccaccctgggagcccacacacctcagcttcactgggaagggcggtgcgggcgcgccggtgccccttcctggacggcgcgggcttgaaggactgggcgaaggctgcctgccgcttggctgcatccggctccttggggaagaagtactcctgatgagaggtggattgggggtgtaagtgtctggctggtgcaagccggtgtgcatggtcggatggaagcgacagggtggaccacgtcaaccatgtgcgccccaatgtactcgcgcaacctcaaacacagtccagcagcatggtgtgggaccatgcccattctcagaagcccagaacggatacctgcctgacccccagagcccgagcagggaccacaccctaggggacctgcccatccaacacccgatcgcctgcggccctccgacacaccgatggctctcactgacccctccttctcccttcaccgaccacnnnnnnnnnntgaacggctagctgcctgacccccaaaccccgagcagggaccacgccctaggggatctgcccatcctatacccaatcgcctgcgaccctccgacacaccgacggctctccctgacccctccttctcccttcaccgaccccccccccccctcctcggtcccacaacccacccagaaggccacagcgatggactcggtaaggtgcaccgccagagggtggagcgaggcatccacgtgctcatacacggtgtggttctgtgaagcaggaggacaggaaggaattcaggttagcgattggggtgaaacgagtgggaggtgcccatcaggcagtcttggcaacaagggggctttcccaacgggtatctttccaataattctgaaatccactcatatccctcccccacccccctgcctccctctccatcaccaccccgcctcgcnnnnnnnnnnaaggaaggaatttaggttagcaattggggtgaaacgagtgggaggtgcccctcaggcagtctgggcgacaagggggctttcccgacgggtgtctgtccgatcattcagaaatccactcacatccctcccccacccacccgcctccctctccatcaccaccccgcctcgccttggtgggcacgcccagcgtggccacgaggcggagcacgtcgtcacgcgcccaggaggcgtcagggttccagaccgacaggatgacgcccgcgccgacgccaggggcgggctccagcgtgcccagcgcatccagcacctcgatgcggtggatgacaaacttgaaggagccggagtggtcgcggttgcgcaggcggtccaggcacaagcgccggatggaggcctggacgaagggctcgcggccgggggagcagagctgccacaccacgcggtccacctgcaggcgcagccgcgacgcgaaccggttctgctgccgcttgcgtgcctcggcctgcgtgagtgtgtgggatttgggggggggacaaagcatgactgaaaggtatgatggccattagattcctggggtggatgccgccccgagattnnnnnnnnnnacgagtgtgtggatttttgggggggcgacgaagcgtgactgaaaggtatgatggccatttgattcctggggtggatgccgccccgagatttacaactggcatcctggcgtgccttccgctcataatatatactaaccctcaccctcctcatcccacatgcgctgcaccttgaggtcctggaggctggagcgggcagcttcgagcgtggtggccgccctttcttcctgctcctcggcccagcacagcagcaggccctgcgcgggcaccgcgtgagcgcgcggggagtacaggtaggcgcgcaccgccccgtccagctcggcgtcggggtcggccagcgggcccaggcccaggtcgaaggcggcgggggcgccggcgccggcggccgacgacgccgcgccctgcgctgccccgccggcaaaggcgtgcagctccagggcggcgacctgaagtggcaagccggggccggccgagtcgggcggcgacagcgcgccgctccgatccagtcgcaacagctgcagccccagccagcggcgttgctgtggggcggggcgagtggaagttctccatctctaaataggggcctgactgcaggatgggcagggaacacccacgtgcacactggagaactgacacgnnnnnnnnnnagggtggaagttctccatctctaataggggcctgactgcaggatgggcaagaagcacccacgtgcacactggagaactgacacgggtgaccaaaattccccggacccattcacgttttcctcacctccagcgtcagcgcccgggcctcggccagctcgcggcgcaggagggcgtagctctgccgcgcgtcctccacctggccgggggtgatggggtggttggagagggggcgtcagggcggcattgcacgatcaggggggttgctcagatcacttttcgggcccatccacccctactccccagaaaaccatgaacacacacctcgtccccggcacagtctgccgcgagcagggacccctcctcgccgacggtgtccacgccaggcccctggctgagcagcatctccaccacctccaccaggacctcgaactccgtgccctccatggtagccacgatctggggaacgctgagcagcagctcctccccgcgcggccccgcgccggtgaagctggcggggccccagccgggggcggtggagttgcggcggtgggcgccgccctcgccgccacgggggcccggcgtgacgcgggacggcgcgcttgccgcgcccccgccgccggcgtgcgcgcccggggtcacgcgcgagtggcgcaggccgatgtggatggggttgaacacccggcgcagcgagggctccgcgcccggcgcgaagcggccgccgtgcgtgtccagccaggcgggcgtcgcgccggggtcgaccgacgtggcggagacatacgcctgcacctggtccagggtcagcttggtgatgctcatcgtgttgtggggcagggtcaggccctccagcagccccgactccgccgccagcaggaatcggccctgggttgaggaaggaagaaaggggaagcatttttggggggttgggtgtaagttccagataatttcgtgccgaggcaagtgcagaatcctcacaggtcagccannnnnnnnnntggggaagcgtttttggggggtgggtgtaagctccagataatttcgtgctggggcaagtgcagaatcctcacaggtcagccagtggttcccagattagtagaggctaccctccagcggaaacacgcatagtcctctcagggtgcgcacagacccttcaacagctcaacatgcacagtaggcgagccaccttccctccccaaaagccacacacacctgtgcttgctgggcctccaggttgatctgcaggttgacgacctccacagagtagcgcagctttgcgttggcatcgtccagcggcgtcgtcatgggcgccttccgggggggcgggtgtgggacagtgcactcaggagaaggcgggtcgcgtgcaaggacgcgaaggaatgtctcttgtgcagagtcgcagcgcnnnnnnnnnnccccatatcagtgaggctaccctcaagcggaaacctgcatagtcctctcagggtgggcacagacccttcaacagctcaacatgcacnnnnnnnnnngggggggtgggtgtgggacagtgcactcgggagaaggcgggtcatatgcaaggacgcggaggaatgtctcttgtgcagagtcgcagcgcaggtcggcgtctcactggaccgcccgttcgactgccgtatccaaacacaaaggcccacccccacaccccttccccgcgagcacacgtacatcgtcgtctgaggactcgctgccactgtcccccacctcctcctccgctgcctcctcctcagcgccctgctgcaggagcaggtcaagaagctcgttcctgccatccggaatggactgtgagggcgacatgatgccctgggaaacccccccggccgccgagcgccgcggcaggctggagccggggcagggggaggcccaggatccgggcgacgccatgctggcagccggcgtctgcgccgcgctctgccacagtgattggggggtggaggatgtgtgagagggttagattcgtaggttttcttgagcagggctgcaagcgatggttggcaggagtggtggcgaatcaatgcaccccgccggcacgacactcgcgggcgctccacctccccacgctcattgcccatgacttccccctcctcctcttcacacccaacccacggccgcacgcctgtcccccaatccctgccaacacgacaagaccccccccccgaaacagaaagaacaatataatctgcctgaccatgcacgccttgtgctgcgcgcgccgcgcggcggctgggctggtggtgaaggcgaccaccaggtgcnnnnnnnnnntgcacgcctgtcccccaatcccagccaacacgacaggacctcccccccgaaacaaaaagaacaatataatctgcctcaccatgcacgccttgtgctgcgcgcgccgtgcggcggccgggctggtggtgaaggcgaccaccaggtgctcgatggcgccccacagagcgtcccgcgccgcaccgtcaatcagcagcttggcgtcgctgacgtggacgaggaggggccgggtggagtgcgggtcaaggacgtccgccagggatcccctgccgccgccgccgccgccgccggggtcgtcgccnnnnnnnnnngcgggtggagtgcgggtctaggacgtcggccagggaacccctgccgccgccgccgccgccggggtcgtcgccgccctgcccccgccccaggctgtcggcggagaaaggggaggtctggaaggagggcgactcgggcgaggcggggggcggcgcgcgctccacgcgcagcagcgaggaggagagcaggcggctggtgctggccgcggcagcggcggcgggtgagtcgtccagggcggaggccgctgcagtggttcctatgggccccagcagcgcgatcttgggctcgagtgaggtggacggcgagnnnnnnnnnnnnnnnnnnnnnnnnnnnnnnnnnnnnnnnnnnnnnnnnaaatcgcggctgatcgtgcgcgtgggggggggcctgcgcggcgccgggagggggcggtgagggggtggacttgatagcacgtgcaacaccgggtttgctgcatccccatgacaccacacaatcgagcccccacaactcacctcttcgcggcgtggggcggtggcttgaggaaggagggaatgggctggttgaagagccagctcgcgccaaactccacccccaccgccgagatgcagacgttgtgggaggggtcggtggtgtcgcaggtgaagtgcacgatttccagcggggaggccgacacctggatcttcatctgtgcacgggtgatgaggaagacgcatgctggtggaggacagtgcctttggtttggaaattgcgagctaggcgggcctgttaagtttgtgtttggacatggaaccaaggcaatcgacaggacatcgaccagccaaaccctctcacctcccgcagcagcttgggcaggttcttcttgggcggcaggcccttgggcttgcgcacgaagaaagtgccgcgccggaccacggcgcggacggcagggtctggcattctcaacagcgcgatccaggtcctcaggaactggatctgagtgtggggaggggggtgggagagggggatgcaggtgcgtcagtcgcccactggccttcagttgtctgcggtctggggttggtccagcacgggcatgctgcgaccctggagttcctcctcggaccccaactcgcatagtggacgcctcctggcttgtaccatggtatctggtgagcattcctcaccccttgattgatatgaatgcatctgtgtttacaaccaccccctcccaatcgcccaaaggagatcatcccacgtcccccaaaacaaccaacctggtgatcgccgaggtagaccacggcgctctgcgcagcgctgccgcccaggtcggcagtgatgcccaggtccagggcctcggacttgtacacttcacccggcaggcggggcccctggacgccgtccaggggcggggtcggggggaagaggtggtgctgccggggggtccggccgccgggcagccgccaccccgcctccaggcgcagcgtcagcgccggcacggccagcatgggcaggcgcagcaagccgccggcggggccgtccagtcccaccgcctcgaaggcgtccacggccaggcccgccagcctcagctccgccacgccctccgccagctcagcgccgacgcggtgggcggccaagaccagccgtgccgagtccgggcccgggccggcgcggcggtcggccgccagggtcaggcgcaggcccgcgacctccagacctgcgcgcccgcgccacatgtagcgcaggtcgtcccaccaggggatgggcggcgggcgtgggagggacttgtccgggtcgctgggcgccaggcgcttgcccgccagcgccatcatggccagcgcaggttccatgccggggccgtgcaagatctgcaggcccgatccctgcagcagcgcgtcggtgtacaccttgacgggcgccctgcgatgcgtgggcggttgggcagtgggcggtgggcaggaggggtccccagtcgaggggcaagacacacaggccatggctgctgccggttctcggggcatgatgcgcaggttctggctgcatacgtgcacaccgttcaccctctcccgccctgaacccagcaacgcaaagtcgcactttgtgcccttgacgctgacgnnnnnnnnnngtcccagtcgaggggcgagacacccaggccatggctgctgccggttgtcgcggcatgatgcgcaggttctggctgcatacgtgcacactgttcaccctcccccgccccgaacccagcaacgccaagtcgcactttgtgcccttgacgctgacgtcgaggatggtggcggcgtgcgccccgcactgccaggggcgcggccgtgtctccggctttgctgtggcctgcttggccaacagcatcggtccggacaccgccaggctgtccagtgccacgaatggctgcagataaggggccaagggggggggggtgaatgggaccagacgagctacnnnnnnnnnnaaatggctgcaggtaaggggccaagggaggggggggtgaatgggaccagacgagctaccagggggcgggacgaagggtcaccccaccctccgtcactgcctcgactcatcaggcggggcccgcgacgttcgaagccattcccgcccccccgcaccgtgcgcatacctggctgcaggccgcgacatggagctccagcccctccacgtccaggtccgggtggaaagcatgcacggacgcaaaggccacgcccgcgctccccgggtccagcgcacgcaggcgctccagcgacgcggcgcggtcgggcgccggcacgtgcacgtcgccgcacagcgcgcgcagcgtgacgcggaacacgtcgggctccagcggcgcggctgcagcgcgcagcgcgtacgcg

SEQ ID NO: 46761 - DNA, 64 bp, Chlorella protothecoides
gagcccgtggtctcggcctccacccctgatgccttgtatgacctcctctccaacctgggcgctg

SEQ ID NO: 46762 - DNA, 61 bp, Chlorella protothecoides
tcatgcggtctatgtacctgctttgttcgcgaaaacaatgccagtggccgatactacattg

SEQ ID NO: 46763 - DNA, 61 bp, Chlorella protothecoides
cgctgcgcctgatacggccagacggcggggtggcagcggcccccggcgcagtcacgacaca

SEQ ID NO: 46764 - DNA, 91 bp, Chlorella protothecoides
gttggggaacactgcgagcattgaaggggggcgaaaggggagaggcatgggctaagagaatatcacagagcacgtcacaacacggaggcag

SEQ ID NO: 46765 - DNA, 355 bp, Chlorella protothecoides
tcccaatacatcgaatgtgacagaagcgggaactcggtggtgagatggcatgtagggaaactctgccttccggtccgcgcggaacgcgagaggccctactctcttaattacaatagagtattacatactgttcagatcaaaggcgtcacaacgacgcttgtgtcatagtttgtgtgccagggctgaatgggaaccggagggcatgctgtgcatgatgttctttggttttccgcgccatcccgtaagtaatgtgttatcggggggcagcatcatttatgagcaaagctacgacgtttggccagatcgtgctccgtacaaagcgtttggaccgacaatacatcgatctaatcgctgg

SEQ ID NO: 46766 - DNA, 76 bp, Chlorella protothecoides
gtgccacactgcgggattgtgatcgtgatgtggggtgggtggggcgggggacgctcggcagaggtgccaccgaggg

SEQ ID NO: 46767 - DNA, 21332 bp, Chlorella protothecoides
  modified_base (92)..(101): a, c, t, g, unknown or other
  modified_base (479)..(488): a, c, t, g, unknown or other
  modified_base (1096)..(1105): a, c, t, g, unknown or other
  modified_base (1796)..(1805): a, c, t, g, unknown or other
  modified_base (1863)..(1981): a, c, t, g, unknown or other
  modified_base (2092)..(2101): a, c, t, g, unknown or other
  modified_base (2546)..(2555): a, c, t, g, unknown or other
  modified_base (2963)..(2972): a, c, t, g, unknown or other
  modified_base (4070)..(4079): a, c, t, g, unknown or other
  modified_base (4480)..(4489): a, c, t, g, unknown or other
  modified_base (4564)..(4638): a, c, t, g, unknown or other
  modified_base (4700)..(4709): a, c, t, g, unknown or other
  modified_base (5132)..(5141): a, c, t, g, unknown or other
  modified_base (5929)..(5938): a, c, t, g, unknown or other
  modified_base (6112)..(6121): a, c, t, g, unknown or other
  modified_base (6385)..(6408): a, c, t, g, unknown or other
  modified_base (6725)..(6734): a, c, t, g, unknown or other
  modified_base (9126)..(9135): a, c, t, g, unknown or other
  modified_base (9275)..(9284): a, c, t, g, unknown or other
  modified_base (9636)..(9716): a, c, t, g, unknown or other
  modified_base (9949)..(9958): a, c, t, g, unknown or other
  modified_base (10420)..(10429): a, c, t, g, unknown or other
  modified_base (10976)..(11022): a, c, t, g, unknown or other
  modified_base (11118)..(11245): a, c, t, g, unknown or other
  modified_base (11754)..(11763): a, c, t, g, unknown or other
  modified_base (12227)..(12236): a, c, t, g, unknown or other
  modified_base (13942)..(13951): a, c, t, g, unknown or other
  modified_base (14134)..(14143): a, c, t, g, unknown or other
  modified_base (14518)..(14527): a, c, t, g, unknown or other
  modified_base (14812)..(14821): a, c, t, g, unknown or other
  modified_base (14877)..(14886): a, c, t, g, unknown or other
  modified_base (14962)..(14971): a, c, t, g, unknown or other
  modified_base (15757)..(15766): a, c, t, g, unknown or other
  modified_base (16037)..(16046): a, c, t, g, unknown or other
  modified_base (16130)..(16139): a, c, t, g, unknown or other
  modified_base (16605)..(16614): a, c, t, g, unknown or other
  modified_base (16785)..(16794): a, c, t, g, unknown or other
  modified_base (17496)..(17505): a, c, t, g, unknown or other
  modified_base (18029)..(18038): a, c, t, g, unknown or other
  modified_base (19410)..(19419): a, c, t, g, unknown or other
  modified_base (19752)..(19761): a, c, t, g, unknown or other
  modified_base (20910)..(20936): a, c, t, g, unknown or other
tggtgagttggttgggtggtgtgtagtgtgcgtgagcggtgaaacaaggggctgtcagggtcgggagcggggatcctcctctcaccatatgnnnnnnnnnnccaaggtggttgtcgagccccacaggcatgcgggcgtcttcatcgcgcgcggcaaggaggacgcgctggtgaccaagaacatggtgcccggcgagtcggtgtacggcgagaaacgcatctccgtcgaggtggtgagttggttgggtggtgtgtagtgtgtgtgcgcggtgaatcaaggggctgtcagggccgggagcggggatcctcctctcaccatatgctaatcagtggtcacagatggctgttgaccggctcacactcgatgtctctgtcatcgacacacccacacccaaacactgtaccacctcctccccccttgccctcaacaggaggctggggagaagacggagtaccgcgtgtggaaccccttccgctccnnnnnnnnnncatatctttgtcaccgacacacccacacccaaacactgtaccccctcccctccctccccccttgcccttaacaggaggccggggagaagacagagtaccgcgtgtggaaccccttccgctccaagctggccgccgccgtgctggcgggcgtggacaacatccacatccgccccggcgcgcgtgtgctgtacctgggcgcggcctcgggcacctctgtctcgcacgtctccgacatcgtgggccccgaaggcgtggtctacgccgtggagttctcccaccgctccggccgcgacctggtcaacatggccaagaagcggcccaacgtggtgcccatcattgaggatgcgcgccacccgcagaagtaccgcatgctggtgcccatggtggacaccgtgtttgccgacgtcgcgcagcccgaccaggtgggcggctggatgggggttggcggtgcagtgactgggaggccgctgcgtggagggtgggggaggggttgtttcaggggttactgcctgatggactgcacggtgttgacatgcaaagccctgcatcaatccacccagtctcctgaatgcgctatcagcctgcggtactctgacccggcaacatgnnnnnnnnnntgcatcaatccacccagtctcctaaatgcgccagcagcctgcggtactctgacccggcaacatggtactgccacccctaccctcacgacaacacgaaagccaagccctcctccgcacattctcaacccccttcccccgaccctactcccgcacaggcccgtatcgtgggcctgaactcccagtacttcttgaaaaacgggggcaactttgtcatctccatcaaggcgtcctgcatcgactccaccgcgccccccgaggccgtgtttgcgcgcgaggtcaagaagctgcaggagcagcaactcaagcccaaggagcaggtgcgcaagggtcgggacggggggcgccactggcgcgtggcggcccgcggctgggcaaccgggcggtcagggggcctgggtgacgaaaccttacacacgctgacgcggccgagcacgccgggacgggcgcggccgccgggcgggggccctgagccgcccgccccgtgcgcgccgtttggcccggcccggcgcggccgcacgtggaccttcttccatgactccgacagccccccctgacgaccggcaagcgccctacctccgcctggggcggacaggcccagggttcactgagcacgcatgcccccatctcccacacccccccacctcccctgccacctttcccgctgcaggtcaccctggagccgtacgagcgnnnnnnnnnntgacgaccggcaagcgccctgcttccccctggggcggacaggcccagggttcactgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacggcaggagagggggggtgcggagggcacccagccctgcgccgaccgctcaccccacccccatgccagcaccctcgtcggccggaccgtgtacatgatgacgaattcnnnnnnnnnnacatgcccccttctcccaccccccgccacctttcctgctgcaggtcaccctggagccgtacgagcgcgaccacgccgtcgttgtgggcgtataccgcgcctccaagaagaaggacgcgtgagctccgccatgcaccaccgaggcccccggcggggcgcttggcgcatgacggcaggagagagggggtgtgcggggggcgcccagccctgcgccgaccgctcgccccacccccctgccagcaccctcgccggccggaccgtgtacatgatgacgaattcgctttcctttccttccccctccccctctgctccgtgctgacacaagatacccggggcttgtaactcggggaaaaggcagacgggcaagctgcagcgcaggacacggtggtgaggccctccgcagctgggcgtccggcgcgaggggggcctgcccgctcgcccgaggnnnnnnnnnncacaaggtggtgaggccctcctcagctgggcgtccgacgcgaggggggcctgcccgctcgcccgaggggcaagatgagcaggggccctggggcgcgccctgctgcttggagctgaggcaggagcagggtgcttgacgccgggacaggagcagggtgcttgacgctgaggcaggagcagggtgcttggagctgaggcgggaacagcgcatgcgggggccaacacctgggtccgctcggcgcgcgggcggggcaccactgcggggtcacccgcagcacaggccggggttggggcacgggttcggtggcggcactggcccacctcctccacagggaccagcacagcgtagacaagccgtccctcgagcctgccgcccccttcccttcagggccagcgtgcctcagaccagnnnnnnnnnngggggccctggggcgcgccctgctgcttggggctgaggcaggagcagggtgcttgtcgccggggcaggagcaggatgcttggagctggggcaggagcagggtgcttgacgccggggcgggaacagcgcacgcaggggccaacacctgggtccgctcggcgcgcgggcggggcaccactgcggggtcacccgcagcacagaccggggttggggcacggggtcggtggtggcactggcccacctcctccacggggaccagcacagcgtagacgcaagccgtccctcgagcctgccgccccctcccttcagggccagcgtgcctcagaccagccctcaatcccggcggtcgcccagcagtcgcaggatgtagaggaagaggttgagcacgtccaggtagatcatgacgctggcccagatgtactcgtccaggcccacgcgctggatgaggagctgggtgtcgaacacgaggtaggcggagaagaggagggcgccgaggagggagaagatggtgcgcgccacggggcccgggtggaagaagatctggaacaggccccaggccagcatggcccagagcaggcccgccaggagcgggcccaccggcgaaaagtccacgccccgcgccgtggcccagaaggagtacgcggtgagcgcggccaccacggtggtggtcagcgccagcgcctccagcacgatggcgggctcgtagaaggagcaggccacgcccaccgtggtggccatggtcagcgtccagaggcccagcagggccaggttcagggggtggcggtccttgtagatgaagagcgggatgagggccagcaggctcagcaccatcagcccgatgttggcggccagggaccgcgccaggaaggcgttgacggagggcaccaacgtcaccaccagcgccacggcggcagtcagtgccagctggatggtcacgatgccgtacacctgcacagccgcgggggggcggaggacatggggtgtgtggcgggaggatgtgtaatctgtgggtaggcgggggggttgggggcttggggggcccaggccaatcaccgggccagggagccgccccaggacgcctgtgcaccaccaggctcgnnnnnnnnnnggagggacatggggtgtgtggtgggaggatgtgtgatctgtgggtatggcgggggggtttggggacttgggggccccaggccaatcaccgggccgggcaaccaccccaggacgcctgtgcaccaccaggctcggcaggcgtaggctgaaggccgacatggcacagcccaccgccacccacctttcgtacgaatccccagcgcagggagttgtcggtggcatcgatgccggggtacagcaggccgcccccgctctccaggtcgtccccatactgcggtggcggtgggggtggacctctggcgactgcaatcatgttttgagattgaaaggtagtcactgcagccccacatcggctcacctttgcgccggagttggaccaggcgtccaggacgcccatgctgnnnnnnnnnntggtagtcactgcagccccacgtcagctcacctttgcgccggaattggaccaggcgtccaggacgcccatgctgnnnnnnnnnnnnnnnnnnnnnnnnnnnnnnnnnnnnnnnnnnnnnnnnnnnnnnnnnnnnnnnnnnnnnnnnnnnatcactttgtaaaaactagcgaccttagtagtattggaaagcagggaggcgatgctcaaacnnnnnnnnnnggtccggggtgtcccgtgtacaccggaagatcactctagagacacggggtgaagagacaaccgatagcggactgtcgctccctccgcaggtttaattgcaggtctataatgtatatttctcgtgacacccgacgtcttgctgcggtgcgccggtcgtcgtcactttgtcaaaactagcgaccttcgtaatattggaaagcagggaggcgatgctcaaactgggcgagatgcttgtggtcactctgacgacttccctcggccatgccgcaagttcaacgaccacagtgagatacatcttgcatttgggaggtacaccaggtggtagagcacaaagacacgcaccctcgttactctcatcaaggccggcaccagcagctacccactcgcacttgcactcgcacttgcactcgcactggcaagacnnnnnnnnnngactctggcgacttccctcggccatgccgcaaattaaacgatcacagcgacatacattttgcatttggtaggtacccccaggtggtagagcccaaagacacgcaccctcgtgactctcatcaaggccggcaccagcagctaaccactcgcacttgcactcgcactggcaagactaatcctgctggccaagcgttctaatggagactcaagccgaaatcatggacatcgatgcccagctggatgcgctcgtggaggtgatgcgacctgccgggccggggttgggcgggctcggcttgtcgagatgtacagcaagcacgggcgatcgggcaatattgagcatcctcaccgtcatgtaatgttgtttccatgtcaagtagctcgtgaggagttgaaatctgtgatgcctcccattgttaactattcacaggagcttgggcccggagatgacgacagccagtttccggtgagtagatgctcatgagaacatcacatttcgttgtcgaatgggatctcaacctcgtgccgccctgcgcaggaagataccctaaaggcagagaaagacgctggggcaggaaaggagtttccggtgggagagctcggtggaacgggatctgcaacttccgacggcgtccacgagcagggcatggacgcagcggacgatctgaacaaagatcatggagagccaccacgagacgctgcgccacccctcgagccgtccttgacggtaagcttgctattactcattgacaggcccactgccacgacagacacatgtcctatatcatgcnnnnnnnnnncgataatgagagaaatgcaaaatgtgccaatctacctagttggatgttcctgtactgatataccactgccaaaacctgcttgcacatctcgtcccatctcttatccagtttaatggtgtggatacaacagctgcgccgagccccaccgaggagcctgagccgttgggggaggtnnnnnnnnnnctgttcctcattgacatgcccacagccacgacagacacatgtcctatatcatgcttgatcccgggcgctgatgccctgaacgcctgtcatcctacaggagaccatgcggcagccaaagccggccaaaaagcccgcttttgggaagcccatcctgctggccaagaagacaccggtaggatgatgagagaaatgcaaaatgtgcccatttacctagttggatgttcctgtactggtataccactgccaaaacctgcttgcacatcnnnnnnnnnnnnnnnnnnnnnnnncaactcaggtggcgacatgcctccaccccctcggcgcgagccgctcgtgaacaagaagcgcatcctggccagggctgcaccagcctcccgctccgtcacaggtacgtgtgcgggctgatggctcataacaaaatccagcaggggtgggctgaggcccgcagcggcccctggtgccctgttcacaagacctgtctggccctgacatcacaggcacagacgcaacggcaggaggactggcctcgcctaacgagaaggttctggtacgtcagcatcagttctgcatgtattcatggaattgctcggagccaaggagcgcnnnnnnnnnncctcgcctaatgagaaggttctggtaagtcagcatcaattctgcattttttcatggaattgctcggagccaaggagcgcagtgagtgtagagtatgtccccagtcctctcaagcaattgacggcatcaaattcatgtctgcagggcttggcagccgacaaacctggcaagcatgcagcgagcacagggtcatcacacaaggtggtcaagactgcgtaccaggtgcgaaagaaagactgatgcagctcacttcacaagagacatagccttctgcacatgcagagaccttgcatccttggtttctctccagagaattgtgacgcgcacaaggcattgccagcctcaacatgctacgtcctgggccagcagcacagcaatgcaatttctctgtgccccatccaccttccccccagctgttctgtgaggagctgcgccccactctggtggccgaaaaccccaaggcctcgatgcccgagctctcccgtctgctcgcatcagcctggcgggcgacgagcgtggaggacaaggctgcctatgctgccatgcgtgcggtgagtgcctgcagggatgctgagaggatatgcggctgcgcatgtcattaaatttggaagaccatgactgctgtgcagatgctgctttacccatgccacgcccattgactgccattgccatgcaaacaccatgctcaggacctgatggcagctgccggtgatccggcgatctctgggatcccggcaaccgctgagggcaggaaggagctgaagaagagagtccgatctgagggaggcaaacaggcttccaaaaccaagggtgggtgtgcatcctctcaagcttgcatttgctttggcgatacctgtggctgctggtatttatccagacgcacaccactcgtcacctgcccttcgggcactcacgcagatgaggctgcatctgatggagagagcgagaaaccctgccctccaccgagcagcaaaaggttgagggcggcggctgcaacagaggcgcacgacagcggtgaagaaaccgaggacgacgacaagctgcgcatggtgaggcacttgtttatgaaaggaccgatggtgatatgcaaagttggcacctgcgtcagaagtgacatgtcgaccagtgccttgcactgtgtcatgagtgactgcctggcgctttcttacatgacctagcaaggcctcacgtccaatggcttgtccgcccaattccttcccattactatcctgcacaccttctcacctttcaggagtgtgactggaccaagcaccctgccgcattcatcatttctgagaatgtcaagaaaggtgtgcctgtcttggtggcggcatgtgcatttggctcctggcttgggagggggctcgggtctgtctcgcggcgggcagaatcaccatgcaaacaagagccctgtgtgttcatggcagggcgcatattccactcccatgctgaaacattggttgtgggcttgggttggctggagcacacattccctgcgtcacacacccaaacacaggtcattatctcgtggccaggaagggactccctctgacagactatggcgtggtgtgctctcgcaccgccaagctccagcgaatggcagagtcaggtgaggcaatggggcggtcgggctgggagcagggttcgggagggggctgggagctggtgcatccgagggtgcgtgcataccatccagggagacacctggcaccctctttgcaggggccacgaggctgcacccacgccgcctgctgcctggggccccccgccaatgtcccgcggaggaagatgccctgcagccgccaccctggcctcgcccctctttccagggaccaatactgcctgccccgtgtcgctgtccatggtggaggactttgaggcctttggcaagaggttccgcatggatgtgcatggcgctcagggtgagcaggcgtgcttgggaagtcaggtgtttgggtaggagggggagggggtgtgctggggttggggtggggcagcaacacatgcaaaagggcttgctgggccccggggtgggtggacgggggtgagtgcaggaagttgggcatggggtgacggagcacgcacaagtggcctggcaggggcgtcatggcgaggtgtgaggaggctgcctggcggggtaggtgcactcacatcgctgggccggggcatgcagcacaccgccctccactctttcttgtcagatgacaacgagctggacctggaggacctgccccccggctcgaccctggagatgtgtgccttgctggtgagagccccaggggaggatggggaggcctgccccggcctggccgccataactgaccgcagcacgcccgcccccggcacgcgatgcgtgccgggccatgacccccaagctcctgcaccctccactnnnnnnnnnngctgcagcaggcggcaggtggccagcaggggcagctgcggcagtgtgggcagggtgaggggctcaggggcgaggatgcgcatggggttggatggcgatcttccatggcaacgcagggcacaagcatgcgcacaaccatgnnnnnnnnnngccggcctggccgccatgactgaccgcagcaagcacgcccgccctcggcacgcaatgcgtgccgggtcatgacccccaagctcctgcaccctccactgggatgcagggaaagctgcgtgagcccgggtacgagctggcgtcgcgtggcaggagtgacatctggatgaaggtatgctggagggtggcgagggagaggggggcctgttccagtgacaagtgccagccgtgtctgggccctcgtgacatggttgtgcgcatgcttgtgccctgcgtcgccatgggagatcgacacccaaccccatccgcatcctcgcccctcacccctgcccacactgccgcagctgcccctgcnnnnnnnnnnnnnnnnnnnnnnnnnnnnnnnnnnnnnnnnnnnnnnnnnnnnnnnnnnnnnnnnnnnnnnnnnnnnnnnnncccggtcgcagcggacggaggagtgagggcaggcgtggagggctgcggcgcgcccctcggacatggcgcgacgtccacctgcccaccacctgaggaccgccgcgcaccgagtgcggggcatcgggggtggcctctcggagagaaaacagcctcgtctggaaagacccacttgcacctgacatcacccagagtgaccacaccgccgagaccggtgatccagccccctgcatgcnnnnnnnnnngcctgtcgcagcagacggaggagtgagggcaggtgtggagggctgcggcgcgcccctcggacacggcgcgatgtccacctgtccaccacctgagcaccgccgcgcaccgagtgcggggcatcggtgatggcctcttggagagaaaatgccctcgtctggaaagacccacttgcacttgacatcacccagagtgatcacaccaccgagaccggtgatccagccccctgcatgcatgcatgtgactcgaacctgaaggcatgcggggttacagtgtggccgcagcggactcatgcagcgcctggcgcccagggggtccccccacgcaccgaggcaggcaggggacggggggagcagcctgcgcctgagtgagcagaaagtcccaaccccagcgccccacgccgcctcgccctcctcacaccccctaccaccaccgcgtcgccgcctcactccagcatggccgcnnnnnnnnnnactgtgactcgaacctgaaggcgcgagggattacagtgtggccgcggcggactcgtgcagcgcccggcgcccaggggattcccccacgcaccaaggcaggcggggaccgggggaaggagccggcgcgcgagtgagcaggaagtcccagccccagcggcccacgccgcctcgccctcctcacaccgcccccaccaccagcgcgtcgccgcctcactccagcatggccgccagcgcgtcgtagaatgcggcaaagtcgcgatcatggtctgcggccgcggcgtgcagtaggcctgcgtggtcggcggggaccaggccgcaggcggccgcgtggccgatggccgcgtgttcggcctcgccctcggcgtgcacctccaggaactcccaggcacacagacggcgccccgccggcgccagcacgcgctcgtccaggtggcggaaggcctccagctccagccgcttctccacgtccgccaggtactcgatggccaggttgtagcccagcgcgtacgacgccttgttggaagggggggggggggggggggggggnnnnnnnnnnnnnnnnnnnnnnnnnnnnnnnnnnnnnnnnnnnnnnnttggggggaagggaacagactgtcgcgccgtgaagcggaggtgccgagcgccgccaggtctcgccattgcacgcataccatccactccgagcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtggatccctcccccctcactcacccacccacccctccccaaatcaccaagacccacctgctcctgggcgtccccggtgcgcccgccaccccccagaacatcgcgcatcatctgggagtagaggatcgccgcggcgggggggaagctcgtcgccgcggcgcgcatcgccggctccagcgcctcgcccagcaggtcctcgtagaactcggcaaacagcgcgcggtgtgtcgcgcctgcggggtggtcgtgggacaaagggcgtgtgagagggcgatggaaacttactaggtgggcgggtcggccgagcaggagcggcgcgccccaatcgccacggcaccgccctccgcacccccttgcatcaatgcccacatcccgcctgcgactggcgcgagggccgccgcatccttacacctccccccgtgaccacattccctccctccccccgtagacgcttttccccccccttccccccccccgcgtctcatcagtcaccctggggctggtcgnnnnnnnnnngtcacacctcccccccgtgaccacattccctcgctcccctcgtgaccgcatttcccccccctcccccccctgcgtctcatcagtcaccctggggctggtcggcgtgcagcccgtattcccccgccaggggcaggatcaggcgcttcagcgcctcgtcgcgcgcgtggtacccgctcaggccgatggtgctctgaaccttgagcagaacggcggtgaaggcggggttgaaagactccaggttgaaggccagctccagcatgacggggcgcagcttggcggctgagaaagggaggcaaagggaaaagtgggggtgcagggtggagggtacctggggtgggggatgacaggccattttagttgcacgccagcagcgccgatgggattgccctgtggcggcctcgtggtccgaggggacgcaaaactccctcgctgtggggccggggtggcctcatgacacatcccannnnnnnnnncggcggcctcgtggtccgaggggccgcaaaactccctcactgcggggccggggtggcctcatgacacatcccacacactctgccaggggtgccggccccgcctcaccaaactcatccaaggacagcgcacgcagggcggcgtcgaagcggtacagtgcccgtacggagtggccatggtccagggaggactgtggcgggaggtgatgggaggggcaaggcttgtgtatgtcctgcggtggcactcactctgtcggccccgacatcccaaggccctgcctggccccgcctcacacctccaatgcccgaacttcatcatggctgatcaggccaggcttgctggcgggtacaaccgtcgcggggcatgggggcgcctgcgtcgcgacggctccagccaccgtcccatgatccatgggtggcgccggccatgaggatgcaaaactcctgccctgcacggcgcatgagagtgggagcgggtacaactcatcccgtcgtagggatatttttcagaatcgacttataagagtatcgtatatgcttgtcccgcacctgggccctccttggtgagaatgccggcgctggggcacgcagggcgagcgctccccgggtcccagaacgaggggatgcaccacagggagcacatgccgatggggcgaaagcacgcatggtggcaaggctgggaggaatgaggggagatgggctccgatgccgcgcaaagcagcgcatggtggacttggcgatcgcctacgcccaggtggcgggtatacccgacaatgaccgataggcatgagcttgcctcaggaatttttggcaccagggaccatcagtcttcacagccgcattcattggcgacccataacttctacatcctaaagtgctggccattccgtgttcatgattgggagacggctctcagcgtcatacactgcagaatctttgctatctgatagatcaagcgtgtgtggactgctcaggttgagcggctctgttttctcacacaaatgaaaagagggagtgcagcaatctgtgcatgtttttctgcttggtatggcgcagcctcgagctcatcacaaaccgtgccgtgccctgcttcagatgcatccactaggccgtacgcaggatgaggtgcaccccggaatccgtaaacacaggaccgctcagccctcccactggcagcgcaaaggcagcatcctcaaagggacgctgcattgcgcctcgagggaagaggcccagatcacctccggcccgggcactgtgacgtgcgaatggggttgtgctggaactttgcatcgtggtgtcttgcaatgtccatggctgggtctacctcggacgatcagcaggccgcggagcgtcccaatccgcccgcccagaatgtaaatacctgctgcaatggctttctttgcgggcgagctcggcaaagtctgcctgaccagacgtcagctggcggtggaattctgcaatcattgactccgcttcctccctgctcctggtgacctgggcctccttccaactggacgggcgacgagagtcgcggtgcttcaccagcaaatgcgaggccctcacctgatcaggagccatggcggactcaagtcgagataagatggccggcgaatagcgtggaagaagtagggctgcgccagctgagctggcgaggcatgagagcggaagtgagcagttcctaaacgaggtcaagattgcgcatgctgcgnnnnnnnnnnaccagctgagctggcgagtcacgagagcggaagtgggcagtttctaaacgaggtcaagattgcgcatgctgcggctcgtgcgaagagcatgtcacgtggcagagcgcacatgctgacatccgtccctgctagaaccccctggaattctcgtccacattgaagatatacaatgtataggtacannnnnnnnnnatcacgcggcagagcgcacatgatgacatccgtacctgctggaaacccctggaattctcgctcacattgaagatatacaatgtataggtacacatgcggcagcgccctatcacttgtggtggcagcagtacactgccaattccccggggtgcagcccaggtcgcatgacagcttcaaaacagaaagcgagaattgatccacggcccagatggccctttgagacgacgaccccgctggtagcttctctcaaatcttctccagataccaaagcagcgccaggcccccaaatatacagccacgacaaagaaataccgtcaaatatgctttaacctcgtggttgtcggaacccaccgcatcgaggatcgaagtacatannnnnnnnnnaagcccaggtcgcatgatagcttcaaaacagaaagcgagaattgatcaaccccaccagctggccgacctgctgttacagcagcttctctcagacttctccagataccagagcagcgtcaggccccccaatatacagccacgacagagaaataccgtcaaatatgctttaaacctcgtggttgtcgaaacccaccgcatcgaggatcgaagtacatatccgagccgcccagtactcggctacctggctcgtgtgttccggggtaccacctcttgttgacagtgggnnnnnnnnnnattctcggcttcctggctcgtgtgctccggggtaccacctcttgttgacagtgggnnnnnnnnnngacagaaaatcttcataccttcaacattttctataacatatatagtttgttgtgtttggctgcatcgtgggcaggnnnnnnnnnncacagaaaatctccataccttcaacattttctataacatatacattttgttgtgtttggctgcatcgtgggcaggcgcagtacaaacactccgaggtgcgagattcaaaggtacacactcaggcaccgcatttctgtgtctctggacgctgaacgcggctctgcacggtctcacaaatcttgctttatggcctaggcgtggtttgcgttgagagtttttgtgtgaccaccacgttcccctctgagtgatagtaccgcggaagtgcctgctcctcaagagtcgcttctcgcgggcgtccccaaccctgcgagtcgtgtacggttgacgtcccgcatatgccttcatacaatccatcttgcccaatgcagtggctggaccttgtctcgtccggagtaggtcgatctccttccgggcctgaaaacggaacgtccccccccgggtgcgagggcatgcggcgcttcgtccggcccgtttcggtgttccactggctacatgcgcctatatgcacccccatgtgacttttacgccttttccactcccgtgcagacctcccagggcatgtttagaccatccccgcactttaaggaagctacctgaagttgcctttcaagccacggtgaaactccctcgccatctcatccaagggctcgcacggcggcacgctccccccatacggtaagctggccacggcgaccgtgaaacacatcctcccgcggcatgttacaatgatgtcctcgcttccacacctgtcgcacgctgcgtttgctcgacagatccagccccgcnnnnnnnnnnccggcgaccgtgaaacacatcttctcgcggcatgttacgatgatgtcctcgcttccacacctgtcgcatgctgcgtttgctcgacagatccagccccgcactcagtcacggcggcctttatcgcgcaggtgcacccccacaacctcgaacctgggtatggtgtgaggtgcgcggagatgagcaacgagcccgggtgcccggagaggtctccggcgcattctcgtggctctcatggcaccacacccgccacccccagcactggcctccttcnnnnnnnnnnaatcgcgcaggtgcacccccacaacctcgagcctgggtatggtgtgaggtacacggagatgagcaacgagcccgggtgcccggnnnnnnnnnncctgattggttgagctgcctcttctccctctcgatgttccacccctgcccccgccacccgggtgtcaagcgcaacgagtgcaacttcttctgtgcccgttgctcaccgcgagaggggcaggcctactgccgcatgtgcctggattcgcacggcgactgcccggggcccgtctttcagatcaggaaatacatgtaccagacgtgcgtgcacgtggaggacatcgccccgctccacgacgtcaccggcatccaggcctacctgatcaactccaagcgggcactgctcatccactccaagatctccgccctggcctctgccaactccgccctggatgagatctgcaggtgccccctgtgcctcgtgttactgggactgccggggttgggagggcacgatattggatccagatggatgggctgtcccctgcaccctccgctttctagggctgggtgccgtctatgtgacnnnnnnnnnntgggttgggagggcacgagattggatccagacggatgggctgtcccctgcaccctcccctttctagggctgggtgccgtctatgtgactgttcgtgcccagatcaggccggcggcccgtgaagctgattccgccccccccactgccgacgctggtgcccctcgtcccttgnnnnnnnnnntaggctggcggcccatgaagctgattccggccccccaactgccgacgctggtgcccctcgtcccttgactacccaccctggcccaacatcttctcgatccgccctgccacccccctcaccttcctcgagtgcccctccctcagcccccccttccccaaccctgccactcccacagaggctgtcagcgtccccttcgctcggactgccagtactgttcgctgcactgcaagaatgtcgccaacagcaacagggagtccaaaccccctacccattccgccaggcaccttccgccggcttctccgaccccggcctcgccccaccccgccgcgcccccgtcctctgcggccctcccctcccgtcagaccgccttccgccccgtgccgcgacgggagcccacgggggggtccccgcccgtgctgcgcccggtccccctccgccgcggggtcgtgctggacctgccctccccaaactccaggccatcgctgctggtgctgcggcgggacggcgccgcgccgccccagccctgggcggagcgccgcgatgcgctcgcccaccccgccctgccccggggccccatggccttctcgggcttgccccagcagatgtacgatcctgggtgtcagggccaccattgctcaggggaggagccttgtggggattgcttctatgcaagtggctcatgatccgctgcgtcggcactcnnnnnnnnnnagccattgctcaggggagggggcttgtggggattgcttctatgccagtggctcatgatccgctgcgtcggcactccctgccaggcgcgggaggggcaggcgcgggaggggccgatcgggctgttgcgccacgcagcctttgagcagggctgggagcctgaaattatagcccacccctccaacctcaccacctcgccccttcgcctcactgcagccgggccagcagcctgcacggcagccaccacaggccgcatgcgctgcagccgtggaccgtgaggggcggcttccagccgcggcggtcccaggagctggacccacagcaggaggacgaggcaggtttcatgtcagcgccgcgccagtactgatgcctgcgtcgtggcagcccgagtccgagccctttatcttgccgggagccggctgccgcctgcaatggccgccgcacaggtgcccccccttcctcaccttcagcgtcggcttgctccggatgcactccactcttgctctctcccctgcctcacttgcagnnnnnnnnnnagaggcgggtttcatgttggcgccgcgccagtactgatgcctgcatcgcggcggcccgagtccgagcccttcatcttgccgggagccggccgccgcctgcaatggccgccgcacagatgccccgccttcctcaccttcagtgtcggcttgctccggatgcactcctctcttgctctctcccctgcctcacttgcagcagccagtattgctccatccttgcattgagatacctcaaagccgcacatcgcttggccttggcgggtcataacaccatttggtttattccctgtcccccagacgccatttcattccgtaccgcctccagtacccagcctgagtgctgcatcccgcttgcacagacaagcaagcaggagctgcaaggggcagcccttgccactggtcagcctccaaacagggagacatggcagctcctgccgtgatagcaacctgtttcaggacctgactggcagcggcctcgtgcctcccttgtctggccaacacgtccacagtggcaagcttgagctgtcccacacctcctgttgggcccatgcatacacagctccttttacccaaactgtctgattgcacaagatgaactgcagtaactgctctgagcgccaacgagagatgtacagcagcagcgaatcgcggaggaggggggtgggtgggtggggtgttaactcactcatgcgtgagcacatggttcttgaagggcctcagcaccaccttcccagccccaggtgccatctggcataggagccaggcgtgcatgcatttctccacgcagcaaccccttgagcagctgggcagagatcacatggccgtatgggagggagatatagtactgcctgtccccctcgacatccaaggggaggagggccgcctccctaccacccagccagctgccgtggtggggtaggagcagccgtccaaggtccaccgccctgtcctgttgagttggaaagttcaaaggaaccaaacatattgtgtcttgcccactgggctggcgaggtgaggatgtgggcttcaggctctgtcaatcgccgtgcatggagtatgggcagggtgacaggtactacacgcaaccatccgatgctgcttctctccaaacccgccacacctctcgattgccccaaaagtccatggtgctgaagaggaggcgtgggggcatgttcccggccgacggggggagtatggccagttcgccgacatacctcctgctaaagtaccaaagggcgcctgatgtggcgctggctccaaaaagtagacccccggctgccaatgtttgcatggtcgtactttcagcctgtgcgtgggcaaggggactcatgtcctcgagtttctttcatgcaaacgatcttttccagtcacnnnnnnnnnnagggcaagggcactcgtgtcctcgtgtatctttcatgcaaacgatcttttccagtcacagccatatgtggtgctggtgcaccagcactgtgaattcaggatgcctgacaagtgcattttgatctgcgagtatacacactctttcccccccctcgccagaccgtcacctgccgcagaagggtggctagtagagctcctgtggcacccacgccacacatctgagccaccttgaacctgaccagtatgcgaaagaggagcatgcccgggcccttgtacagcaccaccttggtgccgggggtcgtggggaggagatccagccactccggctgctgcnnnnnnnnnnccccgggcccttgtacagtaccaccttggtgccggggttcgtagggaggagatccagccactccggctgctgctccctgcccgggggttgccgcggtcgttccgatgttgagggactccacgaccctcctgatgtgaacagagaacgtccatgctgccatggttgccccgatgcccggctctgcagccctcgatgtgcaatgatgcaggtgctgcaggacccagtcacctccggggcccgttgcatggccaggtggcactccatgcacccctgccccgtcacgagagcccggtagagccagacatgatctgcacatggcttgcacagtagtaggccggcacgtcgagcacccgcctgcattgcaggctaggtgcgccccgcgctcgggctggcaggatttcgcgctggttgttcgtggtccaggtccctgcgatctggctcaacacagtgtccattcgctcatcagtcatgcttacagagctgttcagccccaacactgttggagactggggtgtttgggcgccgcagcgttggcggtgctccgtgtcgcgcgcgggacagggctgctggccctccctcacaagacatatcgactgaggtcctgtttcttcagcaggtcctccagcttcttcacgatgtcctcccggtccaccaccacttccatcggtctactcccggagtccgtctgcacggagagagggtaggagagggaggggatctctgtgccagatcccctgctcatgatggaagcatggagccaccctgccgccctgacctccctcctctctgggggcccaaccacacgagccccccccaccccatcgagggcatccctcgcgcatttccctccacccacccaacccgcgcgcaccagctccggggcctcgaacgatacgtcctccacgatgcgctcgatgatggtgtgcaggcgccgcgccccgatgttgtccacgctggcgttgacctcctccgcggtgcgcgcgatctcgcgcactgccgcgtcggtgaagcgcagcgagatgccctccgtggccagcagcgccgcctgctggcgcagcatgttactctccggctctgtcaggatacggtggaagtcatcctgcctgtggcgagcgggggtggggtggggtgggggggtgggggttgatnnnnnnnnnnnnnnnnnnnnnnnnnnnttgatagagagggataaggaaggagtggaagcaggcccagtggacccacacacgttttcaaacgcgcccctttcctcccctccccgcaagtcactccctcgccccacccccctcgcttcactccacagcataccgttggccccccttcctctcccccccagctcccagtaacacacatcttcactcacgtgaggcccttgagctccacgcgcacgggcaggcggccctgcagctccgccatcatgtcggagggcttgcaggagtggaaggcccccgacgcgatgaacagcatgtggtcggtggacacgttgccgtgcttggtggagaccacgctgccctcgatgatgggcagcaggtcgcgctgcacgccctcgctggaagcgtcggcgccgtacc

SEQ ID NO: 46768 - DNA, 61 bp, Chlorella protothecoides
cgttccaatgcatgtctcaattcagcaaccttttccataaaggcacctacccctccccccc

SEQ ID NO: 46769 - DNA, 69 bp, Chlorella protothecoides
ttgcctttatactggaaagggcgctttgagaaatggcagcaaacaaaactcccggagttgaccttctga

SEQ ID NO: 46770 - DNA, 94 bp, Chlorella protothecoides
gcccagcacgtcgtcatgctccatgtgctctgacggcgcctcggcgccattctccccttctccaccctcgtcgcccgagtcgggtgcgtcgccc

SEQ ID NO: 46771 - DNA, 61 bp, Chlorella protothecoides
cagccccgaaagagcaccaccgttccattatcgtcccctcaccgagcttcctgtgggccca

SEQ ID NO: 46772 - DNA, 61 bp, Chlorella protothecoides
tttcgagagcgacttcacattcaaacccaaccatctgaccacctacaacacctggaacact

SEQ ID NO: 46773 - DNA, 70 bp, Chlorella protothecoides
ggcctttgcggcgtcggggccccgccccgaggggtgctcctcgcagaggcgcggcgccgcgccgtgcagg

SEQ ID NO: 46774 - DNA, 61 bp, Chlorella protothecoides
caatcccttcatcagcacgaatcctgccccacctcgtcagtctctccgtccgccatagatc

SEQ ID NO: 46775 - DNA, 5601 bp, Chlorella protothecoides
  modified_base (300)..(309): a, c, t, g, unknown or other
  modified_base (571)..(580): a, c, t, g, unknown or other
  modified_base (1077)..(1086): a, c, t, g, unknown or other
  modified_base (1275)..(1284): a, c, t, g, unknown or other
  modified_base (1530)..(1603): a, c, t, g, unknown or other
  modified_base (1687)..(1696): a, c, t, g, unknown or other
  modified_base (3380)..(3389): a, c, t, g, unknown or other
  modified_base (3941)..(3950): a, c, t, g, unknown or other
  modified_base (4331)..(4340): a, c, t, g, unknown or other
  modified_base (4558)..(4567): a, c, t, g, unknown or other
  modified_base (4653)..(4662): a, c, t, g, unknown or other
cgggcggcgcagagctggccgccgcgctggcgcgcacgcgcgagttcggcgcagcggaggccgcgcaccgcgccttcgtccgcgaccttgtgtcccgcgctttcctggacgcccggcccctggcctcgctcgtccaggcgctgatggaggccgccgccaggatctgcgccctgatccaggttggcggtggcggtagtggtgggtggtagcaccatctttgacaggggtggcgggagtgctaggaggtcggtcggcggactccgtagatcggcgactcagtgggtgctccgcgcatggagnnnnnnnnnngggcggtggtggtgggtggtagcaccatctttgagaggggtggcgggagtgccgggaggtcggtcggcggactccgtagatgggcgactcagtgggtgctccgcgcatggaggggccagggcgcagcagacaggcgggccctgggctcgctgggtctcatccctggctgtatgcgggtgaaggcgactgcaccgcgggctccagtgtgacagccgcaagtctcctcggccataccccaccccacactaatcaaccgcgccgnnnnnnnnnntgactgcaccgcgggctccagtgtgacagccacgagtcttctcggccgtaccccaccccacactaatcaaccgcgccgcgcaggacatcgagggcgagcggcgtgacgcggaggccacgctcggcgcgctgaggtcgccggagcgcgaactgcgtctgaagacgacgctcctgctgcagctcctgcagtccggcacgctgcaaacccagagcagggcgccggcgctgcgccacctggtcctgcgcctgacctacaacggcttcctggcggcggcctgagcggtgggctggttgggccaatggcgatcgtggcgacggcatgcccagcacagcacgctcaagcacgagtcagttgccacagaagactcggacttcttacttcccctcatgctgcctgcaccctctgacacccgcctatctagaaagacacctcgactcaataagaagagagtgatacattgccagccacgagcaccggaggacctgcccttgcgggtnnnnnnnnnngtaagaagagagtgatacattgccagctacgagcaccggaggacctgcccttgcgggttgtgggagctcaacatggagccctgcaaatggcaaggggatgtacagccgcccatgcccacccccaggccaccgcgtacgcagtcaagcttttgaccccagcccggtcgccggcccacgcgactttgccannnnnnnnnngcgcccatccccaggccattgcatacgcagtcaagcttttgaccccggcccggtcgccggcccacgcgactttgccagggcgaacaccgcgcccgcggccaggcccaccaggatgctggcaaggttcctcggcgtccagggcgcattgaaggccagcagaccgatgagagccaggggcaccttgttcaggctgcccaccaggctgtagatggtggcggtggtggtgctgatgaaccagatgctggnnnnnnnnnnnnnnnnnnnnnnnnnnnnnnnnnnnnnnnnnnnnnnnnnnnnnnnnnnnnnnnnnnnnnnnnnnaacggaaggtggtgtttgttggagggatgttaagcctcctggatctggcatgcgtcataggctgtggggaactgtccaactccnnnnnnnnnnccatgagcagcgcgatgaagggcaggctcagcaggttgttgtagaacacctgggccgagggtgagggggtggggggaaaggaaggtggtgtttgtttgagggatgttaagcatcctggatctggcatgtgtcataggctgtggggaactgtccaactccagggttgtgcgagcctgtaacgggtggcatgtttgcttatcccaaccgtgccagctgcagcggctcacgctcaaagaccctgttgccagccccggggagtgtcccttggtgccgccctgctcatgccaggcacatccacccgctctggaatccctggcccgcctcggactccagctgccttgagcagcatctcacccgcgtaccccctcctttggtccccccttcccaaaagtaaacgcaccatggagaactcgtccatcttgcggcccgacaccgtgagcggcgcgatcttgtccatggtgccgcgcagtgccagggagtaggccgccgtggccgcgcagttggccatctgccacgcgtacccacgcgcgttgaagctgaggtcggtgagcgcggagcacagggcgctgaccgccatgagcgccatgcagcccaggacgggggcgccataggtgcgcccgtgcagcacgtagtccccccccagcgtgaagaggttggtcaggttcttcagcaccgtggccatggcaacgttcagcgaggccagcgcccagaagctggtccctatcatggccacgaagaggaggttgacggggagccaggcgcgcacgatgcgcgcactcagcggttccagcgtgatcaggcccgcggcgtggcaggcgcgggtggccaccacgcagagcgcgcactggaagaagagcagcgcgttgggggaggcgaacgagaaggaggacagcgccaccttgttcagcagcacctggttgaggggccaggggtgtgggaatccatgtgggagaggggggtcagtgcctgaagcctaggtggacagggaggtaggctctagagatggaagtgcatgcaggctcgaaggtttcggaatctcacccctgccacccacccactgccagccctccaaccacctcccaccatgctcatggaggcgatgcagtacagggtgccggccagcaggctagcggggacgccgaggggcgcggtcctgtgaatcttgcgggacaggtcgatgtccacgatgccatccacgccatggccggccctgggaggctggccaggcaggaggggggcctcctccctggccgaaccgggggccatcaccctggtgcggaagctgttcgtcgaaccgcgctatcgggtgcacataagtattgaattcgaaagctacggcttcatgagctcgaggcggcctgcatcaggcatccacgctgcgtacccagggtttcgaagcaggaccttgacagcggcggcctggaagcgaacggcagcggcaaggcgacaaggtatttgatctgccaatcgcttactcggtgcactattatgttgtttgatacgaggtcgggaacaaggagtcgaggatgggcgtgatttttaaagtgagtttccacggaaggcgccctcgccgggacctgtcacaaagatggatcgcaggaccgatgttgaccggaaaagacactctcacaactggggtgcattctattgaatacaatgatgcattcgataccaaagctaaagnnnnnnnnnngtgctgatcggaaaagacactctcacaactggtgtgcattctattgaacacaatgatgcattcgataccaaagctaaagatgtgtgtactgaggattgactgcggtcagaaatcgtagcagcgcccagccttctcccagtctccatatcttgtgggctcaggcccctttggtcccccttcttcgccctctggttgattctgcgtgttgggcatgaggggagtgtgaggttgcaataacctccaatgagattggccctcaagcatacttggcacagcagatcctcctgaatctctgtgtgtgaccagcagattcacactcaccccaggccgaggtccctgctccacagctccttcctgtgcatatgtgggggcttcggtcaactgtcgcaactgctcctccgtcttctgctgcagcttctgggtgaatgggtcgactgtcgtcccctcgctggggtggggtgtgctgctccccgtcgccgagctatagttggggcagacacaccgcgccaggtcgacacaatgctgcaatgccgaccagctctcggggacctnnnnnnnnnnctggggtgtgccgctccccctcgccgagctgtagttggggcaggcacaccgcgccaggtcgacacaacgctgcaatgccgaccagctctcggggaccttttgcgaggaggagaacaatagcccggcacctgcgtgacggagcatcgtgttggggtgtgtctgggtgtctcgtgatcggtcgacgttcgggtgtgaatgtttcgtatagatactggtagatttcgtcggtatgggtttaaattgcgaagccttgtgtgtgtggacgttggtgcacgaacataaatcattccatctcgtccgctcttccaccgcatcccgcgccctgccgtgttggccccacccccccgccttggcctacctctcccactccgtcgttccacnnnnnnnnnnaggtgcacgaacatgaatcattgcatctcgtccgctctttcaccgcctcccgcgccctgccgtgctgaccccacccctccgccctggcctacctctcccactccgtcgttccacgcattacaaggcctacagggggtccagcacgccagggggtcgtaccaaggtacaggcagagatgtatgcagtgtgggagggggccctgggaggacggggctccnnnnnnnnnnagggcccagcacgccagagggtcgtaccaaggtacaggcagagacgtatgcagtttgggagggggccctgggaggacggggctccnnnnnnnnnncagggctccagagaggagacggtgggcccccgcctgcgctgcgaatgaaatactgccgcggggcggcgtgggagggactcggtccggggggtgggggggtcgtggcaacgggaggtccacgcggcggcgcggtgcgccgcctagcccaggtcggagcgcttggccagcgcggccatggaggtcttgaggtgcgccttgtaggacaggatgtcgccctcccaccgcgtcacgcgcccgtcctgcacggtccagatctccttggccacctgggagatgagtcggaagtcgtgggacaccaggaccagcccgccgtcccagtcgttgatggcgtcggccagggagtcgatggactcgatgtccaggtggttggtgggctcgtccagcagcagcatgtggggcgtgcgtcgcgccagccaggcgaacaccacgcgcgacttgaggccgtcggacagcttgcgcatctccagcgtctgggccgcgcccgtgatgccgaagcgtcccaccaccgaccgcatctcctccatggacacgcccgggtactcggccatcatgtaggccagggccgacacgtccagcggcagcagctcggtgaggtgctggtggtactgcccgatgcgcaggtggttgtgccgcttgaccatgccgtccagcggctccagctgccccgtcatcagcttgagcagcgtggacttgccgcagccgttggggcccaccagcgccacgcgggagtccaggtccacgcccagctccacgtcggagtagagcaccgcgtcgggggagtagccaaacttgacgttggagaactggaggacggggggggggagcgtgcccacgttggcaaaggccagcttcaccgtccgctcctggctgaccttctccgtcagcccgtcgcgcaccatctttgccagcaccttctccttgctctgcagggggggaggg

SEQ ID NO: 46776 - DNA, 76 bp, Chlorella protothecoides
agcccatgcacgcagcctcctccatcacagcccaagcaaggtccctgcagcgcaccttccgcttcggaactgccaa

SEQ ID NO: 46777 - DNA, 67 bp, Chlorella protothecoides
tttgtttcatgctgccaaggagtgtgcttgcgtggcaatcggtgcagatcatgtacattcctctcac

SEQ ID NO: 46778 - DNA, 75 bp, Chlorella protothecoides
agcctcgggccgacaacatgcacgcccgtaggtggtatcccgacacattccgcgtgccaacacccgctccgaccc

SEQ ID NO: 46779 - DNA, 379 bp, Chlorella protothecoides
  modified_base (94)..(324): a, c, t, g, unknown or other
gttcgaagggagggtgcatgggaggggggaagggggggggttggtctcagcctgacgagcaggctcggactacactgccatggtgcaccttcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgctgcgaggctgcaccggcggaagtcacgacgaggagggcgaagctcagtacg

SEQ ID NO: 46780 - DNA, 61 bp, Chlorella protothecoides
caatgttgccattcttgtcagcggtgcatgacttctgtccagtcttgagactcgacgctga

SEQ ID NO: 46781 - DNA, 71 bp, Chlorella protothecoides
aacccctggggtatgggtcgagacgctccaacgcagtgctgttcggcacactccataaaactccctccacc

SEQ ID NO: 46782 - DNA, 83 bp, Chlorella protothecoides
aatggcgtggagatcagcaagcagtccgccgaggaaaactgcccatgtcttgtgggccaggccagcctccacaacggtggacc

SEQ ID NO: 46783 - DNA, 68 bp, Chlorella protothecoides
ccagccgccgcacctcgtcgccgttgacggtgttcttctccatcagcaggtccgccaccctgcgcaga

SEQ ID NO: 46784 - DNA, 67 bp, Chlorella protothecoides
aacgagagattgctgtccgcctctgccctgtgacccatgctgttcctggcaacatgatgggtgtgaa

SEQ ID NO: 46785 - DNA, 61 bp, Chlorella protothecoides
tcagtttagccacctggccggcgccagcccgcacctacgcttcttcggcaacctccgcctg

SEQ ID NO: 46786 - DNA, 127 bp, Chlorella protothecoides
cccagcgccccttccgcggctgccacacctatggtgttgttatgggtgggagggggagtctgtgaggctttgggtggggaaggtctgagggtcaccgggtatcggcgccagggccacgggcatggtt

SEQ ID NO: 46787 - DNA, 61 bp, Chlorella protothecoides
gtagaggggtggcgccaccgagacttccagagggagggtcaggagttgggacgcgtgctgt

SEQ ID NO: 46788 - DNA, 61 bp, Chlorella protothecoides
actgacgtgcgtaggagtcgtacaggctggggtcctttcggatggcctcgatgccggcccg

SEQ ID NO: 46789 - DNA, 77 bp, Chlorella protothecoides
gtcggcctgtggaagtgagagggaaatatcctgctgtgtgtgtgcgtgagaaagagaggatgctttgtggtcctcag

SEQ ID NO: 46790 - DNA, 76 bp, Chlorella protothecoides
gccgattgaggtgcctgcgccgcatgctgggcgcattggcggatggggtatcccctctcgctcatcgacaatgcat

SEQ ID NO: 46791 - DNA, 61 bp, Chlorella protothecoides
tcacagggtgacgctgagacgagcggcaaaacctccctcccgccacacctcttgtgtgtct

SEQ ID NO: 46792 - DNA, 74 bp, Chlorella protothecoides
cctgccatgtgagatggaataatacattcccgatcatgtatatgtatgcactggtcagagtgaaaatgcaggag

SEQ ID NO: 46793 - DNA, 61 bp, Chlorella protothecoides
tgattggaatcgtgcccaattctggtggtttcctgccgccactccttgccactctacatgg

SEQ ID NO: 46794 - DNA, 70 bp, Chlorella protothecoides
catccatcttctcgcggatgcactgcgaaggtattgtttgggtgtgtggggggggggggggggggggggg

SEQ ID NO: 46795 - DNA, 61 bp, Chlorella protothecoides
gatgtgtggggaaccgaccgctcggggtgcgcagcctgcctgtgccgcgccgacactcgtg

SEQ ID NO: 46796 - DNA, 75 bp, Chlorella protothecoides
gcgaacaaagcaggtacatagaccgcatgatgttcaggaccgcggcctgcaccccaacgcgcccccccgacttgt

SEQ ID NO: 46797 - DNA, 63 bp, Chlorella protothecoides
tgagaaatcctccaatccccctcctctctttcatccacacagaacgcggcccgcctggactca

SEQ ID NO: 46798 - DNA, 11355 bp, Chlorella protothecoides
  modified_base (1315)..(1324): a, c, t, g, unknown or other
  modified_base (1816)..(1825): a, c, t, g, unknown or other
  modified_base (2002)..(2011): a, c, t, g, unknown or other
  modified_base (2899)..(2908): a, c, t, g, unknown or other
  modified_base (3319)..(3328): a, c, t, g, unknown or other
  modified_base (5474)..(5483): a, c, t, g, unknown or other
  modified_base (5926)..(5935): a, c, t, g, unknown or other
  modified_base (6223)..(6232): a, c, t, g, unknown or other
  modified_base (6690)..(6699): a, c, t, g, unknown or other
  modified_base (7415)..(7424): a, c, t, g, unknown or other
  modified_base (7889)..(7898): a, c, t, g, unknown or other
  modified_base (8268)..(8277): a, c, t, g, unknown or other
  modified_base (9494)..(9568): a, c, t, g, unknown or other
  modified_base (9885)..(9894): a, c, t, g, unknown or other
  modified_base (9949)..(9958): a, c, t, g, unknown or other
  modified_base (10036)..(10045): a, c, t, g, unknown or other
gggtcgggggggagccggcagggagcagcagcaccgagtgccacgcccagtgtatgtccatgccattccagttcctggaagaggagcgctcacccaaagcgcccgcatgtctctatgcagggtctctccaaggatgcccagggtgtagccaacagcttcaccgtggcctaggcgctgcggcatcgtacattgcggcgagaagaagacctgtattacgataattttgccagcatgtgcacaacaaccactgccactgaatggttggcatgggcctggtgcaagtgccgtggacactgactgggtctgtaacaacaattctacactgagagaattcccagtgctcctgcatccgcgaggcggggagggcgcgcgtggcgacattgtcgccgtaacaagcgacggcatcgcgcacagatccgcgaggtaaaggcatggtaggtccaacttgaattttgcgccgcaacctgtgagggacagcactccccatcggtcgagtcctcaccatccggtgatgtcgaggtagggggtgggcctgcatgggcgtgcagcccagcgaggacgcgctagggcgtcttctggacaaaaaccggaagctttatgggcaggttgaggcgcagaggggcatcatcgaccgactggaaagccggtgaggggtaggcatggtgagggggcacctggccgggcacgagacatggactggtccctcaagctccttccatcactccccaccagcatatgcaagctgcaagaagacgaggaggtgcagcaggagacgttgctccacgtcaacagggcgtgggacgagttgaatgcctccatcgacttcttgagatacaggtgggacccagcatgatcaattccctcgctctaaatttggcagcgcaagtggcctagcagactaaggcgaagtgtgtcgcctgatggtgtgtcctctgacacctcgcagggctggtgccgcacccgagccgtcagcagacaaccatgcagctgctcagctgccctcgaccgacaccttgctgctggcatgctccccctttcttgctcgcttggcgtccacctgcttgaaatccgacgccctggactcggcggagctggaggagggagagccggaggagctggaggttgccctgtgcgccaggtctgccgccacctccgcggcggccgcagggctcctggacgccatcgaagccctcagggctggtggggtgcctgggaagagggcagagccagacgctgcggcagaacctgcctctgtctcggagcagagtgcggccacgcagcccatcgaccccgccgtcgagccacaggcgctgcnnnnnnnnnncgcggcagaacctgcctctatctcggagcagattgcggccacgcggcccttcgaccccgccgtcgagccacaggcgctgcttacccttgtcaaggccgagaaccggcggctgcggagcgtggccctggccagcgctgcccgcgtgaagaagctgcagaccagcctggcaggtgcctgtggtggttttctgtagagggcaggaaggctgcagtgtgtagagactagttctttgggtcagattggaaggcatggatctgtgtgattgatagcatgtgtttgaggtctgctatggggtagccagggtgctggagccggccggctaagcccagtgcagtgggagagcctgcttacgagtacctttgttgagccagaacttccgtccgtgtctgccatgaacagagtaagaccaaacgattcttgtttgcgcaaccactggctcacctggccacactccaacacggtccccatccagaccgcgaagccgagttccannnnnnnnnnataagaccaaatgattcttgtttgcgcaaccactagctcacctggccacactccaacacgctccccatccagaccgcgaagccgagttccacgtggcccagcgaaggatcgcacagctcaaggccaggtcccagggagaagaaccaccgagtgcggggtccagcagcaaggaggccnnnnnnnnnncccaggcgctgaccgagctccagggcaaggttgcggagctggagcgggaggtggagcaagggagagccgacctgaggcaggcgcagaggtgagtgggtgggtgatcggtgcggtcctacatccaacagcctgcaaaaagcacaagcaccgaagtctgatgcgctttccactgcgccaaagcagctcgactgggtgatcagccggcgggtacaaaccgtctgtgtgtactgcttgagggattcgaacccccgaccctcagatggcgatcgcttgcggagatgctacagggcaaaattcctttatttcccgcatatacccgggacggaccgcgctgtgcaggtttcgcacaaattcacggccatgaatctccgcacggcgcctcacgccctcccacgacgcccctgccgtctcgccgcagggacgcccgggccctccgggactccctgcagctggagcgggacgcggcggagcgagcccgctactacgactcccagcgcctggcccgcctggacgccgagttcaaagggctggaggacgccatgcaccacgcgcacgctgagcgggaccacgtcctgcgccggctgcacgacgccgagttccaggtggggctgacgtttgggagccgagggcggggggccacggggcgggggctggaccggtcgcttgagccaagcacgctgcattgtcacctctagccttcgacaggctttgatcattcgcccctccctttggctgcctgtgcagctggacggcgcggcctcggtccaccgccgcctggcgtcggcggaggctcagatcgccgcgctggacgcccggctggccagcgccagcgcggcccgcgccgaggccgagctggcgctggccgcggagaggggcaggctggctggnnnnnnnnnnaaaatggcatggacatacattgggcgtggcactcggtgttgctgctccctgccggctcccccccgacccatccacaccttgaaccagcgcttgtcgccagcctggatcttgaggatgtagaggttgccgttggacacggtggccgtcaccaggtggtggcgcccgccctcatcgccatctgccgaccgcgtcagcacggcgtacctggcaagcgggaggaggagggggcgttggtggcttgtgaaatgggtgccggtatgcaatgccctccccagcagtctgcaatcagatgggctccagcctcagtcgccatctgtcgtgccggggaaccccccaccaacacacacactcttccccttcccggggctgtcaaaaatgcatagcttgctcacttgtagtacttgtgccccnnnnnnnnnngagagggttccggtatgcaatgccaccccagcagtctgcaatcagatgggctccagcctcagtcgccatccgtagtgccagagtaagctccaccaacacacacactcttccccttcccagggctgtcaaaaatgtagcttgctcacttgtagtacttgtgccccttcttgtcggtggcctcctcggcgtcaagcagcgccgcactggagacctggttgggcttgaacccaccctcggaccgcgactcacctaggaacagcgggggggtgggttgggtggggacgagagtgacgaatggaaaccggccgacataagcattcgtcaaagcatgccagcctgtaagcattcgatgctcattccacgagaagtttgtcaggccatcaagccgccaacccttgctgcctccgccgcctcacccttccaggccgcagactctccaaagaggaaggcgttgtcgctgaggaacttgtcaggcgcgcccaggtcctcgatgctgttcttgccgacggggcgctggatgaccatcaggttgttaaccgggaagtagttgtcctcatacctgtgcatcggaggcgaggaaatctgaactttgcaagtgcacacaagaccatgtagagtccgagacagtgacagcaatacgcttggcatgcaacgcatgcatcgctcgacaatggatggaagtgacatgcaagcaccgcagactccgaatgtacccgcgcaagtgatgcacaggagcctgctgggcacagcaaaagccaaaaacgctgaaaccctgctccaaatcgacccacgcccacgccctcattgcacacgccctcattgcacctcagcacagttccagggaagtcccgctccgggctggggttccacttggcaggcaggagcagggcgaagccctcgcccgcatagggcacaaatcccgacttgttggtgatcttgcctgcgaacacgcgcgcggcatcgccgtaggcggcctgggacgcgccggtaccggccagcagggcagcggttcccgcgagcaggcccagggccgcacggcgctccatcatctgtgggcatgggggcatgcgtgctgaggcatgacctttgcatggcgcgagcttgcctcatcaccgacaggcagtagcacccgggggaattcttcggggaatctcggtcgataatgacgggatgcgttcaacccccccctcgtcacagggtttcgagacccctgtgcaggggcccatcgcagatggagccatcaccagcctccccatcgcaccggctcggactgctgggccctgcatgggcaggagacggtcctgggaatcgcgcgcctggtcgacggtccgtgcacgaccgccgcgccccccagggagctgacactggtgagcgacatcatggtcccgagatcagaagatgccttgaggaagtgtcgtgatgtagtgcggggcgggctcgcgggggatacgattggcgacggcaaggggtccgccccatatccacacccaatcgaactgcatggggcaggccggggtcgaaacggggtaggtacaccgccccgacaggtgattcgctgcacccccggtactgcgccgtgaaagggatgtagactgagacgcgcagtccatggatccgagaatgatatgttctaatgtaactagcacattgcttgccatgggaagcatgcgcgacggagcaaagggggggggggggggggggggggggggagggggggggggggggggggggggggggcggtccttcagacaaactgcccatcgccctctgcgccctgaccggttccggggcattgggatgggatccttgaaaggatgcacgcatgtaatatagaggtctcgcccgtatgcgagctcagcctccccggggtttgcccgccacatcgggccgtggctggcccagtgctgcccaggcttcatccacggccttttgcagccccttgtgccgcgtgctggcgtagcgtgtgtagtgggggtgtgaagtgccgaagagggcgcagtccttggtagggacccaagaatagtcagcggtgcctgtgcaatggggtgaccgagaggaagagggacacaatgaggttgcgtcgtgtggggcgctcctcttgaagaaggacgtccagtgagattcatgccggctcaaaaggcccggnnnnnnnnnntgaagagggacacggtgaggttgcgtcgtgaggggcgcccctcttgaagaaggacatcccgtgagattcatgccggctcaaaaggcccggggagtatggcactgcctgcaatccgccgggcccggccacgtccggtgcagctgtcaccatgtgcacagaggactagagcacctcgtccttgcccacgcggtgcgtctcaccgtaaaacaccacgaagacctcggcggcgttggcctggcggctcctggcctgggcaggggtcggcatctggacctgcgcgggccaccaggggaaggtgggcagctttgcccagaccagggtcccgtgggggagcccgccgctgcccagccccgccaccgcaggcggcaggctcggcttcgatgcgacgcccgtttgctgcatggccaggggacgggcgccggggcccaggggctgcagctcgnnnnnnnnnnccggctttgatgcgacgcccgtttgttgcatggccaggggtcgggcgccggggcccaggggctgcagctcggtgtctgaggggccaaaaacaggtggggatggaggggtgtgggctgccaggtggggctcgctccagcgctccggcggggtggtgggaccggggccatccagcccgcgcccgggctccaggtcagccagggaggcgctcttgtccatgtgggtgctgtctggacagtgtggaaggaatgggcggggtgagagaggagtgagcaaggtgggggaggttnnnnnnnnnngactcttgtccatgtgcgtgctgtctggacagtgcggaaggaatgggcggggcgagagaggagtgagcaaggtgggggaggttgccgatctgcaaccaagtcgtgcagagggtgccgagacaatgaaggaacatgtgtggccctgtgcaaagcagcctccagccccgtcacccaggggcatgcacgctggagcatcgtcagttgatagcttcccaggcgtccagcatgaggtgcagattcagtgccgccgatgcgcatatcttacggagcaggagtcccccccacaacaacctcacccgaggacactggacttgcgtgccaggcagcggatggaacggtcgtctctactccgctggaggttgcctgtgctggtcctgcatccaggcgtgaggggtggggtggggccgctgtggggacacgcctggggccacctgaattattggaggcccgcagcctgnnnnnnnnnntgtgagggatggggtggggccgatgtggggacacgcctgggcccacctgaattattggaggcccgcagcctgcggccacattccaactcccaaccgggcctcgaccctccgacacactacctgcggagaagacacgcctcacactgggtcccctaaatgtgagtatgagcttcgagtccttgccgccgcctgcgtgcggaataccgaggggtgcattgcgatggacgcagaaccagaggggaccggaggcggttgcatctacatgcctgtgcacctaccttccaggcgacgctcgacacgcaatgccatgccccgatctgcgagcacgatataaaaggtgatgagtcatgatacaaaggatgtgctgcggctgtgcgggtgagggaacatgatggtagcaggttcggacatccagtgaagcctcccttacagaaagtccttctccaagatccctatggctgatgggccgtcttgcactgggggttcaacgttgctgctccgaatcttgattcaaatggatgaggatcctacccatcttcggacatctcgctcgctgcattgatatcgaggaggtggaggacggggtcgtcatgggggcgcacttagattctgcagcgcgcgcgcaaatttgtaatggacacacctgcagtaggcgagtaacgtagtcccgaatcccagcacctctcaatgcacatgtaccatattgattaatatcnnnnnnnnnnctctgcaataggcgagtaacgaagtccctaatcccagcacctcccaatgcacatgtaccatattgattaatatcaatggagacattgacgtacttgcgggagcttctggcggtggtatgggaggtggccacacaggtgaggaacgctcgtactgaacccatgatcggggaattcgagtttcgctgaggcgtaggatcaaatctcaatgttaatcaaataccacagaaactaacaatgcggagcattccggacttgggggacatcggggaatctctcgctggcgcaactgtgctggtgaccggcccgacaggcggcattgggcagcagtcagccacggagtttgctcgtcggggcgcaaacggtggggtgaagcactaaggaggggttgggatgtctcacgcacctgtgctggacaaggggagtgcgtaccgtcacattcgttgctctcctgcggtcgttaccacnnnnnnnnnngagcactttggaggaattgggatgtctcacgcacctgtgctggataaggggagtgcgttccgtcgcattcgttgctctcctgcggtcgttaccaccgtgcactgtgctcacgagaaccctaatttctggctctgcagtggttctggcatgtcgcaaccctaagaaaggtgaggagctgaagaaggagctggagggcgcagcagcggcagaggggagggcggtgccgaacctggaggtgggtggctggtggagggttgaaggcacatgctggagaatgggtgatgcaactcaccagaccggggccctgaaaggtggcctctgtaattaaaactgtgtgtgatcaacctttattctcaggtcatggagctgnnnnnnnnnntggggccctgaaaggtggcctctgtacttgaaattgtgcctaatcaacctttattctcaggtcatggagctggatgtgtcgagcctggcgtcggtgagaaaatttggagaagcctgggagtcgctgggccggcccctccacgtcctcgtgaacaacgctggcatcttctcaatgtcaggtgccgcggcatggttgtttggatccaggatgcgtaagcttgcagatgggacagcgctgtacggtctgccacacatgtcgacctggagttgtttgagtgacagagtgggcgcatgcatccgccacgtgcctggctgtccacccagagaccagcactgggcagcctgtgcctcgccctgcgcaggcctcttcctccctttcttccttcttgccaccttaacccccccttctatcctaaacactggatgaccttcctgcgccccaccccatcccttttgcacagcgccctacaagctgaccagcgagggatttgagtcccacctggcgaccaactacctgggccacttcctcctgactatgctgctgctgcccgccctcaagcgagggtgcacgcaggtgaatgactggagtcaatggggtgtggggtccagcgcatctgagtagagcctgcacggcagtctgtggtcgtcggggcctgtgtggctgagcacaggcacatgcatgcatgtcccggcggggcgtgcttggatgtgctgaggctttcacacgcagtcaccctactcccccccccttcactccagaggggtgcgccctccagggtggtccacgtctcctccaagctgcactacatgggcagcgtgcggcgcggggacccaaacctgagcaggcggtacacgtccctcaccgcgtactgccagagcaagctgctgcaggcgagtgccgcggctgctggcgcctgccctgcccccgcgcctgccttggcccgatgcatctcccccccaaccgccgcctctccctcccacgccggcccccccgtcgagcccagcccccaatcccctcccacccgcgcaggtgctgttctccacggagctggacgcgcgggcgggccccagcgtgcgcagcgtggccgtgcacccgggcgaggtgctgaccaacgtcatccacacgctgcccgggccggtgcgatggctgtacgcgcggctgctggcaggcgtgctgctgacgccgcgccagggcgcacggtccacggtgcacgccgnnnnnnnnnnnnnnnnnnnnnnnnnnnnnnnnnnnnnnnnnnnnnnnnnnnnnnnnnnnnnnnnnnnnnnnnnnncgtgctggccgaggaggcggccgcgccgtacctccacagcgactgcgcaccggtgccgcccagcccggcggcgcgggatgccgagctggcgcgctgggcgtgggcctggtcggtggacgccgcggggctggcgtccgaccgcgacctggcgccggtggcaggcggtggcgcgccgtgagggcccctgcagggccagaccctcgtgctgcctggcctgggcgaggttctgtgggcacctgcagagggcacaccatgcatggcagagagtggccgactgcgacatcgaacccccttggatgtgtcgccgctgcaccacnnnnnnnnnncagagtggccggctgcgatatcggacccccttggatgtgtcgccgctgcaccacnnnnnnnnnnaacagagactggagaccttgagcagcggcgggaacactggcacccggacacaccacctacctggaggccccatgccannnnnnnnnnagcacagcatgtagatattccaagcgacagccagggcatgcaagcactcgcacgacagagactggagatcttgagcagcggcaggaacactggcacccggcacacaccacctacctggaggccccatgccaacttcagcaggcagagatgatgctgatgcggcgcccgaccgctccgggcctggctggtcctcaaaccccgtgccacagcttttcaaggtcctgaagcggccgcgcccgagcacggtgccctgcatgggtcctggacgccctccacatcttcgcggcacgcttcctgccaacaggccaggcgccaagctcgttcatgatgtctcgagcaccacatcgacgacgatctcggcgttcgctgaggcacctcatgggctcaacagcgcctggacttcctttgctctgccatcgtagctccgtgccaggcagctcacgtgtcccctccatccctgcgcgcctcatgcccactcgcccgctgccgtgcagcaggggtcgccgctcacgacgccccgactcctgctctgctcccttgcatgccccagctggcgcccctgggaatctcgcgctccactctgccctcacgccactgctccttcagtgtcctcacgccagagccctgtcccctcgccccgagtccacagtctttcgcagccaggcccagccaggctgcctccccaggcgctccctcgcctcccagatccagtccagcttgctcgctccacgcggccagccagacagcgcacgtccctaccccagcattacacggtcagcccaagcggcacgcgcgtcgggctcccatcggcaccagccactccgctggccagagggacctacaggagctgtgggacaagcttgcgtggtgttcgtggagggtgcatgcagcagggtagagcaaatggaaggggggtgaaacaggccacaggcagccagccagcggtcctgggagtgggattgcggcagggagcaactccttggaccgcagcagtctccaaggggggggtggcgctggtcaaacctcctttcagctcacacgccggcagcgatgcatgccggcggcctctgacgtcgactctggtacaaccaccatccactgcaccgccacatcagtcgtcggcgggggcggggcttgcgctgcgccgggggcttgcgctgcgccgggggcttgcgctgcgccgggggctgcggctgacgctgcgccgggggctgcggctgacgctgcgccgggggctgggcgagcgtgaggcagatcgtccgcggcgcgggctgggcgagcgtgaggctgggctgcgagacctggacgcc

SEQ ID NO: 46799 - DNA, 73 bp, Chlorella protothecoides
cgcgccctccaagcatatcttctgggcgctcagcgtggccccgccttgcacagcaatgctgagaactcgcgcc

SEQ ID NO: 46800 - DNA, 73 bp, Chlorella protothecoides
aggcaagcgcggcctcccacatggcccccaatgctgaggaatcccatttgttgatttattgcgctcttgcatt

SEQ ID NO: 46801 - DNA, 61 bp, Chlorella protothecoides
gcccagggccgagaaggcatagtctgcgggtgggctcatccctggcgaccacctgcggcga

SEQ ID NO: 46802 - DNA, 61 bp, Chlorella protothecoides
cacggtgctggtgtcccagggcctgcgccccgcccccgccctgctctgggcggtgctgtcc

SEQ ID NO: 46803 - DNA, 87 bp, Chlorella protothecoides
gggcagcgtcgggtgaagggggcctgggaccccacattgccgacatggaggcgggctggccgcagcggctccctccgggtctcccca

SEQ ID NO: 46804 - DNA, 77 bp, Chlorella protothecoides
cacctcaccggctaccacatgccagagttcgagggtgaggagggtacggcgggaggggaggggagggggaccgatct

SEQ ID NO: 46805 - DNA, 61 bp, Chlorella protothecoides
cacctcggccgcatacatgcgcgccacgcattcgcccagccgcttgttgggcagcgtggag

SEQ ID NO: 46806 - DNA, 61 bp, Chlorella protothecoides
caaacagtgctagcgaagctgtgtaagaaggtcgaaatattcactcggtcaagatcccggt

SEQ ID NO: 46807 - DNA, 68 bp, Chlorella protothecoides
ccctcccctttttaaactgccccccccccctctcgatcccccccctctataaaaagggacgcgctgga

SEQ ID NO: 46808 - DNA, 61 bp, Chlorella protothecoides
gtttgcaattatccaggagcacgcctgtttaccctccagcgtccgctgctatgcagggcgg

SEQ ID NO: 46809 - DNA, 88 bp, Chlorella protothecoides
ctaccggacagagggcatcgaccacctcacccagtgcaaggaggtgaggaacgtggtcgcgctccagcaccgagggagacaggtatac

SEQ ID NO: 46810 - DNA, 66 bp, Chlorella protothecoides
tgaggaatgcaagaagtgctcgatcctctgggatccgcacatccagccgctcgtgcatgcacagtg

SEQ ID NO: 46811 - DNA, 186 bp, Chlorella protothecoides
cttacctttgtaaagagccacagacagccggccctacactcaccagcggcgttgatccacacggcatcccactgcactggcgtcttcttgcgccctctcttgaaggggcgcaggaacatgaccgacccgggagggtacatctcaggctggctgccgccttgcgaaagggacgttcggaagtacctg

SEQ ID NO: 46812 - DNA, 61 bp, Chlorella protothecoides
ctcggcgtgcaaggtgcccatatctcccattccaaaggccgcaaggtccagcatgccagtg

SEQ ID NO: 46813 - DNA, 61 bp, Chlorella protothecoides
ccctggaggtgacaggaggaaccttcaaacgtgcggcgttggcaagcaaggggcagctgca

SEQ ID NO: 46814 - DNA, 61 bp, Chlorella protothecoides
tacctctggcttccacaacaagtggatgtgtacacccaaggccacgagataatcagtgttt

SEQ ID NO: 46815 - DNA, 61 bp, Chlorella protothecoides
cttcatcgacgagatccacaccatcgtgggtgcggggaagggcgaggggtccatggacgcg

SEQ ID NO: 46816 - DNA, 68 bp, Chlorella protothecoides
tggagcgcaggattggtccggggtgcaaggaggcggagagggggggattggggctggaggatggggtg

SEQ ID NO: 46817 - DNA, 75 bp, Chlorella protothecoides
gacctggtcctgactggcggagcaaagttggcccccgtgccacgcctgtccgacatcacggcaagcaaggaggga

SEQ ID NO: 46818 - DNA, 61 bp, Chlorella protothecoides
cgaccccctacggcacgagagaccatgcgaacccacggggtcccacgcacagtcgagggac

SEQ ID NO: 46819 - DNA, 72 bp, Chlorella protothecoides
caccatcatcgccgtggtcatgcccttcttcggccagatggccgggctggtgggcgcgctggccttcttccc

SEQ ID NO: 46820 - DNA, 107 bp, Chlorella protothecoides
cagcttcttgccacaagctcgaggagcggtggcctgcactgcctcggtcatgctcctgggcttgagccaggccggccctttggtcaggccagagtctctgggccacc

SEQ ID NO: 46821 - DNA, 68 bp, Chlorella protothecoides
cagggcgctgggtcaagagacaaagaagggggggggtccagagggacttgggtctcctcctgccaccc

SEQ ID NO: 46822 - DNA, 61 bp, Chlorella protothecoides
ggagtggtcccggaaccagtactccccctccgccaggagcagggggtcgaagcggtcggtg

SEQ ID NO: 46823 - DNA, 61 bp, Chlorella protothecoides
ccccatcctgtacatgtgatccgcgatgctttctgggcccttgacgccccgcttgacccat

SEQ ID NO: 46824 - DNA, 79 bp, Chlorella protothecoides
gcgctggcgcacgttccctcgtcgtcggaggagaagatgccggggcgccatcccagttttccactcggggcatgccctg

SEQ ID NO: 46825 - DNA, 78 bp, Chlorella protothecoides
acccagctctaatcgccctgggattccaccctgacgtacagaggaccatgtgcgaggtgcatgtccaggatgcgcatg

SEQ ID NO: 46826 - DNA, 71 bp, Chlorella protothecoides
gcggaggcgtcggggcccggcctcggcccggcggcgggtggaggcgccgagccctggaagggggagcagag

SEQ ID NO: 46827 - DNA, 18091 bp, Chlorella protothecoides
  modified_base (715)..(724): a, c, t, g, unknown or other
  modified_base (1217)..(1226): a, c, t, g, unknown or other
  modified_base (2476)..(2485): a, c, t, g, unknown or other
  modified_base (2716)..(2725): a, c, t, g, unknown or other
  modified_base (3678)..(3759): a, c, t, g, unknown or other
  modified_base (4947)..(5050): a, c, t, g, unknown or other
  modified_base (5360)..(5369): a, c, t, g, unknown or other
  modified_base (5808)..(5817): a, c, t, g, unknown or other
  modified_base (6028)..(6037): a, c, t, g, unknown or other
  modified_base (6249)..(6258): a, c, t, g, unknown or other
  modified_base (6466)..(6475): a, c, t, g, unknown or other
  modified_base (7307)..(7316): a, c, t, g, unknown or other
  modified_base (7379)..(7605): a, c, t, g, unknown or other
  modified_base (8246)..(8255): a, c, t, g, unknown or other
  modified_base (8873)..(8882): a, c, t, g, unknown or other
  modified_base (9635)..(9644): a, c, t, g, unknown or other
  modified_base (10101)..(10110): a, c, t, g, unknown or other
  modified_base (10709)..(10718): a, c, t, g, unknown or other
  modified_base (10770)..(10779): a, c, t, g, unknown or other
  modified_base (11491)..(11500): a, c, t, g, unknown or other
  modified_base (11555)..(11564): a, c, t, g, unknown or other
  modified_base (11850)..(11859): a, c, t, g, unknown or other
  modified_base (16076)..(16085): a, c, t, g, unknown or other
  modified_base (16945)..(16954): a, c, t, g, unknown or other
  modified_base (17211)..(17220): a, c, t, g, unknown or other
  modified_base (17530)..(17539): a, c, t, g, unknown or other
  modified_base (17989)..(17998): a, c, t, g, unknown or other
cacccacccacccaaacccaccgggtaggcgtggggcatttgatcatggactctagcatgtttgtggcgacgatgacgggcttgccgcgcttgcggcaccccctcacgatcttggactgccagtagggcacctcctccaccggcagctcggcgcccaggtccccgcgtgccaccatggcgccatccaccgcgtccaggatggcgtccaggttggccacggagtcggcggactcgatcttggccagcacgccgatggcggaggtgccagtggcccccgcccgcgccagccagtccttgagctcgtagatgacgtcggcggtgcgaacgaaggacagtgcgtagtagtccacgccctgctccagcccgaaccggatgtcggcccagtcgcggtcggtgatggcgggcaggttggccgacttgccgcggatgttcaggtggcgccgcgacttcatgctccccccgtccacgatctcggtgaccacgtcggtgtcggttttggagcgcaccacagcgctcatgatgccgccgtccaccagcaggatgtcgcccagctccacgtcgtcgatgaagccgtcgtagttcactgttgcgtttaggggggggatgttcctggggtcaagaagctttgtggtggggagggagggaccggtcccacatgcgatcagggcccctggggcaggagagggggatggcgccccggggaggagggggggtnnnnnnnnnnacgtttaagggggggtgatgttcctggggtcgagaagctttgtggtggggagggagagaccggtcccacacgcgatcagggcccctggggcgggagaggggatggcgccccggggaggagggggggtgcccacccattggggccccgccgctcccctcctcctccccatccagccccacccacacctccgatgcgattgttggtgccgtctgcgccggcgacgatggtgaaggtgaccgtctccccggcccgcagctccaggggctgggtgacgtcaccggagcgcacctcgggccccttggtgtccagcatgatggccaggttgcgccggcccatcgcgttgtactcccgcaccagatcgatgacttgctgcggtgagcgagcggtgagcgagatcgggggcaaggggggcggggcccagaagcatgcacgggcgggtctgcctttccctcccacacctctcccaacaaacctggtgggaggcgtggtcgcnnnnnnnnnnaggggcaagggggcgggggcggggacggggggagataggtatgcatgggagggtctgccttcccctcccacacctctccccaacaaacctggtgggaggcgtggtcgccgtgggacatgttgaggcgcacgacattcatgccggagtcggcgaggcggaaaaacgcctcccggtcgcaggaggtggggccgatggtgcataccgtcttggtcttccgggggggcgcgttcagggagtactccccatgctcgtcgtccagctgctgagacgccaaggagggggacagggaaatgcctttggcatacccggcaacggcggaggtggcagtggtgggtcgggaaggctcgggcctgcggatcgggcgcagggagaaccctggtgggtggctggcctcgccctggtgcgtcgagaccgatcggcccgcaagaaggcacccgtcagccccatcccaaccctgtgaagtccaggaaagaaattcatatcgactcacctcccaccgccgcggttcacgggcggggtggcagtgcacagcacacgggctgtggtgtgcgcgggcctccgggtccctgcctgatgggggctgaacgccccaaagggcctcaccgtagacactgagcactgcatcatgggcataatcgaagttttatagggcaccttggggttgctggcatgccccaacaccattctgccatgagagtcgatggagccggggtagagagggttgccgacgtggcacaagctgtgttgacctccccaaatctggagggaccattcttctgcaatcccgactgttatccaggaacaagcccatgagagtgcattgatcacttcaacacagtcgaaagtgcatggggcgcctcatcatacaggacgccttgccaagcacgacggatttgagggacaccagtcattgcgctccattggtctgggctccccaacaattacacctggctaacgcccatgatggagggtgagatgttattgtcctagtctagctgttacacttatctttgggagacttttcgaacttgcacaggggaaatccaggactgcaaacttgagtctatgcacactcccaaggcagctgatcgcaaggtgaggccgcagctcacaaagacatcctgcgtctgcattgttgcgttcttgtgcttcagcgctgccttgtaggagctttggaaagaccaagtcattgtgatcaacaatattgatgatggaggttgcaggggacgccatcagggattgtggagagnnnnnnnnnntcaaacctggggggaccattcgtctgcaatcccggctgatacccaggaacaagcccatatgagtgcatttcatttcaacacagtcgaaagtgcattggacgactcatcatacatgacgccttgccaagcacgacggattttagggacgccagtcattgcgctccattggcctgggctccccaacagttacacctggctaccgcccatgatggagggtgagatgttattgtnnnnnnnnnngttgtgattcaacaaaactgatgatggaggtcgcaggggacgccatcagggattgtggagagcgaagaaggatagggccaagattcagccacattaggggccgacggtggaggagtcaaagacaaggacagcgtagctgggggatgatggcgaggatggaagctttaggggcctcaatttcaggatgtgggaggggacaggatggttggcggcatagaaggtggaggcggccagatggtgggtggtgtggagggcggaggcggcaggatggagggcgggggcggcaggatggacggcggcatggagggcgagggcggcaggatggaccgtggcgtagagggggagggtgatgtgggaggcggcgatgggagtggaggactgggagattgcggtggaggtggtgatcttataagaggaggaaatggcgacatctttgtggagggcggcgagggagccttcttggggggaggcggggacgccttcttgggaggtgagggcggtggttggttgtagtccctgagcactgacttgcgaagttccttcaggctgcacatgttcaaaacctttcgagttccaatcgcgttgttgcaccgcagattggtgtccatattattgtaaccccagttgaggtctcccatgttggagttccctgcattattggccgtttgcatggtataatcagtggcagggtgagaagggggcctgcaatcctgcactcttatcatatcaaaccatgcgtccaaatgccaatccgccatccctgcaatcctgctcaccgatgttgttgttgccgtcgttgtagtcgccaaaattgttatttcccttattcccggtaccaatgttgccattcttgtctgctgtgcacgccttctgtccggccttgaggcactctacgctcaccatgatcttggtggaacgctcgttgatgacctcaaaggggctcatcttgatgnnnnnnnnnnnnnnnnnnnnnnnnnnnnnnnnnnnnnnnnnnnnnnnnnnnnnnnnnnnnnnnnnnnnnnnnnnnnnnnnnnagtggtctccctgaccgaacccgccttggcgtagcccatccacctgtggtggttgagggacgaaaggtcagtcagatgggctggtgatatgagccatgccgttgtctaggacttgcattccagaactagaccgagtcggactcagcacgcacctgcagagggtgtccgcgctgctggcctccagcatgtagacgtggggcccgtacctattagaggaagaaggagtgcacgacgagatcgagggagcagcatccggcgtccggacacccacccgtgccagctttacgcagcacaatcaatccatcgtcagtcaggctccggcccctgcggaagcacagctgcacggactgctaaccagtactgccaggcacaactcacgtggcagccgggagagggaagaacttcgtcgtgcatgcgccctgagcgtgaggggaatgacgtatggggcgtcgcaatccagatctggcatccactacaaggtggccctacctctgaaagtcttgcacgccccaaagtccacctcaacttacccgtgagagcacaccgaggcttaacagggggagcatcgtgctccaaaggcatgtccgcacttgcgacaccatcttgcccgaaaaggtgtgggccaagatgggatatctttcagcaccaaaacgatgcagtaatgtggactgcgcgggaagaagcagccttctgcttgctgaggagcagtttgtgcgtactatattgcatgctccccctaattttgttctggtcgcagcggagaggggaatgctcgcggccacccggatgccctcctttccttcgcatatgccatcgagggctttagcattgtggttgcaagtacataattattacgaactgcttaccttccatatcctgtttctgctttaaattgtttgtatgtctataaacagcccctaccgacggcatttctgtctcccgcctttgcaaaggtgacaagtccccttctcagtggttactcgctatcaaaaacgattcgtatcgaaaagctagccattgctgaattcgtgatccctgtctcatgatgaaggcggaacccggaagctatgttcttgaatgctgcgctcaggctgcacttgccggggtgccagagggcctggtcccaacaattcagagagtgccagatgacctaagtatacagacacacatggctttgatttttacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccgggagcggagcgctcgcggaacaagccagcatgggattaaccaggacgaggagggatgccaatatataaagaaaactgtcacataattcgaggttgaggggattgggtgaagcaattggatctcgccaccctgatccagccccagcaccaaacacctgggacactgcgagccacatccgagcggaagttgggcatcgctgatttgctgtggaaaggactgatctatattccaatatctttcatattgagagcagccggaagccctgatctggtccggaagcatccgtgcgaggcacatggcctgcnnnnnnnnnngcctctggaaaggactgatctatattccagtatctttcatattgagagcagccggaagctgatctggtcaggaagcatccgtgcgaggcacatggcctgcgcctttgccctacccttgcccaatacctcggggtacttcagggccccctcggggtcccctcctcctccccccagccgcaatcgatgtgcacgaggtgggcggggggcttcctggacacgtgcaggcaaccaagtggctgcgccactcgccacggcctgccaggagggcaccatctacccagacgccacggcgatcatcggccgcaccccattggtgagactctgcatcgggcatgccagtcgctgtgccctgtcctcgacgagtgtcggggccagtgggcagcctcccccctccacgcctgccaccggacgcaggtccgcctgcagaagctgccggtcnnnnnnnnnntgggacagtgggcagcctccccctccacgcctgccaccgcacgcaggtccgcctgcagaagctgccggtcccatgctttgcggagattgtttgcaagctggagtacctgcagccctgcaaaaggtcggtcagtgggcaggcccctggctgcggccgtacctggacgccattcgcgcgccggtcgccgtccccacgcgtgccgcgccgtgtnnnnnnnnnnatgcaagctggagtacctgcagccctgtaaaaggtcggtcagtgggcaggccccagctgcggccgtacctggccgccattcgcgcgcccgtcgccgtccccacgcgtgccgcgccgtgtgcatgcgggtgctctcggctggacaggagggccgcaccccatcaacccccaccccctgcgatccctgtgcagcgtgaaggaccgcatcgcagnnnnnnnnnnaaggagggccgcggcccatcgacccccaccccctgcgacccctgtgcagcgtgaaggaccgcatcgcagcccagatggtggctcgtgcggaggagcgcggcctcatctcccctgacaggacggtgctggtgagtggcatcgctagtccgctgctgccaggtgaccaacgtgctgccctgccccgctgtccatacccctgacccccccnnnnnnnnnncgcggaggagcggggcctcatctcccccgacaggactgtgctggtgagtggcatcgctggtccgctgcggccaggtgaccaacatgctgccccgccccgcggtccataccccagaatccccccacacacgccaccttccccccatgacaggtggagcccacctcggggaacacgggggtgggcctggcctgggtggctgcagcaaaggggtaccgcctgatcctggccctgcccgactcctccagcctggagcggagggtcctgctgcgcgcgctgggcgctgagctggcgctcaccgacgggaagctggtgcgggcgtgggcgtgggtgccgtggctcgtgaggaccctccctgcacagaccgggggaccagtgcgctgtcaggcagcggtcaccagcccccgccgcccactggatcgccgcagggcatggtggcagccattgagaaggcagagtccattgtggcgaccacccccggcgcgtacatgctgcagcagtttgacaaccccgccaacccagaggtgtgccgtgggggtgggttgtaccggggcctgcctgcgcacgagcgtccccatggctgcaggcatgacggtgagggcgatcgtcctgatgcacagcgtgtgcggcagcgctccattcccgccctgccggccaggtggcccggggtagtcctccccaatccccgccgccacgctccccaaccctttccaggcccactatgagggcacggggccggaggtctggcgggacaccgctgggaaggtggacattctggtggcaggggtcggaaccggcggcaccatcactggtgagcgccggggaggggaggggnnnnnnnnnntccgatccccgccgcaacgctccccaaccctctccaggcccactatgagggcacggggccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtacctgaaagagcggaacccctcgctggagatcatcgcggtggagcccgcagagtcgccggtgctctcgggcgggaggccaggctaccaccaggtgcgggccaaccgcaagaggggggcggatggggcggctggtgctcatggttgcacttcccccccctggtgccctgtgcacatgcgtcggcatgcggcaccccatgctgacggcgcaaccgccgctggcctcggctgcccggcgagcgtggacccccccctccccatgctcttcccctgacctccccctccccatgctcttcccatgacccccttccctctgcgccgcgcgtccgagcagattgaggggctgggcgcgggtttcatcccgcgagtcctggacttcagcctgctggacgaggtactgcgcgtgcgcacgcaggaggccgtggcggttgcgcgaaagctggcccaggaggagggcatcctgtgcggcatctcctcgggcgcagccgtgcacgccgcgtacaagtgaggccggggggttggggtgggggccggcccatgcactcaccaaagcaggcgggcgctggggcaagggccaggagcgcagcgcccaaaatccccaccctcctgaacttggatctatggcccatcggggtggcagnnnnnnnnnnccgcaggcgggcgctggggcaggggccaggaatgcagcgcccaaaatccccaccctcctggacttggatctatggcccatcggggtggcagcccgccatactccccctccccctttacacccccctttccactccctccccattccactccctccccattccactccctccccattccacccccatccagggtggcgcagcgtccggagaatgcgggcaagcgcatagtggtggtgctgccctcctttggcgagcgctacctgtcctccgtcctgtacagccagctgtggacccaggacgcgacggaggaggacgagatgccggccgagtggcgcatgcacaatgggctgtacgtggccgaccgcgacccgcccaagctgtgaggggcgggcgccagtgagggcatgcgccgcgtctgcgagggcgggggtggggccagggagggtccgctgcgtcacagaccaccttcgttgccgtaccgcatcgtgtacatgcacccatccggtggtccgccgccgccagaggcatcaggcagggggctgggtgaggttgctgcaagggaaagcagcgaccacgcaggtgtattgtggagcccgggggggttgcagcgaccctcannnnnnnnnncgggtgagggtgctgcgggggaaagcggcgaccacgcgggtgtgttttggagcccgggggggttgcagcgaccctcaggcgttccaggcagggcattccaggcagggcattccaggcagggcgttccaggcaggggggccgcgccctggtgaaggcggccaggactccagtgcgcgagcgctgccccgccccagcgccgccccacctggcgcgcccgctcagtccttgtgcggcgccgggagcggctggggcgggatggcgctgccgtcgcccagggcggcggcctccgccagcgcggcgccgggcttcaggatggcgcgcagggcctcggcctcggtgtaggcgaaggagacgggggtgaactcggaggcgtgctggtccacggcaggggccatcgagttggccagcggcactatgcccgctgcctcgtcccggctcagcctgcgcacgaagcgcgcggggttgcccgcccagagctcgccggcagggacgcggcggccggggggcagcacgctgccgggggccagcacgctctgccgttccaccaggctgccctccagcagcacgcagcggtcgcccactaccacctggtcctccagcgtcacactgcgcagcaggcagccctggcccaccgtcacgtagtgcccgatggttgtcgcggcggggaggccggtgggggaggaactgatggggttgttggtttttttaagggaggggagggagagggggagggattaagaaagggaggggagnnnnnnnnnngctgttgggaattgttgttttttaggggggaggggagggcgagggggagggattaagaaagggaggggagggccgctcacccaaaatgatggaccagccaggcggcaaggggcaagcatgggaacgcgcagcgaagtgaggtgtcccgggggctacagtgcgcctacgctaggctgcgactgcatgtgcggaaacaaaaccccgaccctccaagcccaactccacggcacctggcggcatggatgacggtgcggtcctggacgttggaaaacgcgccgaccttgatggtgttcaggtcgccgcgcaggacggcgccataccagatggaagcctggcgggtgggtgagtttggaaaaggggggcgtcagggggattatggaagagtggtcactggtcaccaacatcccccacctacaatactcccccaccaagcatcccacctggtcgtatagatccnnnnnnnnnngtggaaaagggggcgtcaggggcattatgggagagtggccactggtcaccaacatcccccacctacaacactccccaaccaagcatcccacctggtcgtatagatccacgtcgccgatgaccaccgcgctgggggccacccaggcgtccggtgccagggaagggactcggttgcccagggggatgagctgacgctgcctgcggggtgaaacccggggcgactaccttgagagggtccggcactcacgtcccgtgccactccggcaccacccgccccagacccctcacctattgtaaacctcctcctcgatgtggatggatgtgtgtgagctggatgaggtggtgaagaccctctgtgctgctgccacggggacctcggcccgctgcacgacaaggcaccgtccccagagctgggcactggcccggcgcaatgccatctcgccgcagctgcctggggcgcctacaatacaggtagaactacaatttgcggggatatgcactcggcttgactaggggtgctggagcctcgtcaggtctactctgccccaggcctcgcccaccctttcttggactgcgcaggggtacagcagaagtttggcnnnnnnnnnnatgccttggtttctcaatctgcgcgcagtctggtaatgctacttatggtggnnnnnnnnnntctcgtcaggtttactctgccccaggcctcgaccaccctttcttagactgcgcaggggtacagcagaagtttggccaagcaagaacactctcaacatgcatcatgacagacactttgaggatgacagttactttacctcgatcatctaccagaaacagaaatgtgccttggtttctcaatgtacgcgcagtctggtaatgctacttatggtggtcatggcccatacatgacactcatcattcacgagcgtgcccctgaggtggagacccgtcactgcacactctctacgaaaacatttccctgttctagactttcacgtaaggctgcggttcacacagtgcccaagctgcagactaggagcagtaaactgacaatcttcgctatgccatcctccattttgagtacatatcaaacatcatgaaggagaatacggttattgactgctgtatctagttattgtaagctatgaataaccggtatcctgtgtgctgcttgcaaatcatacaaggacaccttcagccatgtcctttcttcacgcagcctccttctaagggacagcgcataccttgaatgcgacccgtgcgactggagatcagcgacacccacactccatcaggtgctgcatccagagatgaaatttcatcacgataaagtaaccctatctccaatccagcaaagagtgggagtactttacaccgactcgtgctcgatnnnnnnnnnntactaggagcagtgaactgacaaccttcgctatgccatcctccattttgagtacnnnnnnnnnncgatgaaacttcatcacgataaaacaatcccttctccaatccagcaaagagcgggagtactttacaccgactcgtgctcgatcacttgggctggtgtggcattcgttcggaagccggtctcgacaaagtcgggcggacattggttcactgcattgaaatggctgtgaccacgcgcggactgggggtaggaccctcggatctggtgagctgtcgagggtgccagtgcggtgcaagcctatggtgttgcccctatcggcaacgctgaagaaccgagagacactcgttnnnnnnnnnntgggtgccagggcggtgcaagcctgtggtgttgccccgatccgcaacgctgaagaaccgagagacactcgtttccacaccatgtacgatccccaggatgctcctcggcttgtgttcgtaactctcaaggatgcgccccatcgccgaagggtagccatccccctgcccgaaaacgccgcttgggacaagttcaccgcctccgtggcagccaagctcaagctgggggcagtggacggcgtgttcctggccagcaccggggaggtcatcacgcgactggatcagttgcaggacatcgacgaccttgttgtgacggaggtgtgtggggactggcccaggactatggcggtgccatggtccatcgctccccacagggcatggctgtctcttcctgcacccaatccactggccatagtagctcgctccaatttcaatctccaaccctgtgctcgacgcaacaggctcccgctcagctggcaacgtccacctccggggtggcgcccgctgcagtccagcgaacctcatcgacgcccttccgtggtctcgggggagggtctgagcctgcagtgagccccctgcaggtggaacctgccgtccatgacgaggacggcgacagcaagtatcagaagcgccattcggcgctgcagcgcacgctgcagccgctcttcccgggcctcttttcgtccagtaatggccgattgccagtgaccaccaagtaggatggaggggggtgtgaactggcagaccaagggttgagcaccataatcaaggcaccggagcccatgcggccaagctgtcgcactgcatttcatgaggcggcgaggccttgatatggggctggcccggggcgtccgcactcagcatgccccggcgaggaatatgagcgcaaggatggcgaccccatgttgctctgtacagctgacgggaacgccagtcttgtatcctgaccataaccaccatgttgcttgcaccgcgcagggacatctcgtccaatggggcggtgacctcccccggcccctctgtggacctggcccgcaagcggccacggcgccgatctcgccggtgggtcgaccctcgcagcgccctgatggcattcgccctgctctgctgcctggggaccatggtctttgtgtacctgcacaccgtcgggctgcgagggtccctcccctgacggcatcccaggcctggctgaactcccgctcgtgaaaggcttgcatgctaataaccagtgccagcaggatagcctggacaagcaagctggaggagagaagtgggttcctatgcattccaatcctggatgggaggctgggtgttgccacatgttggccttgcatcttcctgccaagcagcagcaggtggactcaaaacctggggccagagggacagggggcaggcagcgagaggagcgctcggaggtacaagcagggagggctgcctgcatcgggccgcagcgcaacgcagcgactggaggtcaagtgttcgtcgactgggcgccgagggattggcaggcgcgtgccccgtttcacgccttggccggctcgggagcagacccctcgccggcctgcgcccggcaccctcccgcacggagcgctgggcggcccagcgcacccgcgccccgctcacttctggatggcctgcaccaggctggcggccagctcggccatggcgtccaggccctctgtggggctggcggcctcgcccagcgcccgcacaagggccgagccgacgatgacgccctccgcgccccagcccgccagctggcgcgcctggtcggggcgggagacgccgaagccgaccgcgacgggcttgtcggtctggcgctgcagctcggcgatgaggccctccacgcgcgcctccatggcctccttgacccccgtgaccccggtgatggacacgaggtagacgaagccggaggagcgacgggcgatggcctgcatgcgctcggggggggtcgtgggcgtggtcagcaggaccagctccaggccgtgcgccgccgccacgtcggccacggccgacgcctcctccagggggatgtcggggaccaggaggccttggatgagggagacagagaggggcgactgagagggtgggcaaagactggaatgggccgagcacatgcccatactgctcgaggggcacggcggagagacatggcacggtgcggagcggggggtctgccgaggccatgcggatgcatgcccacactccctacagacccgtctcacccttggcccccgcggcaattgcctgcgtgcagaacttctccaggccccgggtgaggatggggttgaagtagacgaagagcaggatgggggccttgatggtgggcgccacctcggccaccaggcccagcacgtcgtccagggtggtgccgtgggccaggccacgcgtggcagcggcctggatgacgggtccgtccgccacagggtcgcaatagggcacccccagctcgatgacagaggcgcccagggcatccagccggcggatggcctccaccgtggtgtcccggtccgggtcgcaggccaccaggaaggggatgaatgccactctgtggggtgcagattgtgcatgagggtggcaattccaatgcccatgcctcgccttgctcccggcacccgcccgcggccctgctcaccggccctcccgtttcagggcctgcatggtgtcggtgatgctggcaccacgcgcctgagcgccctccagggcagctgactcggctgaagctaccatgacggggcgaagggcagcgcaccggggtctggactggaaggctgcgaacctgggtgctgggcgcaggacggcgaggtgaccacctttccgggtgagtactgtggcctggcctggggccgctgccaggcggagggaggaggccattcccaaaatcacaagcggcctgggtttggagaccgggcagggacccggccatgtgcatggcaatgcctcggcatccatgctgccatgttgtcgcgagctgtgcctggctttccagcctccccccaatagtctctgcccagcgggcctgctcaagaggggcaaatcgcccagggatcagcatgccggtaatgccgaagctgcacagggctatgagaggtttggagggggtgctacctgcgtagtctcgacttgacgtgaagtgccgtcgccttgggcatcttcgcttggacaggcccgtgaggtccgatacatggccttacacgcaccccacccagtgcttcagtgagaaagatcaagtgagaccctggatcaggcctggctggaaccttgtgcatggtgttcctgctgtccatcacttgtgctcgggcactcaaagttgcgcctcccacctcccgcagtgggacgccggcgcaaggccaaggagcatcacggggatgcatcggacggcggcaccgtggacaagggggcgctggctgactgcctgtcgcagacatccaaaatcgcagccgagtgcaacaccattctgcgagacctcctgaagggtcgctcgccgcaccaccacgacctccagcgtctcgcgagccaggtgcggatcaggcctggattggaggcccaatcctgttccttggacctggcagcttctgctcccaaagtcacgtgcgctggatgtaatctctcccccagcgtcgggtccacccccctccctctgagtctcgtttcccaacgcgccccccctttccgcagcaagccacgctgtcggagctgctgcgcatgctgcgtctggacagcacgacggcggatggcgcccccctggcctcgcccatggacctgctgggccccctctaccgctcccagaacagccccctgtcggtgctgaagcagtgggacctgccgccgcccaagcccaaggcgcgggggggcaagggctctgcggccgcgggggccaggggcggcggcgaccgcgctgccctcacccgccacgagcgctgcctgagcgtggagcactactggaactcgctgaccccggccacgcgccgagagctgctgcgggtgcccatcgacaagatggtggagggtgcgctgctggcgggggaagggccgggggggttccctctgggcgtgggcagggtggtcgggagggagatggttgattaagctgatcgcctgccccgactaaacaggggagtgccgcccctgctcccgccgcagctgcatccccccctccctcaccacgctcccagtcccccccctttcacccacagtggcttcggagacggggggcgaggnnnnnnnnnntcccctccctcacaacgctccccgtctcccccctttcatccacagtggcttcggagacggggggcgagggcgccgtgaaggagctgtgggaggcgctggccctgctgcgcctctccggcggccgcacggcggcctactggcgctgcccgatgtgcgacgtgcgggtggtggagccctcggccttcctgcagcacctccaactctaccacgaggacgtgcagtatgctgacgacgacgtgcctttggtgtgcaccaagtgcagccgagaggtggggcaatgagcgggggggaggggcaccagcggagaacctgccggcaggggtgaggcagagttgcatgtggcccatggggcctggggcgcagagcctgtagcatgcctcctgccagcgccgaggcagtcgggtcacgccttccactcgcacgcaggtcgtgggcgcctactaccagaacgaggaggatggctacccgcccgtcgtgctgtgcatgacgtgctgctgggacgagcaggtcctccagggtgaggctcgggctgcgggggcgtcgaggcgcatggcgtgggcgggtggagcgcccgccggcgcagggtgtcttggggagcaagtctctgccgacacacagcgcatgagaggctggcttgggggattgctcctcgtcgcgtgactgccgaccccccctccctctccccaaacacagggacgggtgaggagctgagcggggcaatgcagctgcggctgcccaccgcctcgcacatcctcagccctggcagcagcgcctggtcctccgagaccggggacgaggatgggagcgaggacggcgagggcctggggctcgggggcgactggggccccgcaagcgacggnnnnnnnnnncggcagcagcgcctggtcctccgagactggggacgaggatggcagcgaggacggcgagggcctggggcccgggggcgactggggccccgcaagcgacggcggcgccgacgaggacggcagcggggatgaggatggcggcaccccgccgcaggaggaggcagtgcgccggagcggcgcgctctgccccgccgcagacgacgccgctgccgaggtggccgtgcagtctccgcgccggcccaagcggaccgtcaccgagnnnnnnnnnncctgccccgccgcagacgacgccgctgccggggtggccgtgcagcccccgcgccggcccaagcggaccgtcaccgagcacgccgcgccgcccagaacctgcctctgctgcgttgcgcaggtgagcgcgggcgagcgcaggcattgccagtgccagggaggcacaggggccgggtggatgcaatggatggacccagagggcttgttctgtgtggagagggcgtctcggacgctggacggcagtgtcgaagggagggagagggggaggcggacgatgcgatgcggctggagatcgagacgcccacatcgcannnnnnnnnntttgttctgtgtggagagggcgggtcggacgctggacggcggtgtcaaagggagggaaggggggaaggcggacgatgcgaggcggctggagatcgagacgcccacatcgcagcatggccccaccctttgtccttgtcaccggggctcagcatgtgccggcagcagtgccgcgctggcctgaccaaccaccacacagccctgcctggcacacagacatcatgaaccccctccctaccctgtgccaggagaagcccgactcccagctgctggtggacgccatcctggagcagctggccgcgctctcctccacgcgccgcgaccagctggagcgcgtgctggcgctgctgatgacgcatgcgcaccgcgtgtacagccgcgggtacgggggccctgaccccggcgaggccgggcggggggccggcggcgctggcgcggccgccgacgcggccnnnnnnnnnnagggccctgaccccggcgaggccaggcggggggccggcggcgctggcgtggccgccgacgcggccgccgcgctttccacgctgcgcgcgccgg

SEQ ID NO: 46828 - DNA, 61 bp, Chlorella protothecoides
cacaagaagcatcatcttctcagaacggtgcagaccgcagggcacagagtctacaggaatt

SEQ ID NO: 46829 - DNA, 82 bp, Chlorella protothecoides
gctggcatggcagaaggtcgcggtgatgaattgccaccattgtggcgcccagtggtgcagcgggagggctgccaggatgggc

SEQ ID NO: 46830 - DNA, 78 bp, Chlorella protothecoides
atatgcagtttccttccctccctcttcaccaatcatctctcccccctctctcgcaggtttccctttgttgcggcgggc

SEQ ID NO: 46831 - DNA, 61 bp, Chlorella protothecoides
ggcgccatttgcttggtgcccatcactcccacccaccatcaccctgcattcccaaccaaca

SEQ ID NO: 46832 - DNA, 64 bp, Chlorella protothecoides
gagttcaatctcacacactccttttgcgtctcaaaaggtcggcatggcacttccggtagcaaag

SEQ ID NO: 46833 - DNA, 4092 bp, Chlorella protothecoides
  modified_base (298)..(307): a, c, t, g, unknown or other
  modified_base (546)..(555): a, c, t, g, unknown or other
  modified_base (651)..(660): a, c, t, g, unknown or other
  modified_base (748)..(757): a, c, t, g, unknown or other
  modified_base (1333)..(1342): a, c, t, g, unknown or other
  modified_base (1991)..(2000): a, c, t, g, unknown or other
  modified_base (2392)..(2401): a, c, t, g, unknown or other
  modified_base (2477)..(2486): a, c, t, g, unknown or other
  modified_base (2762)..(2771): a, c, t, g, unknown or other
  modified_base (3208)..(3217): a, c, t, g, unknown or other
  modified_base (3453)..(3462): a, c, t, g, unknown or other
  modified_base (3852)..(3861): a, c, t, g, unknown or other
ggatgtcacttgcagagaccttcatgcagtactgctcgatctcctacttgcagtacgcggtagcactgtcctcagtcagaaactcgaccttggctcccaagctgcatgattactcaggaataagttctaagagtactcgccaacataattaaattcattcacgactcgtccgggccaaaattgttcggataccttggtctgcccccaggatgcagcgtcccggaagatgccggacgcactcccggccaccattccggaccaacatttacccgactactaccactcacatggcgctggnnnnnnnnnnaaaaattgttcgcataccttggtctgcccccaagatgcagcgtcccggaagaagccggacgcactcccggccacctttccggaccaacattcacccgactactaccactcacatggcgctgggaagggcaatgaatgtagattcgcaggcttcctatggattgggaaaggactggtgactttggtaggtctcttcagggtggaagatcgatataggcgctcctcccccttgctcgcggnnnnnnnnnntgcaggcttcctatggattgggaaaggaccggtgactttggcaggtctcttcagggtggaagattgatataggcgctcctcccccttgctcgcggnnnnnnnnnnaagcggccacaatggcacgattaggtgtcatttttcccatcgttgcgggtttgaggatcctctgtgcttctccgaaatgtgccagcannnnnnnnnncgaaaccaaatttctctcaccgaagcgatagagacaccacacagtatgtaaatagcggccacaatggcacgattagatgtctgttttcccatcgttgcgagtttgagggtcctctgtgcttctccgaaatgtgcaagcattcgtgcctcacacgtttctgcacagctcaggagttgcgagtctatcttctagaataggtgtgatgtatttagaccctgacgacaaatgcagcaagttactggcaggattccatgtattgcctcccccgagaaggtacagtaggaagagtgacccagctgcgcaccggatggcaactggaggcctccggaccaatctgtggatccaatgaacgtagcaatctgctgtatgtttcactgacacaccctgaaaaaattggtaccatcggaattatcatctcgtttccacaccttaatctgtgtacctctcctaggatggcccgctgcacggccagacgagtttggggtctggcaagaggagacatacctaaagaagggagtatcgtggaattccacaacgagctgagaaagacaccttcaggatctcaggtcgcatccnnnnnnnnnntttggtacacatcggaattatcatctcgttcccacaccctaatctgtgtacctcgcctaggatggcccgctgcacggccggatgagtttggggtctggcaagaggagacgtacccgaagaagggagtatcgtggtattcctgttgtgggcgcgggctggcccccacaacggtggaccgctgtatatgacctgaagtaggaatgttacagacgagaccccgaatgcactgtgatggccgggtttcataggcgccgcaaggagccgtggactcggtgcagagcgggaacaggtggaacgtggggaaagggcccggtcaaggggaacccccacaacagttccacaacgagctggggaagacaccttcaggatctcaggtcgcatccccggagttgagaatgtcccgggaccgcctgaggccattccttccccggaagatggagccacagcatgtcggcatcatccccatccagtgccacgaccgtcgtgcaaagggacgctgtgtctcatgcacagcagacccaggggccgcgggcttctgccctggctgggagtgaatccatgcctccagtgccctgctgcaacaccttaccctcgccatttcaataggttgcttattgcctgaccaggtcaaggccgcattccggttctnnnnnnnnnngactggagccacagcatgccggcattatccccatccagtgccacgagcgtcgtgcaaagagacgctgtgtttcatgcacagcagacccaggggccgcgggattctgccctggctgggagtatgtccatgcctccagtgccctgctgcaacaccttaccctcgcgatcacaataggttgcttattgactgaccaggtcaaggccgcattccggttctgagagaacatctagggcagagagcctcgtacgtcatctcggcctacccgcgcttcaattacagcctcagccgcaaatccctcccacacctcacgaaagttgaaatggacaggtgatgctgcagaaatatcatcgtgtgatccaaccgaaaggccatcgcatcgactctctaggaannnnnnnnnnagtacgccgcctcggcctacccgcgcttcagttacagcctcagtagcaaatccctcccacacctcacgaaagttgnnnnnnnnnncgtgtaacgatgcccatacatatatgtatggcagctgaagtgctggccacccaaagcttggccacccaaagcttgctggcattctctctgaacatgcagcgcatgcagccgatattctgcatgcgaaggagcccttctgactgggtaagaccctccagacaccgaacaaatgtaaagggggggggaagtcggctcagaggaactcccacatactacctgttgcggcaaaccctgaaagaccagtgtggcatcctaaatcgtgtcaagcacacaccnnnnnnnnnntgtgtaacgatgcccatacgtatatgtatggtagctgaagtgctggccaccctaagcttggccacccaaagcttggcaacccaaagcttgctggcattctctctaaacatgcagctcatgcagccgatattctgcatgcgacggagcccttctgagtgggtaagaccctctagacaccgaacaaacgtacagggggggaagaagtccgctcagaggaagttccacaacacctgttgcggcaaaccctgacagaccagtatggcatcctaaatcgtgtcaagcacacacctggttacatcttgcggccacattgcgtatgattccatcagaagctgcaaaggcgtgagaatgtaggcgggggagggcagggcacacccaaaggagcaaggtcaacggcaacaaggcacagggggggggattccagcttgtcgacatcnnnnnnnnnntggagggcagggcacatccaaaagagcaaggtcaacgacaacaaggcgcagggggggggattccagcttgtcgacatccctcacttgttccaggaagccaattcatcgcgaggttaaccttggaccctttcaggcacatgaagcctcacaggtcaggagattacatcattgaggcgcatgactctctcgaaacgagggattgggcaccactgctgtcaatgactacgcatgtaaannnnnnnnnnttcttgttccaggaagccaatccatcgcaaggtaaaccgtgaaccctttcaggcacatgaagcctcacaggtcaggagattaactgaatacggcgcatgactcattcgaaacgagggattggataccactgctgtcaatgactacgcatgtaaagcagtacaagttacctctctgataggtggttgccggtgtcattgtatactcgtttgcagcaggaaggctccatgaatatactacaagagagttgctcaagacattgactttcacaaattcataagtgcttgtggtcactataaatgttatatggaatccgccggctggattggcctggaagactgggccaggtaacatgggggggggtaggggaggaggcatggggggaggtgagnnnnnnnnnnatggagtcacctttattataggtggtttgcggtgtcgttgtatactcgtttgaaggatcaagagtccatgaataagatatacgagagttcctcaagacattgactttcacaaatttataagtgcttgtggtcactgtaaatgttatatgatatgcgtaggctgtattggcctggaggactgggccaggtaacgtggggggcggtaggggaggaggcatggggggaggtgag

SEQ ID NO: 46834 - DNA, 61 bp, Chlorella protothecoides
tcggctgctgtcggcgcgcaacaactggccacctgcgcgggcgagtatcgtgtcgagcccc

SEQ ID NO: 46835 - DNA, 61 bp, Chlorella protothecoides
cgtcttccctgagatcctgcagaagtacagcggcgtgcagttccaggaggccgtgtggttc

SEQ ID NO: 46836 - DNA, 61 bp, Chlorella protothecoides
gcaccaagatgtggaacctggaccggctggaccagcgtgacccgcccctggatggcaagta

SEQ ID NO: 46837 - DNA, 62 bp, Chlorella protothecoides
agtgcctctgaggctggcatgcggggggtgggagctcatgcaggaactggtcacacaagggg

SEQ ID NO: 46838 - DNA, 10168 bp, Chlorella protothecoides
  modified_base (111)..(248): a, c, t, g, unknown or other
  modified_base (789)..(798): a, c, t, g, unknown or other
  modified_base (1255)..(1264): a, c, t, g, unknown or other
  modified_base (1533)..(1542): a, c, t, g, unknown or other
  modified_base (1963)..(1972): a, c, t, g, unknown or other
  modified_base (2453)..(2462): a, c, t, g, unknown or other
  modified_base (2574)..(2583): a, c, t, g, unknown or other
  modified_base (2635)..(2866): a, c, t, g, unknown or other
  modified_base (2938)..(2947): a, c, t, g, unknown or other
  modified_base (3040)..(3049): a, c, t, g, unknown or other
  modified_base (3831)..(3840): a, c, t, g, unknown or other
  modified_base (4252)..(4261): a, c, t, g, unknown or other
  modified_base (4531)..(4540): a, c, t, g, unknown or other
  modified_base (5054)..(5063): a, c, t, g, unknown or other
  modified_base (5293)..(5302): a, c, t, g, unknown or other
  modified_base (6322)..(6331): a, c, t, g, unknown or other
  modified_base (8816)..(8825): a, c, t, g, unknown or other
  modified_base (9164)..(9173): a, c, t, g, unknown or other
gcgggcggggcgctgctcagggcctctacgcacgcaagcaggtggcgccccgcctcctcgagcagtgcggtgcttgcctcccccccaccgccgccctcccctgccgctacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctccaccaccaggcgcagcgaccggagcgcatcgcgcgccagccccgcggcgtgctgcgtctccgccagcagcgcgccggtggtcagcgtgtccacgtgcgcggcgcccaggccgcgccgccgcacctccagcgcctgggccaggcaggcctgggcgggggcccaggcgccgcgctggaagtgcagcacgcccagcgtgtgcagtgcggcgctcacccgcacgtcctccgtgccgtaggcctcgatcagcagggccaccgcctcgcggtacagcggctccgcggccgccagctcgccgcgcaggcgcagcagctccgccaggttgtggcttgcggagccgacgtgggggtcgcgcgggccgaagccctcgcgcgccatctccagagcgcggcgcaggtaccgcccagcttcctctagctggccctggggggggggagtgggggaggaggcggtacgtgtgttgtgttgataacatcggcttgtatcttctggccaggagggagcgcaggcgcaaatagggcaccacagacagcaacctcnnnnnnnnnntggggagtgggggaggaggcagtacgtgtgttgttttgatggcgttggcttgtatcttctggccagtagggagcgcagtcgcaaatagggcaccacagacagcaacctctctacagaaagatcagaaatccacgcaaccaaagagctgttcaacccacctgcgcagccaggtttcgtcccatgtcagtgtagatcctccactgtgccgttgcatcgttgctgggcccgtcggcggacgggggggggacgcagggggcgcagggggcgggaggggcctcggagtgggacacctggaccaaggcgctcgaggccagcaccgctgtgccgaggtacgcgaggtaccgagcacagggcgtaaagtcattcagatggtcgtgaagaataattctgtgtgtcacgctcctacccccgagcctcgaagccaaacgcgccaggcccggcagcatgtcgacgacannnnnnnnnntaaatggtcgtgaagatagattctgtgtgtcacgctcctgcttccgagcctcgaagccaggcgcgccaggcccggcagcatgtcgacgacacgagcagcgggcagaaagaccgattggaaagctcgtggatcaatcgcttaacaggaaagataccgtatggtggaacgggatattcacgagcgtggaatcgaagcatgcaggtcccagtcctggttatgacggtggtcgacgtgccatcatcaaggcgccattaccacagatcaccggnnnnnnnnnnaggcagaagcaccgattggaaaactcgtggatcgatcacttgataggaaagatttcgtatggtggaacgggatattcacgcgcgtggaatcgaagcatgcaggtcccagccctggttatgacggtggtcgacgtgccaccatcaaggcgccattaccacagatcaccgggaccgcacgtttgcctggctgtgaaattcgcactttgacgttgtgttcggttgtttatattggaatccacagtaatagtgaattcagcacgctggacgaaggcgcgctggcatgctctcgctgagctagagtcgatgatctggtgggatcacaacgcaaggattgtaccccattgattcagagcgcgcgcgctcggagggagcctcgtatggagggcctcgcgaatgggaccaccagcctgtctcgactcgnnnnnnnnnngcacactttgacgttgtgtttggttgtttatattggaatccatagtaatagtgaattcagcacgctggacgaaggcgcgctagcatgctctcgctgagctagagtcgacgatctggtgcgatcacaacgcaaggattgtaccccaccgattcagagcgcgcgcgctcggagggagtctcgtatgaagggactctcgaatgggaccaccagcctgtctcgactcgatcttcgccagtttcatttccttaaatgtgtattgaggaaggtgtcaagatgtgaagaggcttaatcggccaccccactgcgtccacacccacgtcgccccggtgggatgggctggaccggagctctgagtttggtggccgctgccttcctgggatccaccacaactctggtgagtggaagattcaaacgtaggttatagatgcggatcttatattttcgccagagcgcttatgcgtgtgcctggcccgagcaggtnnnnnnnnnnctggatcttgtattctcgccagaacgcttatgcgtgtgcctggcccgagcaggtcgcagttgtcctggtgtggaggaagcggcctggggtctcccagcaaggcccccccccnnnnnnnnnngttcgccactttaatttccccaaatgtgtattgaggaaggtgtcaagatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcctggtgtggaggaagcggcctggggtcttccagcaagggcccccccccatccgccatggcctgctggnnnnnnnnnntaccgagtaaagttggcgggatggtcctctgtcttggcttcgatactctgctgtccagctcgtgcagcacctcctcccccccaagatcctggnnnnnnnnnnctcattgggaacacaccactggttcgaatagagagcctgtcccgagagacgggctgcgaggtcggtttcggtggtttcttgtaggaaggaccaagtaaagtcggcgggatgctcctctgtcttggcttcgatgctctgctgtccagctcatgcagcacctcctcccccccaagatcctggccaaggcggagttcctgaaccctggcggctcggtcaaggaccgggtggccgcccagatcctggaggaggccctcgccagcggtgcgctgcgccccggcggcaccgtcacggagggcaccgccggctccacaggcgtgtccctggcgctgtgcgcccgggccgcgggctgcagcgccttcgtggccatgccagatgacgcggcgcgggagaaggcggacacgctgcgcacgctgggggctgaggtgcgacggatgcgccccgtgtccatcgcccaccccgaccactttgtgaatgtggcgcggcgcgccgctgcggagcgggagggggcggtgtttgcgaatcagtttgagaacctggccaacttcagggcacacctccggaccggtgagggggggaccagggctgtgtgggattgatggtggactctggcgtggaggatgagccgggtttgctgcagctcctcgactgtgcatgggaaggagacaagcatgggtgtgcatataccgcgctggatactggtggggtgcacccatcttcgatctataccatcttggagcgctcctcaccgcccttctcccacccatcctgggtctcccctggcnnnnnnnnnnatggtggggtgcacccatccccgatctataccatcttggagagctcctcaccgcctttctcccacccatcctgggtctcccctggctccacgcagggcgtgagatcctggcgcagacggacggaatgctggacgcatttgtctctggcgcggggacggggggcacattagcaggggtgtcgtgtgcgctcaaggccgccaatcccagggtcaaagtcttcctcatcgacccgcccggcagcggactcttcaacaaggtctttgctgggagactagaaggctttggaggagttgcctgtgcgacgggaatgccacagaggaggggcatcatcaaatcccatcctcctgaggagtaattcccattcgagcttgtgcccacatcatgtcaaggcacgttcctgggcacgcccatnnnnnnnnnngtgctgggagactggaaggctttggatgagttgcctgtgcggcgggaatgccacagaggaggaggggcatcatcaaatcccatcctcctgaggagtatttcccatttaagcttgtgcccacattatgtcaaggcacgttcctgggcacgcccatcttccccccgcccaccttccccacccatttccgtcctcctcattgccctcctacctggaaagaacagccccatagccccgtgccactcccgacaactccgcaggtgacacggggcnnnnnnnnnncggaaagaacagccccatacccccgccccgctcccgacaactccgcaggtgacacggggcgtgatgttcacacgcgaggaggcggaggggcggcggctgcgccaccccgccgacaccatcaccgagggcatcgggatcaaccgccagacggccaactttggccgtgccctcgtagacggcgcttttcagggctctgacatggaagccgtggagatggcagcctacctcctgcgcaacgacggcctcttcgtcggctcctccgccgccatgaactgcgtgggcgcggtcaaggccgcgcgcctgctgggcccgggagcaacgatcgtgaccgtgctgtgcgacggcggggcgcgccacctgtcgcgcttccacaacgccgggtttctcgccgagcaaggcctggcgccggtagccacaggcacggggctggccttcgtgagcgatgggccgtaccgccccgcgatcggtcaagtcttgcccacacacacttgacaagccggcctgcaccgggatnnnnnnnnnncggcacggggctggccttcgtcagcaatgggccgtatcgccccgcgatcggtcaagtcttgcccacgcacacttgacaagccggcctgcaccgggatccaggggtccggctggacccctggtgcgacgcagacagtcctggctgaggtccaggctgacagctggtgctggaagggtaatcggatcgagcttcaaacccgcgtactcttaccgttctgcacatgcacctgnnnnnnnnnntggtccaggctggctgctggtgctggaagggtaattggatcgagcttcaaacccacgtactcttaccgttctgcacatgcacctgatctgcactgtattctgttcacaactttgttacatcccctagagaggaagcgtcatatgcgcgtagcgctcatgccaattgagtcgttcaaggtgatgtgactaggtgccgccgtcctccctaccccgcgctcagtacccgcgcgatcgcacaatgaacctgtcgcgaggaatgtcggtgccagcatccattgagtcgaagttctccttcatttgccggaccgcctcctggcgctgggtcacggaggagacatgggggaacacgcggactcgggggtgggtccacaggggcgaggtcttcggcagaggctcctcgtggaagacatctaagaccgcggcggacagatgccctgaatccagggcttgaatcaggtcgacgtccaccacgtgccccccgcgggcgacgttgatgatcgcggcccccggaggcagggtggcgaacaggcgggcgtccagaaggccggccgtctcgtccgtgagcgggagcaggcagatgagaatctgagcctctcgggccagctcaaaaaggccttctcggtcatggtagtaggatatgcgcgcgtttttctggtcattggctcgtgcacttcgcgtccaggcggagacggggtacccagccgccaggaggagggtggccgtggcggctccaaggttgccgaggccaagaatgccaacgcgcacgctgctattgtcccgaatggtaaaattctcgacactcttgtcccaacggcagtctttttgggcttctaagtatgcgtcactgcagggaggaatttggttttgcatcatgagtgtggctgcaaggccttagcttggcaagccataatggcttggatgaagggacaacgcagtcaagcagctgcaggtccatgcacatcgccagcatccccgctttgccctcaactaccaccatagcgttctagaatctcctcaaannnnnnnnnncagcttggcaaggcgtaagggcttgaatgaagggacaacgcaatcaagcagctgcaggtccatgcacattgccagcatccccgctttgccctcaacaaccaccatagcgttctagaatctcctcaaacccctccaccccagcctgaccatttgcgctggacgttgatgaccgcccacatgcagaaggtggccatgcgctgtgccatcagggggtccaccaccctcaccatgggcacatgcgtagggcatacctcgtcccgcagcatgcggtgcgtgatccccgcgcccatggagtggatcagtctcaagtttgggcattgggccagcagtccatcgggagggttgaagcaaaccacgtagcggaccttttccaagtctacccctagcttggcttcgacgatggtaaggcccgcattctccagctcccgcctccaagtagcgaggaaatcggggcctccgaaatcttcagaggagccggttgggaggtggaaggaggtttgggtggcgatgcggattacattgcttatacgtctgcacgctagggagagttgtcccggctgctggggcgcggggcttacctgaccacaacaggacctcgtagtccttcccctctgactctttgtcaattgccatggttttggaccagaaattgattcaggtcctgacggttgtctgctgtacgccttgcccaaacttcggtcgaccactcggtatgcacgttttcaccgaggacggtgatcgcagtgagcaattggcgattgtccacttggacggtaaggcaaactgaggattcgtgtcgtaatggctcctcacacagcgatattgcagcaacgcttaccttttgggaatgcacattgatctcctccgtgggggacgcccccacgtggttacgtgaccggcaggaaaacaagtcttcccgtattagggttgtcatcaggcgcacgagcaagtttgcatctgcagcggtctcgcgcctgcaaagtccagtcatgcacataacaaagcttagcgccgtcagagtacagaagatattccacatcgcacatggcatggagggacctgtttgacatagtgtactggtgcgcggcatgagtgggcaggttgggactcccttgcacagtcttcctacaagtacatgaactccgagtgactgacggcgttggcggcccctttctggtcttcagcttcctgccgctccctctcgtaccgagcatcatcggttggcagttcgtgcctgtcacaggaacatggacggtggatgaggtggcgggcactccgctgggtacagtcatcgcaaggacaccccccaggacagtacactgtacgtgtgagggtggcaggcacctccagagctctgaaatcagaataaacacatccacgctgcacgctggctgctacctgcaggttgggcaggagttgtgctccttcagccatggcgccaggcaggggagatgaaacacgtggccacacggcaaggcctgcaccgtgtcttccacctccagctcctccctggggattgcagaagggcagggagcatgagcatctgtgcacatgcagactggaggaagctggtcgctcacaggctttgcttcaccgcagagggggttcagagcgccaggagggctagccagaaccccataaaacacgttcatcctctcaatgactccctcccctgccccagggcgctcaacccccacagggtcccccggtctcacatgcacacagggcaacgggtgccggcgccgcccagctcggccaagcgtgatggcgtcaggacctccttgggcagggactgcaccacagtcgcgctggcagggggcgcgccgcgcggcacgtcagccatgctgtcctccagggcctgcaggaggtccgcatccaagaggtgtggctccgggccctccagggtggcgcccagggccccattctgcatctgctgcaggtgcgccattagagcctcgagcgccgctgcactctgtggacttgattccggccctgctgcaggctcggcatgtgacagcaagccctggaaggaaaatggcgggggcgccgcagccagtgtcgctgtggccggttcgtcctccaggtgcgcagcacaggacgccaggtaccccctcagctgggtggcgaggttcccactcctgtccgacgcgagcgcggcgcggtaaagagtctgtgcccgcgcccagaaagcggtggagttgtaccggctctggaggagggtgtggacgcgtgcaaggagcactgaataggccggatcatcgaccaccgatccgcccgaggtgggtagtagatccttcaagcgttctacaccttgctcgaaggtcgctttcttctccaacaggggcttgatatcactcgggactgcgggcatggcgaactggctttccttgctagtgatttggaaagggcgcgatccgacgtcaatatagcttgaccgtgtatctctatcaactggcaaagctcaaagtcctgaggcgatgcctgnnnnnnnnnncggctttccttgctagtgatttggagagggcgcgatccgacgtcaaaatagcttgaccgtgtacctctatcaactagcaaagctcaaagtcctgaggcgatgcctgcattgtatccctcgccggtctcttctggacccctcatcgcgcctgcgcctcgccgtgtgctgactcaggaagacgaagtccaacatgcgtcggaagaagcattgtgtagagtgtaactatacctatgtacgctgtgttatgaagaaatatcccatcgccattcctcaaccatgtgaaaccaaggccagccatgacactggtctgtcagaggggcaagtgatcttggagtgggnnnnnnnnnncatccctcgccggtctcttctaaactcctcatctgcaagggtctaatcatggagatcccccaaactggacgacatagaaagcctagttttgccgaaatctaagacgagccatgtttggatttagatttgtaaatgttgaatatatcttaatcgggtcccgaggaccccacgattggcgagacccatcaggacacttagtttggccttgccttggctaggcgagggtgcgttcacatcggacgttggacagtcacagaacagtagtgtatcgagggcgcgggctattaatgatctcgtgagcatgagtggggggttgggccccgcgctcgaccatgcccgtcgtcttccaaatgggctctggaagggtgcagcagcggccgctctttcatgcccagtcagagagagcgtgttagcgatatcttcagcattggatgggaatggagagcaccccgacggtcaaaactggctgtatctgagcagttttatattatagcagtgcatgccagtcacgctgaaggtctgccacatcattactccatgggcaacaagccccataattcacatctcgacaggctgtgcagaggccgacaccaccgctgcatggccacaatgtccagtgcaagggggcttaaagggttatacaaacctcatctgacggcggtaaccaatcttggagggtgtccataactttgaccgaaaagcagtgcttgacattgggcgtgtaggttgtgtctggagtgtacacatactgctttaccacctttctaatcctcaacgcggagcctgcgacaccatcctcgatcaggatgacctgaataaaggcatatgttgatgaagtaatggtgaatgtcagcttgttcgatcctgcagatttgacttccaaagtcaagggctgtggaggtggaggtgaagggggaggggctggtggagagggcagaggcggagaggacggaggtggagagggcggaggggaaggggctggtggagagggcgga

SEQ ID NO: 46839 - DNA, 63 bp, Chlorella protothecoides
ttccctgccgccgcctccctgccatccgatgttccccccgtccaacggcaccctgcccagcag

SEQ ID NO: 46840 - DNA, 61 bp, Chlorella protothecoides
caaagtgaggaaacggtaggcttgtgcattcgtctgcttccctgcttctttccctcatcct

SEQ ID NO: 46841 - DNA, 72 bp, Chlorella protothecoides
gcatggcgccgcggggcgacggcgacgccccggggtttgatacgcgtcgccgcgccgcgcctgcccctggcc

SEQ ID NO: 46842 - DNA, 61 bp, Chlorella protothecoides
gggatgacacgccggtcccggaggcggaggtggaggagggggtgccgggccgctccaacgc

SEQ ID NO: 46843 - DNA, 70 bp, Chlorella protothecoides
gggacgaagtgcattcgcaaaaaaacacttggtcagcatgagcatgttggcagccccgttgacgtcgcgg

SEQ ID NO: 46844 - DNA, 73 bp, Chlorella protothecoides
gcgcgagacggggctgggcaacctgctggcagacgccatgcgcgtggccatgggctgccaggtcgcgttcttc

SEQ ID NO: 46845 - DNA, 61 bp, Chlorella protothecoides
ggtggtccaattccgtcgggtcccggtgcctcagcaccgcatgacccccttgaagacaagc

SEQ ID NO: 46846 - DNA, 72 bp, Chlorella protothecoides
gaactccagtagtggtcggcggcgccggccgcccacgtcgagagcgcacctcctcgctcctcaccattccat

SEQ ID NO: 46847 - DNA, 61 bp, Chlorella protothecoides
tcctgacgccaagcagaaaccttgcaaaggtaattcaccacacaactctgcaacctggttg

SEQ ID NO: 46848 - DNA, 64 bp, Chlorella protothecoides
gtctgcagctggttcttgaacagcacctgggtccggagggaggggatacggtcatacagggggt

SEQ ID NO: 46849 - DNA, 61 bp, Chlorella protothecoides
ggaagctcggcccagctcaggccatgcgtggtctggatgtcactttctgacagggatccca

SEQ ID NO: 46850 - DNA, 61 bp, Chlorella protothecoides
cctgagctccagccccctcgttgctctcccaccctccgcagccgtgaggaggtcggggagg

SEQ ID NO: 46851 - DNA, 61 bp, Chlorella protothecoides
cggcgagggagtgccggacgggctgggggtagggctcggcgagggagtgccggacgggctg

SEQ ID NO: 46852 - DNA, 61 bp, Chlorella protothecoides
ttgtggatctcgtagcgtccttcgtagggcacccccgccgacagcgccagggggtcggaca

SEQ ID NO: 46853 - DNA, 63 bp, Chlorella protothecoides
tcgctcagcgaatgctcttgaactcgtatgtagggcatcgaccccggcacgagaactccgcgc

SEQ ID NO: 46854 - DNA, 61 bp, Chlorella protothecoides
ccccggtaccagagcctgtacatgagcagcaacgagatcgacggcatcctgtacacccagg

SEQ ID NO: 46855 - DNA, 127 bp, Chlorella protothecoides
ccaaccgcgtcttcaagaaggtgggctgctgggccgggcgggaggggggggacagggagatcgcggcgcccgctcgacacccggcggtcagtcggtggccgcccagagcacccgacccggcccacga

SEQ ID NO: 46856 - DNA, 79 bp, Chlorella protothecoides
tgcctgccatgccagcaggggggaggagatgatggccaggcgagggccgagggcagagaaagggttggcagatgcccac

SEQ ID NO: 46857 - DNA, 61 bp, Chlorella protothecoides
caacccaggcattttacaagctcttctcggtaacccggggctcctgcaagctcttctcggc

SEQ ID NO: 46858 - DNA, 61 bp, Chlorella protothecoides
tcttggcaatgggccatggagtggctgggggtcacctttccacaacaagagactgatcaga

SEQ ID NO: 46859 - DNA, 71 bp, Chlorella protothecoides
acaagagcaaggcagcagctggcgcaggcgtgtcagctcgaacaccgccctctcaggcctgggactcaagg

SEQ ID NO: 46860 - DNA, 71 bp, Chlorella protothecoides
cccccccctcccccccccccccccctcttttccagctgtctacggcgcgcatcgcctttggcttctacgcc

SEQ ID NO: 46861 - DNA, 12664 bp, Chlorella protothecoides
  modified_base (1145)..(1154): a, c, t, g, unknown or other
  modified_base (2383)..(2392): a, c, t, g, unknown or other
  modified_base (2887)..(2896): a, c, t, g, unknown or other
  modified_base (3457)..(3466): a, c, t, g, unknown or other
  modified_base (4425)..(4434): a, c, t, g, unknown or other
  modified_base (4895)..(4904): a, c, t, g, unknown or other
  modified_base (5281)..(5290): a, c, t, g, unknown or other
  modified_base (5965)..(5974): a, c, t, g, unknown or other
  modified_base (6435)..(6444): a, c, t, g, unknown or other
  modified_base (7076)..(7220): a, c, t, g, unknown or other
  modified_base (7296)..(7305): a, c, t, g, unknown or other
  modified_base (7381)..(7390): a, c, t, g, unknown or other
  modified_base (7607)..(7616): a, c, t, g, unknown or other
  modified_base (7828)..(7837): a, c, t, g, unknown or other
  modified_base (8609)..(8618): a, c, t, g, unknown or other
  modified_base (8744)..(8753): a, c, t, g, unknown or other
  modified_base (9841)..(9850): a, c, t, g, unknown or other
  modified_base (10874)..(10883): a, c, t, g, unknown or other
  modified_base (11325)..(11394): a, c, t, g, unknown or other
  modified_base (12415)..(12588): a, c, t, g, unknown or other
aggcgcagcgcggggtccgggcaccaggccagcccggccacgccccgccccagctcggcgccctgcagctcgcccaggtcccagcgcgccgcgcagcggccggtgcgcgcctcccacagccgcacgctgccgtcgcgggaggaggaggccagccacgcgccgctggcgtcgggggccagccccgtgacggctgcggcgtggcccaggaagcgcaggccctctgccgagggaaagggctgcaggtcgcgcggcttgggcaggtgcgggaccagcacgctggggtccttgacgggcgcgcgcttgcgccgcccgcgagggcacaggtacaggtccaggcagcgctcgaagcgctccttaatgaaggccgcgtaggcgggcaccgcgcgcagggaggggaaggcggtgggcacaaaggcggggcgctcctcctccggctgcatggccacggccgccagctcctcctgagcatggtgggtgggaggaaaggtgggaaagggttgtgtggaggtgggtcggtggcaaagggaacgacccttctggttggattctgtttgttcgggtggggtgggggtgatggggaaccgcaggcagcggcagccgtgcgacaactctcacccctccccccaccacacacaaaggggatcacaaacacacacacgagcacaagtgcatcctccccccaccccccctaagcaacccacctcagtgggcaggtactccttgggcgggttgtatgactcggcgtggcccggcaggcgcggcttgggcgcggggatgtaggccagccccgtcccagtcctgctgctggcctggccgtcgtcctgccacataaggtagggcttgtccgcctcctccgctggcggcgcgcccagcttgagccagcccctgcggatggcacgcaccagcttcaccaccttcttctcctcccacttggaggggacgaagcggcgcttgggctcaggggcgccggtcaggggcatgacctccgtgtcccgcgtgaaccagtcgttctcctcggggaagggattgacctccaggtgcgggaactggcctgccggggggagcgggagtgaggtacgtgttgagggtaagggagatggggtggcaggctggagggttgaggggggctgtgaccatgccgtgannnnnnnnnnagagcgaggtgcgtgttgagggtaagggagatgggggtgcaggctggggggttgaggggggctgtgaccatgccgtgaagcacgaagagcagggcttctgagcgcactctgaggacacaggctccagtgccctgtcccgggccagggagttgggaccatgcccccaaactctgcagcgacaccctctccaaccccaccctacccgtgcggatgcggttgatcatgcgcatctcagccttggacaggactatctcctcgtcgttgtagtcatcatacaccgtcctcaggaactgtggtcaggaccgagggagggttgagaggaatgtgtcacaatgtgtgagccctgaggtggacagcctccggggcggcatgccccctgggtccccggtcatgccgctgaccctccgctgcgctgcccgtgccatcagtcaagcatccccatgcatcccacatgccccgacccaagctcccccgccagcctcgccttggtggagtcgttccgtgccagcagggtgtccagcttgtccttcctccccttcttaaccagcttcatcccatccttgtcgtacccgatgtgttcctcggcgtcgtaccactcgaggggcacattccccaccgtgttgcgaccggggcgctcgtcctcggaggagtcggaggcggggtcgtcctggggccggggggaggctggctcctcctcgcccatctctccatctgtgcccgtctcactctcagaggtcacaaacccggcctcgtcagcctcctccctcccctcatcttcctctgaagcgtctactgtcggcggctggccagccctgaagtggggagtggggagggtttacagcgcaggttgcatggggcagcgcagggggatgggccgacccttagcaactatctccagaactggcatgcatgctgtccccggctgctccaggaacctcacccattgccgacgttcctcctgagggcaccgacgtagtccttgactgcatggtctatctcgtgctcgacatcggcctcggagtccgagtcgccagagaaggcctccacgtcctcctcctcagtatcgctcccgctgctcagcaccagctcggagacatccacctcagagggagggcgctcttcattcttagctggctttcttgcacccgtactggctcttttggggctcattgaggggatataatcctagacgaccctaagactgtcgcgggcatgtgctcgccctggannnnnnnnnncgcacccgtactggctctcttggggctcattgaggggatatactcctagacgacccctagactgtcgcgggcatgtgctcgccctggagcagcgcgggagcaatctcttcagccgaggagcacggacttatatgtcggtaaatatatggtatctcgcgtctggtgctacagcctcctctcctctgggtctggacaccagcaccatgcagggcgccactctcggcccccgccggctcgaacatgggggtttccgcgcgcggagagatcgtggagctggatcgcaggtggaatacccaccctccctgccaggggacagtttgatcgccctccaccaatgctcctgaatcacgatctcatgtaagtagatcttgtctgacagcttcgactctgcttgaacggtcgatcgccagcttgtgccccagctctcttcgtttgtcgtcaggtcaagaccaggtcctcgctccttcaacatgcaactcggtgcatgcggcacannnnnnnnnnttgacagcttcgactctgcttgaagggtcgatcgccagcttgtgcccgagctctcttagtttttcgtcaggtcaagaccaggtcctcgctcgttcaacatgcaactcggtgcatgcggcacatctcgggcctaccgaacccccatttcatcagcaactcatcgccagaacattcaaccacgggtcagattcgccgaacgaaccctggtgagcgtgatttaaccggggttgcatgtggttgatccagtgccactggagggccctccaatcacctctaaacccaagccatccaggcgtcgcgcacggcgagccggggcaagggccatccaagggtgggcgcaggcaaagccacccctgtgaccagtaaacctgccaacaagactgccacccccaaaccgctggagcttgagccaggtcagccctcgcgagggggatgggacagaggggaggtaatgaagcagatatgctgcaaagcggatgtgaatccttatggctgctccctcaagttcctctccccttcactcccatgctctatacaggcagtgcatcgcctctgggtgcnnnnnnnnnnctatggctgctccctcgagttcctctccccttcattcccatgccctatacaggcagtgcatcgcctctgggtgcttccccagcagaggggggcgtcaactttgcattggcagctcctcatgccacagcggtaaccctgtgtctctataatgccgacaacagcccccttcaggagctgaagctgcacagtacgggtgcgggtcgggaatgctgcacctcccatccgctacttcgcagctcgggttgttccgctgattgggacatcggtgaatgatgcttgcctgagcctggtcttgagtgctgtggccaggaatcccaccgccaccctcatgcttacgaccacccccacccccaccaggcgaggtctggcatggcctcgtcgacggcctccccctgtccggcatcctgtatggctacagggtgtccggggccgagggtcccgactcgccctaccgctgggacgacacccgtgtcctgctggacccctatgccaggctggtggcaggccgggcccgctttgggcagcgggacgagagagaggggttccaggagaggctggggtccctcttccgcgggacctttgacttcgaggccgagccctttgactggggccccggggaggagaccggccgcccagacatcgccaccaaagacctggtcatctacgagctgccgctgcgctgcttcacggcctcccccaccagcgggctcccggaagggcagcgtggagggttcctgggactgaaggacaaggtgcgttcttgagtgtgggggttgagctcacgctttcccgttgagaggcaagggcctttgacaggacacttgctcgtgctcacgcagaccctggactccagggtcaaggactggtgcctgcgcccctctgtcagagcagcatgctccattccttccaattcccatagatcccacacctcaaggagctgggcatcaatgcggtggagnnnnnnnnnncagagcatcatgctccattccttccaattcccgtagatcccacatctcaaggagctgggcatcaatgcggtggagctcctgccactctttgagtatgacgagcttgagttccagcgcaggtgtgacttgagcgtgggatgttggtccagaactcaggcccgtagtcttgggtctcgctgtcttacagggaaaggtatctgggtgcctccacttctgatgcagagagctgttgagctggaattctggcagcttacacctcgcaccaccctgaacacactactccaccgcagccccaacccaagggaccacatggtgaacgtctggggctactcccacctcagcttctttgcccccatgagtcgctttgcggcaggtctggcgattgctccacatggaacttcttgggggttgaagagcagggctaacctgctggtcagccacccttggtgtcggtcacacgnnnnnnnnnngggtttaagagcagtgctaaccagttggtcagccacccttggtgtcggtcacacggttgctttctacagcactggcgtgcatgcagagcatcgcgtgcataatcgtcgcagatgtccacctggcctcagcaagcaccgcttcctcctctgttgccgctgacctgcagatggcggcggcccactggcagccgatcgggagctgaaggagatggtgaaggccctgcatgccgcgggcatccaggtcattgtggatgtggtctacaaccacaccgcagaaggtggggcttggttgttgtgcggggccatggggatggttcccatgaggaggcccgccagcgccgccagactcaggtccccagtcagaagcagatggtccnnnnnnnnnnccgtgcggggccgtgggatggttcccatgaggaggcccgccatcgccgccagcctcaggtccccagtcagaagcagatggtccagggcaacccgcttgctcagagacgctgtctttcccaaggtggaacttgtgtcagaatcgctatcccagtccccagcagcttcactccaccactcgccacacccctcctttccaccctcaatgcaggcggcgacgacgacccgtacctgctgtcctggcgtgggatcaatgctggggtgtactaccagcaggaccccgcctcccacgccatcctcaacttttccgggtgtgggaacacggtggcggccaaccaccctctggtccaggaccagatcctcacctcgctgcgctggtgggtggaggagtaccatgtcgacggcttccgcttcgacctcgccccctgcctgtgccggggtcaggacggggagcccctcgccaccccccccgccatcgaggccatgagcaaggaccccatgctctccaaggtggggcggcggtgggccggtggtgggccgggcatgctctgaatacctgtgccaccctgcctcccggagagccgtcaacgatgccaacctggtctggaccagggaaagtagctgaacagggaatgcagaggtcttggctccctgcctccctggcacgagtgcaggtnnnnnnnnnntcccatgctctccaaggtggggcggcggtggaccagtggtgggccaggcatgctctgaatacctgtgccaccctgcctcctggagagccgtcaacaatgctaacctgatctcgaccagggaaagtagctgaacaggaaatgcagaggttttagctccctgcctccctggcacgagtgcaggtgaagctgatcgcggagccctgggacctcggcctctacatggtgggctccttcccaaactgggacagctggaaagagtggaacggccagtatcgggacgacgtgcgccggttcatcaagtgagggtgctctgggcgggagcaagcgagtagagtttggttgcctcaggctctgcagcggactgcagagctcactcgaacctcagcatcccggcatcgcaagtatcatgagggccctgctcccacctcatgcagtaccagtgatgtttccacgccccatcnnnnnnnnnntctcaggctctgtagcggactgcagtgctcacttgaacctcagcatcccggcatcgcaagtaccatgagcgccctgctcccacctcacgcagtaccagtgatgtttccacgccccatcaacgcctcctgaccagcatccctctgtttcccacctcaacaggggggatgccggcttcaagcagaagtttgcgacccgcctggctggctcctcggacctctacaactacaacaagcggtgggtgactgggggagttgcgtggcttcccccgttcctctggctgtgggtccgagtccagctcccttgcctttgctgcgccacgccctcctcccccgcaccctgcaggaaagcctcagactccatcaactttgtgattgcgcacgatggattcaccctggcagactcagtggcctacaacgagaagcacaacgacgccaatggcgaattcaaccgtgagaccacctctttggctctgtcggccgtgggagggagtcagccactcaagacggggctgtggggtcagcgaagctcagtaggcaaccccgccacatgctgtgccatcccttcgcccatgcacccgcacctccgtgcttccttccacacaggcgacggcaccaacgacaatttcagctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaggcgatgagaagggaaattggaggactaggagatgcagctacttcacgccaggctggcaggaagtgcatcannnnnnnnnngaaaggggatgagaagggaaattggaggacgaggagaggcagctgcttcacgccaggctggcaggaagtgcatcannnnnnnnnntcatccctttacccatgcacccacacctctgtgcttccttccacataggcgacggcaccaacgacaatttcagctggaactgcggcgtggagggggagacgagtgaccccggcgtgttggcgctacgggcgcgccagatgcggaacctgcacctcgccctcatgctctcgcagggcacccctatgatcctcgcaggtggggtttggcttgcctgtgnnnnnnnnnntgtcgtctggccgcatgatgagtgccatctgtgtttgcggacttgccaagaatggcggtgttattctccatgccatggactggtgtgataccaaaatgcagctgcctggcgctgctgctctagtcaaatgcctcccgtccctgtcgggaggctcgctgggcacttgcttggacaggaatggccacacacggcataccaccttggcatcctcnnnnnnnnnngcaatgggggattcaacggaaagggaacggtctgccgacctctcactccttcaagaagcctccttgagactaagtattccaaattcgtctggtgcttgcaggggatgaatacgcgcagacgcggcacggcaacaacaactactacgggcacgacaccgagctcacgcactatgactgggagaagctggaggaggccaagcagagcgggtggttcaggtgggtcgtctggccgcatgctgagtgccatctgtgtttgcggacttgccaggaatggcggtgtcattctccatgccatggactggtggtatgccagaatgcagctgcctggcgctgctgctctggtcgaatgcctcccggccctgtcggggggcttgctgggcacttgcttggacagggatagcccacacacggcataccaccttggcatcctcaaagcactccaagcgaatcagcctcccacaccacctccttgccatcctcccaggttctacgccggcctcatccacttccggacaggtcaccccctgctggggcgggacaaattcctgggtccacaggacgtgacttggcacgaatccagctgggaggacccagagtcgcgcttccttgccttcaccctgcatgacaggtgggtggggggttggggaggttgggagcgggtctggacaccccacttgcatgttgttgtcagctcctttcagcaagcatggaagcatggacggggcatctctgagtcttgcggaggctcgccgtgcttgctgctctgcggccnnnnnnnnnnagacagggcatctctgagtcgtgcagaggctcgccgtgcttgctgctctgcggcctttgtactctctggcacctgcacgcccaaataaacatgggcaggcgccgctgggtgtgtcaccttcagcgnnnnnnnnnncactctctggcacctgcacgcccaactgaatacggccaggcgccgctgggtgtgtcaccttcagcgctcagccagtcttacctgaccctcctcaatccaggggccaagggggaggtgacatctatgccgcgttcaacgcccacggcttctccgtggatgtggacctcccgttgccccccccgggccagcgctgggcaagggtggtggacaccaacctcccgtcgccacgggacttcaccccagggggtaacaagggggtggacccgcgctacaacatccagtgcttttcatccatcatgctccttgcggtgccagtggaatgaatcattgagtgcgccgctgctcctcctgtcctgagagtcctccttgctcatggcatggacaggggaacacggggtggcaagcgccctgtgctcgagatggatgggatgtggtggggccaagtgctctgttgtcgatgaaaccgtcccagcgcgcgcagggttgacaagcattgggtcgacatgcgtgagacgcctctctcaccacattccgataagtgtttgagttttacgaccaataagcataaattcaatcgtcctgctccagcagattgtccatatccctgctgtacttggcagacctccgttgatttctagttgcacacagcggtcttccacgacatcccgcttcatggctagggaaaaattcgcagaatccaatgctctcgccgacatcagcaggcgactcgcagcctcgagtgcctcggctgaggtgcgcggagcccctcgggtgggctataactgaaactctgggcaagggattttgccatgcccatagaacctccttgttttccctgttccgcagaagcaggcgcaaggctctgcaggtggaaccatcaacagccctagaccgagattaaaaaaacagaagaggtctcagggtgagctgccggaaacaattaccagctccctctggacttgcacgtgtgcacatggccagacgctccatagcccctcccaccgccaacctggcttccttgcagggtctgatgaacctttgagctctggaaggcccgcccacagtgacagcttgagggtcactgaacnnnnnnnnnngattaccagctccctctggacttgcacttgtgcatatggccagacgctccatagcccctcccacctccaacctggcttctttgcagggtctgaagaacctttgagctctggaaagtccacccacagtgacagcttgagggtcactgaaccctcaggtagtctggaatccagactcctggcccttgctcgagtggcagacagcaatgacagccccggccagggccctttcagggcagcgggggcggtggcgcaagaactacgcgcttggatccagggcggcagcaccctgcaccaggcagggagtcctgctgccttggaagcggttcgagagctggaaaacgtggcctgcagtctgcaccatgacgccctgggcctttggcgactcagccaggcggccctgcgtgtgcaatgcatgctgagtcagcacatgcactcagaccaagcagagggtcaagcaaccagcgctgcagacaccgaggccttcatctccaggttctatgcctcgttccaggaggagctgggcgccatggaagcggaggggactgatgtcagcccagatgtgcttcgtgatactgtagcctcctgggcatgcgggcccctttgatctttacgcaccgcatgctggtatggacctgtatcctcatcgaggcgtttcctttggtgccgggtgaagctcgagacgggcggatgtagatcctatagcggacgcatggcacagagcagcgtgtggaagcgtcatgggccctctcccggtccttgaggccctcgaaagccaaagatgattggcattgtcttatactcttgctgcatgccgttttgtgccccatcccggtagaataggagttgcgcaagattcgcccgaggggcatctagccgcatccccacctgccattgagcatgccaaccaggtgtcccattgtaagatccctctcatttggcgaaacaagacgccccaccaaggtagcatgccctcagaatcggagacgccgttcccaaacaatcccctctcactacaagatcgcannnnnnnnnncggagttgcgcatgattcgcccgaggggcacctagccgcatccccacctgccattaagcatgccaacctggtctcccattgtcaaatccccttcatttggcgaaacaagacgcccaaccaaggtagcatgccctcagaattggagacgccgttctcaaacaatcccctctcactacaagatcgcaaactcgtgccgaacaagtcactgacatcgacgtcagcgcgctgtaagggaatgcccatcgcattggtcggcacaaatgcaatttgctggcacacgagcgtgatgactgccgtccaattgcgagtcatatccatccacgcaagtatctagatttaactgtgactgtccatgcattcgccttgtcctcttctgcatccctcgagcaggccagtgcaaccgtccctgggagcaaccctagtcacccacccgagcggcagnnnnnnnnnnnnnnnnnnnnnnnnnnnnnnnnnnnnnnnnnnnnnnnnnnnnnnnnnnnnnnnnnnnnnnccctcctcgaccgagtgatgggcagtcatgggacgccatggcggtcgtgtctggtgtgtctcctggcagcctcaacctgggctggggtggctgccaggctggccccgtcgctgaacgccagtgcagacctcctcgacctggacgccccccatgaatggcagccctgcgctcgtggcctgcacacctccgacatgacactctgtttcctggggggcgccctttgcccagcccccctggtcggggaggagggccccttgggccttacggccccgttccaccggcgggacccccacaaggacctcttcccactgaacctacgtgacatcatcggcctgaccctggcctccctggccctggccctggcggcatctggcggcctgggcggcggcggcatcctggtgccattgtacctcatcgttctgagtgagcttctgttgttgaggcccatgagcgggggtggacagcactcccgctcatggctccatgacaagtgtcccacattctcgacactcctgcccattgaacctgccctgcacccagccttcatttcccaacgctctcctccccccgtcccattcctgtctcaccagggtttgacacctacagcgcggtggcgctgtccaatgtgaccatcgtggggggcaccctaaccaacctggccatcaacatcgggcggcggcacccgctccgcgacgcgccgctcatcgactgggacctcatcctggtcatggagccgtccaccattctgggcgccatcctcggcacctatgtcaacgtgaggaggatggtcgggggtgatgtggtgatggaccggccggctctgacgccaaaccaggctgccatttcctcagcgtccttggccccacctccgatatagagcatccttctgaccccttcccacccccccaccccccaccccaatccccgcagcatgtgctgcctccctggctgaccaccatcagcctgggcctgctcctcaccttcatcacctacaagctggtggtcaaggcacgcacgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgactcggtggcggccgcggcggtggcggcggaggacggcgggtcggccagcgacggctcggccccgacgtccg

SEQ ID NO: 46862 - DNA, 127 bp, Chlorella protothecoides
gtccttgacccgcatatgatttttgatcctaggctgtgagtgtaaagattttcatggcagggtatcttgaccctttggtctcttcgtatctcagatctgtgcatgcacaagggtgtagccggctcag

SEQ ID NO: 46863 - DNA, 80 bp, Chlorella protothecoides
gagtgtggggacagagtgggaagctggtgtctgggcagaggagattcgcaagttacgaaactcagcgcgtgtgacacact

SEQ ID NO: 46864 - DNA, 62 bp, Chlorella protothecoides
agtgcccacgcaggacggggcagccgcgccgagcccgctcgacgccacgaatgtgcacggaa

SEQ ID NO: 46865 - DNA, 61 bp, Chlorella protothecoides
atggacgcgatgcatgcgatgcatatctgcgggtgggccactggtgacagctgcagggcaa

SEQ ID NO: 46866 - DNA, 99 bp, Chlorella protothecoides
ggggggggggcgggcgcgagcgcgtggttgcccttgagataaacacgaccgtggcaagggagggtgggagggtgggtgcacaagcaggtagcttgccgc

SEQ ID NO: 46867 - DNA, 61 bp, Chlorella protothecoides
ggccgggtacgacacggccctggtcctgccggaccgcccgcccaacaaggcggggcagctg

SEQ ID NO: 46868 - DNA, 61 bp, Chlorella protothecoides
cctgcgccgactggcacagcatgcgctgccaactggcacagcatgcgctgccgagtgcggc

SEQ ID NO: 46869 - DNA, 61 bp, Chlorella protothecoides
gccctgccctggtatgtcctgcctgcacccacccccctgcctcccttgatgccacagagcc

SEQ ID NO: 46870 - DNA, 67 bp, Chlorella protothecoides
caggtccgaggccgacaaggcgagggaggctgccgaggaggctagcgtggcggtagcccgagcgacg

SEQ ID NO: 46871 - DNA, 8894 bp, Chlorella protothecoides
  modified_base (584)..(593): a, c, t, g, unknown or other
  modified_base (658)..(667): a, c, t, g, unknown or other
  modified_base (740)..(749): a, c, t, g, unknown or other
  modified_base (948)..(957): a, c, t, g, unknown or other
  modified_base (1496)..(1505): a, c, t, g, unknown or other
  modified_base (1822)..(1831): a, c, t, g, unknown or other
  modified_base (2036)..(2045): a, c, t, g, unknown or other
  modified_base (2989)..(2998): a, c, t, g, unknown or other
  modified_base (3252)..(3261): a, c, t, g, unknown or other
  modified_base (4937)..(4946): a, c, t, g, unknown or other
  modified_base (5608)..(5617): a, c, t, g, unknown or other
  modified_base (7591)..(7600): a, c, t, g, unknown or other
  modified_base (8246)..(8255): a, c, t, g, unknown or other
aaaggcgctgtggcccaggtacggcggcggctccgagcgccgctgcacggcgccgcccgcgctggagcgcgacacgcgcaccgcggagacctcctcctccccatcctccccctcgtcgtcctcgtcggagcccgccacgcccgcgccccgcgcgcggccgccccacgcgtacggacggtgctgcaggcggtagcgggtgtagctgtcgcggcgcgtggtggggatgccctcgctcccgctgctggagggcaggggctcgtcgtcctcctcctcccccgccgcgctgtcctcgtcgccgccgccgccgctgctcgaccgcgccgtgcggcgcgcgccctcgggcgacgaccgcgtgcgccgctcgggcagcacgccctcgtacgccatgctgatgcgcggcgccatgacgtcgtcctcgtcgtcatcggcgccggacccgcggcggggcacgcgcggagcaaagcgctgcgcgggggcggagcgcgcacccgccccgccaaacatggggaaggcgggggggaggttgtaggagttgcccgtcgaccccgccgcggagccgccgaaggaggacatgtcggccgtgnnnnnnnnnnagggttgaaggagttgcccgccgaccccgccgcagagccgccgaaggaggacatgtcggccgtgnnnnnnnnnntgagtgggccccggtccaagggcgatgccgtgccacgtcacgtgccgcggactggcacggcagacatgtcccnnnnnnnnnncccggtccaggggtgatgccgtgccacgtcacatgccgcggactggcacggcagacatgtccctccacacccgcaccataaaacacacccaccccaggcatccttgggccgcgttgttggtgggcccggggcccctcgcagcacacaccagcccccttttcccccttttgccaacacacaccttcgcggtccatcatgnnnnnnnnnntagcacacaccagccccctattccccctgtgccaacacacaccttcgcggtccatcatgggctgcggtcccaggtcaaaggccttgaagctggccacggtgtccctggtctccccccccgcgctgccgtcctcggagcgcgaggtcgaggtcccgtcgctgccccccttggcaccctcctccgcggcctctgcatcgtcgctcgcctcacccaggggctggatgtcaccaaagagctggaaggggcgcggcggcgagggcgggcggctgggcggggccggcgactccacgtcgccaaacagcttgaagccgccggcagccttgccgggcacctccgcgtccgccgacacgctgctgacctctgcggcgaggcggtgtgagggaggaggggtgggtcgcgccaggtccagacagctacctgagcccacaggctccctgctcttggctgccaggcaggcctagcgacctccatcctcatcccttgcaatcatggacaagccgggtgccttgaccttggaccagacgcggcagcgtgctgcnnnnnnnnnngggcaggggtgggtcgcgccaggtgcagacagctgcctgagcccacaggctccctgctcttggctgccgggcaggcctagcgacctccatcctgatcccttgtattcatggacaagccgggtgcctcgaccttggaccagacgcggcagcgtgctgcttcacagtactacgtgaccgcacagcctcctcgatccaaagacagtcagggacatgggactgccctcatgcccaagccagtcgcagccccagcccaaagtccagaaccctccacccccccaaccccccacacacacacctgggaagaggctgaagcctcnnnnnnnnnnacccaaagtccagaaccttccacccacccaacccccccacacacacctgggaagaggctgaagcctccggcagcgggggcctgcccgacgcccgggcccatgctcttgctggagcgcagcacgccgctccgcggcgccagctccactcccgtgccgacagaggtgcgctgctgtgccagcgggcgcggcaccaccttcctgatgnnnnnnnnnnccccgtgctgacggaggtgcgctgctgggccagcgggcgcggcaccaccttcctgatggaccgcccgcccggcccggacaggcctgccagctcggtctcgctgatgcccgggggcagcacgccggcgatgaaggagttctggcgcgaggcggcgaggggcaggggcgagggcgctcggtgggggctggggtcgaaggacatgcggaagttggtgaaggagcggccgcgcccgcggttggccagcgccgccgccgcgtcctcccccgcctcgaacaccgagggctggggggagcccaggccctgcacgctgcgcatgcccagggagatggagtgcggcagcccgctgcgctggctgttggtggtaacgtacgactcatcctcggagggcgcgccgaagccgttgccgccaaaggaagagccctgcagcgccttgcgccggatgtacaggttgctgtggcgcctgtttgtgggtgtgggggggggcgcgagggaaggtgggaatgtgatacaaggtgaggagagacagctctcaaaagtgcactgtgagggcctggggcatcgcgccaggcatggttgcctaaaggttcctcgcctggtctcccgacgcccctccccgcctccctccagcacccggggttccttgggccccacccacacccaactcacatgcgcgaggacccccccgcgtcttcgtcgggcgggcgcagccggcgcatgatcatgtcccacagccagaagggggcgtggatggcaatgtagctggacagccccgcgatcacaccgtctgcggcggcagcgggggcagtttgtggggtgggcatcggtgcggtgacgtgtgtgaacacgctacacgcatgcggggaagtagttcctggccggcgacggatgtcattgagcaccgcatcgctccgagcacgcggcaccttgcagtcgagcggccacgnnnnnnnnnngcacgcacgcggggaagcagtccctggccagcgacggatgtcatcgagcaccgcatcgctccaaccacgcggcaccttgcagtcgagcggccacgcaaccctctgcctccccacgcttcattccccactcgacctcctccctggacttgtggcccacatggcactaccttcaatcctcacccctcccccctccctcgacccggcacatacccctcaacccacacccccaccaggaccgcaacccaggccccacnnnnnnnnnntccctctgcctccccacgcttcattccccacacgatctcctccctggacttgtggcccacatggcactaccttcaatcctcacccctcacccctccctcgacccggcggatgccactcgacccacccccccaccaggaccgcaacccaggccccactccgcccttccgcctcacatgccacggagtaggtcatgggcatgaggatgatggtgaggagggcggggatggcctccccgatgttgtcccactcgatgcggttgacgtggccgatgaggatggcgccgaccaggacgagggcggcgcctgtggcgtagggcgggatgctggccaggacgggggagaagaagagggcgatgaagaagtacatggagacggtgatggcggtgagccccgtgcgcccgccgtcctcgatccccgccgccgactcgatgaagacggtgagcggggtggtgcccatcatgctgccgatgaggatgccgatgccgtcggccaggaacgcccacatctggcccgggaactcccccgcgtcgtccaggaagccggggagcacggagtccaggacgtgggccatggagagcagggtgcccgtgcagtccagcaggtcgatgtagagcagggtgatgagcacgacccagagctcgctggtgtcaaacgcgtcccagctccaggccaggcccgtggcgtccagggtgggcgcggccacgatcttgcggaacacctggaggcgggcctcgcccccggggatggcggaggtggagcccaggtaggtcgcggcgtgccccgggatccaggagatgacggtgacaaaggcgatgccgatgatgagcgcgcccttgacgccgacatagaggcagagggcggagatgaagccgccggcgatgcccagccacatggtggcggaccgcatctggccgccggagcagccgaagacgtcggcggtggccagcacgatggccgtggcgttggcccccgtggcgggggtcagcggcgcgtcgaagctgtacacataggtctgggagtggtcggtgcagccgcccagctggaccagggtggaggagtcgaacaccaccacgtccaggttgcgcaggccggtgaaggccagcagcaggccgatgccgacggaggaggccagggccacggtcttgggcatgaacttgatgatgccgccgcgcacgccggtgatggacagcaggatgaagatccaggactccacaaagatggtggccatggtctgctggtaggtcagctcgccgcggccgtacacaccaatcacctggtaggccacgtacgcgttcacgcccaggccgggggccagggccaggggcaggttggcaagcgcgccgatcacaaaggtggagatgagggaggaggcggcggtggcggtgatcaggttgcgctgcaggttggccaagcaatccaccgccagcgggtcggtgacgttggacaggcatgccgcgcccatcagctcgctgttggcctggttgcagttctccgcaggggagcaagtgccgcccgtggcctgcaggatgttggggttcaccgccaggatgtacgccacctggaggagcagagggtagcatgaggggagtgggtggggccaaggggagttttttggggggggggggcggtatgcatggggagctggtcgggacaggtggcaatgctttgggattgtnnnnnnnnnngtagcatgaggggagtgggtgaggccaaggggagtttcttttttggggggggggcggtatgcatggggagctgatcgggacaggtggcaatgctttgggattgtggggtaagtctgggacaggggcatgggcgccaagtggaaatccaccccggtgactttgtggaggcattcaatacgctggaggcagaagagggcgacagagcctgcccgcgctggatccagggtgtgggatccattgtgacacggacaagcaccccgcctggtcgcaaatctggcgcccaggatctccattcatccccaatcacaagctcctcccaggaaatggttgcaacagcctgcagcgccctcgaatcccctacccaccatgaggaaggtgatggtcccggcccggagctccaccgtaaactttgcattgcgctccctgaagcgaaagtaccgcccaatctgcacgaggaagcaatcagccctgggtcaggctacaaagtattcaggacatttcatgtatggttgggcaccatcaacatatcccctacctctgccaggcttgatgccccgccacaccgccgggtctgccctgtgcagaacacccattttccccacactccccatgtcgtcgggcacccaccctattgccgtccgcccagttgttcaggcgcatgnnnnnnnnnncccccacactccttatgtcgtcgggcacccaccctgttgccgtccgcccagttgttcaggcgcatggacatcttgtccagtcgcttgttcacgctgtccaggccgtcccccatcttggagacggcagtctcggtggacgtggcgatgcccttggccgaggcattgatggaccgccgtgtgccgttccatgcttccactaccactccggaaagtttttggagaccggccatggcgatcggccgcagggtgcagccagatgccgcggatcgggactcgagctagcgtgcctcacggcccagggccagcgagtgcccacccagaccctcggcgccttgcatgtcactccgtgccaaaggtgaccaggacccgaaacaggtcctcctgctgacctgcacctcctacgcgagcgttcgcaggcctgcaaatgtgccggcagcttccgcactcgacccgcggcacagcccttgggcgaggcgattctcagcaagtcgcaggactccgctcagtgaccgcgggcatgcgcgtggatggggagaaggatggcgatttccaaacgccacacgcccatgtggctcctcgcgcggaaccctctctgcaggggggggaggtctcgccccctcgactccccctagcgcgctgcgcattccaagatgccgcctgtacactgcggatcccctggggatgccattgcagatatcttgctgtgcacagctccacacctcacaccatccgatttgcaggcgggaatacatacgcacagaggaagggcatgcctagtccctgctcccccccaggtgccggcccccatggcccctgggaacctcaggccggggccgccgcccccgtcctgcccacgcgcgccgaggtctggggtgccgaggcgcccaccgcccccgggtcgatgtaccgcccgttcacccggtcgtactccagcaccgcctctcccagcgtccctgccaccttgttcctcactttcctgaccaggatctgcacctcggcagcgttctccgcccccggctcccggttccggtgcaccacgatgccgttgtcagccttattgatgaagtgcgcggagccggagatgtcgtacaggttgggggcctcccctcgccactgctgcagctggcgggggtgggccacgaaccagacgtgcacgcccgacacctggccaggtttgggaagaggacacgggggggggagtgtttgtgcccatgggtaaggggaggagcacggagcatgcaagggggcgtggagaaagcaagcctgtccaggggaaggcaaggtgggcaggcaccgctgctgatgggccgtgcgcgctggggtgactggacacaggcacatggcctccaccaacaccgaacaggcacctctttcctccacacacctgcgcgaatctcttgatcttggtcagcatctggctgacgtactccgtctcgctcatgtttccggggcgctggtggtcgagctcattgtacgggtcgattaccaggccgcggatgccgtacctggcagggggggtggcgcagaggggggggggcttcctggcagcactcgctccgccgcatcacagtgggacctgggctccagtgcgcggatgccgaccaggcagcctcaacctgagctcgccaagcgcggtccagtgcgtcactcctgccccacccctctggcccacctgtacacggcggccttggccacatccagcacccagtccacgctggggagggcgtcgtcctcgtacctgtgaggccattgtggatcagtgcttggcaaggagggacatggagtgctcacacctgtggagccgaggccaagctcgaccaggcgcaagcagcagcaggttctggaggtacaccaggcatcccaagtttgcagcttgcctcccgaccgtgggacgcccgcctcgtgagcaggggtgcagggcatagcatccctctcccccttctcagccccagtcccctcccctgtcgggcacannnnnnnnnnatacctgtgaggcgattgtggatcagtgattggcatggagggacatggagtgctcacacctgtggagccaaggccaagctcgaccaggcgcacgcagcagcaggttctggtggtacaccaggcaccccaagtttgcagctttgctcccgaccatgggacgcccgcctcgtgaccaggggtgcagggcgtagcatccctgtctcccttcccagccccagtcccctcccctgtcgggcacaggcgcgcaccgcacgaggtggaagcgatcgtccacccagtccagcccctcgttcagctcctccagggacatgcgcgtcgagttgcgggcgtagggcaggtcaaagaaggggcggccagtgtacttctccaccagctgccgcgcatggtccatggcctgcgtggagcgcggtgcggggtgagcgggtgagaccgagggttcgaggccaaagagatggtgagagcgggatgctggacacctgggcatggccctctgcgcacttcaccacaagattcgcctgcctgacttcgggcgttggccccccccccccaggcatgcctgtccagagtgcccccctcagccaccttccctcccccactgctaccccccaccacccgcccacctttttctccatggagcacatggcannnnnnnnnntcctcccccactgccaacccccacccacccaccaacacccacccacctttttctccatggagcacatggcaaaggtccagccatgcacaaaggccaggttgcagagcagggcgtctatccactctgacttcccagagttgggcacccccgtgacgatggtcagctcccccgggatgacctgtgcatgtggggggggaaggagggcttgctgaagatgctggagtctgcagagagggcttcagaggcgcagaccaggctcaggacacagatccaccccgattcgccatcacaggacagcgcgccgcccactttgtaaaaggcgtccagggcgggccagcccgtggacgccgcctgtcccgtgcgcgggtccaggtagtagtgccgcaggatgtcgtcgtagtactcgtggaagcgcagcaggccgcggatgggcagcggctccgcgccctccaccatggcgcgcagcatggcggcgccgtcgcgcatcagcacctcgttggcgtccttgcggtaccaggcgccgcccggcgcggcgtcgccgtccgccgcgctcccctccccgggcccctcgtccggtgccgcgggcagggcgtccagccccgcgccgcgcgccgccagctcgtggtcctcgcgcgccac

SEQ ID NO: 46872 - DNA, 66 bp, Chlorella protothecoides
tccagagggggctgaacagcccagtgcaggcagcagcctgccatcgcgggggcgacgctgccttgt

SEQ ID NO: 46873 - DNA, 18769 bp, Chlorella protothecoides
  modified_base (365)..(374): a, c, t, g, unknown or other
  modified_base (586)..(667): a, c, t, g, unknown or other
  modified_base (729)..(738): a, c, t, g, unknown or other
  modified_base (800)..(809): a, c, t, g, unknown or other
  modified_base (991)..(1002): a, c, t, g, unknown or other
  modified_base (1763)..(1772): a, c, t, g, unknown or other
  modified_base (2513)..(2522): a, c, t, g, unknown or other
  modified_base (3133)..(3142): a, c, t, g, unknown or other
  modified_base (3229)..(3238): a, c, t, g, unknown or other
  modified_base (3654)..(3663): a, c, t, g, unknown or other
  modified_base (4406)..(4608): a, c, t, g, unknown or other
  modified_base (4951)..(4960): a, c, t, g, unknown or other
  modified_base (5342)..(5351): a, c, t, g, unknown or other
  modified_base (5632)..(5641): a, c, t, g, unknown or other
  modified_base (7308)..(7317): a, c, t, g, unknown or other
  modified_base (7609)..(7618): a, c, t, g, unknown or other
  modified_base (7840)..(7849): a, c, t, g, unknown or other
  modified_base (8573)..(8640): a, c, t, g, unknown or other
  modified_base (8964)..(8973): a, c, t, g, unknown or other
  modified_base (9441)..(9450): a, c, t, g, unknown or other
  modified_base (9638)..(9647): a, c, t, g, unknown or other
  modified_base (10119)..(10128): a, c, t, g, unknown or other
  modified_base (11145)..(11154): a, c, t, g, unknown or other
  modified_base (11953)..(12093): a, c, t, g, unknown or other
  modified_base (12315)..(12324): a, c, t, g, unknown or other
  modified_base (12724)..(12733): a, c, t, g, unknown or other
  modified_base (12965)..(12974): a, c, t, g, unknown or other
  modified_base (13224)..(13233): a, c, t, g, unknown or other
  modified_base (13573)..(13582): a, c, t, g, unknown or other
  modified_base (14932)..(14941): a, c, t, g, unknown or other
  modified_base (15215)..(15224): a, c, t, g, unknown or other
  modified_base (15282)..(15291): a, c, t, g, unknown or other
  modified_base (15507)..(15533): a, c, t, g, unknown or other
  modified_base (16362)..(16371): a, c, t, g, unknown or other
  modified_base (17369)..(17378): a, c, t, g, unknown or other
  modified_base (17782)..(17791): a, c, t, g, unknown or other
  modified_base (18314)..(18323): a, c, t, g, unknown or other
gtcgcgcggggcacggtcgtagccgccgccgtagctgcgcggggcgcggtcgtagccgccacggccgccggagcgctcgcggtcgtagcctccctcgcgcggggcgcggtcgtagccgccggagcgctcgcgccggggctcaccggagtcgcggaccgcgtcggggcgatcctcgcgcacgaagagcgcgcggccgcggaagtcggagttggcgaactggtcgatggcggcgcgggcatcgtcgggcgtctcaaactccaccacgccccagccctggcagtggggggagagggtggagggggggggactagtgtcggacggggaagggcacgggtcatggcgacgaagggagtccaggcatgggnnnnnnnnnnagtggacggggaggggggggctggtgtcggacggggaagggcacggatcatggcgacgaagggagtccaggcatgggaacggtgggcgaggcagtctgcggctcacagcatcaaagcgccgcctgtggcaccattgaccggtccaaagatctcatcacccctgccaggcccaaagaacaatgcccgaccccgctgaactcaccttgttgggnnnnnnnnnnnnnnnnnnnnnnnnnnnnnnnnnnnnnnnnnnnnnnnnnnnnnnnnnnnnnnnnnnnnnnnnnnnnnnnnnncttggtctcgaaggggaggttgtgcacaaacaccctgcgggtggcgaatccctcatccccgnnnnnnnnnntttggtctcgaaggggaggttgtgcacaaataccctgcgggtggcgaatccctcatccccgnnnnnnnnnntgcggtctgcgattcacagcatccaggcgccgcctgtggcaccattgacaggtccgaagatgtcatcacccctgccaggcccaagaacaacgcccgaccccgctgaactcaccttgttggggcgcacggaggcgaaggcgacggggcccgccgcgctgaagtggtccttcaggtccgaccannnnnnnnnnnnggcgcggggcctggctccccagctgagctggcctggctctccacgcgaggctcgggagtggcctccgcggagtaggcagccgtctgcatcctccagcggctgcgtggcaggaggggaggtggtggtggggtttccgtccgggccacgggaacgctcctgccccaaatctccgccatgcaaacagccatgctcccatgtgacacgcatcagcgcacctaggtgccaccagggtcgggcggatcgccattaccgggcgcagctgtgtgagggcggcccggtacatcggggccaggagacggacagccatggtgggtggaagaccggtacgaggcgctccacaatactgcatgctactgaactaacaaggagaatgcggcaagcgtgtaatcaggctcggaggcgggcaccgcggtggtcgcgtgttacggagtcctgaataatgaggcatgcaggaacagtggattgcaccctcccgccaccctcatctgtcccgacatcagaaccgatctgggcgctccctggcagccgatctggaccgcgtgggtcacccccacgccatgccccgtccaggcatgaccttttcgcaccgtcatgcgggcgttcacgctgtctaccacgcccccggggcgagtgcggggaaggggtgtgggaaggcccgtgccggaactcccctcacgtgatcgtgcccatagaagcgacgccccggcgcacgcgatagccaagcccctgaaatgcccgagaatgcatgtactggtgtgcgnnnnnnnnnnttcacgtgatcgtgcccatagaagcgacaccccggggcacgcgatagccaagcccctgcaatgcccgagaatgcatgtactggtgtgcgttgggcagggcgacaccgggccggctgcccctggggccaccctgtaccctgcaggcaagcgacaggccaggctggctctgcctgccctgctcgtcgccttggactcaggctccgtggacaccgacaccatagaggcagccctggcacagggcgccaccggcattgtgctggtggaggacacccatggccccgcagccctgtatgaggcggccgtcgccgcgctgtctgcggtgcgagggcgctgccccgtgctgatcagggaccgcgtcgacgtggcctccgccacggaggccgatggcgtgctgctgatgcgcggggcgctgcccgtgctggtggccaagcgcatgctgggaggcggcggcgcgctggtgggcgccgcggtgggcagccgccaggaggcctccagggctgcggccgacggcgcctccttcatcgtcgtccaggttcgtgcttgattgttataggggagggttttaaaagaccaggaatgaagcgggaatccattcgctgtgtctgagactgggcagcacagtgttgcctgggagcaaggagaggggatctccagggatatccgagtatggcactgcgcccacctgccgcccactccgttcctccacacatgccaggaggacgctgcgtcctccagcggcgnnnnnnnnnncgcctgggagcaaggagaggggatctccatggatatccgagcatggcactgtgcccacctgccgcccaccccattcctccacacacgccaggaggacgctgcgtcctccagcggcggcagcgcgtcggccgccgagctgatgggctcgtaccgcgaggcccagcgcagctccaccagcattccacttttacgcagcctggagggccttcgagccgagggccccgccctcgacagtcacctggcatcagcagacggcgccgtgcttgcgcaggggtcgcacgccctggtaccgtctgttgccgccgcgctcggccgggcggggggtggaggctcggcctcggcggctgtgcggcaagctggggccccttccaagcagacgcctggaggaaaaggcagtgacgacgagctggtggagagggagagggagctcctgcagcaggtgagtccagggtgcagcggggaagtgtcaggctctgagggaaccacctcattcctacgggctgcttgggtcaagaatttcatcaagtttttcccctttgcattggcagcaggctgcaggcaagccggccccatgcaattcttgatttacttcccggatcattctcctcccnnnnnnnnnngaggcagtgacgacgagctggtggagcgggagagggagctcctgcagcgagtgaggccagggtgcagcggggaagtgtcaggctctnnnnnnnnnngtgggtcaggccaccccttcgctggagggccaggacctggtgagggacgcgctgagtcagctggacgaccccttcctcgtcgtggtggtgggcgagttcaacagcggcaagtcggcggtgatcaacgccctgctgggcgagcgggtgctggcagagggggtgctgcccaccacaaacgagatcagcctgctgaggtggcgcgagccaggcagtcagcagcccgaggtccagcaggtgagtgggcctgcttttcttctggagaggggcattctggggctgggaaatggagatgggaatgaagggcacggcatggggcggattatgctatcagaaatgcgcgcatataaagcctgtactgttcctttgcgaggcggagtgagtaaaccgggccatgcttccctggaggtatttgtgcnnnnnnnnnncgagtgggcctgcttttgttctggagaggggcattctgggactgggagatggagatgggaatgaagggcacggcatggggcagattatgctatcagaaatgcgcgcatgtaatgtctgtactggtcctttgcgaggcggagtgagtgaagcgggccatgcttccctggaggtatttgtgctcgagacccctcagtgacactgatacgcccacccaccgtcctccaacccctcccacaccaccctcccacttccttaccccacccctgcctcaaacgcaccaggaggcggacggtattttcacacgctacctgggcctggacctgctgcggcggctgagcatcgtggacacgccggggacaaacgtcatcctggagcggcagcagcggctgacagaggagtacgtcccccgcgccgacctggtgctcttcgtcatgtccgcggaccgccccttcacggacagcgaggtgcgcttcctgcgctacatccggcgctggggtaagaaggtcgtcttcctggtgaacaaggtggacgtgctgggggccgagggtgaggtggaggaggtgcgcgccttcgtcgccgcctccgcggagcgcgtcctgggcctgcccgcggcgggggtgctgccgctgtcggcgcgcctggcccagcgcgaccccgccggcgagggcgggcgcctggggccgctgcgcggcctcatcgagggcctgctggcgcggggcggggagagcggccggctcaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggtcgggcgccagctggagggcttccgcgccgccatggagcgcgagggcgccgtgcagcgggcggccgtcgccgacgcggcgcgggagggcctggcggccgcggccgccgtactggacgaccagctgcagctggggaacctgccgggcctgctgcgcgacgcgatggcccagtcgcagcaggggggggagcgcgagggcgccggggtcgcgccgggggttgcggcggccctgcgctacggtccagcaggtttgattgttgtttttggggggtggggaaggattccctgatatacgccggagaatgggggagacatgtggtgggacgggatccggcctgtannnnnnnnnntggggaaggatcccctgatatatgccggagaatggggaggacatgtggtgggacgggatccggcctgtactcctagctatggtgatgtagcatccctaccatctggaaattcagtggcgtgaccgctgccagatgtccaagcccccgtgaggggccacaccaagagcgacctcttcgaggtcgctgatctctgatatccaacccttcaactccctcacttccagggagcgtcgcggagaagctgcgtggcctggtgtcggagcacgccgcctggctgcgcgttaactgcggccgccaggcggagaactacgccgcctttgccagggactgggaggggggtcggcgtgcccgcgatccccgtgccggccgagaggagcctgcnnnnnnnnnntagggactgggaggagggccggcgtgcccacgatccccgtgccggccgagaggagcctgctgcaaccgtggagctggacgccgagcagcgcaggtgcaaagacatgttagttctggatgggactgattcgatccgtggccgcgattgggagcatggctgaggtgctgctgccgtggtcggtctgccaggacacccatgcgccattgaaaaaccctgattctaaggcaagctattcatccactccactcaccccgatagattgtggcggcagcagcagagcnnnnnnnnnntccctgattctaaggcaagctgttcatccactccaccccacccgatagattgtggcggcagcagcagagccaggcgatggaggctgcggatgatcagccccacgcgatcgataccccgtcgtccgccctcaccaccagcacgcccagcgccgcgctggcgagcatcgagcggttggaggccagggccacggaggccctgctggtgcaggaggtgcggcaggcggtggtgggcaccgcagggacggcggcgggcgcgggcgtggcggggttcttcgccaccaccatcctgcccaccacactggaggacctactggcgctggcgctggcctccgcggtgggctacgtgtcggtggtgaacctgccgctgcgccgcgcggaggccaagcggcgactggaggagctgacgctgggcatcctcgaggcacgttgtgttgttgtcgccatgctttgggagggtggattatcgttctctgttggcctcgggaggtggcgtaaaaaggaagggtggcatctggatgataccgcgcattgcaggtttgcatggagaagttgtgtatgccacaggatacccacatcccagcaacagagcattggcccttaacggcacgcatccacaccatgatgtctgtgacgggattgcccctccccagctccagcagccagccttgcctgatctcaacccctccgtgcagatcgtccaaacagacatggaggcggacctggctcagcaggtggaggcctgctgcgcaggagtgcgcgaagccatcgcacccctcgaggcggctgccgccctggaggaggagagcgtggcagagttccagcgagagtgcgggcggctgggggaggccgtcgaggaggtgctggcgcgcgttgccaggctgcacattgcggctgactgacgcctgggactgaacaggaaactctggactcgaatgtctcaagatatcctcagagagtctgggcacaaatggcttgcccacctagccggccccggggcgtcgtggtcgacctggggcctgccctgtcagcaccagaagtgctcccacaactgctgtttgcatttcattgtccccatggcatcacacgctctccccctccatcactctctcgtctccttttgtccacttgcaccgcgctaaacaagtggatgtggcgacacaagccaatagcaagcgtgtggcagacaaacggatcataaaacatgcaactcgtcgtggtttgcaggccgtggcagctgcaggtcagggtggcatggcgaccaggagcatttgagtcccagagtcggcgccagccgctgctcagctcacttggactcaatctcgcccgcgatcttgctcttcaggctctcgatgtcatccagcagctcctcccggctggacttgaacagcaggtaccggtaggtgaaccagccggtgtagcccaaacccaccagctccagcaggcgggggacctgcggtgaaacaggtgggctcacatcaatcgacccagcaaatgcatcactacacccaaacacgacgcgcaaggcaccccattcacaatacaacccctcaatgcagacgagccgatgctcaccaggggaacggagtttaaggctccgacaattgtagaggaaagccagagcaggaccagggcgccgacgccatacacgaccacgctcgtcttgttgnnnnnnnnnntacatcaatcgacccagcaaatgtatcactacactcaaacacgacgcgcaaggcaccccattcacgatacaaccactcaatgcagacgaaccgatgctcaccaggggaacggagtttaaggctccgacaatggtggacgaaagccagagcaggaccagggcgccaacgccatacacgaccacgctcgtcttgttgtctaccttgtcccactgcagacacaggagagggcgatgtcggtgggcgatggatggtgggggaagaggctggcatgcaccgggactggcttccctgnnnnnnnnnnagcacaggagagggcgatgtcggtgggtgatggatggtgggagaaggggctggcatgcaccgggactggcttccctgcagctcacccctggcttccctggcacagtggctttcaaactgggctaatttcatgcaccacagcatccccatcgcctccaacccaccttggcctgcagatccttgacatacttatccacatccacattggcgtcgttggccgtgnnnnnnnnnngatgcaccacagcattcccatcccctccaacccaccttagcctgcaggtccttgacatacttgtccacatccacattggcgtcgttggccgtggggcggatgttcttctgcgccctcacaagggcggggcgggaggtgggccggggggcctgtggaaaggaggggggtccaggcgacgtgtcagcatgggaacaccatgcagggacgccgagatcacatcagggatcatgctgaaagcctgtgccctgtcccacgcacccatgaggtgggggcgaggggcctgccagccagagaaccgggccggctggcggttccccgcaaacccacggaaaccctgttcaggggtcccgaaatcactgcctgagccatcatgatgatctgtcgacttattttctgagagatcggcgatgcgggaaagagaaatggtactcgctatgctgcacacactcagggtaaagggctgattacccaggacctcccaggcgtggacatgaaagttacaacatcctgctttctttttatgaaccttgcgctgaagttcccttgatttccccccccaaacaggcctgggccctgaagcggatcccgctgtgtgctcttacttggcattgttactaagtactgcggtctaaattggcgtttatgtatgccggggtcggggcataggtcggagatggcggaggcgagccccgacagtggacacgccgagtccgcccccatcctnnnnnnnnnnnnnnnnnnnnnnnnnnnnnnnnnnnnnnnnnnnnnnnnnnnnnnnnnnnnnnnnnnnntggaacacgggcctttttgactgttgggaggactgccatctaacggccgagggcctgtgctgtccgcagtgcttgcatgcggacaatgctacgcggatcgaccgctttgcgacatgctgcccctaccagtgcagctacatgtgcctctccgccctcctcctctgctcatgtacgtcggtatggggtagcaattgggctgacctgcgagcggggaagcctgacgcgccgttcgcatgattcatccccatggtgcgtgacacctgtcttggtctggccctggcaccccatttttactcctctccccctcgcacccgcagtggtggnnnnnnnnnnctgattcatccccattgcgtgcgtgacacctgtcttggtctggccctgacacccccttcctcctcctctccccctcgcacccgcagtggtgggagggcaccaccggaaggagcttcgacacaccttttccctgccggagtctccgtgcagcgatcacatggtgcactgcttctgctcctgctgtgccctgtgccaggaggcccgtgagatcaaggtgcgcctctcggtcctggagccaaggggggttgggcagtagggcggcgcggcatgtttgcaacagaagcgtacctggctacgcattgttcccactctgcctgcctctgcaaatcatcgtttgcatgctgtccgttcaatgccaccctggcccgaccccccccagccaccccccaccctaccctgcctacccctcccagcgccgctccaacatcaagcccgcaccgcggctggcggcgggcctggcgcgcaccnnnnnnnnnnagcctctcggttttggagccaaggggggtggggcagtagggcggcgcggcatgtttgcaacggaagcgcacctggctacgcatttattcccactctgtctgcctctgcgaatcatcgtctgtatgctgtccgttcaatgccaccccggcccggacccccccattccccccccacacccccctgcctannnnnnnnnncagccgccagaggtgcagcacatggcgcgcacctactcccacggcctgtcgctggaggagtgggagtgggacgcggcgggcggcaaggtcggcctggaccccagcacgcgcaggtccagcaaggccaccagcgtcgtggccccaaaggccaaggccatccgccgcagcgccatggtcacgcggccctcgcaggccggcagcgcgcgctccgcctcggcggacagcagcgggggaggcctggggtccagcggcgggggcctctctggcgccgacggggtggccgccgacgcagccacgcccaatcccctgctggcgccgccggccgatgcggccacggccaacccgctgctcgcccggcgcgaggaggggcccggcccggccgccccgctggcaagtgtgaaggagggcgtgggcgaggagggggacgaccccgccgccctagaggcgcacgccggcagcctcagcttcgtgnnnnnnnnnngagcgtggaggagggcgcgggcgaggagggggacgaccccgccgccctggaggcgcacgccggcagcctcagcttcgtgctgacgcaggccgcggtggctgccgcgcagcgcatccaggaaaaggaccgccaggagcacgccgccatggagcggcggctggagagggcgcgcagctcgcgccgggagcgcatggagtgaagggaggggaatggggtggcatggcgccgcggggcgacggcgacgccctggggtttcaggcgcgtcgccgcgccgcgcctgcccctggccctcgaggcctccagcccatccccgtgctcacccctggtgccgctcatatctggggacgctctctcgccagctgcaacccccctgtcatccccctccaccctgtatcttgtcatccgcagtgcgccctgatcaatcccgacccgcatgctggcgctcttcctcccctcccctgacccccgcgtgcccatgtatacttggatgtattcacagcggagggtcacgaggcccgtgctcgtcgcgagcgggcgcctgtcatttccgtgctcgaacagctcagcgacctagagctcgtcggcggccggtcgggcgtcgccttcccccgcgccaccctcctcctcctcgtcctcccccagcccctccagctgctgcgtcagctcctccctgctgtacatcttgccgcgcaggccctggtcgctcatctcgcccatcacccgatccaggtcctgcccgtcagcggccttgcgctcccaggcggggtagggcgaccagccggcggggagagggggtggcggggccgcacaggcatgggactgcgccacgcacagctttgtggtgaaggcctggcgattggtcccggcctgcgtggggggaggggcaaggtgcgggcgttggggtcctgatgtgggggaacgagagggggagcttgggctagggatgggccgcacgcctgcacaccggcattccggggggggacagagggtagcttgccctgggggagccacccttgnnnnnnnnnngcatgcgcgggactgcgccacacacagctttgtggtgaaggcctggcgattgatcccggcctgcgtggggggaggggcaaggtacgggcgtcggggtcctgatgtgggggaacgagagggggagcttgggccagggacgggctgcacgcctgcacaccggcgttcggggggggacagggggtagcttgccctgggggagccacccttgctgcctcgctccagctgcctcgcagtggtgcaggggtgcttcgccgccatctccatgtcagaaccccaaaggctcagccacggtgcactgtaccttggaggcatggaatcaaggcccgcccagagcgcatgcctgcctgccaatcgaccccaacagccctccgaaaccccagccctctcaccgtgtagagggcctctgcgatgtcggtgtcatgcgaggcaaggatatcgtcggcggccgcctccagggtcttgcatgccacaccacacacgcccagctgcaggttagcggggaggttgagggtgattgtgggtgtggttgcatgaagtgaatcatacctgggctggtgttgcaatggcggtgtgttgcagggtttgcttgacgcaggcgaccccgccaggctcgccgaccatgccgacacaagcaactcacctcgcccttgtccatgacgaccagcttgtccccctgcttcacgatgtccagctgggacagccactccccctcagacctccaggcggtgcccagcttctcgatgtgctccagcagtgtcagctcgtcgacctgtgctggtccagggaggggtgtggcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccttcttggagaccgtggaggtcttcagcaaggcgcgaccggacctccatgcatgcttggccaggtgctcgcataaggcgcactgaatgtacttgatgtccccccgtcggggagtcgctttagggggaccttctgcaaatgcgatctgtgcaacaacgaggaggagcagcaggctgcttgccaccctattgctcagtgtcttcatgtcgaccagaccagnnnnnnnnnnggaggaggagcagcaggctgcttgccaccctgatgctcagtgtcttcatgtcgaccagaccagcttccttgatcacgcaggtcgggatggttgtgtcgcctgctctcgagcgatctgactgaaggatgataataccaattgtgcactccaaatccccaatggccgatgcaggcatctatgggactgatcggatgatagcattgccttccagaacccaatcacacctgtctcgcatgcgtgcgtgtcagagctcgtcacgcacagcagcacgccccgtgggccaaggtctcacttcgtcgccctgggttctgctccatgtaatcaatggctccctctgaagcttccaatctagttacagtatgtacagagggggatcatgtatcatcatggcagcgagtgnnnnnnnnnngccaaggtctcacctcgtcgccctgggttctgctccatgtaatgaatgcctccctctgaagcttccaatctagttaccgtatgtacacatggggatcatgtatcatcatggcagcgagtgcccaacgactttgacaatcgcggctgcggactggtcaccaggagcacaatgcatgccgatctcgcgcctcgagccagccatgcatccccctgcggcagcaccaccaccgccnnnnnnnnnnctcgcggctgcggactggtcgccaggagcacgatgcatgccgatctcgcgcctcgggccagccacgcatccccctgcggcagcaccaccaccgccgcagcagcagctgcccgcagccagggggtatgcaggcagcgatccacctgctgtgccaagggtgacgccccggcgggcgcagcaacctcggctctgcctccggggctgccctccctcgccctgacaccatcctcgagccgctgcagcctgcgctnnnnnnnnnngctcggccctgcccgcggggctgccctccctcgccctggcaccatcctcgagccgctgcagcctgcgctccaacgcggcctggctccgcgtcacacctccgcacaggatgcttgtgtacttgagcaggaggttcttctccaggctccactgctcctgggcgggggaaggctggtgccctactggtgggcccatcccgggcccccgccggaagagcaggtgctcacacaggctgcggtgagggagggtggaggatgcgcatgcgtcagtgtttgcctggtaggaggggggggattgcgggggtgcggggctagagagcccagcctgtggaccccttgaccnnnnnnnnnnaagaatgcgcaggcgtcagtgtttgcctggtaggacgggggggatagcgggggtgcggggttagagagcccagcctgtggaccccttgaccctgtgatcccttctgaacttggacccctcgacacacaaacacacatgccaggggcgagtctgcccgtcccgcccctttgaaacgcaccaccccacacccctacctgagcgcaaaggtgtcgccgaggccggccgtgcccgcgagatcgacgacctgggtccaattgagggcagcctgctgaccggacccctggccgctggtggccaccagccccgacagcttctcgatcacgtggcgatctgcatcaacatgcacgccctttcccggctcgccggcccagcacccgatgcactgagccagcagggcggccgcctggggtacgtcagacttggagcagagcgcctcctggagcagggaaaagtatacgtgggctgccctgtccctcagcctgcgcggaggggtgggagtgaggggggggtcactgggtggctgtgcagtgccgcccaaggctccatccagcgggcacgagtcattgcgcgggttcgccgtgatgaaggcttggccagcaggatgagttggtctcccactgatcagcagcgcgctcatgaccaggaactgtgctgtgcttccccatgtcccctcacggctcgtccccatctttgtcaacctacccagacagaaagagcccccgtgcaaaggccaccagggccagctcgtcataggcgttgcccgggtgggcagccacgtactccagcgtctccgtggggaggccggggatggccagcttggtgcccgccgccagctcgacacccctgcgcaggtgttcgatgggcctgtgcgcccctggctctcgcgggggtggctcgctggcagcctcgatgcaggcccgtgccgatgcctccctgtactccatggcccgggactggaggatgtagatgggggtgagggacttgttgggcagctccgccccggtcaggggatccgtgctccggtgcgcgaggtgccgctcgatggccgatctctcgtagacatggccgccagccgtgagcacggggttcacaaaggtgtcgtgtgtgatcgggcagcgcagctcctcgggcgtctcgaagagcagggtgtcgtcgcgctggcgggcagcggtggtggggggtggcaggggaggcttcccccctcctcgagactgacgggccaccatcgccatcttctagcttctgacttcgaggatcaagtcgacagcgagatccccgtcatgacagccagcagatcaagaagtgcagggaatgcccgggggcaagcacactatgttgccactggatatnnnnnnnnnntttcgaggatcaagtcgacagtgagagcctcgtcatgacaaccagcagatcaagaagtgcagggaacgcccgagggcaagcacactatgttgccactggatatggccagtttgaatactgatcagtcctgacgagcgttgagatcacggccttgaaccgctgccaatgccattttctgtgagaataagttcaataagcatcatcgcagggcactcacacatcgctgaaaaagatctcgaggacgagagggcgttgtcgcgccctgcagaatgannnnnnnnnntattgaactcgtgaaattcctagcactatgttgcgccaattgtggtcccttccccgannnnnnnnnncgacgagcgttgagatcaaggccttgaaccgctgccaatgccattccctgtgagtataagttcaataagcctcctcgcaggtcactcacacatcgctgaaaagatctcgaggaagagagggcgttgtcgcgccctgcagaatgagctcgagttggcgagcgaccacgtctttctgaagcaatgctgttccgatgcaatgtaaacatgatactgtannnnnnnnnnnnnnnnnnnnnnnnnnnaacactcgacaaggacacgccatattcgggagtccagcgtgtctcggccagcatcgtagttttaagcttttcgaggtacatgtgctccatggcgtcatggacccagggatgaaatcagataatcgaggagggagctcatgcaccccctccctcctgttgccagatttttcgcaaagagggccgtgaggagcgggtcaaggagctccaggtgggatggcaagggcttcagttgttggggtcgagtatggtgttctactggcctccaaggggcaatgcatggtgcagggttcctgtattggcgccgccggagatgctcttgtcatgcaaggagtggcggccccgtcttgcacactttttgccctgatgccaggatattccaaaccctgggtccaccaccccaccaaccaacaggaggatctgcagcgaggatactttgacgacttccgggaattccgggatcagcacggcaaggtcttcgagagccgcctcatccctgtggcctcagcccagccctttcccactttgacggcctcgctccccgatgaatccaccatccgattcccagtcagccagggagctgccaacgtcaccctggttgcaattgcctttcgagctggcgctcaggcaagtccgggggagcccaaatggccagcacatgctccagggtggatggcacgatggctgagcatgagggcctgtcgtcgcgatgagacgggagaagtgtccggcctggctggggaccaggctcgtgctggctgggagggcagcctgcttctttgcggggggcccagcagccaggcacccggctcatcgtgtgcatcattccagnnnnnnnnnntgatgagacgggagaagtgtcaggcctggctggggaccaggctcttgctggctgggagggcagcctgcttctgtgcggggggcccatcagccatgcacccggctcatcgtgtgcatcattccagtgcaggacctcattgaggcttggtctgtccctttcagtgaagccttccagtctgcctctaatgtacaactggtggagctcgcacttatagagtctgtggtacggaggcgctgagaggaaggggggaatgcaagggggtgctgaggcacagcagggtcttgtgcggccagccgacacccacagcatgaccttcctgcctctgcacacttggccaggatcataccaccatccaagcatcccctccccctcctcgcaagtcaggtcatgcgcgcttggccgttccggagcctgctcttgaaaaacgggacggcgagccaggagcggtaccacatgcccgtgcagtacctgttccactttggggacgccaagccgctgtgccatgccctggggctcaccaaccggctgacggggtgggtggaggggggcgtgcggtacctttgtgatcccggcttggctgcagcatcccctctgggctcgacgagcacagcacccatctcggatgtgtatgctgcatgtgcgcctggcgtggttccccgtcaccctgacagcaacccaacccagcctcgacgcgtgcaggtacgtcttcctcgtggacggcgcgggcagggtgaggtggcgcggcagcggccctcccacgccaaacgagctggccggcttcctggcggctgccgagcagctggcgcaggggaccacgctaggcccgcggccgcctccccgcttgccgtgacttgtttgtttgctgagtggtgtccgggtttgcaagggtgccagcgacaggtacctcggcaccacaactaagcaaaactctggcatgaaggtagaatggggtgcatgggtgaggcaagtcgaatgcggtcaggcctgctgcgtttggnnnnnnnnnncaccacgctaggcccgcggccgcctccccgcctgccgtgacttgtttgtttaccgactggtgttccgggtttgcaagggtgccagcgacatgtacctcggcaccacaactaagcaaaactctggcatgaaggtagcatggggtgcctgggcgaggcaggtcgaatgcggtcaggcctgctgcgtttggccgaggtgcgagcagctgccgaaggcgcgagtgagtgcgagagggagcgcttggccgagattgggcgcgcactctcacgtccacaaacttgaaaccgacttcccaggtccctggcaagaaagtcatcagccggcgaggcacgtgccgagcgccatggtgcccccccccgcgaggcccgccagctgcgcctcgcactcccgctcgtgctgccccgannnnnnnnnnggtcatcaggcggcgagtcacgtgcccagcgccgtggtgcctccccccgcgaggcccgccagctccgcctcgcactcccgctcgtgctgccccgacaggaagtggtgcagcaggtcggccgcgcccatcacccgccggcaggccaggcaggcgtacaccagcttcctgtcctcgctggtctgctccacgctgggcggcccctccgccggccgccggtcgccgcgcacggtgacggagccggtgccgcggtacgcgcagtgcaccgccatggacttgagcttgtgcgccgggtcgcgctggtgcaccagccatgcgcggtagctgcccagggccacctggcaggcggggcagcccagcgcagcctccgccgcctccgccacctcctcgtacgtcatcttggcatctgcgttggtgtgaggggggtgatcaccgcgttcaaaggggttgaggggtgcgtcgtcgtgctgggaggggcgtgggatgaatctgtggagtttcccagctccacgcatcgccgtcggcnnnnnnnnnngtcaccgcgttaaaaggggttgaggggtgcgttgtcgtgctgggagggcgcaaaatgaatctgtgaagtttcccagctccacgcatcgccgtcggcccgcgaaacggtcagcggggagggagctgcgcatctgcggggtgctcatacaggggaagaagggcacggtcctgccatctcgcgcggcctggtcgcacaggcacccagaagcgcccagcgagcatcgagcgctcccttcacgtcgtgacacccacgccggtgtctgcacgtcggtcgtcccccccccccctctttccccccttacgtaaaaacaaactctacctgtctcggcgctgcccagggagtagggcagcctggccgggggcagcgcctgctttgccggctggctctgctcccaggagtggtcgtagttgtcgggtgagggcgggtggtcctccgggtggctgtgc

SEQ ID NO: 46874 - DNA, 61 bp, Chlorella protothecoides
ctgcggcgggacctggcgacccctgtccggaagtcgaccattccgttgacctcctcctggg

SEQ ID NO: 46875 - DNA, 94 bp, Chlorella protothecoides
tgagaatgatgctgagttcgacgaccggggtctactttatttattcttgcagacgcatcttgcgaaccaagtcgatgggccgttctggccgttt

SEQ ID NO: 46876 - DNA, 70 bp, Chlorella protothecoides
ccatggcgcagggtgtttggtcaacaaccagtcctccgctcaccccccctcctcgcgccagacactgcct

SEQ ID NO: 46877 - DNA, 61 bp, Chlorella protothecoides
gggacaaactgcatgctcatgccttgtaggacctcaacctcagctagccaataccatcccc

SEQ ID NO: 46878 - DNA, 77 bp, Chlorella protothecoides
agacggcgcagggcgccacgccgccggcgcacgcgctggcggcggcgctgcccggcctggagggggcgccgagctgg

SEQ ID NO: 46879 - DNA, 61 bp, Chlorella protothecoides
ccaaaggtttgcggagacactgatggactggaactgcggctcgctcacgatgctggcatct

SEQ ID NO: 46880 - DNA, 64 bp, Chlorella protothecoides
ctctatgcacgagaaacaatggattctcacatgtaaagcaggggtgtcagtggtggcgggcttc

SEQ ID NO: 46881 - DNA, 61 bp, Chlorella protothecoides
aggtggctgcacacagggcccagagccgggagcaggccgggctcagggccagggccccgcg

SEQ ID NO: 46882 - DNA, 80 bp, Chlorella protothecoides
tctcggtggtcccgcctggtggtcggtgctccggctgccaggcctgtgcatggacgagcccaccacgtgcacggagcggc

SEQ ID NO: 46883 - DNA, 77 bp, Chlorella protothecoides
ctcaagccccgctacgaccgcctcccccccatccccccttcaccgaccacctgcaccccctgcagcacgccactccc

SEQ ID NO: 46884 - DNA, 139 bp, Chlorella protothecoides
cgcgcgcctggacggcgtggacgccctgctctccatctgccaggttgggagaccaccttcttgggggggggaggagtgcttgcctctgtgtttgtgcgattggagagggatgtgaaacggatgggggttgagcagatgt

SEQ ID NO: 46885 - DNA, 61 bp, Chlorella protothecoides
tggtcccactccatccccgggggatgtcaggactcggatctccatctccgtcatcttttcg

SEQ ID NO: 46886 - DNA, 25434 bp, Chlorella protothecoides
  modified_base (637)..(646): a, c, t, g, unknown or other
  modified_base (1321)..(1330): a, c, t, g, unknown or other
  modified_base (1547)..(1556): a, c, t, g, unknown or other
  modified_base (2968)..(2977): a, c, t, g, unknown or other
  modified_base (3040)..(3057): a, c, t, g, unknown or other
  modified_base (3160)..(3169): a, c, t, g, unknown or other
  modified_base (3712)..(3721): a, c, t, g, unknown or other
  modified_base (3890)..(3899): a, c, t, g, unknown or other
  modified_base (4821)..(4830): a, c, t, g, unknown or other
  modified_base (5700)..(5709): a, c, t, g, unknown or other
  modified_base (5980)..(5989): a, c, t, g, unknown or other
  modified_base (6414)..(6423): a, c, t, g, unknown or other
  modified_base (6506)..(6725): a, c, t, g, unknown or other
  modified_base (6788)..(6965): a, c, t, g, unknown or other
  modified_base (7439)..(7448): a, c, t, g, unknown or other
  modified_base (7531)..(7540): a, c, t, g, unknown or other
  modified_base (7673)..(7682): a, c, t, g, unknown or other
  modified_base (8622)..(8631): a, c, t, g, unknown or other
  modified_base (9562)..(9571): a, c, t, g, unknown or other
  modified_base (9972)..(9981): a, c, t, g, unknown or other
  modified_base (11258)..(11267): a, c, t, g, unknown or other
  modified_base (11562)..(11571): a, c, t, g, unknown or other
  modified_base (12022)..(12031): a, c, t, g, unknown or other
  modified_base (12301)..(12310): a, c, t, g, unknown or other
  modified_base (12406)..(12574): a, c, t, g, unknown or other
  modified_base (12773)..(12782): a, c, t, g, unknown or other
  modified_base (20412)..(20421): a, c, t, g, unknown or other
  modified_base (21110)..(21119): a, c, t, g, unknown or other
  modified_base (21199)..(21208): a, c, t, g, unknown or other
  modified_base (21440)..(21449): a, c, t, g, unknown or other
  modified_base (22018)..(22027): a, c, t, g, unknown or other
  modified_base (22556)..(22565): a, c, t, g, unknown or other
  modified_base (23205)..(23214): a, c, t, g, unknown or other
  modified_base (23946)..(23955): a, c, t, g, unknown or other
  modified_base (25241)..(25364): a, c, t, g, unknown or other
ggcgccctcgcgctccagcgcccgcagctcggcggcggccaggtcctgcatgaccgaggccaggccgcggtccacgccgccgccagggcgcacactggcgcgagccaggtcggcgccggcctccgcgccgcgcgcagtgccacccccgccgccactcccactgccgctggcttggcggcgcatggagtgctgcacgcgcgcggtggtgaggcgcagcaggtgctgcgccacatcgtcccgcacctcccgctccatgccctggatggcgtagaccccggccaggcgcgccaggctggcctccaggcgctgggcatccgccaggcccgaggccgcctgcgagcgcagcgtcatggccacgtgctggggcaggtggaagaggacagggcccttgcccagcacgttgccctccgccaccgccatctggcggccggggaggtaggagccggtgagcatgagcaccaggcccaccacgccgccgatgccctggtagtactcccggcgggtgccatcaggggccacgtggatctgcttcaccacgcccgacaggaccatgaaggcgccgggtccctcgcgccgcccgctgtcagccacaacgtcgctgctggaccagaaggcctcccccgtcgcaaactcgcgnnnnnnnnnngccctcgcgccgcccgctgtcggccaccacgtcgctgctggcccagaaggcctcccccgtcgcaaactcgcggatggtccccgcagcaaagatgcggcggaagtaagcctcgctcagccctgacatgaagggcagggagcgcatgagggagcggtggcgcggcggcttccacaccgggcccgtgatctccaggtgccgcgccttcttgtccaccgcgtccaccatcatcttctgctccccgtggtccaccatgcccgagtcgtacagctcttcaatgaaagtgaactgctggcgcagcagggccatggccgcgcggtaggactggatggcgccgaagcggtcgggcgcctcgatctcgcggtcgatgatgaagcggtacgccgcatccgtctccacctccacctccgcctgtgaaggaggaaggtaggaggaggagggggttggggtgggtaggagggggggttagtttgggagagctttgggcgcctccacgtgatgggcgaggggctgcgccgcccagggcgcaggccgagaaccgcctcatgtgcctgcttcactcgtcgcaggtctcgccgccgccagcctcagaagcacagggatcttcagcaccttgcagtgattgcctgcaagattgtaggcccctacattacattttccccctgtctttctccctgnnnnnnnnnngccgcctcatgtgcctgcttcacgcgtcgcaggtctcgccgccaccagcctcagaagcacaggaatcttcagcaccttgcagtaattgcctgcaagattgtaggcccctgcattacattttccccctgtctttctccctgtaacccccgcacccccccacccccaagggaaaacaaaaccaccatgtcaccagcaggtctgccgcgccgtccacctnnnnnnnnnngccccccccacccccaagggaaacgaaaccaccatatcaccagcaggtctgccgcgccgtccacctccttcagccaggagacctgggggctccacagcaggctgaggtagtactccaccgccacctcgcaagccaccagcatgcgccggcccagcgccgcgcgcatgatgcccgtcagcttgcgcaccggccactgcaccgtccactggagccaggcggggctggcgcggaaggcgcgggccatccacatgaggaggcgcgccaggcagcgcgtgaccaggtcgccctttggggattggggaagggggaggaggaggggaaggggcatttgaaagggtaatggcggacagatcaggggggttcaccagatgcaggaggcccccctggtggccgctagattttgcgaccaggaggcacacgatgcacgtacagcccactcccatcggccctgcagcggcatgctcgtcatcgtgattaatggactccccaccacctcacagttccctggccccaccttgatctccttctgcaggctctgccagatggcaaaggggcggtcgacgtgctccgcggcgtggtcgcaggcgtagtccaggatgcgcaggcccttgattgacagcaggccctgcaggcgcttgccatggaagtagcgcttgagccccgacaccaggcgcccccgcatctcgtcggtggcctcctcgctgagcacggggcgcagggaggcgccagactccgggccttcgccgcccaccccggcgaagctgccgtcgggggactgcggctccgagtcgccgggcaggctgcgcggggtcagcgcatccgcggagcgcgcgcgggccaggtgccccgacagccgccccaggtccctggagctggggcagggggagggggagggggggtgaggcgggcgtggcctgatgcgcctgctccggtgcaaaggtgctcctcagaagctcggcacgccctcctggacaagccgtggccccacgggtcagctgcacagactgttgcgccagagtctcgctgtgaggcctggagcaatgcccggcggtaccaacaacccctcccaccactgcagtagccgaacacacaatacctcacacaggttctccctgcccagaccctcaccctgtgtgggacaccaggtctgctgagggggtggtgccaagcatggccatcatgggcagcccggcgcggaggggcagcttgtgcaggctggccttgtccaccttgttctgccacgacctgcagagcgggcggcgggtgcaggagatggggggaggggggagattgtcttagctgcccatgtgcgccgctgagggtggacagaagtgtaggtcacctggcaacctgggcacacggtgacacccgacggccccttgccgaccaccaccaacagataaaagattccnnnnnnnnnnactgggcacacggtgtcacccgacggtcccaagccgaccaccaccaacagataaaagattccnnnnnnnnnnnnnnnnnngggcgtcagcgactcctccgcttgcgccctgagcgggcgcggcgtagccgccacgggcgcctcggggatggtgtctatgctggggccgcgggtgtgtgccagnnnnnnnnnnaacgctctccacgacgttcacgggggtgcctcccctggggcgcccgtcctgtgaccgaggcgtcagcgacgactcctccgcttgcgccctgagtgggcgcggcggcgccgccatgggcgcctcggggatggggtctatgctggggccgcgggtgtgtgccagccggtgctttgccagcacgttggagaagggggtgttgccgtgggctgccgaccccgacccgcccctcttgtggtgactgtcgcgcattggggagagggaaggggtggattttgagggcatggggttggcatcccaagggggtggtaaagcaaactgccgacggggagacaaagctggctgagtaaatcatacggtcctggttgggcctgtgaatctgcataggcaacctaaactgcccacacagtctcacatgtgggtctggtgtgaggcaatgggccgggcaaagggcgtcacatccaggtgtgtggaggggagggaggtctccgccgtctgggccaggggaaagggtgaatatgtgtgggatacaatgtatattgccgnnnnnnnnnnatgtgtggaggggagggaggtctctgccgtctgcgccaggggtaagggtaaatatgtgtgggatacaatgtatattgccgcagaaggagacaggttcagatgtgcacatggtccgccctcctcgccacgcaacctgcgacccaaggaaagcacctcccaatgtgaatgnnnnnnnnnnctccgccctcctcgccatgcagcctgcaacccaaggaaagcacctcccaatgtgaatgctcagtcttgttcaagcaacggttcccaccccaccttcttcccgaggagggtctgttgggagttgaagctggccgagtgtccaggcaggtttgcccgagacctctccagctcctggcgcaggttccggcctgtttgtgggcgggagcatgctcatcccagtcacgctggtgtctgctgtgagacctcacctgcccaacaccaggcaatccccaagctgaactccctgctgccagctgtactccctgccccgccttacccatgactccagacactgtcgcatgagcatcccagtctgtgcctcgcatgtctgcgctcgtcgcccgtgacgctgatgagacaaggaagggggaagaggatgggctgggggtacgatccaaggtacaactgcaactatctgcaaggcaaacacagtgagggcaccaaccatggtgatgccgatggccctgatctgtcaggcaggtcacaacatgcagaaactacagtatcactcatggctgccgtgccgtgtccctgccccccttcccaacctcattaaccatcaaagatcctcgacccacctcggctgggcctgggcggccgcgctgcgaccgccccgggctgctgctggggcggaggcctcgtcatctctatcgagcgctgcttggccagttcctggagcaggcgtgcctggagggccctgcccatctgggcgggcatggtcgagaagtgattggcctgcgtcccctcctctgcaaaatcagggggtttgggagggcttgagtgtgcggggatcttgtcaagatgaccatgcagaagtgaggaacatgcactgctgggcgcaggcttcggattcgaatcgtccttgaaagttggcctccctctcnnnnnnnnnnctggcctgcgtcccctcctctgcgaaatcaggggtttggggaggtcttgagtgtgcagggatcttgtcaagatgaccatgcagaagtgaggaacatgcactactgggtgcagacttcggatcagaatcgtccttgaaagttggcctccctctcaaggttcaacatcaccccaaaatgccctccctccgcaccaggtcgagcctgcggcgctggctcctgggcgtcgctgggaggcgcctctgccggcgcgagcagcgccacggtctccgccgactgggacgaggacgacctgtcgccggagccttcgctgccgtgtgcctcactgttctcctgcgcccgaccatcatccgccgcgccctctgcctttgccacgctctccgtctcctctccttcctcctgcatcgccctccacgtcgcctcgcccgcccgcccggcctggcgcggcggcggcgcctccccaccctcgggcacggagctcatgcgccccgccgccagcagccgcgccagctccgcctgcatcttcttccccgcctgggaggtcatgcgcgcggaggcggtgccgctctgcacgccgtcgtcgttgtcgtgttcgccgctgctgtcgccgccgccgagcacgacgtcaggccgccccctgggctggcgaggcgccaggcccaggggcagagacatggtggcgtcctgggcgtgctgcgtctgcttcgccaggttcgccgccagctcgcccgccacgcgccggcccagggccgcgggcatgctggagtagtagtccagggggggctcggatggcggctgcgcagtggcatcaccctcgtgcgatacagcctcaggaaccggttcgcgcccacccgccgcgccgcgctcgccagnnnnnnnnnncggcatcaccctcgtgcgatgcggcctcgggaaccggtccgcgcccacccgccgcgccgcgctcgccagccagcgcggccgcaaaggcacgctggaccgacgccttgatgacgtcttcctcattcaccaccgcctgtgcgtcccgctcgggctcttctttccccccgcccgcccgctcgtcgccaaccagctcctgcttctcctggcccaccaccatcccttcggcggacgccaagtccaccgagcgcttggtcagctgggcgcggagctnnnnnnnnnnctgctcctcctggcccaccaccatcccttcggcggtcgccaagtccgccgagcgcttggtcagctgggcgcggagctcgcggcccagggacgcgcccagcgcggccggcatgctggagtagtaggcctcgtgctcctcctgcgcgctcattcgggggcccgcgccggcctgcggagcggcgccggcaggggcaaaggcgctcgatggagatgcggtgaccgggccgtcgccgccctcgccatctgcgcccactgcgcgcttgcccgccgccttctgctcggcggccatggactcgcgcagcgcggcgcccagctgcgcggcgctcagcgcgggcagcgtgctgtagtaccgctcctcctcttcccgtgcccgcacgtcgggcccagggccggccgctgcggcaaagggcgtggcgaggcgctccnnnnnnnnnncgacgtcttcctcattcagcaccggctgtgcgtcccgctcgggctcttcttcccccccgcccgcccgctcgtcgccaaccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaggcgcggtgcccggaccgtcgccgcccccgccatctgcgcccactgcgcgcttgcccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccgcgcgtcgggcccggggcccgcggctgcggcaaagggcgtggcgaggcgctccccgacgaaagaagcggtgccggagtgcgcggaggcgctgccgtgcgtcagcgacccggagctggcgtggggggaggggcgcggggtcagcgtggcaggcggggcacctagggcggcgccggggactgccgtggcgcgccccagccccatctccagatcggcggagccctcgtgccacgaggtctgcagggttgtgtgtgtgtgagggagggccgaggatcacggacgagcacgtgcatggtctgggcacctgctaccaacaagaccttgcaggtacccggcccgggtgcggcgggcacttgaggggtgggcccacgaaggcctcctgccgcagagcagggaggaaatgctaggctctcaaactcctccccccgcccctgcaactcacccgcgccaggccgtcgtggtggagatagggnnnnnnnnnncgtgaggaggaccgaggatcacgggtgagcacgtgcatggtttgggcacctactaccaacaagaccttgcaggtacccggccnnnnnnnnnngatctcgccgcgcagctcctcgaccacatcagagatgtcagacatggtgaagttgctggaggccgtgctctccgagtcagatatgtagccgttggggctggcatccgcccccaccagcttgcccttggccggnnnnnnnnnnaatctcgccgcgcagctcctcgaccacatcggagatgtcagacatggtgaagttgctggacgccgtgctctccgagtcggatgtgtagccgttggggctggtatccgcccccaccagcttgcccttggccggggagtcgccttcggggacagccccgaccccgccggccgaggtcctcaccccaaccatgtgcgggatgatgtctgccacctccaccgcggggttgcccagcaccgccgacccgcggtcgttcatgcggccaaacaccgcggacttgaccctgtgatacagcgctggcaggccgcggccgtgcggctctgcgaaggactcgctgcgtttggcggggaggtcgaaggcggccagggcggtgctgacatccacgtaggccagcaccgcatcccagttggcgccctgcaggaactcgtcggtgtcggtctgcagcgcctccagcgcgttggacgtgaagcgcaccagcgccgccttggccttggcccgcatcttgcgcttctcccagggaatcttgttcaggcgcagcagggccatgatctggccgatgaagggcgcgttgaccaccagggtgagcagaacgaaggccgaggtccacaggctgatgtccgcgttcactgcgttcagcacagtataggggtcttcagggttgttgcggtcgcccaggtggaactgactgttggtgttggggaaaagggggggggatgggtgggcaggagatgtcagcttgtattattatgacgaggtccaagcatggtcatggagtggatgcacggccggtgtacgcaggaaagggcgggcagaggaggatggcgggcgtggagggaaagcatgcagctggaaacggtggcccatgacaggcaaacacccgctggccatgtgatgaatggcgggaaatgggcgcaagacgcttgttgttcacttggccaaacannnnnnnnnngaacggtggcgcatgacaggcaaacacccgctgaacatgtgatgaatggcgggaaatgggcccaagacgcttgttgttcacttggccaaacaataaagctgcaaatgaagaactccccccgtccatccccgcacccaaacttgcaaatccccacccatggggcacctcacctgttggagataaagtccgcgaccatgatgagggacactgcgccgcggaggccgcaccaactggtgaaaatgatgtcctgggtcgacagagctgcaaggggggagggttggcatgagcatggtgacgacgcacgtggcgtccagtgcgcaagctgtggctctccacaggctgattctgggattgtctcagaactgagccaccaagtcccaatccctggcacaggatgaccaacctcctggagtacgccacccctggacccgacgcatgcggcctgctcgaccatcgcggcctggataccttttgtgtgcccctactgccaccctgtcaccagctgcccaccttccccgacccatttgaagatggggttgaagagcaccaggcaccctgctcggatgaaaaacatgaacacccaaatgagggggatggctgcgtaactccaggccgtgttgttcaggatggcgacggagctgggagggtttccgaagggggacagagggtttaggggaaatggctgggaatcacctagagacatgggggtttatgatcaggagccctgcttgccaaccccatcgcccgacatccagttttatgccttggcctcacttgacggtatagttgacggctgcaataccgctccacaggaacaccagtccattagccgaaaaggtgatggcgtcccagactgcagcaaaaatgagggtgggggggttacatatgaccagacgggccagtgctgatttgcagagacccaacctgcatnnnnnnnnnncactgcagcaagaatgagggtggggggttacatatgaccagacgggctagtgctgatttgcagagacccaacctgcatgccgacgtgccctctggactgtgaatgaccatggcctctcccaggcctgcatgcccatctctttccccttaccaccccaccaccacgtcgctcacctgcgtcaaacgccccgctttcctcggacgacgacagcatgccccacttggaggtcatgttgccatagaggccaaagaccaccaccgagataacgcccgagccctggagcgcagggagcgaggggggggggtctaagctggggtgatgcacgcgaaggagcttttaaaggagcttcttctgcagtcaaccccgcaaccacaccttggcaggatcgttggcgacatagnnnnnnnnnngggtgatgcacgcgagggagcttttaaagaagcctcttctgcagtcaaccccgcaaacacaccttggcaggatcgttggcgacatagaaggagaggtatgccaccgcaatgatgacactgttctccacgtacggcttggcccccctccacctcagccagtgcaggaagtggaaagtgagccaggacatggccagcccgatggcaaacccgaccgaggccagcctgggagtgaggaaagggggacgcggtgtgaggcatggtttccctggatccggcgtgcggccttcgaggccgccccttgaccccggatgtccctcttcatgggaaccagggatcccagagtcatgctgcgccccggccctccagcccctccaccgctccccacttgagcgtctgggtgatgatcgtgggcaggatgctccagaccgaagggtagggctccgcggggttgatgtgttcctcgatgatgtgcatgaacacctcaaacagggtgatggcggaggcatcgttcagcagcgcctccccctccatcagcaccaccagccgctccgggccaccccctgaggaagaggaggggacggtggcgatgactcgcttgggaggagatgtggtgtgtgaatgcgccagctggctgatccggtgctgctctcgatggcagggttgacggcgggctgcagcacagtacgctcaagaaactcggcagtgcccgtgtagaatacgccggcctttccccctcacaatcacgcacgacacaaagcataccctgtttcaggatggcggccgcagccagggcatctgtgggcgcaatcatgctggcaaagagggcgccgtgcacccaggaccagccccggtcctggaagcccaggacgaagaggatgaggggcgtgaggatgagggcggagaggaccaccatcacaaacgccatcatcacggcgtggaggctcagctgcgcagggaggaaggggggcaatgggtgactgataggacgagctgggctgggcagggcaggctggtcgggcaagtcgcagacacgttcttgcaagtaattccaaggccgaggtggacctctgccgactctcaccttgcggaacatgaagaaatcgatgcgaatggctgagtcgacgagcaagggcgggaggaatgcatagaagaagagatccggtggctgaatgttgagcctggtggtgagcggggggggggatgcgggtggtaggaatgagacaattaagccacaaggaggcgcttctggaacgttgacacaaggcagcgatgaagtnnnnnnnnnncaggaatgagacaatcaagccacaaggaggcgcttttggaacgttgacacaaggcagcgatgaagtgaccatggtcacctggggcaccgtactcaccagatgctgatggcatttgaaatgaggcccaggttcacttgccagttgattattcccaagacaccacctgtggaggcagggtgcgagctcgccatgtgtactcaccaaggccttccttcatgtcgaatcagccagcatgaggcccccgatagcgatacatcaggacacaactgctacaccaggcagcccaaatgtccannnnnnnnnnagatagcgatacatcaggacataactgctacaccaggcagcccaaatgtccaagctcttggagcctctcgcgcaacacaccaccgtgcacacacctgtgatcagcacccacaccgctgacagtttcccaaacagtgtcgccatgaccaggagggcgaggcccacgaacaaaaatgcgtcctgggcttgtaatggcacggagcaccacacgaagtcatctgtgccatggggttgatgtggcggggtgggtaagggatgttcctgcatgccagtctcatgggcgccatgggtgcaagaaccctagggccaacgccaccctggcgatcgtaccgtgaacggttactcggtgccccgtggtcacattccaaagcaggcaggcggtggagagccagagctgctcatagtgctcgtatccgtagatggagggggggttggtgatgttcaggtgctgnnnnnnnnnnggagcaggcaacttgatgttccgtgtcctgcagaccgaagcattgtgcagctgtgtagtttgagtagtcgccctctaacgacatgatggggccaaacccagggccctcgcgttgtaatggggaagctgatcggagtcggcaatgggtagggtcaacctcctccaaccccaggttcaggggtaactcctgtcggaaaccatcaggcttcacaacaaatccacgttgatttgcttgttcaaatataaagcggtcgaacacgcgtgccggggnnnnnnnnnngagctgatcggagtcggcaaggggtagggtcaacctcctccaaccccagcttcaggggtaactcgtgtcggaaaccatcaggcttcacaacaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctgttcatctgcagtcatgcttaagcgagacaataccaagccggcagattatattacaagagatgactgatctcgtcgatgagaagtctacccattttggaatggtaatctatgtgcaaatcgggattcatttgaacaagcatactactagcacgactcatcatcacctccgttccgctttgttcgtccaacccccnnnnnnnnnngccggtactagcacgactcatcatcccctccgttccgctttgttcgtccaacccccatacgggggaggcctctgttcaggccttccagcagcaggcaggccttgcacactgcctgtggattgtgtgggaaagacagattgttgtcaagagcccatacacatactcccaggaaaaggctttgtaagatcacagcttatgtgttgaacatcagtcccaggttgggggtggactgattcttacctggctcgacatgtacccacagcgagtgcagctccctggctggctctttggctgcatcgcttcgctctctatccgaaagtcctcagcagcagagatcagatccactatggcacgaggccgagctgcctggacaggttggggtcgggtacagactatcattaaactaaagttgcagcagcctagagtgatgctaagggtattgcataacctgggtccactgacgaaacagtgtgaagtagatgtcttattgtgctattgacagagattgcaagggactccacatagagacccctgtctacctctaggtccttgataaactcccgagccaatccccgagcagcaaagggggagtagatgcactctgcacagcggaatgtggcgcagaggagtggctctgcatgcatggcttcacaaagtcatgcacggcaaagcaaggtctcaaaggacagcgctccacatagaaaacaaccgcagctccccacctgtgctaaagtagtccagcttcttgaagtaggcatacatcacgatctccttctcgtacacatacttgaaaggctttacccgggggagggtcgaatccgcgcctgtgatgatgctgggacagcgccgaagcctggcagcccaagaggcgttggggtagggcttgagcactcgcacgcatctctgagcttcttgatgatctaggtggagggtgaggacccaacgagcctaggatgccatgcatgccacagggtgcatgcttgacaacataatataacagctcagtcccgggcccaccttgccaggtcagcacgcaggaagttgagcagcacagtctccgcaatatcgtcggcattgtgcccggtagcgatcttgtcagccttcatcatggcggcgcctcggtccagtgcctgggtaaaagtagtgtgggaaggtgggtgcctgcggacctgcactgcgtgtgataaaacctaaactacaaacccacccagacatgccagcaacaaatggcagtccactgttgcctcgagcgcggaggagctgtcgcacctgtcggcggaacaccccgcagaaggtgcagttgttcttcgtgccgatctgggccacaatctcatccatagtccagccatacaggtccttgtaggagcaaatggtcagcgggatctgaatggtgcggagcgggtgtcgagggttggtgtttctcagtatggggcttgccaagatgaatgtcgagagccttcaacaatggctactcgcataatcagttccaagtggcgatgcaaggacaaccaacatggtgccatgaatctcactgtgcggccctcccacctggtactgctgttcgttgcgcttcaccgtctcaagagagtcgtcccggtaccccttgattccctcgtcaatggacagcaggaagaggtccagaccatagctgtgcagcaggagggagagtgggagacgatggagcccacagcgctgttggaaggctaagttcggggacttccatgcaaagacatgcgcctcagccgcttctgagcccactatagtgacctcttactcgtatctcctgttcagggtggtgaggatgtgagccagcaccgtggaatccttgcccccactggcgccgattgccaccctctccccgcgccgaaacaggttcgtggccatgatggtctcgtggacctccgtctcaatcgcggtgtaaaagcattccttgcacagctcttccgacgtctttgggcggcgcatggccgcccgctgggtgcggcactccacacacagcttcatgggtgctcggggcggtatcggagctcagcgggtgcaatgcgccgttggcattctgggagctgataggattgatataacttgaatgaatgtatggtttatattccatgatgccccatgcaaggatatcaacaccatgactctgtccccgaacctgcatgctggggtgtgcggcgaatcggcccgagactgatggagatggcagtacagatctgttcaccgttgacaagtcattcacactcatcgttgcaatgctctgttcacatcgtcagcttgagcacgaggtccaatccaggagatgattgcaggaatgtagaccggcgctcatagtccagtgtacgtgttcttcctctttcggaacaattactccgagtaagaagactctggtgcagaaccatctgatggtgagcttgagtcttcagagcttgtgtcccagtctgaggcgtggatggtgcaatgcctcactctgtgctgagaatggcatctctgcaaaatgaacacggcacattatgctcttctaatggtatccctccctgcaaaggagcatgcagtatgcacccaatacctgtgacaatacgctgtcgtttggcagtctgcagcctgcccgatcgccgttgagagctgggcggtgtctcctgggaaaccacctggctattcattgctgtgccagcatcggatacagggggccctgtaggtgcgaagaagaatacgcaggtctcatttgcagactcggccaacaaacggcagtcaagccgtatcccagccctccgtcagaggcactttgcgacgctcaaggcatcagtcagcagcccctcttctcaccggatgatcgcttgggagtgttgggagaggctgcgcctccctcatctcgctgcatcgtagcttccatgggttgggctggcaggtgcgccggcacaaccccctccccctcgcctgacagccatgtgtacttgtcgaatactatctgtgcggcaggaggagggcgtggaatgctgtggagcagtcagagttgggcaagtgtcttaccgtgtcagctgcacaagtcctgcattgaaatcgagctgcttagggttccaatcttgcctcccttgcccacaccaaggagtcgaagaggtcttcacataatacatccttcgaaccgagcctcagaaccgcatacttggttcggggaaaggtcagcgtgcctgcatggaggaatttcggggcacggtgactgaggatcctccgggcaaccatgaaggaggtgctgttgcgatgccgagatggctgcagatcacggtctgcacctgtcagttgcagggcgccttgagggaggtcgatgtgcatcgtcggttgggcactgtccagattggacagggtaccctggcggccacaggggtcaacagggcagagaggctggtggtgaggccgggcaggtagcatcaggcaaacactcaggcctccacctccttttgctcgacaactggtgcccacaagtgtgtactcaccagcttgcccccagtgagtgcctgcagtttcatgcaaaaggctaccaagaagcgtttgcgtcgcgcaaaccccttcttgatgatgtctttgccacggtgctgtagtatctctgaggagggagttaggcttggtctggcggctgcagcatttccatatcaattatacctctgcaagggccctgcacctttgaccacatcccacatactctcagatagggacccagatgtggttgatggctgtaatgtactgctgaacatctcctggaacattgattgaaacgagcttgtcatggggttagtcgatcaccctgctcattcctgcgtcgtgatgatgatccgagcaacagagcccactcgcacctgcatgaggctgctgccgctaggagcacatgcatctgcagtactcattgtagctttcgaacgcggtataagccccgatattgagtggaaggcgactacactgtttgcacactgtgacacagctatcaaggtattgttgccacagacctcctgcaggctggccttgtctcaagggatgctcctagattttgatcagtgactctgatctacaacatgtgggcgtggcaatgatcatggcaatgaaatgtggggggagttcctgcgttttgaaggggccccgggggcgcgcgcgctttcctggccgggtaccacccatgtgggaccctcggatcggaacacatcaaccaccacctcggcgacattgaaccacctcttcggcttgattatacctcccaacccgccaaacatgtacttggagaccgtgcgcggggctggtatgccctgccgagcggtccctgaccatgcacaccggtgcgctcccttccgccctgtggtgaacaaggtcacgcggagccagaggggctgtaggagcaccactacagtggcgagcatgggcatcggcttccaccccacctacgagccgacgaacgagccggtggtcccctccttctgcccggagtttggccttaccacctcccagatgagggtgctaggactcacacagcagccggagatcggcacctccatcgatcctgtgagtgggactagctgctgtatgaagctttgtggtcaacccgtcaccagaccagcctgcaccgtcgctgccccatcatcttagcaaatgacatgctgtggcaggaacagcatggtgatgcagctgccattggtccctccttcaacccaaagggtttttaatcctccaggataccctgacggccaaggcgttctacgttggcgaccatgtgagtgagaccagtcgccaggcaacacggatggcgcgggacaccagagccccaggccgggcgcctccggatttgccgtccctcctcctggatgggcgcatttgctacattggcatgccggtgggttggtgatatcggtgctgttgtcagtgctgctggtgattcagatgaatggcgccctgctgtctctgtgagggaatggtcgatgcgctgcctcgtgctgtgttccaagcctgtcagacacccacctctcaaacccctttccacaagctgacacaccttccaccctcatccctgcagctggtgcctgctgtgacagagctcgtcatctcagagctcttgtggctgaactactcgtctcaggacaagccggtgtatgtatacatcaactccacaggtgtgtgtgtgtgtgtgtgtttttgtgctgtgagggagacattgaactggcgctgtgcatgggggtgcccatgttgcagtgaccatgttgtaccgaatcgtggacccctaccatgcgcaccagagttggcttctgttactagaacagtgtagcacaacccacttccacaccttgccgtcaaggggctctcgtgccctgttcagcggtaatcctacgttaatgtacaagcacccccccctccttttccccctttcctacaaccaactatcatcaggctcccagactgctgctggggagagcgtgggctttgagacggaggccaccgccatcctggacaccatggcctacatccgccctgacatctacactctggtgatcggccaggcctgcggcaacgccgccatgctgctggcgtccgggaagaaggggtgccgctacgcgctgccccacgcgcgcatcatgacctgccccccccgcctgaaccgcgcgtttggcagcaccagcaccgtcatgatccgagccaacgagctggaggccaacacccaggtgtttgtggacttcatgaccgcggccacgggcaaggacgccgccacggtgcgcaaggacattgggcgcaaccgctacttcacgcccgaggccgccatcgagtacgggctgatcgaccgcgtggtgcagcccagtgaggcggtgcagatcgagcgccgcaactacgagctggagatgcggtcgcaccaggccgcgcgccgggcggcccaggcgggccggcagagcggcccagggcccgagacgggcatgtgacatgcttgggagggggagtcctgtttgggggacgaggcggtggaggagcggtcccggggccaaactgccagcgagagggccgctggtgcctggatgcggttgacgatggacattgtgggaatgattgctgtggggaggttgcaacccaggttgcccgcaggcgtgtacacagccctttccttttccctgcctgcctgcctgccgttgaaataccagcaagaccagtcagaggctttggacagggagggaaacttgattgcagcagcctccgcagcaagcagctgcattccttgtgttcaccggcgaggacattgccgtgagaatacgcaacagtgctgcacgtgcttctttcccaagctccataactgccttctgggtctgggattccattccttcaggatcctcagtcacactgcagcagggctggcatgatcacactaaactactcctcgccctcctcgggttctggcgcgagccggatgaggtcgtcgatgcgcaggatggtgatggcagcctccgtggcaaactgggaaggaggcgggtgggggaagatggtgatggaggttcatggaggaggcgtatgagaaacaagaggagcatgaggggtgcccactggggccagggaggattcaccaccgcccccgctttcctcctgcccacccaactacacacgcacacctggatgatcttgagcttgctgagcgccggctccagcacgcccgcatccacgttgtcccgcaccgtgccctcgatcaggtccagcccaaactttgccaggtgcttcttgtcaggcttggtctgcggcagggtagcgggtgaaggggggtgggtggggggtgagggggatggggtgcagggaaaggcatggctgcatacgcaggggaaggttccacttcgtacctcccagattcccctacccttcattctcaaccaatgatgcatgtccccatcatccctaacgtaccccagatttcccccccgcctccccccccccctctccatcccagacctgcgcggtgaagtggtaggcccgcagcttggccaccagctcagtggcgtccttggccgcgttcacggccagggtcttggggatgatgagcagcgcgtcggcaaactcggcgatggccagctgctcccggctgcccagcgtggtggcaaagttctccaggtacacgttcagcgcggcctccacagcgccgccgccggggaccacccgcccgctctccagcacccgcttgacgatgcagaaggcatcgtgcagggagcggtccacctcgtccagcaggtagtcattggcgccgcgcagcagcaccgtcactgcgcgcgtgttgcgcggccggcgcaccatgatcacgtcgttgtccgacaccgtctcctccgccacctcctcagcgctgcccaggttggctgcgtcgaacgactcctgcccctccatgtctgccagggtcatcacgatgctggcccccgtcgcccgggccacccgcctggttttgtgtgtgtagggtgggggggatcacagtggttgaatgatgcctgtgggcagggagttcccctggagggtgcacacgaggaagagggtacagagagcaggggggcggcagtcgagatgggtgacgtggctgttggtgcaaaaagcggatctgtgcaagacccggacgccattcgccccacaaagccaaaccacnnnnnnnnnncacagagagcagggggccggcagtcgagatgggtgacgtggctgctggtgcaaagagcggatctgtgcaagacccagacgccattcgccccacaaagccaaaccacctgccgaggaaaggaggcccctcccgcgatctggcgacatcccatcccacccctgtcacccatcaccacgcaatcactccatcacccacttgaggtcctccttgggcacacggcggcaggcaatggcgcccgcctccacaaagtacttgagggacatgtcgtcgatgcccttggtagtcaggatcacgttggcgcctggtggggtggggtgggggtggcagcagcggggtgatggaagaacggtgtgctagagcgtttagcccatgtcatcaaccccgggggagcctgagcttgaagtgccagcgcacatgatctcactctcacccacccaccccagtccccacacctcgctcacatacctgcgtcgatgatcttctggatgcgctcgcgcgtgatgtcgctctcgcgctcccggatcttctccagctcggcggggtcggacaccaacacctgcactcccatgtgcatgcgcgccttctgcaggttcatgtccaggcaggcgatgcgggcgccctccacgcgcttgggcatgccctgcagtgcgcgtggcgggcgtggtgtgagagcgagggttgatccatgnnnnnnnnnncgggggccgcagcagtggggtgatggaggaacggtgtgctggagggttcagcccatgtcatcaaccccgggggagcctgnnnnnnnnnnaccctccacgcgcttgggcatgccctgcagcgtgcgtggcgtgcgtggtgtgagagcgagggttgatccatgcaagggaagggggggttgagtgcagagcgcgggcaggaagaccaggaggggaagggcagaggtggtgcaggaggttctgctggccacaggccgcccttgcacccctgtgggtaccttttcccagaccaagagccgtcgtttcgccccctcccccactccnnnnnnnnnngaaggctgaggtggtgcaggaggttctgctagccacaggccgcccttgcccccctgtgggtcccttttcccagaccaggagccgtcgtttcgccccctcccccactcccatatacacacactccactccacgacatacctgtgcggccctgcctaggttcagcgcatacccgtctaggagctggctgtccttcaggctcttgccatgggccttcaggatgttgatggcgctcacggggtactttgtcttcccctgctcgctcgtcgtcttcacgcttgtcactgcaatgtttgaggtttgggagaatgactgaaggtttgggtggttgaagggggaaatcagggcccagacttgtgtgcagcggggcaatggaaggtcaatgccatgttgctatgagcatggcccagactctgcggccaacgttacctcaatgtatacttgaaggcctaaacaagcaatggcaactcccaacctcccatctcacccaccctctctcccgtcccctgctttctcagccccattcaccatcctttggcttacctgcctccacgacaatgttgccaaagaannnnnnnnnncgtcactgcgatgtttggggtttgggagaatgactgaaggttaaggtggttgaaaggggaaatcaaggcccagacttgcgtgcagcggggcaatggaagatgaatgccatgtcggtatgagcatggcccagactctgctgccaaagttacctcaatgtatactggaaggcccaaacaagcaatggcaactcccaaccgcccatctcacccaccctctctcccgttccctgctttctcaaccccattcaccaccctttggctcacctgcctccacgacaatgttgccaaagaagtctgcctcagatcccacaatcttgctgctcattgccgtacgagcggcgttcaggagggtgtccttgccgagcgtgtctgtgttgatcgccaggttctcctccacatacttgcatgcctgaggtggggtgtgtgtgggagcatgagcgtcagtgctgggtgaggggcgtaaagatgcaggaggccagcgtgaggggcatgcagccgcagcaatggtcctgatgactgctcatgtggnnnnnnnnnnagtgggaggatgagcgtcaatgctgggtgaggggcgtaaagatgcagggggccagcgtgagaggcatgcagccacagcaatggtcctgatgactgctcatgtggcacggaagggtgggctgctcgagcgtgcaaccccatggagttggggcatgcaaggcaccctcagctggatatgctcatctcacgagctcgtttctttccattttcggcgctccatgccagcctgagggaccagacgctggatgcaggcacgtacctctcgcattgccaggcggaagccgctcaggatggaggtggggtggatcttggagcggacgaggtcgttcccgcgcttgagcagctccgaggcgaagatgaccaccgaggtggtcccatcccccacctcctgatcctgcagatctgccaggtccaccaggatctgatccaggagagtgtgggtaccggtgtgggttgaggcaggtgggcggcgccgaggcggcatggctactggttacctgacagtcatgcacgtgtggggcccggtgctggatacatgcgagcggcttggctcgaggagtcggccactccatcaaggtaatcacaccctgcataccaccctcctacacaagtcgtcaccttggcagcggggtgctccaccnnnnnnnnnnagtgtgggttgaggcaggtgggcagcgccgaggcggcatggctactggttgcctgacagtcatgcacgtatggggcccggtgcatgatactttcgagcggcctggctcgaggagtcagccacttcatcaaggtaatcataccccgcataccacccccctacacatgtcgtcaccttggcagcggggtgctccacctccagcagcttgaggatggtggctccatcattggaaatggtcacatcaccgatgtcgtccaccagcatctgcgcgcagaagggtgacccacacaggatgtgaggctgagatgcgaggtaatgggtggggctgtaggtcccgctggaccctttaatcacaccggatggtcccccccgcaccttgtctaggccgaccggtcccaggctggacttgaggatatttgccactgccaggacggctgtggtattctgggtgcgtacatcctgcccactggttctatcgccattgatgtgcagctgtgggccggatgccccagacatcgtgggcggcgatggcaggcctcctgatcaccttgcgagctttgccaggtatctgccttccacactcctggttgctggatcagagatgttgtattacagatgtaccgatttgagtcgtggtgacgagccggtgggtcgcctgccatgttggcgccatgcccccccttcggtcaatgattcgagcctcccgcccgagcgcgcgaggggtctcgacccnnnnnnnnnntcatgttggcgccatgccctccattcggtcaatgattcgagccacccgcccgagcgcgcgaggggtctcgaccctctgaactggggatgagggacgcatggagagtctctgcagggcatcaagtccgcagatgtgaccaaatattcggacttgcttcgtgggtatccagcgaggagctgcttgaggcgaccattgtcgcaccatcgccggacgtgcccaccccctctgccgactcaccacggcgccgttctccagcagggcgcattctacgacaacctccctgaccagggttgcggaggatgccccatgccccatcctcattttgccgcactccactccctgagcatacattcggcgcaagctgccccctcccccccacgacctgtgccggcatgcacgcccgagccttccgggccgctgccgcgcgattctccagggcctttgtgcctgtgtggcatgcaggtgcgatgtcgcggggcatggcttcccggatttaggtgccatgatccctggggacgatccggatgtgggttgtgattgcgtgcaggcctgctccttccccatgccagtcggtgctggccatggacagaacaggatctggcatgcttaggcgcatgcagatgtctggactccaggctcgcacagcccgagagtagcctgagctggcccaccaaggtgcctccccccacaactcgtccgctcaccaccctcgacccgcatgccgcccccaggcacacggcccggcacgcatgtgaggcacgtgtcgtaccccgcccgctccctggacggcaccgttgccgacctggagtcggcctgggagcgcgaggccctgctgcgcacgctgggcgagcggctggcccccctgcgcgccctggcccgcgccaacgcgctggccacggccgcggacgcggagctggccgcggcggggctgacgcgcggggcgctggaggagatcctgcgcctgcgcgggcccggccccgccgcgctgtcggacatccgccgcgccgcgctgagggcgctgggcggcgaggccagcctggtggccctggagggggtcagctcccaggcggtggaggtggatgagacggcggccagtgaggccggaccgagtgtggctggggcgggtcggcccaggaccggagggcccgggctgagtgggccggccgtgagcaggatcacagcgagcgaggcgcggccgggcagggtgactgccaccgaggcggagctgggcgaggccgccgtcgcgtcaaagcgacccccgccgcacgcgtcggcccagagcgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgccggcctggacggccgcggagggcatgcaccgcctgcgctgcccgcgctgcggcggcggcagcg

SEQ ID NO: 46887 - DNA, 61 bp, Chlorella protothecoides
aaaccgaggccgcccagctcgtcatggaggggggttggggcgtggtaatccattaccctgg

SEQ ID NO: 46888 - DNA, 61 bp, Chlorella protothecoides
gcaagcctgcacctcaagggaggaaggaagtccgccggccgttcacctcaagcccacctcc

SEQ ID NO: 46889 - DNA, 61 bp, Chlorella protothecoides
ttccctaccaatgagaagacgtcccagtttccgtgcactgtgtacaagtcaggatcggggg

SEQ ID NO: 46890 - DNA, 76 bp, Chlorella protothecoides
gccatgccgtccagggtccgtaacaccgacgatgtgtatgtagagcaggcgaccacctccacggcaattgcagcgg

SEQ ID NO: 46891 - DNA, 75 bp, Chlorella protothecoides
gctccaggtgccaaacgaagcacagctcctaaaaactgcaacatccctggagtcggctggcatcgctcacaaggt

SEQ ID NO: 46892 - DNA, 73 bp, Chlorella protothecoides
cccacccactctattcctcaccccatgtcgtctccccccctcacccccccccccaaaacaaaaaggtcccatc

SEQ ID NO: 46893 - DNA, 65 bp, Chlorella protothecoides
ctagaccatgatcccttgcgtccggatgtggtgcaccggagagaggggaccagggggaatcgaac

SEQ ID NO: 46894 - DNA, 73 bp, Chlorella protothecoides
tcatgtcagctctcgactttccccacatccttggagccgcgtagcgatttcggcctcgcgcatcttttcgtga

SEQ ID NO: 46895 - DNA, 64 bp, Chlorella protothecoides
accctcgccgatgcagtgcatgcgcaccctcgccaatcgacaagcacccactctgcctgcagac

SEQ ID NO: 46896 - DNA, 61 bp, Chlorella protothecoides
tgaatgtcgaagggctggatcgcgtcccccaccagcacgaagcccagcctacatgctggcg

SEQ ID NO: 46897 - DNA, 61 bp, Chlorella protothecoides
agaccctgtcatcctgaggatgaacccactatcaactgcagccctgggctactctctgggt

SEQ ID NO: 46898 - DNA, 61 bp, Chlorella protothecoides
cacgacgacagacacccaaccatgcatcgcacgcgagagcatgctctggagccactgagtg

SEQ ID NO: 46899 - DNA, 74 bp, Chlorella protothecoides
attgagatcacgcgctatactttgacgatgggcagcccgcagtcggcttcacgttgcgacttggagcccgcgcc

SEQ ID NO: 46900 - DNA, 72 bp, Chlorella protothecoides
ccttcaactcacaccacaacgcatggccacacattataagggagggctgtggctgtcgccgtcgccctctgg

SEQ ID NO: 46901 - DNA, 61 bp, Chlorella protothecoides
gatgtgctggacggcctggctcccctggacatgccgggcatcctcgtcctgtccgccagct

SEQ ID NO: 46902 - DNA, 77 bp, Chlorella protothecoides
gcgcagggttgctcctgctgccctgggacgcgtttggttcgatcttcaggatgccagcacctgagtttgaggcaggg

SEQ ID NO: 46903 - DNA, 61 bp, Chlorella protothecoides
ccagggggggcactggagcgtctccaagcacgagtggctctaatgatcgagacacccagac

SEQ ID NO: 46904 - DNA, 61 bp, Chlorella protothecoides
cggtggtggtgctgatgaaccagatgctggtgaaggagatgccaaacccgatgaggccgct

SEQ ID NO: 46905 - DNA, 61 bp, Chlorella protothecoides
cctgtgtaggtggaaagcgtggcgcggggtgtcatgtgcgagtgaaggacaacagacatgt

SEQ ID NO: 46906 - DNA, 70 bp, Chlorella protothecoides
ctcgcccatgccgcgcgggttgtcgtcggggacgtgggcaacccagtgccagacctcgggcgccaggccc

SEQ ID NO: 46907 - DNA, 61 bp, Chlorella protothecoides
gccagggacggtggcggcgacagcggggggtgccctcctcccggcgctgctcgccagcctg

SEQ ID NO: 46908 - DNA, 30910 bp, Chlorella protothecoides
  modified_base (135)..(169): a, c, t, g, unknown or other
  modified_base (373)..(382): a, c, t, g, unknown or other
  modified_base (602)..(611): a, c, t, g, unknown or other
  modified_base (1008)..(1017): a, c, t, g, unknown or other
  modified_base (1165)..(1174): a, c, t, g, unknown or other
  modified_base (1256)..(1265): a, c, t, g, unknown or other
  modified_base (1786)..(1966): a, c, t, g, unknown or other
  modified_base (3222)..(3363): a, c, t, g, unknown or other
  modified_base (3537)..(3546): a, c, t, g, unknown or other
  modified_base (3882)..(3891): a, c, t, g, unknown or other
  modified_base (4196)..(4205): a, c, t, g, unknown or other
  modified_base (4489)..(4498): a, c, t, g, unknown or other
  modified_base (6987)..(7096): a, c, t, g, unknown or other
  modified_base (7981)..(7990): a, c, t, g, unknown or other
  modified_base (8117)..(8126): a, c, t, g, unknown or other
  modified_base (8295)..(8390): a, c, t, g, unknown or other
  modified_base (9133)..(9142): a, c, t, g, unknown or other
  modified_base (9543)..(9552): a, c, t, g, unknown or other
  modified_base (9788)..(9797): a, c, t, g, unknown or other
  modified_base (12254)..(12457): a, c, t, g, unknown or other
  modified_base (12975)..(12984): a, c, t, g, unknown or other
  modified_base (14541)..(14550): a, c, t, g, unknown or other
  modified_base (14972)..(14981): a, c, t, g, unknown or other
  modified_base (15321)..(15330): a, c, t, g, unknown or other
  modified_base (15436)..(15445): a, c, t, g, unknown or other
  modified_base (18497)..(18506): a, c, t, g, unknown or other
  modified_base (18609)..(18618): a, c, t, g, unknown or other
  modified_base (18679)..(18688): a, c, t, g, unknown or other
  modified_base (18983)..(18992): a, c, t, g, unknown or other
  modified_base (19353)..(19362): a, c, t, g, unknown or other
  modified_base (19790)..(19799): a, c, t, g, unknown or other
  modified_base (20111)..(20120): a, c, t, g, unknown or other
  modified_base (22215)..(22224): a, c, t, g, unknown or other
  modified_base (22712)..(22721): a, c, t, g, unknown or other
  modified_base (24105)..(24114): a, c, t, g, unknown or other
  modified_base (24604)..(24613): a, c, t, g, unknown or other
  modified_base (25154)..(25163): a, c, t, g, unknown or other
  modified_base (25416)..(25425): a, c, t, g, unknown or other
  modified_base (27067)..(27076): a, c, t, g, unknown or other
  modified_base (27767)..(27781): a, c, t, g, unknown or other
  modified_base (27848)..(27857): a, c, t, g, unknown or other
  modified_base (29531)..(29540): a, c, t, g, unknown or other
  modified_base (30422)..(30431): a, c, t, g, unknown or other
  modified_base (30668)..(30677): a, c, t, g, unknown or other
gggcgccgtcccgcacccgccgcgcccgcgcctcgccgacgctgtttgcgcccgcctcgtctgccgccggctcggcgcgatctgagcctgcgctgcggcggccgacgccacggccccgtccccgccccccggcgnnnnnnnnnnnnnnnnnnnnnnnnnnnnnnnnnnncggacccgcggcctctttgggccggcacggactcaccgagaggtgcacggccctcgcctcgccccgcttccacgcctgccgcggctgcgtcccccgcgacgaatcctctcgagactccccggccgcggccacgggccccgccccgtctgaggtcgcgccgctgcgcatcgcggaccggcctctcgcccaccacctcccactccnnnnnnnnnngcgcctgccgcggctgcgtcccccccgacgaatcccctcgggactccccgaccgcggccacggggcccgccccgtctggggtcgcgccgcggcgcatcgcgcaccggcctctcgcccaccacctcccactcctgggtggcgggggccggttcaccggctgcctcctcgcccgcaatggcggtcatgaggtcctcgggcgacacccggaggtgcagcagcnnnnnnnnnngccggctgcctcctcgcccgcgatggcggtcatgagatcctcgggcgacacccggaggtgcagcagctcggagtgcagggtgggagtgtgcaccgccgcatcctcggcatccggcagcgtctctgccgagctgctgctgctctcctgtactccgtcgccggcgtgctcctcggcctgtgcaagggcaaggtgccgcgagcaacacagactgcctcaatcgattgccacggcacaccaagcgatggcgcgtctcagggctggacagaggagccggctgtttcccggccccggcctccgtacagcccctcaacagcccccatccaacaccaagctgccctcccttaccccccaacccaccttggagtgcacctcggccaggcgccgctctatcgcctcnnnnnnnnnncctccgtcgccggcctgctcctcggcctgtgcgagggcacggtgccgcgagcagcgcaggctgcctcagtcgattgccacggcacaccaagcgatgccgcgtctcagggctggacaaaggagccggctgtttcccggccccggcctcnnnnnnnnnntcgctccccctgctcagcagcctcggcctcggccacctcccgccggcctgcaggaggatcgtggaggagggcagggctgaannnnnnnnnnccgctcctcctgctcagcagcctcggcctcgaccacctcccgtcggcctgtaggaggatcgtggaggagggcagggctgaacacggagctgcatgcaacgcacagcctcccatccccctggcccgcctgctgcctgcgcatccacaaaacccgagacacgcatccccacacaagtcaccggtctgcttctcacccaccacctttgcccatgccagttcagtagctcctcggtttgccctccggctttctccatcgaggccagcatccccctccccaagacctcccccagtccacctcctgtctcaaacgccccctcccccacaccactcacatgccgccgccgccgtctcggcctggcggtggcagggccggagcaggggctgccagacggggacgcaggccggcgccctcgccgccgcctcggcgcggcccagccggggcacggcgcaggcgcccgcccccggcgcgggcaggaagtcgacgacgaccaccgtcacgtcgtccttcaggcggtccttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccacagtccgtcggaggccaggatcaggcgcgcgccgccgggcggcagcacggccgcgtggacctccggcgtgcctaggacgcgcgggcccgccgccgcgtcgcccagcgtgcgtgacatggccagcccccccggccagacgcgggtggggcccgcggggcgcccgttgaccgtggagggcgcgacctcgccccccgacgccaggatgcgcgccgcctctgcctcgctgtcctccaggcggtggttggcgctgactgtgagcacctcggaccccgtgtccagcaccgcgaaactgtcgcccacgctgctcaccagcaggtgccagccgacgatgaccgccagcgtcgcggtggtgccgccggtcttgaaccgcgcgcaggcgtcggcgttgcaggcctcgaagccgtcgacgagggcctgcggtcaggagggggggggggggcgcgggttgaggggggattcggtggacagagaaatgggtttgcagggggtggagatggcgctgaggggcgtcggcggatggggacatgggcccgggtttcccacgcgccacgatgagtgggcggcgcaggcagaatcaggcccctccacagtgttccaagtctgcagtcaagcctgagtcggtccgctcagccagccggccactcgtgaaatgacatgaacaccatgcagccgcacctggggcaggcgtcgggccagcagggactgcagcgcggccacggccgccagtccagggggcagcgagtccgcgtctggcaggctgggcaagccacgcggcccgggccccgacgcggcatccgccgccgccatgaccgacttgagcagggagttggacgcaaaggtcgccacgttcctcccgccgtgcccatcgaagatgccgtatgcggcaaagctggtccgttctggatacagggtttggaaggtgcgaagtcgtgaaggagaagagggtggggctcgggggccctgtgtccagaggcagagtccgaggtgcctgaaggaccagatcctctgatccagaccgcaactcccctgctgccatctcacatatggctgctacagagcacgccgcaccatgcacaaccaaagctgcccttgggccataccttggctgccctccactccccaggagttgttggatttcagcagccactgatcctcgttgctgctcgatctatccttggccaggccagcctgtgcggttggatggggagagtttcatgctgcgcacaatggcccatcgagggtgctggcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggctctataatgggcacatgagggatggcagcagggcacgggagctccgagataccgcacaatcggggcccctcctcctcggcatcttcagaagcttcatcatggtcggaaggcacgcccgcaatggggctggggggaggcgtggcctcaggatcagccctgccctgtgccnnnnnnnnnnagcaaggtacgctcgcaatggggctggggggaggtgtggcctcaggatcagccctgccctgtgccaggtccggctcagcagggtgtggggagggaggggcaggcacctcggcctcgtcaccgcgctcctccttgcgagctgcctccctcttccgcctccgcttcagggcagccgcggacatgacagacgtcgcggcttccgctgctcccgggccttgcccttgaccggtctcgcttctcgtcatctggccagggaggacgcgcaaggccgtcatacatacatttgagcaacgaggatctaacagcacgagctcgtacgcatgcatccgtaccgctnnnnnnnnnngcatacatttgagcaacaaggttctaacagtacgagctcgtacgcatgcatccgtaccgctgaaaaagtacctaagtcctgtcacggagttccccaaccaagcctggctgctctcttactgtctgcacacggattttgccagcacaaagctgccgcaatgctgatctgctggtttcgtgtatgtattcgaagaggacgcagtgatccagccagccaaacatgatgccttgcagcgacgacacggctgtggattctccggttgtctcctcaaagttacaagaaagcaggaaacacctccagcgccnnnnnnnnnnaccaagaggacgcagtgatctagccagccaaacatgagcattgcagcgacgacacggctgtggatgctccggttgtctcctcaaagatacaagaaagcaggaaacacctccagcgcccaattgtcatccgtgctgacacacccgagcaaacctgtctggcaccttggtcattgatatacggtaccagtcgaactttgcttaccacttgccatatattatcgtgagttattggtgcaggagacctctgcgaccatccaaacctgacctcgctcttcattaagcgnnnnnnnnnngcagtcgaactttgctcatcacttgccatatattgtcgtgagttatcgcagcaggagacctctgcgaccttccaaacctgacctcgctcttcattaagcgcgccaccgggcgcgaccctcacctcaccatgaggcgcttcgccatactggcggagcaggcctccaaatcaaggtatgcatcacactgggcgggccgcaatgcttctggacctccctgcgaccctcgtcgcggagccggggccgggcggctacccctcacctgccacaccgtggcgcgggaccaggtaccgagccctcaccccccgaacatcactccacaggattgccagcggagcctgtgcggaaaccagtggtcgtgccctcctcggccgcgcgggcctggccgacggtgcgccccgctccgtggcggacctggagcaggtccccaccctggtgcgcagcatctggggccgcggctgcgagggcgtgctggcgggcctgcgcccgggccaggccgcggcgcgccagctggtccggcgctgggaggacgcggagctgcggctgatcgcggtggccaactccctggcctccaagtccggccagaaggtgctggcggtgggcatcccgctggccgccgcgcagctcatgggcctggggcgcgaggcccgggcctacgccgtgcccctggaggcgcagggcgaggcctcttcacaccacccgcgcaagccggccggcggcacgggggccgacgctctgcacgccgcgcgccgcctcgcgctttgcctgctggccgcggtggcgcgcgaggcgctgctggccgcgcgcgccgccttcctgggcctgctcttcctccccgccctgctgtccagcccggcgctgtggtgcggcgaggccgcgcgcggcgcctggctgcgcctggcctgcggcacgctcgcccgctccggccccgccttcatcaagtgggcgcagtgggcggccacccgccccgacatcttccccgccgacgcctgcgcggcgctggcgtcgctgcaggccggcgccccggcccacgcctttgcccatacccgcgccacggtggaggcctcgctgggcgcgccgctggagcgcctcttcgtccggtttgaccccgagcccgtggcttccggcagcatcgcgcaggtgcaccgcgccgtgctgtccacggaaggagcggccgccgccgcccccccacgcgacggcaaggctcgcccggttggcgcgcggcgcggcaaaccttcgcccttcgcccccggcgcggtggtggcggtcaaggtgcgccacccagcggtctgcgatctgatcgagcgcgacatcacgctcatgcgccgcgcggcgcgcctcctggagctgctgggcaccggcggccagctgcgcgagagcgtgatgcagttcggcgcgcccctgcgcgagcagctggacctgcgccaggaggccgcacacctgcagcgcttcgccgccaacttctcgggctggcgcggcgtgcgcttcccgctgcccgcggggccggggctggtcgcccccgacgtgctggtggagacgttcgagggcgggcagctgatcgcgcgcttcctggagacggagggcgcgcgcttcaacaagcgcctggccggcctgggcctggcctgctacttgaaaatgctcctgcgcgacaacttcctgcacgccgacatgcacccgggcaacatcatggtggacctggagcgaccggggccctccacctgcctcggcgcactcgccgcctggacggggtgggacctgcgcctgccccgcctcgtgctgctggatgtgggcatgaccgcgcggctgacccccgccgaccagggccggctggtcgccttcttcggcaacctcacccgcctggacggccgcggcctggccgacgccatcgtgtccttctccgatgcgccgccgccgccgcgcgccgccgccgccttccgcgcagacctgggcagcctgttcgacgggctggacgccgaggccctgcgcgccgacaccgcgggcgtggtggcgggactcatggacgccatccgacgccacggcgtccagctccagggcgtggtctccaccgtggtcatcaccacctgcgtgttggagggctggtccacgcagctggacccgggcatccgcatgatggagagcctgcgcgacatcctacccagcgcctggggggagcgcgcggggcgggcactggactccgccttcaccaagtcctccctggccatggccgtggccagctgaggcggcgtggggggttctggagtcaggaacctgccagtgcatgcagaggccggcctcggcagccgcgggaagactggaccccgccgcgccagcaaaggcccctcctcagcagcagccacttgtagaaatgtgcggcttgtccccatctccaccccccttgcagcgaacgaacatcgaatgtgcatcaattttcccatctgcacaagtccccttttccggcagcgcctgcagccgtgcgcccacttgcgctcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcaaagtcagtgggtgtcaggttgttccagagtcaacgtgtgtctggtgtttcggaagttcaagccaatcacagcgagtcgagagccgtgtggtcctgggcaaggggctccgcggcggcctcacctcacggggccggagcaggtggcgtgcagcgccaccccgcatcaacaccgacccctcactcccggtggcgcttggcgcgcgcggcctcggcatcggccaggtaccgcttggcgaagaccttgaagtagaagttggccccgttccaggtggccaccaggaggattgccaggagaaccatggtgtggagccaggggtggtcccagagcagctttgtgggcagcaaagacacccacgccgccgtcatgtggatgctgaggtacagcaccggctgcggggttggagggagtgggggtcggaggtgtttggagaggggaggggatgaggagacggggaggatgcttggtgaaggcacgggtgtggggacacggcacacaagtgcaagactgagaagggcgccagcaacatgtcacaggacgcgctttgcccagccacatcagaaagccacagccagccccagcacctacctgcagccgcggcggggctctgagcacaaaggtcgacagcggggacttcttgcccttcagggcagggccactcaccatctcctcaaacctgcatggaggggtgcattggggacgggatcaacccagggacaggagtgttgcctagccgggcagagaacacctcaggcaaagcaccgaggacttgagcttgcacaagggagccaagcagtcggccctccagcagcaatgcattcacgcggcagcgacgtccctgtcctccccacttacatgttgctgtagccccgggagcggatgnnnnnnnnnnattgaaagcattcctaccaggcctcatacagatgggctggggcggtcgaggccctcccccccccttggaaaagcaaaagcaatcgtgtggttacgtagcgcctgcttgcacccaccagcacatagtnnnnnnnnnntgttgcacaagggagccaagcagtcatccctccagcagcaatgcattcacacagcagcgatgtccctgtcctccccacatacatgttgctgtagccccgggagcggatgtgcttctccagcaggatgaatatctgccagggggagggtcaagcatgatgtcacgacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgccaaggcccacgccaggtagaagaccatgggcagcagcgccatctgcgtccagctgctgctcccaaaatcagccagctgatcgggggacagccctgcagtccactccggtcgagggcgccatctcatcgtcctgaaggtaagggaggggggcggggtgagggcagccaaggggaggctatggtgagaggtttgacaaggggaggggcggatggcgcgagcattctctggataggagcagtgctcgaatgggagccagtgtgccagctctcaatgcccaagccgttgcctggaatcggtcgatgtagacccgccctggtccacgatcttacacccccgctggaagaccacccactcaccaggccaagatcgccggcgaggcatgcatcatcaacgtggtttgctgcagggaggatgcggagcgaggtcagagccttgcaggaagtcaaaggggcctggtgctgcgtcgccccttcctgtgcctgctccccgtcccctcgccctcccatgctgaaaaccaggcaggcagcctgcgcagatgcaaagccaccaagcacacgcccacgcctctctcgattccccaagcatgccacacactgcccctgctgccctccgtaccgcaccttgtcgacatcgtggaagaccagggagttgcgcatcgcaacgatggaccacatgaggggccccgccatgtgtgcaaaggccagccgtcggagcaggggggaggagggcacccagaagnnnnnnnnnnggcaacgatagaccacatgagggggcccgccatgtgagcaaaggccaggcgccggagcaggggggaggagggcacccagaagatctggagggctgccaggatgttgccggcgtagcagaactccagcatcatgtagtgcaggccgcgggagcggtaggagaaccagcgcatggtgaatagggtcaagcacttgatgagccagcagtactggtacgtgctgggtgacgccccgagccagaaggccaccagcctgagcatggattcaggaaagggggatgtgtggatcgggggtgtgggtgtacaggggtggacagggggtccaaggatgccctggcatgggtaggggactccacaggggccctctggtcgaacacggcaggagtgagggcgctggcaagggnnnnnnnnnnttagtgtgcatcgggggtatgggtgtacagggttggacggggagtccaaggatgccctggcatgggtgggggactccacaggggccctctggtcggacacggcaggagtgagggcgctggcaagggaaggcagtgcactgtgcgcatgcaggagcaatgttcatagcgccgtccgccctgtcagtccccggtcccagggccgccgatgctatactcacgcaacgttggccactccnnnnnnnnnngtagcgccgtccgccctgtcagcccccggtcccagggccaccaatgctatactcacgcaacgttggccactcccagcgtgaaggagaccttgtccagcatgtggacgtcgccccgcagcatgcgctccccgatgcgatgcaccgcgccagagctggcggcgcgggcgagtggcgccgaggcgggaccggctgagggcgaggcggccgtgatctgcaggagatcagggcgggaggctgtgtttacgaggagaatgggtcgcgatggtgtgactaggtgagaaaggaccgggatggggtggcagggaggggctcctgggcccttaagcaatgaccaccgggtgaaaaccctaggtgcactcagagcagccatcgcgaccccgtgccacgcggatttcacagcagcttcggctccctacctcctctttgccgtctccaggggtttcatcggaaaactccttgccctcttccagcacctttgcgaggacctccacctccttgtctctgtccaagaactccgcgaggctgtcaagcgcgaggtccgcctcagtccacgtgcgactgatgaggtcctgtgccgcatcaaaattctccttgaacgttgcagtggtgctcagggtgcggcgcggtagcgcggtgtccatggtgtgaagcaaaagttacggaacgacaggtggccctgacggtgagactgcccaccaagacgcaccaaacccagtgcgctcctggtcaaaccaaggcaggaatttggaaatggggatggtcagggggcagcaagctgcacgatatgcgcggtgcatggggtggtcgcgaagtcctcaaagtcacatcgaggagtactgcgcgctagcatggcgggagaagaacccctcatcgctgtcggggggatgcacgacgagacaccaaagccacacaggggcaccacaaggtcctttgcaatcgggcctgaggcaattctgttaaatttaaaggattagggcgcgcacctgggcgcacagtgtggctcttgaatcgccgtaggcgtgggcactgggcaccagggtttgaactttcccttcgacacaattcgccggggcctgggaacaggaccatcgcccgcaccgctctgcgggtagcatggagccttcgagcggcatgcgactggcgagagtacctcgaagcctgctgacgccactaactcggcccctggccaggcccttccgtcagcacccgggggatggtcgcaggttcggccaccgaatccccccccgcacccccgccccccctacctgcgccgccctgacctctgagtcgccctgctcccaggccccgacctccacgcccaccaagctctacgacatgaccaccctgggcaacctgtgtgtcgacgtgctggtggaggtgcctcgcctgcccgatcccacggcgcacccagcgctcctggaccggctgcgggcgacgccgcccggccctgactccctggaggtggggggcagcggcaacgccagcatcgctgcggcgcgcttgggtctccgcgtctgctgcacaggccctctaggcagggacctttacggccagttcatggcatccgtgcttgccgtgagttgccttgttgggggagggcgggtgggggagaggtacgggaagggcatggagtagacggagggaaaatgcgggagcgtagaagcaacatccactgcctctctgcgtgtatgggtgaagcggttctagattcggagctcatgttctgtaccacagcttgcggcatgcagacgatgacactgtgtggggagccctgcaatgcaggactctaaaaccacaataccaagggcccacatctcacactgccctcgactgggtgtcatgtcagtgtcactcccatcacctcgtccatgacctaatagacctatacaaacacacacacacaccccaaaacaacctcacacaggccgagggcatccggctggcccgccccgcggccccgccctccctaacctgccacgtgctggtggacccggcggggcaccacgccttctgctccgcctacgatcacggcccctggccgctgctgggcgacgcaggcgccgccttcgacgccgaggccctgctggccagccgcgcggtgctcgtgtccggggtcctgctggacgaggcccccccggcccccgtgctggccgcgctggccgccgcgcgcgccgcgggggccgcgatcttctttgaccccggcccgcggtcctggaccttccagacgcctgcgcgggcggccgcactggccgcgctgctggcgctgtcggacgtggtgctgctgacagaggacgaggcggcggcggtgacgggcgtgcgtggcgcggaggcggccgccgtcgcagtgctgcgtcgcaatggctgcgctgcgcggtggtgtgcggtgaagcgcggcgcggcgggcgcggtgctggccctgcgtggcgcagcggacggcgcgggtggggcgggcggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgctggccaatgcggtgggcgccgccacggcgtgcagccggggggcgggaaggagcgtggcgcacccaggcgcggttaggcgcctgctggaggcgcaggcgggggcggggggggaggggcggggtcccgcgctcggagccctggccatgctctccccctgccacggcgccgaggcggggagggacggccgcgcgctggcggcggaggtctgagctggagcaggggctaggtggccggtggagagtgggaggcaggagtgtctggcgcaccagccacacatccctcgtcctccccgcctgccgccgccatgtagagtgtcttttcccgtgtgccacctgaaccatggcacgaaattcactcccattcccgccgctgcccatcgctatgacgagcgtctctggccattccccctcgctttcttctccacccctgctcctcgcacacagcggcaagacgcgcattcctgccgtgtgcgctgtacctcggctggggctgggccgttgacagctgccaacnnnnnnnnnntccctgctcctggtacatggcggcaagacgcgcgttcatgccgtgtgcgctgtatctctgctggggctgggccgttgacagctgccaacctctctcttgctaccatgcgtcccttcctcaagtgactctcctctcgacccaagttttccaagcacatgtacacctcatacatggtcacgggcaaggggcggctgccagggctcacatgcagtactagtgaaggcatcgagtcacataccagctgcgggttcctccttacatgcaggatggcatgcgcgcaatgtgcccttagattgcaaccaccccttgcctgtgtgcaagcatgccgcacaacccacgtgcagtgcagcccatccagtcctctcacaaactcgaggtggagttgaggtccagataggagcccagggcggtgttgcggttgcgcaccgcaaaggcgacattgatggcctggaagagggaggggcggtcgcagctgtgcagcgtgacgcccgtggcttcatcgtagtgcgggcagaacaggagcatgagctccaccgccagcctgcatggcgggagcatgcgcgtgaggaggggaggtgggcataaggccgcgagggggaaggggctgcctgaacaacctgcctgacaggggaatgcggtctacaagtggggctcagggccaaggccatttcccccctaaacacacagatttagaacccagacctacgcccctcccactctaccccactaagtagtcttcctttcttccaaggtcccacctggtgctgccgatgatgatgatgacggcgacatacttcatgacgcgtttgatggacttggggtaggccctctcccattcaaagcagtggtacttggcctccacacacaggccaatgaagtcaaacacaaagcccgtgatgagctaagggaggggtggggcaatggtggagatgacagcctggtgcgagacctctggtgggttgttttcaacggctgggaatgctgtctgtaatcttgaagctactccagatggagtcaatgagtgcaatccagacctgaatccttgctgctgcgatgtccttgggtggcctctccccaccactgtcctgggccccgttgccacattctgttctacatgttgccaggatgacctgatccaatccagtcccttctcccaggccagcaatgcgccaggcacccccacgcacctgcccgccggcattgatccagatggccgagtggttgggaggctggccaggcgtcagacccacgcgtccaaaggacatgagggccgacgccgcaaggatgccgccattctctgccagcgaggtcgtgaacagctctacaaaccgcatctcctccaccagctgttggtcgtgaggggtatgtggggaggggtagaggatgcagggagccgatgtgccgctagcatgatctgcccccatgcaataatcaatccatgcgggaccctagcaggagccagcttggaaatggtggaccgtccaggcatcacagaaaatccccaaagcacccgggacatctcactccttccttctcaacgcacatatctggcattgnnnnnnnnnnaaatccatgcgggaccctagaaaggagccagcttggaaatggtggaccggccaggcatcacagagaatcccaaaagcacccaggacatctcacttcttccttctcaacgcacatatctggcattgatggcctctgcgccgcgcgcgccgtacagggtgctcatccaaaggtcgtcggcgccccggtccgacaggcgagctgccagttgcagcgagcactgcatgaggttgatgaggaagacagaccccaccgagtccaactgcatattggggtaggggaggctgggctcagaatgcaggacaagggctggcactgagagtcccaggacaggcatgtcgacagatgacccggcagctgcaaggacggatgttaggtgatacccttactgaaccccattcaaatatctaccaggcaggcagccnnnnnnnnnntccggcagctgcaagaacggatgttaggtgatatccttactgaaacccattcaaatatctaccaggcaggcagccagctgtcacctggagaagcaggaagcgaccgaatatggaggagtagagggccgggtagagcacgaagcagacttgcatgaggtcgggcacggatcctgggcgggagggggagtggtgggtggtatggaggttcgtttggggctcatcggatggcagacacgcagtgtcagaccctcgaaggaagcatagccccatcagacccccaagactccgccctttccaccctgcaagtcggggccagggtctcaccgctgtgcagcatgannnnnnnnnnacccatgccattcagcgcggtagaggagcgtgcggtgatcagactgcggaagcgcggggcagggtaggtggagggaatatgggtggcaggaatgcggatgagagannnnnnnnnnaaagaaagcatagccccatcagtccccaaagactccgccctttccaccctgcaagtcagggccagggtctcaccgctgtgcagcatgaactgacggaagagcatcatgaccgcgctccagatgacggggtggatgaagaggcgcacgatggtgagtcccatgccattcagcgcggtagaggagcgggcagtgatcagactgcgggagcgcggggcagggtaggtggaggaggaaatatgggtggcaggaatgcggatgagagacaggaggggcgatgtgggagctcacagttcattaggttgcgcgcgcccattcacggcagtaggggtttggcggggcatggctaaagacacaggcagcgcagagacaccctcccagagcacgcaccctcctgcccgccgggtgccagagtatttgcacgtctgcagcagtcgctgtcaccaccccaagcactccctccccctccgccgcgcctgggcatgatttggaggtacaccgtggtcacgccggcgcagaaaaacatgagcgcaatccagcggtagcccatgatcttgctgccggtgtggagctggacgacttgtgcgatcacaaacacggcggtgcaggaagtccacgctgtagtgggcaagagggcaagaggttggcactcctatcctctctgagcttccaaatcagagccttctcttttgagcctgcatcaattcgacatccccaacacacacggaactccagtctcactcgacaagaaggtcagccacaggttgctgaagctccaatgcgtcaaagggacagccacaagcacgacgatggcgcacgctgcggcacagaccgagcaggctatcaggtgcttccgctggaaacccttggctgtggtggttcaaaggaaagttggtgatcgctggacatgtccactgactcaggcagcgcccagcgcatatgagtgtgcatgccaggagcggcggcagtacattgggtcctagcgtgtattggattcaatcccaaacactttcctgaagagcatgatcctcttgctacaaaatatgcgccagacttacggcagagcaccttcccaatgatggtggggaacacagtgagccagctgtactggacggcgtagaagatgagccagaagatggcggcgcccctggatgtcacaacattccctgtgttccatcccttcaacacgcagctcttgaagcctacgatcatcgactgtagggcagatgtgggcaggagcgtaacctgtgacatcaaagagttaagtgccagcaatcgactctgacagcgtcagggagcagaaacccatcatattgaggcctcaccatagagtccttggcatccgcgttgcacagcaggcgtgggatgagggccgccatggcggagaagcaggcaaacatgaggacggtgacggcgatctccgggatcaagtacttcccgtaaaatcttaggtgggccttcaagaccatgcgaccgctgtccttggtcgccctctggatggcctggcaggatccggacttggttcgaccattagccttaatatttgtcgagaaggaccgaaggagacgggagctggggctgccgggttgcactttgatggaggggtcccgccggagggtggtagaccggcccagcaccatcccgacgccagtcttacgaccaatcagacgcgtaccacggcacagagtcaggaatctggaacatgggtcctcatcggaatctcatgccgggcatggcgctgtgggcaccggatcatttgacgaagcggtgggataccgcagtttcgcagcacgccccgcagccgctcctcatcatgaggggaggaactgccgcatctccccgtggaccctgcgcaggtgcttcgtcatccatcctcaccaaatttccgacagtgtgccttgtggctgagtgcaagctttccgtcttcctgttgacgctggccaggtcgggtgtcgtaagtgatctcggcggggaaggacccctttcacacagaatctctcctatctgaaagggagcctacaatgcgggatggccattgaaggatgacaaaacgccgaggaccttgtctgtgaggaggctccccagtccgggctggtttcgccaagggggtcaggctcgtcgaagcaccaccctgttttgatggcgagccaggggtggccgccgtccccctccatcatgagggagcttgtggggatgggattcgatcccacagcggcagccgaggcggtgcgggagacgggcggcgcgggggtccagcatgccataaactggatgctggaccgacccaatgtccctgctgctgccccgcggccggacccgcaccccactgcgggccccctcggccgttctccactggccctctcccaaaagtttgccgcggcatcactcggcgctgcaccccccgggccggcctcgtcagcaaacccggcccgagcctcggcaactgccctgggcggtatcggagtggcagggatcctgcagagggaggagcatcgagccgccgctgccaacaggtgggacggtgggcagggctgacagctgccagggctctgcgacttggcatgcagacgggcccccaccctgcctgacaaccgtcggcactgctcgtgacaccaccatccaccctccctgatgccgctcgtgcaccacagcacgatcgaccaggctttccaagacctgagccagctgatgagcaaggccgaggagatggtaaagctggccgagtacttcaaggagcgcctgcaccagcagccgggggccggagcgccggaggcagagctggacgctgagacggccctggacctctttgatctgggcctggtcaccccagtgaccaaggagagtgccgggcggcagtaccaccgggagcttgctcgacaggtaggagtgacagggtatgacttgatcaggcgaggtacagccatggaacatgatggagtctcaagctagcggcgaggatcctgtttgccgaggtgactgccgagtttaggatgccaggtcggttcctgtggccagactcaacaatcggcaggtgtgcatcgccaccaggctgccnnnnnnnnnnttgacttgatcaggcggggtacagccatggaacatgatggagtctcgagctagcggcgaggatcctgtttgtcgaggtgactgccgagtttaggatgccaggnnnnnnnnnnagccgaacccctgaccccctctcatgccctttcatcacccatggcagctggtggaggtgcnnnnnnnnnncgcccaacccctgaccccctctcacgccccttcatcacccatggcagctggtggaggtgctgcagggcccgcttcagaaggccggcggcatgctgccgctgccggaggtgtactgcctgtactgccgcgtgcggggctcggagctcatctccccagacgacctgctgcatgcgctggagtgcctgccccacgtgcaggcgcccatgcaggtctggcagcatggcgctgggggctttcgtgtgttcctgggcatgggaagccgtcgcagggctccatccagggcgtggtcgccggnnnnnnnnnntcctgggcatgggaagccattgcagggctccatccagggcgtggtcgccgggggcatgatgggcgatggcctgcgtgccagcccccaccgtctgggcctcccagcccatgcccagcctcactccattagccctcgacctcaaccctcctccacaacttacgcagctgagggacttcacctctggtctgcgggtggtgcaggccgcctcgttttcggatgacaggctgtgccagcggattctggacatcctcggcggcgaggggccagccggccagtctctgggccagggactcagcatagaggatgctgccgccatcctgggcacccccagagccctggcggcggagcagctggagctcgnnnnnnnnnncctctgggccagggactcagcgtagaggatgctgccgtcatcctgggcaccccccgagccctggcggcggagcagctggagctcgccgagggcaggggattcctgtgcagggacgatgctgggcacggcagcgtggtgttttatcgcaacttttttgccgccctgtgacaacgtggtccgggagcctgtgcttgtagggctggagtgacactctgcagagagtggggatgggatcctgtgcatgcacaatggctgctcatggctatcacggaggcactcccggaagatccagctgtcgcggagctggtcgaatctggagggaaggcgcgggatccaggcctccgcatcggcatcctgttcacatgtctatgtccgactatgatccccgcaatacccgtatcaaaccaagcactccaaagatctgcctnnnnnnnnnngtacacatgtccatgtccgacaatgatccccgcaatatccatatcaaaccaagcactccaaagatctgcctcctcccatgtcgtctctcgccagcttgcgcaagctcaaagtgtccgagctacgggatgagctctttaggcgcaacctggacaccaagggcgtgaaggaggagctgatccagcgcctcgcagatgcggatggagctggggagggcgagccgaagcctgagggtgaggagcctgtcaccgactccccggaggatgtcacagagccacagcccacagcagaccagccggtgagcgcacccaggnnnnnnnnnngccggtatgatccgttgaatgatgccgatgggaacgtcgagtgcggctggggtcctcaccataatcgagcgatctcataaccgaaggcggagaacggaagccaaggcaccgcacctccagaggtggaggcggcagaagcccctgcctccatggtcagtgccccggccgcccccgaggagcccgcctccagtcaagtgacagaggcagagaaggccaagaggagagctgagcggttcggaatcgctgtggtgcccccaagtgggtctgccggcccggcgccagaggacaaggagaggctcaagaagcgcgccgagaggttcggtctgccccctcccatcgaaacggaagaggtctgttgggaccgctggtggcgtaagtgctgtcctgctggaggtgacgaactcctggcaacccttgggaaggatgtaccaggagtcgtgaaacctatgccaaccctcccatatgactctgtttgaaaccagcaccctcgatctgactgcccccaggaactggagaagaagaagaaacgcgctgcacgctttggccttcctgctcccgtcatcaagtctgaggaggaggagaagaggttggcgcgtgcccagcgattccaggcggcgagcgctggcgtgactggtgagaggttgggggagaatgtgggacgatgaatacatgtttcatttgtgttcttgtaagtgcctttgcctttggatttttctgcttgatattcttcgtggtcctgtttatcagaaacacatgtttcctggcaggcacaaccgaggaggtaaaggcaaagctgaaggccagggcggagcgctttggtatgccactggcaaaatgagccggggggagaatccatgacccctctgtggtggtacggaatgccactgagactctcagcactccaaggaatcctgaaggcagtggcgccgccggctgtgtgcagtgcgtcccaaggattaggtttacgtgcaccttgcaccaggcgtcgcagatgccaagctacctcgtctggagaacccaccttccactgactgatggcttgacaagactaatgaaagaataactacatgtgaattatttgggccaagctttccaaaaacaggtccatgaaaaggatgagcaattttgtggatggttcacacgcaagctgcatcagagaagcgtgtaggcctatttgctcatcttactcgctttgctgcggatttttgttgctgctgagaacctgccgcacgagcaggcgggcgctggggtccagttcctcgacctttgcgtccagcgagtccaggcgctgtgtcagactgcagcaggtcaggtggttgaaagctcagacacgacctacatggcacgtccctgccaactgccagtcgaacccatcttacacatccagatatgctgccaggccttcgggggttgagttcgtttccccaggcagcggggctgggtacaccatatttctcatctgagcttccaggcgggccaaggcccccctgatctccgcatcctccgacccctgctctgcctcaagctgttcaggaggagatttgggggcaaatctgcttggcatatctgtcataggggtgtccatcgctgtctgagatccattcacacgtaaggtcacccaccagctccaacatcccgcgcaacaccgggacgacagacgggtcggctataggctgctccaccatcctgatcatacagtaatactttcacggcatagtaattcgcgatacatgctgcatgatttcgccaaccctgctcagtgcccaccacactgatgtccacattcacgtaactcgaaggcgggggcttgggaggactcgtcaccaatctgattagcaggagtgggtgtggacccttgcagcgaggctcatataaggttaacaattttgaatttgcgatcgggagaatttgtgagaagctgcctcaacagcgctggagatacgccaagcttttggagcagggtcattgctgcacagtacaggctcgacacttaacgacctccccccacctctgacagtactgataccggcatcactactgcagccttcagttatccggggcgagaggatcgggatcaccattccttctcaagagnnnnnnnnnncctttttggagcaggggcattgctgcacagtacagactcgacaccaaacgaccttcccccacctctgacagtactgataccggcatcactgctgcagctttcagccatccggggcgataggatcgggatcaccattccttctcaagagcgacccgggagatgttcagcaaacgcacccggcgaagagcgggtgtctgctggcagccgatgcggcaggcaagcggtcccatcaactcctcagaggacattatgaatgatcccgacaccgacgaaacctcagagagggtggcccgcatcgttcggcacgccatggccaggtgcgcactgatcatcagggtgttggcctcctggattgagccgtcatacccaggggcacccccggctgtccttgcctggttcgccatgtacctaattgtcatgcacccggccgggtcactcaggcctggctgccatgaagcagcactgccagagccctccccggcttgcannnnnnnnnnagccggggctctcaggcctggctgccatgaaccagcactgccagagccctccccggcttgcacagcccctcaccgcgtcgccaccccgcccctcccgccccagggcccccaaggagacgtccgccgcaatcctatcggagctcaaccagctggacagggtgcacctggtgctggccctgcaggccgccgtcgaccgcgaggcgattcagcggcggggcaccgcctgggtggaggacaacatccggcacatcggcagcgggcacccctccagcggcggtgcggcccacaccctgaccaggcgcgctgtgcagaaggatttgggctgggaagggagttgggaggggacgtgctacgagtcgcatgcctcgaaggggtgaaaggggtcccagtgtgcgcacacgcggtcatggtcctcgaacctcacgtccctgcatcttccggacacgcatcgccccaccaacagggcccagatcgccagcgccctggagtaccagcgtgtgctgtccaagttctccatgtctggcgacagcatgcccggcaggcgccagctgctggccgtggcgctggcctccggcctcccctttgtcgggtttggcatcatcgacaactccatcatggtgggattctaggcgcatttcagagtggggaaggggggtcccaaggtgtggggcgcagggtgctgggtttggtctctcgatggacgcggcgcgctcggctctggaatgcatgtgtgagcggcggctcagagagaccctgcatcgccccacctccggaacgccgcctcaattcaccagatcatggcgggggagcagatcgacacgctgctgggcgtcaggctgggcatcaccaccctggcctccgcagcgctgggcaacctggtggcggacgtggtgggggttggggtgacgcaccagatccagagcaacgccaagcgcatcaagtgggccgccccgccccgcctgtccacgctgcagcagaacctgccacgcgtccgatgtgagggtgtggggtttatgcttgttgctgggttggggggaagcatacacagaggaggggaagtgcatgtccttcgcctgctccggagcgccaggcatgagggaatattgcaaggttgtctctcgtgctcaccatccaccccctccggtaaccaccacatgccaacctcgcacagatgcaaagtttgctggggcggtgctgggtgtgtccctgggctgcatcgtgggcatggccccgctggccttcatggagaccgggtttttcgagaaaacgccgccaaaggccccggagggcagcgccgccgccgccgacctgatgtccgcatgatgctggggccggcctgcttcccaccctcggcccccctcgcacctgtcctccacctgtttcnnnnnnnnnncctggggccggcctgcttcctaccctcgacccccctcgcacctgtcctccacctgttccgcacccctctttcgggacaggcaatgcaccctcctcggcgcttccaggccagcaattacatgtgtcacagagcgacagcagcccagcacaataccatggtacagggggcgagcatgcaggaaatcaaagaaagcgggggggcctggcccgtgcagcgggatcccgtgcagcgccggccaggcccgcgaaaagtgccggagcgtcgttaacagtgcggagggagcgggcagggtcatggggacggctcgcgaaagcgtttggaaaagggggtggactggtgcgggagaagcatgcatgggaagggcggaggcaacttgggagcgggtgggggatctggcccggggacagcgaggcgaggaccagggagcgcctgcgtagcaggtcctgggaggcgcgcccgcctgccgctggctcgggacccttgagcccgnnnnnnnnnncaccagggagcgcctgcatagcaggtcctgggaggcgcgccctcctgccgctggctcgggacccttgcgcccgaccctcaggcctggctggtgggcgacatcgccagctgcgcgggcgagtccgcggaggccccgtacagcacggcctccccagcccccgccgcggcgccccggtactgcgccacgccgtggtaccccaccccatcgcccctgccctgcccggcgccgctgggcgtggccacgccctgggagcggggcgccggccccgggctgggtccctcgccgtccaggctggcgcgcgagcgcttgtggggcgaggcctggttgctgagcggggaggggggcggggggccatcggaccccgggaccaggctgcgctgcaggccggcagtcagccccgaccgcaccaggctggaccagtcggcgccgcccgcgccgtgcagcgccgccacgggtgcggtgggcgaggggcctgcttttgggtgtgagggggggaagggagtcgggccggtgaggagggtttggcgcggtgagggcctgnnnnnnnnnnggccacgggtgcggcgggcgaggggcctgctttggaatgtgaaaggggggaggggagtcgggccagtgaggagggtttggcgcggtgagggcctgggagcacgcaggggaggagcctgctgcaggcaaaaccaaaggcacgagacttgcaccttcccacgagcataggcaggccacaggggggcaaccccgcgcacacacgttgccagtcgcatccttcttcccaccccccccgcctctggactgcttgatannnnnnnnnnagggggccaccccgagcacccacgtcgccagtcgcatccttcttcccacccccccgcctctggactgcttgatacccctcctggcatcaatactcccagcaactctcctcaagtccaaccccgccccctctcctacaccccatcccagcaccttccgacttcccccccccaaaacacacacacacacacacacttccctccccattcccccaccgcaccctgcagctggtgctgggggcgaatggcgtgggtccccgcgctaggggccggccccaggccattggcgccctgcgggcttagggccagggagggcgggagcgcagccggggtcgcgccctcctgccccttgtaccccgcctgctgcgcgccaaacaggttcagcccacgcgcgatgtcgtcggtcagcgtgcgccgcgcggcggcgcccaggtccagctgccccgcggctgccgcctgctgcgcaccggcgccgttgggcggcatggcctggcccagcgcgcgcagcagggccagctgctgcgcctccagcgcggcctgctgcgtcaggtcctcgagggcgcggcgctgggcggcctccagcagctgcttgcgctgctcctctacggcgcgcagctgttgctcctgtgcggcgcgggtgctgtacgtctccgtgggcaggcccacctgcagcagcctgtggggggatgggggcgacagggaggagcaatcaggttgtgtggcagcagggaggagaaaaccctggactggtcgaggaggcggcgggccctcacaaacagcgaatcgtggcatggatgccgacacatgtagttattccatcaggcagggcgcgtggcctccgagtcctcgcacccccagcagcactcgcctatggcagttgccgcatcgtacgatgaggcagggcggagcctgcacccgcacgtcctcgggtatcgggacctgaggatcgatacgtgtttgggtacacattagttgagcgggcaggggcagggagggcgggcatgctcccctacgtcttcgcatgtcggcgtcatgtgtgcgacaccggccgagaaaaaccctggagccccccatccctacctcgagcagggcgccgcagtcctgtgcctcgcatgcaacacgcacacagagtggtggtgggagggaagggtatgatccgggttgtatcggggatgtctgcgtctgggtggccatcgcgaccacacaggcgcacgcggtgattggctggcacgctcgtcctcccctgtagcctgacccagtcctttgcaagaccctggatgctcgagtgggacgcactttgactttgagcaaaggttattggcgtgtggcggtggcataggaccggccatcggatggtgtgaacgaccaaagtttccgcatgggattcggggtctatttgagatcgcccctcccccctttccgctcgcccccccggccggttcaatacaaaaagttacaaacagctgctcatttggatgatgcggagctcagacatcacgaaccatgcctcgtgcggccaagagggccctcgcatcccctgctagaaagaagtgtgcggccacggccaggagggtggccaggagggcaaggatatacgcaaggtgcgcccccagggagccgctggggacgcgagtcagcacggcannnnnnnnnncggccaggagggccaggatataagcaaggtgtgcccccagagagccgctggggacgcgagtcagcacggcactggcatctgcggaggtggacagcacccacttctcgtcaggggagaaggcgatggccgtggcaaaggtcatgtgggcacctcggcgatgcagcaccctcctgagcccgcctgccgtcaccaccacctggtccccgtcgggcgtcacagcccccagcaggcgcccgctggggctggccacgaagccgcagatgggggacctcgtgacagggcctctgcttcgtgcctgtggaagggacagagaggaaagcagtggagtcggtcaccgcctccatccctcatccggcccgaccctcccatcagcaacaaccctggagcatgtgcgacgccgcagacacaggttccacacgccctggcaggcatggatctccctgcgttgcccggccagcgcatccgtatcggcacgtcagagccactcccagccccacaaacagccctgacccagggacaccctcgctgcggcgcctccccacctccagacggatctcgccgctcgccagctggcgccagcgcaggatgtgcccctcccccttccacttcaccgcggtgtagatagcgggcccagcgccctcggccagcgtgatgcacttgaagaaggtcgcacgcggcatgtctgcgcggnnnnnnnnnnnnnnnttgccccacacatcacccgcctccacgatttcccccccttcccccattcctcaccctgcggtacggnnnnnnnnnncctaccagacgcgcatcgcctcactcctgccaacaggcgcagggctcccacacgcagcgtgccctgccccacacagcacccgcctccacgatttctcctccttcccccattcctcaccctgcggtacggccagctggagcaccttatcccctgtctcggcattccagagcgctgccatccccgcctcgtccgtcgtggtgaggatgccgtcgctgtgggcgcgcgacaggtcggccgcccgaatggccttgtcctctgacgcctgccagtgcagcttgggctcaagggagggccagtgcacgatgcgcacgctgccgtcctccccccccatcacgagcaggcgaccgtcggaggagaaggagaggcacttcagggcgccgatgctgggggccctggacgcaaagctgcctgtggggtgtgtggcggcgcggcagtggatgcgggccctgtttaccaccccggcctgtgccttcctccaagcgtcccacgccttacctcctgggcgggagagctccggcgcatctctaccgctggtgctgggctggaggtccaccccctgcacccctccgcgggtcatgcccaggaccagagatcgtccggatgggtgcatcgccatgcggtagggagcgtcgtcgccggtgttgtatttggtgacctcatccgacagcttgcccctctcgtcgcagctcacgacgaccaccctgtgtgtgtgtgaggggggggtgcttggggagggtgctgaggggctattccagatggtcgtctttactaatgacatggaattgcatgcacaccacccatgcgcacttgttctctattccgaggttgcccccaccagccatgtacgcgtgagggccgtctggccaggccacgccatacagaggcgccccatacttttggagtggggcacgccgcttcatcctgagagtagtgtgcagatcgaaggtggggttgttgcgcccatgcatggccgacttgcggaggttgcgagagtggacagatcgtgcacagcttgaaggcgtggcgcaagaaaggaggacgaggatggtgctcaggactgtggtcaggctgatgtatactctaaggattattattcacgtccccatcgatccatcaaacaccttgaaagtcctgtgtcgctctctcacaaaaaggccaagcaagggcaggcatgcctgctgtcagcgacacggctcacaccttgcgcgcccgcgtgcgctgcttggtggcgctctccaccaccttctcctccaccggcaggcccttgcgccggcgcgtggcgtcgatcagcttgcgcgccaggttcgccgcccccacgccctgcccctcctcgccccactcctcccgttccaacaggctggtggggacgaagaaggggtccacccccagccgctcccagtggctgagcaggagggaggcggaggccgccccgctgctgcgccgccgcagctcatccacgaacccaaacgagctctcggcgggcaggtaggcgtgcactgcggggggtggagataggtggtggtttggggataggcataggtgggcgtgaacttgcgggccggtcaggcgctgcatgtcccaaggggtttgagcagcccgccagcgccgctcccccgcgcccctgcctgccagcccacccacatccagacacccccccgcctcacccatgaacannnnnnnnnnctgggtgtgaacttgcaggccagtcaggcgctgcatgtcccaaggggtctgagcagcccgccggcgccgctcccccgcgctcctgcctgccagcccacccacacccagacacccccccgcctcacccatgaacaggtcggagccttcccgcagctcctcccgcagcaccctcgcccgccgtcttcccagcacagtgtacaccgcgctcagaccctctgaggacgtcgcgatctgcagtgggaagggggaaaggggcgacagatctgtgctgagtgtctgacctggagtatgcgacagacccttgcccatcacacgcttcagccccccctggtccccgccagctgacccacctcgcacaggtacatggcctccacgagccggggcgcggaggcggcgagggcgcgtcgggccgcagcgcgcacagcggccgccacctggccgctgagaggcccgtacacgtcctcgcccgtgcgcggggcgggggaggcctcgtccccggaccccaccaccctggcctccacctcgaagccgacgccccacatgggctcatcgcacagaggccctgcctcggtggccatgccgaagccagccaggaccccggcctcgatgctggagcgtgggttgcagtgtgaggggtgaacgagggggcaagaggttgggtgtggcagggtgggggcttcgcaaacaaagccgggaatgtgtgtaaaaaacaggcggggaaggagcaggggtgccaggcaggagcacagttaccaacggtacgagctcgccaccaaggccagcgggcacaggtctaggcttcagaagcaccttactgctgtgtttaatatgcacctcgccaccccccccatgcctccagtacatccccgcacatcccgtgcnnnnnnnnnnctggcttcagaagcaccatacctgctgttttgaacatgcacctcgccacccccccttacgcctccagtacatccccgcacatcccgtgctcaccctctggcatgcccccgaccctccctctcactcacctgtccctcagccgcgccacgcccccggcagacaggcccagagccgttccctgcgcgtcaacctccgcgttcccggcgtgtgcgcccccctgacccaggcagaggaccnnnnnnnnnntcggcagacaggcccagagccgtgccctgcgcgtcaacctccgcgtccccggcatgtgcgcccccctgacccaggcagaggacctgcgcaacctccggccggcccagcgggatgcgcagcgtggcccgtgcctcctccaccgcctcgtcagctcctgccccctcggccggcgcggcgccggccgccaccgggcccacgacggcggggctgggcgggcgtgcgccgcgcccctg

SEQ ID NO: 46909 - DNA, 61 bp, Chlorella protothecoides
ggggaggggcgctgggagtggatgggaggggtctgcgctgccggtatccagtagtgccacg

SEQ ID NO: 46910 - DNA, 63 bp, Chlorella protothecoides
tcaagacggcaccacgcacggcggccctggtacagatgaaaggtacgcgtgagggagctggga

SEQ ID NO: 46911 - DNA, 75 bp, Chlorella protothecoides
tcggcctgcccagcagagtgtgaggtgcttcctgtgagactgccagcaggagagcagggtgtgccaacgactctc

SEQ ID NO: 46912 - DNA, 103 bp, Chlorella protothecoides
tgcaatgcatggcttcccagcacccgtattcgggtaccttcccccagcaagagcccctcacccgcctcgccacgggggtggcttcgtgcatggcggccagatt

SEQ ID NO: 46913 - DNA, 110 bp, Chlorella protothecoides
tgagggtgcggtgtcctgcggttcgtgggggaaaagggccatccggtcgtggtgcgtcccacagaactggaggtcctgatgattggtgagggctcgggccacactccagg

SEQ ID NO: 46914 - DNA, 61 bp, Chlorella protothecoides
gccgcgccaccacgaggtggacgtggcgggtgttgtggcgcgcggcacggccgccgcgctg

SEQ ID NO: 46915 - DNA, 76 bp, Chlorella protothecoides
cagtgtggacatggatctttgagcctgagattatgatgtcgagcgtgagtctcaggtgtgagggtgaggtttatca

SEQ ID NO: 46916 - DNA, 61 bp, Chlorella protothecoides
gaccaaagaaacagcaggtggaagtggctttttgctgcagtcttgcagcgttcttgctctc

SEQ ID NO: 46917 - DNA, 61 bp, Chlorella protothecoides
atggcgaagatgaggatcatgaaattgatgacctcgtcctgccagccgtatggatgcacca

SEQ ID NO: 46918 - DNA, 61 bp, Chlorella protothecoides
gcgggcaggacgcgccgcacgtggtggccggcgccgaggagggcggccgcgcggtgggcac

SEQ ID NO: 46919 - DNA, 65 bp, Chlorella protothecoides
ccaagaacctttcccctcctccctcgcccaggaaccattcccctcctccctcgcccaccgccctt

SEQ ID NO: 46920 - DNA, 61 bp, Chlorella protothecoides
tccagaggtaggagaacttggtgtcgtccttggccgggggcaggtccccatcgcgcacgcg

SEQ ID NO: 46921 - DNA, 70 bp, Chlorella protothecoides
cccacggtcggagccagaggaccccccccccctactgcctacctgtggactccccaatcaaccccagcag

SEQ ID NO: 46922 - DNA, 61 bp, Chlorella protothecoides
accctgcaagcccaccacagtacaggcaggtgcagatgggagctggaggacgtctgggaca

SEQ ID NO: 46923 - DNA, 923 bp, Chlorella protothecoides
  modified_base (143)..(175): a, c, t, g, unknown or other
  modified_base (292)..(301): a, c, t, g, unknown or other
  modified_base (747)..(756): a, c, t, g, unknown or other
gccgcggcgccctcggccgcgcgcagcaggccgcgccgcgccgcggggcgcaccgccaggtgccacagcgccgcggctgcgtgccgctggacctctgggtccggagcggccgccgctgccgccaccgcacgccccagcgagannnnnnnnnnnnnnnnnnnnnnnnnnnnnnnnnggcagtgtcgacgactgcggggcggggacaaggccgtctgcgacgtcacgcgcggcgcccgtgccgcccgcatccacggtccctctcatggcgcctcctcccgcgcccgatgccacnnnnnnnnnngggggggcctgggggaggggcgtcgccgtctggcgcaggcagcgtcgacgactgcggggcggggacgaggccgtctgcgacgccacgcgcggcgcccatgccgcccgcatccacggtccctcccatggcgcctcctcccgcgcccgatgccacgtcgtggtcggtcctcaccgccggctcctcgagggcatcgccgctcagggtgcctccctcctcgaccagctgcgggcgcccccgccggccgtccgccgcctgcgccggctcctcccggcctcgccattgctccgccgactcgccaccccgctccccgcgctcctcgacgcccccggctccacgctcccctccttcctttccttcctcgatgcccccgtccccgcgctccgcaccccacggccccagcgacaggagctccggctccgtgcacgcggcggccagcgcggccgcgnnnnnnnnnngttgctccgccgacacgccaccccgctccccacgctcctcgacgcccccggccccacgctcccctccttcctttccttcctcgacgcccccgcccccgcgctccgcaccccgcggccccagcgacaggagctccggttccgtgcacgcggcggccagcgcggccgcg

SEQ ID NO: 46924 - DNA, 61 bp, Chlorella protothecoides
tggcagccgccgccctctgctctctgccctacaccgcctcatcggccgcgctgcagctggc

SEQ ID NO: 46925 - DNA, 61 bp, Chlorella protothecoides
tgctggttgtggcggatctgacgagggggggctgtgggacttgggcccaatcctgttgctg

SEQ ID NO: 46926 - DNA, 123 bp, Chlorella protothecoides
tggcctacttcagcctgcagcagggctttgtggatggggtgagggctggtgcagatttgcgggactcggtcatatcttttcagcatgcagctattggctcctgacctgacaggcatggagtat

SEQ ID NO: 46927 - DNA, 18362 bp, Chlorella protothecoides
  modified_base (170)..(179): a, c, t, g, unknown or other
  modified_base (596)..(632): a, c, t, g, unknown or other
  modified_base (1674)..(1683): a, c, t, g, unknown or other
  modified_base (4322)..(4352): a, c, t, g, unknown or other
  modified_base (4440)..(4449): a, c, t, g, unknown or other
  modified_base (5009)..(5018): a, c, t, g, unknown or other
  modified_base (6423)..(6432): a, c, t, g, unknown or other
  modified_base (6782)..(6791): a, c, t, g, unknown or other
  modified_base (7624)..(7633): a, c, t, g, unknown or other
  modified_base (8134)..(8143): a, c, t, g, unknown or other
  modified_base (8879)..(8888): a, c, t, g, unknown or other
  modified_base (9241)..(9250): a, c, t, g, unknown or other
  modified_base (9670)..(9839): a, c, t, g, unknown or other
  modified_base (9965)..(9974): a, c, t, g, unknown or other
  modified_base (10177)..(10236): a, c, t, g, unknown or other
  modified_base (12715)..(12724): a, c, t, g, unknown or other
  modified_base (13701)..(13710): a, c, t, g, unknown or other
  modified_base (14098)..(14107): a, c, t, g, unknown or other
  modified_base (14426)..(14435): a, c, t, g, unknown or other
  modified_base (14542)..(14551): a, c, t, g, unknown or other
  modified_base (14735)..(14744): a, c, t, g, unknown or other
  modified_base (15216)..(15225): a, c, t, g, unknown or other
  modified_base (15611)..(15620): a, c, t, g, unknown or other
  modified_base (16181)..(16228): a, c, t, g, unknown or other
  modified_base (16309)..(16318): a, c, t, g, unknown or other
  modified_base (16890)..(16899): a, c, t, g, unknown or other
  modified_base (17048)..(17072): a, c, t, g, unknown or other
cgggggagggaggcgggtggcgcgccggcgtcaggaatagacgcgggcagggctgtactgccgccgatgccgccaggccccgacgcatgcccccctgcgcccatgggctccgcgtctgcgccgacgcccgcgcgcacatccccccgccctgccgcccgccgccgccgctnnnnnnnnnngcccccatgggctccgcgtttgcgccggcgtccgcgcgcacacccccccgccctgccgcccgccgccgccgctcgtacacgacgatggggagggcccggatgtcctcggcggacatgccgccggggccccgccccggcgccggggcgacgccgccctcgatacgctgccgcctgaccagccacaccgcaagcatgacgctgaggaccatgcaaatgcccagcgtgccgatcatgtcgatgaagaaagcgtccacggactacaagagcatggaggaaggggtgggtaagtgtgtgttggatggagggaataataattgcaagggccatcttgctgtgcaagatggtgcagcaagccctccccggcctcaggttcaccagtgaacgagtctcatcgtccaccccccccccccccccccnnnnnnnnnnnnnnnnnnnnnnnnnnnnnnnnnnnnntaccctctccaccggctcacattggtgatgaacacgcggctgatgccgggctgcagcagctgcttgagcatgatgccggacttgagggaaatgaagacggcggggatgccggggtcgagcgcgcccagcggcttgctcatgatgatcagcgggccgtcgctctggtcatgcacgatggcggcggaggcaccggcagcctcggcgtgggccacctgaagagaggaggggaggaaggtgggaacattcttcaagaaacgtatcaggcatgatgcaaggcaagaccctctgacgctgctgggagcatttcccccaatcagtttggccggcagcatccaggtacttggagcacccacccacccgagcttctctgtgctctgcacgctgccctgcgcccaccacccaccccctcccgggcaccttgcgatcaaaggtgcacgtctccaccagcccctgggtgcgtttgatgagggccacccagcgcttgcccttggcgcctggcggggtggtcagggtggaacatgcgtcctgtggatttgccaggtaaagaagaccctccagcccgctgtctgggatggcaggtccaaagtcagcaggtaactgtggaaggggcaattttatcgatgtgaataggaagggaggtggctcgaccgctgtctgacgtctgggatgcagggttcagggcaagcggcatccaacaggaccacgggcaccaggggtgcaagcaaaaagcaacctccgtcccgcaagctggtataagacgctcacagatgggatcgggtcgaatgttatgttgctggactgcggcaaggaaggggcgagacgtggtcagggcaccttgcgacatgggctgacgcgagttcagcggtacgacacggaatcactcatgcttcggaactggcagcaggccggcgaggtgtctcctcgcagacgaccacaccatttcccttacctctagagtcaccgaggcgccagcagtcttcgaccaggccagcaccaggaggcaagcggcctcgaatgggatgcccagcatgcctccttcctnnnnnnnnnnccgggccgacgaggtgtctcctcgcagacgaccaatccattccccttacctctagagtcaccgaggcgccagtagtcttcgaccaggccagcaacaggaggcaagcggccccgaatgggatgcccagcatgcctccttcctagaccttgctcccgggaaccaagcgctcctgggcccgtccagagtcagtcgataggcgccaggcctataaaatgcactgcatggctcgctctgacacaccctacaccccggtcgtcctcgtatctggcctggctgatgtggtcccggcgacacatcatgcgtcgcgcccgcgcgccctcctgcgtgggatagcttcctcccagacagtgggtggccgaatggcttaacctgtttcgagccccgttgaaatacagcctctacaagccatgatacttatgtctgcatcaaggacatcaggctcccgccgggatcacccatccagccgctccaagaagtcgacatgccctccgctgcccggcacccatgcactctgattggccgcgaggatctccaggccacgggccgagatccgcgcctgcccggcttcagcgcctgcgcccagctccacggcatacagtccggggcccgggggctggttcaggaatgcggcgctgggacactcgatgttcgccccctctgccagcaccaagcggtggggccggcccaggcacgaacgcacagcacgcaagttgccctgcgccagcatgtccctgaccctgctggatgacacggcctcctccccctccgcgccagtcaccagctcctggatgcacacctggcggttggggttgcggtgggcaccctgtgacgctgagtttgctcggccagctcactgtcactggtgctggggtgcaacccacccaccctagccccctctagctcttttcccctcgctgttcccagaaatcccaacgcaatcacctccattcccagctggatgccgcgccgagcgaggaactccgtgtctccggccgccttgtatccaaagcggaagccttcgcccaccacgacgcccgccacacccaggtctttggagaggaggcgcaggaaagcctctggatccatgcctcgcacctgtgacagcaacaatgtggcccacttgcgggaaggggttcccttgggtcttcgaggtgcacagccgtctcaaacagggccctgttccgttcacatccccagccgctccgatggcacccaagcccgatgccaaggtttctggtcacatgtgtggccccttcctcccgtcctaagatccctgcgccccctgcattccccggcagctccaggtctgcatcgcatcgcgcacctcggcaaagggtatgcgcagctcacgcggcgtcaccccgaactccttgccccaggcggacaggatgcgggcccggtcgccaggcgccaccagcggcagccgctccctccagcccagcacggccgccatgccagagaaggagatgagccaggggacgcccggcctggcagccgcccaggcggccagggccgcatggccccgatgcagcgcgtcaaacttgcccagggccacccaggcaccggcggcggggtctggcgagagccgggcgcgccagtctgctggaaagggggcttgtgcatgggcttggctgctgctggggtccagggttgcggggtgggcaagctgccagtcggacatggcgcatgccggaggccgaacaacgccatgcaaggtgcacaccggcaccatgtccatgaggccccacacaggaatctcacctgctcccgtttggctgcccctgatcagcgtgggagctcgcccacgcgatctggtgcacttcaccgatacgaggcgcaaggtgcgggcgcacggactggtgtgcagccccggtcgcagcatgtcaccgacggccgttccggtgcggtgcggggcctccgacggtgctctcccctgtcgggctactgtccccacccagccggcgagcactcatgggtgcatgtctggagccaaggtttgatgtcgcgtcgtggcgttcgaccagctgactcgcgcgatggggcagaaaaagcgatccacacttctatggtgaccatttttgtaggttcaaaccgcaccttgcctcacacgcgtttcaacacggggtatctgcctgggggtactgtgattctaccgggcgcttcagggacaggaggggggggcacgccagcgccaggcctgtcttgcctacccgaccacgaccttgtcatcgtccatgaaggagtaggtggggacctccaggttgtacggggcgggccccttccggatgcggcccgaggtgtcgtagtgggagccgtggcaggggcagaaccagccctggtagtcgccggcgttgggcagcgggacgcagcccaggtgggtgcacacgccgatgacgatgagccactccgggttcttcacgcgcaccgagtcgggctcggggtcccgcaggttggacagctccaccgcgttggccttggcgatatcgtcctcggtccggcgccggatgaagacgggcttgccgcgccacttcaccgtgatggtctggcccggctggatcttggacaggtccacctccaggttggccatcgccagcacatccttggtggcctgcgtttgatttgtttgatttgtgtatggnnnnnnnnnnnnnnnnnnnnnnnnnnnnnnntgaggaagcatccgccgtgataccgaggcatgctcccttaacagcccacacccctatcctccacgcccctgcagcaacagccacccannnnnnnnnnacatcggtgtgtgtgtgagtttactagagggatgtggggaccagtgggggcctccacgcagcctggaacctacgatggaggccagggtgcgatgcggcaaacccacggggggaataaccacaggcagtacgggcaccctgagcaccgaacacccttcgggacgcatgctcgccgctgcatggcagcagtctcacggggaagcatccaccgtgataccgaggcatgctcccttccaacagcccacacccctaccctccacgcccctgcagcaacagccacccaccgtcatgctgagtatgaacttgaggaccgccaggcggacggcggaggcgccgatgaagcgtcctccggtcagcacaaagtatgtgaaggcacgcttgctggggtcgcccggggggaagcggatgtggttggactcatcgtacctgcaagtgcagagggttgagcatgggcggcgagcagagggcgtgtgaggccaagccaggaccaggatccccgattccaactgaaccggttagggccaaaaaggctggggtccatggggctcatctgatggcacnnnnnnnnnnagtcgagccaggaccaggacccccgattccaactgaaccggttagggcgccaaagactggggtccatggggctcatctgatggcacttaaggtgtggcttaactccagtcacacgctaaaatatccactcacgtgatggcgtgggttgggttcttcagggcgtgcacggtcggtggcagcccggatgtgttggctggggacagggcagcgtccgcggagtagcctgggcgtgttgcggggtggtggtggtggtgagcgctgcggatattccacacaaccaactcaggggctacgggaaacacccttgccccagccgatgcctgggtttccggactggaacatgtggggtcaccacggtcatccctgccgaacctccatacctctgcaccaagcgttgacggccggttgcgcggctgccagggatggcacagcactgccgttcaaagtagctgtggcattacaaaagggggcacccgctgccgaggccccgctctgcaaaaaacggggcaggagcgcctgggccgaccggcgcagcatgttgggtcctcgcagatcaccaacaccttatatattctaagcttcctccaacacctctccacttcgaaacgagccccgggttcccagacgtggatttagcgctggcgttgtctgccatgcgcgacagtagtccacccgggtcgaggaaagcggggagaggggtcgagattagtaagggtatctccatacacattgacaactgcccttagcatcctggcctctggtggctatccttgctggttggtaacattctgtgcgtgcacggtcgaaccagcatggcattaacacaagacatggtgcctgcaaaactcttctgtgctgggtagggaagcaaggggcaatccaatctgagcatgggatggaccgccaggtttggagtcggctataggcacctgctcagcccaccaggtgccatatcctgtataagttttcaatccaaactaattgtcagggaagcgtgcaatggatgtggttgtccaggaatatataattgggaagctagtaccaagactgtgtatcgtcatgtctcacaggcgtcaaggaatctgtcgtgcatcattctcctgcccatcctgattggattctgggacagagggcggcggggctatcgtgccccctctctttgctagcttccgcactttgacgggcccctgcatgtcgaagctgttcagcagcatggaagactggccggcccgcgagatcagcacctgtcgtgaatggggcggcaggagcgggtatgtgaatgccaatgaccggaagagggaaccacgtaaccaaccgtgacataagcagcatggtattctcggcagtactcccctccagaccatcctctctgattgtgcatgccagcaccaaaccagtccacagnnnnnnnnnnccatacgcagcatggtattctcgacaatactcccctccagaccatcctttctgactgtgcatgccagcaccaaaccagtccacagaccttgagcggagccgaggaggcggggggaacaccttgcggccagggctcgccgtccagctgcatgtgcgtcttccctgcctcgtccttcaccctgcacacacaggcatgcgccacgggatcgaatacacagtttggagggggtgagaagctcggtcggcggggtggcaggccacatgcccagcacgcaggagttctcaaggagtcagcgcccaagtcgcccacctctcccttcccccccccgccagcccacctgccgtgggccnnnnnnnnnncttctcaaggagtctgcgcccgagtcgccgacctctcccttttccccccccgccagcccacctgccgtgggcctggaactctagctccagctcctccacctggcccaggcgcttgccgtgcagcttgttgctgacctggcccatcaccatggccgtgtgccaaccgttcttgaaccccaccacctgtgtgttggatggcgagaggggtggtcggagggcacgcgggggtgcggggaggggacatggatcggcgcgggggggaggtcctcgtcgtcaggccggcctgcgtcccaggcccctgcttacgccgccccctcctcggccgctggcaccccccctgacctccccccgcacctccacgagcccgtcgctgaagatgggcaccacccgcttcccctgcctcagcccgccgccgtccgacaggccccagatgtcccgcccgccgccgtaggactgcaggttgagcaccacgatggcccgcaccgaggcgggcagcgggatgtcgcgccaggccgggcccccaggcccgcctcgcccgcgcaggcgcacgctgttgcgcagcggcggcgcggcgcagaaccaaccgctggtgcagctgtaccagccgtaccaggcctggttcatcacccgggtctgtgcggcccatggccgggactcgcgcagagcgtggaatccgtaggcggcctccgcgtccaggcccacgctgaagtagttccagaacatgcccgtgacacgggtggccccggggggggtctgcacgtgggggccctcgggtgcctcgtcgcccacggcagcggcggaggctggggccccaccaccaccgcccccctcannnnnnnnnnccctgcacgtcggggccctcggttgccccgccgcccacggcaccggcggacgctggggccccaccaccaccgcccccctcactgcccgcccctgcgaggctgagcgagtggggcaggtgttcgaagaggccgggcgtggggccggccagcgtgatgcgccaggcgtccagcgcacggggctgggcctccgcgtagcgctgcagcgtgtggtacagctggtccgcggcgatccactttttgaggaaagcattgccccagccgaagctgagggccaggtcgttgcccgtgcccagcggcagcaccgccacggccggcgcgggctccaggcccaggtcgaagatggtcttcaggatccaggtgaccgtgccatcgccccccgcacacaagacgcgcagattcctgtgggaggaaaggggggaagacggctgtttcgtgggcaggagcgagggccacgcggtcgccgcaatgctgccgagtgcgggcgccgggcggcaaggggannnnnnnnnnggacggccggttcgtgagcaggagcgagggccacgcgggcgccgcaatgccgccgagtgcgggcgccgggcggcaaggggacggcgacgagcagccctggggcctggcgggcttccccccgcactcgccagcaggccccagggggcattcgtgagcctgcatgcgccgggcgcagaaaccctcgcccaaggccaggccagggcaccacctgcggatgtgcgcggccagcttgtcgcccttggcctccctctccagcaggttggaccacagagtgcgcagcacgggctcgggcctgtcctccgacagatcaaactgcggcgggggtggtggagagcgcgggggtccatggggttgccacatgcacagcccacgtacaccgtggccagagctgcacatcgagtccggaagacagcatccgggtgccactcctctttcactgaagcaccaccaccatcccaatccccttcccctcaccacttgggactggccgaggctgcgggagagcacggtgagcagctgggtgcccatctgcccccctgaccggccgttgatgaaggcgatgaggggggtgtccgccaggtcgttgccgacgtacttcttgcaccccagcaggtactccccggggatcctgcggggagaggggggaggcctcgcacgtcggccaaggggggcagtgcccatgcatgggacgtgtcgacaggaaacttgcggccacgatcctttcccccggcccccnnnnnnnnnntgcacgtcggcaaaggggagcagtgcccatgcatgggacctgtcgacaagaaatttgcggccacgatcctttcccccggccccccgcaacctccgagctcgtgtcgcaccggtacggctcgcgcatgtctgacatctcgcgcagctcctggtactcctgattcgtgatgggctgtgtcacctcgtcaggggcctggcggtgcaggacggagggcctggagccctccgtctcaggtttggacaccattatgtgtaaggtttaaggagaattatcgatcttggatttcgtttgcgcatctactgtgctggaggatctctgtttttaggaggtcaatctgcagatgcgatgtgtgnnnnnnnnnnagaaaattattgatcttggatctcgttcgcgcatctactgtgctggaggatctctgctttataggaggtcaatctgcagatgcgatgtgtgagcgcgcccggggcttctcatagcaattcgcattggcaggtggggaggcacaggttcctccctgggaagtaaacgaggatcctcccgacggcgtcgccgagtggctcccgtggtcgaagttccatccatatgtccatgctagtgttactcaagaactgcaccctgcacaccaatagagcgtttgcgataccaaaaacacacggcagagaaccatgatcaaagggctcgatgcgcgcagaatcgagtattcaacgctgtgtaagttatgtctttattgaagaatctcgacggtggacgtgcagctctgtaaaggctatcggaactatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgatgagagtcggcctcgatcgcgcccaagaagacgtgatacagcattggggagtcaacctgccccattcatgtgacagacctgtcctgtcctgtcccgtcgcctcacctcctcccaccgagctnnnnnnnnnngttcaacgctgtgtaaggtatattgttattgaagaatctcgacggtggacgcgcagctctgtaaaggctatcggaactatatggcgcacaaccagggtcaccggaggtcggtgggtgatcgtcgacgaccttgccctcatccttcggactgtcgccggcctggaacaccgacgggactggagtcgtacatgagttcccatccnnnnnnnnnnnnnnnnnnnnnnnnnnnnnnnnnnnnnnnnnnnnnnnnnnnnnnnnnnnnaccaatctaaattcgatctgcgggtgcgcacatccctcatttcgcgcacatcctgacccatgcgcagctggatgcatgtgggcgggcggatgtgcctgcaaagcagtagtatgggatgccacaccagagtcacgccctgtgtgccagcaaagccgtgggtggtggcccgggagaatctcggccaaaaggttgcggggtcacagggttcaggcatattgtccccattttgctgcactttccggccctcgagaccgccaagtgaggcgtgtcgctccacaacaaccaaccttgcgcttccgcgcaatatcctttgtgggtgccccaggatgtctggtgccccctccaacttcaacgcccgtcgcttcctcgacgaaaatggcatctccggcggggacgccactgcgcatgacaccagcctctcctatgagaccgagccacggcccaggaagctggtcagctccgaggccgagctctcgctgctgaagcagttggacggcggggaccccagcattgcccacgtcgtgtcctaccagttcaacaagcacaggcacaagtgagttgaccggcggtgtgcctgcagcgatcgggcctgggtcgaggggtgtcgccgggtcggattgttttgccggcgcccatggcggataggatgtgccagcaaaattatgtggatcgttaggtcccgccgccattccccggctcactcccccccagctcgctgaccaccttccacctcctttacgactgcaggctcaccgatgaattcaagtcctggggctggttcggctgggcctgctggttcctgccctgcctgggctggctgaggacctaccgcatcaaggagtggctgctggtatgttggattcggtggatcggctgtgcgtgcccacactgatgtgtgccatggtccatacaagctcgtgctctagtggctgatgaggctcatcctacttcagcggtcgcaaccttccacctcctgttgccgccccctggaccccctccctgcccctgcctgctccctgcagcttgacgttgtggctggcctgtccgtgggtgccatggtcatcccccagggcatgtcctacgccaacctggccggcctgccctctgtctacggcctgtacggcgcctttgtgccctgcctggtgtactccctcctcggatcctcccgccagctggtgaggggcttgggttctgcgatgagtgggcctgccctgtgcattgaggggggagtgtggtgcagggctgtgccgtgggcggcaagctacctgcttgtgcacccacccacccacccaccctccctccccacggtcgtggtcatctcaagggcaaccacgcgctcgcaaacaaccccccaccccccccactctaccccttgatgacttttctccttcatgcatgcccttcctccctcctttcctcccccaggctgtcgggcccgtggccgtgacgtccaccctgctgggcaacgggctggagaagatatttggcagcctgtccaccgaccctaacaaccccgaggacccggcgctgcaggccaacatcaactccgcggccatcgaggtggccttcctggcgggggtaatgtacaccggcatcgcactgctgaacctgggctggatcatccgcttcctgtcccactccgtcatctcgggcttcatgtctggcgccgccatcaccatcgccctgggccaggtcaagtacatcctgggcctgaagcttgggcgggggtccacgatccagtccctgctggacatgatcttctccaacctgtcgggcttcaagtggcgcgagttcgtcatgggctacttcttcatcggcctgctctacacattccgctgggcgggcaaccgctttgcgcacaagcgcctcggcttcctccgcttcctgggccccatcaccgtggtcgtcacctccatcgcggtcatgaacatctttgggctgtacaagaaccccaccaccgcctctccctacatcaagcccatcggcaagatccccaagggcctgccgcccttcagcgccaaccactggctgccgctgtacgacgtcagccgccaggtcaccctggccatcatcatctgcctggtggacgtctgcgagtccatctccatcgcaaaggccctggcccagcgcaacaagtaccgcctgaactacacgcaggagctgcgcgcggtgggcgtggccaacctgtttggagccatgttctcctgctacaccaccacgggctccttctcccgctccgcggtgaacaactctgcgggcgccaagaccccctttgcccagttcgtttgctccatgctcctcatgctcacgctcctagtgctcacccccatcttcaccaacatgtcggccaacgtccaggtgggtggtggtttgttgtgtgtgtgtggggggggtgttgctcctgttggggtctggatcgcgaggcaccgggatccctgttgttgatcgctgtgcctgctgctgcgaatgctgtttgttnnnnnnnnnnggtctggatcgcaaggcaccgggatccctgttgtcaatcactgtgcctgctgctgcgaatgctgtttgtttctggcttgtgacctccgtggccccatgtgttttggagtggcaggaactcccaggccacttcatcccactacccttcatttaccatccccccctacccctaccccaacaaacaaccttcagggcgccatcatcatcgtgggtgtgctgggcctttttgattactccgagttcctgtatctgtacaaggtgaacaagctggactggatcgtctggctcatcaccttcttcgtcgtcctcttcgccggcgtggagatcggcatcggcgtgggtgtgggcgtgtccttggtgctggtcatctggcgcgccgccttccccgccatcgtgaagctgggcaagctgcccgactccgcggtctaccgcaacgtcaagctcttccccgacacccagcagaccccaggcgtgctggtcatgcgcgtcgacgcgcccttcttcttcgccaacgtggagtccatccgcgacggcatcgtgcggcgcgtggaggaggcccaggccacgcccgaggccgagtccggtgccgcgcccgtgcgctacgtagtgctggacatgggcgcggtgaccgacgtggacgccacctccatccactggctcacagagttcgtgtacgacctcaagtccgatctgggggtgcagctggtgctgagcaacctcacccgccccgtcctgcgcgccatcaagaacggcaacgtgcaccggcgcctggggcccgaccacatctttgtggacaccaacgatgcggtggtcaccctgtccaccgggctcaagcagggcagggtcgacaaggccctctgaggcaggacgaggggcggcgcgcaacaccccaccccccgagcctcacgccgtctgcaagcaggcggggaagagtgctggcacgccaccccctcccacccggccaacccaaactccctnnnnnnnnnnaacgaggggcggcgcgcaacaccccacccccggaacctcacgccgtctgcaagcaggtggggaagtgtgctggcacgccatcccctcccacccggccaacccaaactccctttccataccaagctgtctcactgtaccgcggtccgttgcctgagcgggtgggcgggaggcgccccccgcaccccctcggctgcactccagtctcccgccccttggaccctgctgcgcacgccccttcctaacttgtgtaccttccgattgttttcccactcacccccgactgacgcttgctcgggagggcaccagggcaggacccctgcgatgctcgcacacttgtgtgtgggaggtccgctcttgcccaccctgtcctctcccacccgtcttttgnnnnnnnnnnaatgctcgcacacttgtgcatggcgtgggaggtccgctcccccccaccctgtcctctcccacccgtcttttgggcgggggttggcggcaataacatggggggcgagcgcttgtgacatgcttccactgcttgttttatgtattacgatggctcagctccttttcgccctggctctgacaacttggttgtagatgcgtctcgcaacgcggcagactatgcgacagggtgggctgcagatccagggtgggcttccgctccgtttggtcggcctccatggcgttgtgcaagtgccaggagccagtcagtcgagagcactctnnnnnnnnnnacatgcacacacgcacgggcaggcaggtccggccccagccagggtggcagcgagagccacgccctaaaccacacccgcgctcagaagcggtcaaaccccgccgcgtnnnnnnnnnngccgctccgtttggtctgcctccatggcgttatgcacttgccaggagccagtcagtcgagagcactctggatggcacctggtgctgcagaattttcaccttgaccccctacccggccccccgcccacattcccccagctgctccctgtgaatcaacgcagaccgtgactcctcgcattctaaannnnnnnnnncatgggcacctggtgctgcagaattttcacctggaccccctacccggccgcccgcccacattcccccagctgccctcccgtgaagtaacgcagaccgtgactcctcgcattctaaatgggcatcgcatgcacacacgtttaggcaggcaggtccggccccagtcagggtggcagcgggagccacgccacacgtgcgctcagaagcggtcaaaccccgccgcgtcgccaaaggccgggggggagggcgcgccgttggatgtgggtgcgggcagcgccaggtaggagttgaggtgcaggtaggcgttggccgcctgctcctgctgcttcttggcctcctcgtccagcttgctggcctcctgtgtgtgggagggggtggttgggagttggcttgggtgagggtgtgacctgtggtttgccttggctgtggcctatggtgaacctgaaggaatgttccagcgatccccggcccaannnnnnnnnncgcctcctgtgtgtgggagggggtggttgtgagttggactgggtgagggcgtgacctgtgctttgccttgggtgtggcctatggtgaaccagaaggaatgttccagcgatccccggcccaaacccatgagcacaaaagttcactggccctgcgctgcctctccgggaggccctcaaccccctcccatatcgtacactctgggtcccagcctgtcctcttgcggcattccagtctagactgccctgcctcgatattcgccgcctctcccctccaatcacaccgacgctccaaccccatcaaccacctcccagtccccccttcccccaccccctgcacctgagcctccttgcgctcatggaccagggtgtccaccttggtggtgtagnnnnnnnnnnggtctggacagccctgcctcgatgttcgccgcctctcccctccgatcacaccgaccctccaaccccatcaaccacctcccagttccccccacccccccgcacctgagcctccttgcgctcgtggaccagggtgtccaccttggtggtgtagtcgcggagcacggagatgaggtagggcatgacggcgtcggtgaggccgttgcgccaggcaacctccagggccacgtcgggcttgaccaggtcgcggcagcggtccaggcactcggcgaagcggtcgtgcgcgccctcctccacgaagaagcgcaggaggtcctcggcgatgccgcgctccccggactgggccgccgtctccatggcgtcctgttcgttcggtgtgtttgcgggtggcacgggtgaggagatcgagggtggtggtgatgagcgaggcagcccctggccaccgtcaggagtgcctgtctgctgccctcaggacgccttgccagacaacctggatgccagcacccgcacagatgacacttcccgaccgcatggcaggaaaatccctgatcccccccccccccnnnnnnnnnnnnnnnnnnnnnnnnnnnnnnnnnnnnnnnnnnnnnnnnaaaacccaacaccagtgctgacctcgtagagcttgtcggtcttggccagggccaccgccttgtgccacttgaggttgcgcnnnnnnnnnnaaacccaacaccagcgctgacctcgtacagcttgtcggtcttggccagagccaccgccttgtgccacttgaggttgcgcttgtagatgagcgcggccaggcgccggaactcggtgtcctcgtgccgctccagccgccccgccagcgccagcgcgtcgtagttctcataggaggtgatgctgtcgcgcaggcccgcggcgtcgccctcgcccacaagcagctcgttcaccgcctcgttcaccgcctgcaggtcgttcttctgcaccgacaccaggtactccttgaccaggggcaactgcccggcgcggcgcatgatgtccaccacgcgcgagtggtccacccgcgactccaccacctgcgagttgggcaggcgccgggtttagaggggaggggaagggggaagggaccagggcgtgcgaaagtttgcgagggacggggccaggtgtcgtacgagaatggtgggattgccagttaccaatggaaggggaaagggatggagtgccaggacgctgccttgccggacatgggagcggccctggccacatgcccaccaattcctttgatccccatccnnnnnnnnnnaggacggagtgccaggacgctgcctcgccgggcatgggagcggccctggccgcatgcccaccaattcctttgatccccatcctgcccgtcgcgacacggccctgtttcaatcaccttgcgtgggccccccccccccccccccccccccnnnnnnnnnnnnnnnnnnnnnnnnncgggtgctcttccaggtagaaggagatgcccttgtacagggtctcggccgccttcaccttcaccgccacgtccttgaactggacgtgctcccaggcagcggccgcgtgccccaccatgacccccagcgcgttgtcgtactcgtcgtaggcgacgtagaggaaggtgagctcgcgccagagctccagctcctcgcagacgcggatgagggcggggacgttgcagcgcggcgcaaacagcttgaggtgctccatgaggcgttccgggcggtggcgcgcgtacagcgcgcccagctcggtgaagatgcccatgtgcgcgcgctccaggccgatgcccgactccagcagcgcgatgagctcgtcggcgtggccgcgctgcgtgtagaactcggccacctcggccaggtcgtcggcggcgacgatgatgttcaggccgcacagctgggccagcttgaactcgccctcctccacgcaggcatagcacacctccttccacgtgcgtgggctgttggccttgcgcgccgcgtccaccgccgcctggtagcggtgcagcttgaccagggtgctggccaggcggccgtagtcggggatggtggcgaagaccaggcgtgcggcgtcgtgcaggccctcctccgcgcagcggtcgcccaccgcgcggaggtcggcgaggtggggggcggccacgaaggcctccagcgcgggcaggtcgccggcgcgcgcgtaggagtgcacgatctccgtgtccaccttggggtccttgacccgcttgcgcaccatgagcaggtacttggtcagctccgcgtagtcgccgctctcgtgcgccttggccaccacctccacgtgcttgctggtgtcgccggcgcggaggtaggccgcgatggcgtccgacacgcgggcgtgggccaggtaggcgtcggccagctcggtccagacgcccgcctcgtccaccttggtcgcatactcgtgcgcgcggtccaggtcttccaggtggtccagcagcacgtggatggcctgggcgcgcaggccaaacttcttgtagatctcgaacgcctcctcgaacagctcgtagcccactgcgatctcgcccactgcggggccgtcaaagttgtccaggcggtggatgtagtccttcacccgcgccttgtcggcctggcggttgtggaggggttcatttggggggtgggggggtgggatctccgaaggggagcattggatcgtcaaaccagggcgcagggcaggccgacctcgctggctcgcccgcaaccccgcgctcatcgttgctgcgccactctg

SEQ ID NO: 46928 - DNA, 86 bp, Chlorella protothecoides
agctaccacaccgagaccccaaacacccccctttcccccctctggctctgatggggggcgcattacacccagcaggcgaggcacgg

SEQ ID NO: 46929 - DNA, 24550 bp, Chlorella protothecoides
  modified_base (119)..(229): a, c, t, g, unknown or other
  modified_base (560)..(569): a, c, t, g, unknown or other
  modified_base (1037)..(1046): a, c, t, g, unknown or other
  modified_base (1268)..(1277): a, c, t, g, unknown or other
  modified_base (1605)..(1636): a, c, t, g, unknown or other
  modified_base (1850)..(1859): a, c, t, g, unknown or other
  modified_base (2710)..(2719): a, c, t, g, unknown or other
  modified_base (2807)..(2816): a, c, t, g, unknown or other
  modified_base (3285)..(3294): a, c, t, g, unknown or other
  modified_base (4099)..(4108): a, c, t, g, unknown or other
  modified_base (4184)..(4193): a, c, t, g, unknown or other
  modified_base (4621)..(4630): a, c, t, g, unknown or other
  modified_base (4891)..(4900): a, c, t, g, unknown or other
  modified_base (5261)..(5270): a, c, t, g, unknown or other
  modified_base (5352)..(5361): a, c, t, g, unknown or other
  modified_base (5727)..(5736): a, c, t, g, unknown or other
  modified_base (6128)..(6137): a, c, t, g, unknown or other
  modified_base (8080)..(8089): a, c, t, g, unknown or other
  modified_base (9600)..(9609): a, c, t, g, unknown or other
  modified_base (9677)..(9686): a, c, t, g, unknown or other
  modified_base (10444)..(10453): a, c, t, g, unknown or other
  modified_base (10813)..(10822): a, c, t, g, unknown or other
  modified_base (11251)..(11260): a, c, t, g, unknown or other
  modified_base (11323)..(11332): a, c, t, g, unknown or other
  modified_base (11873)..(11882): a, c, t, g, unknown or other
  modified_base (12275)..(12284): a, c, t, g, unknown or other
  modified_base (13257)..(13266): a, c, t, g, unknown or other
  modified_base (13323)..(13332): a, c, t, g, unknown or other
  modified_base (14710)..(14719): a, c, t, g, unknown or other
  modified_base (14869)..(14878): a, c, t, g, unknown or other
  modified_base (15188)..(15271): a, c, t, g, unknown or other
  modified_base (18832)..(18841): a, c, t, g, unknown or other
  modified_base (19383)..(19392): a, c, t, g, unknown or other
  modified_base (19487)..(19701): a, c, t, g, unknown or other
  modified_base (19943)..(19952): a, c, t, g, unknown or other
  modified_base (20274)..(20283): a, c, t, g, unknown or other
  modified_base (20549)..(20558): a, c, t, g, unknown or other
  modified_base (21429)..(21438): a, c, t, g, unknown or other
  modified_base (21758)..(21767): a, c, t, g, unknown or other
  modified_base (24169)..(24178): a, c, t, g, unknown or other
gccgctcttgtggcccctggcatcacctcatcgatcggcatcctcggtttcccatctgaggagaccccccaaaccctgccacgcccctgccctgttcatcccccccgcccctgcctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacccgcatgatgctggccatgggcacctttgtgtacgccacgcgcgccatcgccggcttcggggcagctgccgtggcggggcacgagatcctgaggacgctctgggtcaccgccacccaggccttttcatcgctggacattgccacccaggtgggttgcactggttttgtgacgggaggtgcgccaggcatgggaccacggtgtgaagggtggtcacagggacgactactccgcagcactccctcgctacgtcgccaggccccttggcccggggtggtgcctgcctttctattcgagcatcattcgatcacgctcctgcacgcacgcagnnnnnnnnnnaggatgtccctcacctgcaaccatcccgtacgaccagaggcggacgcgctccgccacatggagcacagcaggacctgcgagtggacggcgacacgcggtattggaacaatgcactgaggtctccgcaagccatgctaccgcaatggccagccgaccaggcgcacggggcacacgggagggcgccgagcacgaagccgctcacctcaaggctgcgcgtcttggacaaagggatgcagtaatgctctggttcggtgggcgctccgcgttctcagatggaggaatccgtcctcaagagctccgcagattctgcggcagccaccggtatgcggggttcccggagttacacgcacctccctcgaccctgcaacgcggaggctgggacacaatacaccccaaacatgtccaacgctgatgctcctgcccatccaggtcgtcgctacgcagagaatgcacccacctgcggtatcnnnnnnnnnngtgttcctgcccatccaggtcttcggtacgcagagaatgcacccacctgcggtatcgtgggctgcgccttctccttccgtggctcaggcgctccaatgtatgggcggggatgcctggggtgcgagcgaagcgcgacccgtacaatccttttgatatatctgagggtgttagagtacaccgaaacagggttttgccgcagctgccttgccaactttccgacgnnnnnnnnnntggggatgcctggggtgcgaacgaagcgcgacccgtacaatccttttggtatatctgagggtggtagagtacaccgaaacagggttctgccgcagctgccttgccaactttccgacgggaagggtgctgtcgactaccgctcgcaagaaaaccccaaagtcagcgtatatggccgcatgcgaggagggggcagggaattagcgtcgatatgggcatctaaatggctgtagggcggagatgccttcgattgcgtcgttcctgctgtgcctcacagcaggttgggtgccggggaccttcccgtgcgcgacacgttgcgaccggtgcccannnnnnnnnnnnnnnnnnnnnnnnnnnnnnnntgggagctgggtccggctcgcttcgcggcgtcgcgtgcccatgtaacggggagtgggcgatgtccggtcacgccgaacccatgcaagcccatccccccccccaacagggctcatgcccattgacagaccgggactggatgagggatgtgtatggaactttcacgcgagtactgattaccaaacagaagagcgagggacggagacggtcagccgnnnnnnnnnngcgctcatgcccattgacagaccgggactgggtgagggatgtgtatggaacttccacgcgagtactgatttccaaatagaagagcgagggacggagacggtcagccggccgtggcaggggcaggcctgctctgcagggggctggccggggaggccagcctccaggccgcccccgccagccgccccagggtgaggcccttgagcacggcccagacgcccaggatgccccagccgtacttttgcgcagcgatcaggcccagggccacccccgccgaggtcaccaccatggtcttggacagccaggagatctcctgcgcgcccagcagcgtcccatcgcacaccgcggtcaccgcgtccagcggcatgcccagggccaccagggggagcacctgcgcgacgagggaggggtgacacagcctacatgtgtgtgcgtgatggggcctcgccgctggagcgggtggtcgccgtggatacagggtctgccatcatccgcggcagcttgggcggagcaccccgacccaaagcccccacccaccatcgtgaccaggccctggacggccggatcgctggtgaaaacggtgggcagcgtctgcctgcccgccagcagggccaccgccagcagggcgccgatgccggccgccaggcgcagcacgcgcgctacgatgtcatacgcggtcttcctgtcgcccttgcccaggtagcttgccaccagggtctgcgtgcgtgcaggagcgtgatcgaatgacgctcgaacaaaaaggcaggcaccaccccgagccaaggggctcagcgacgcagcgagggagtgctgcggagtagttgtccctgtgaccacccttcacaccgtggtcnnnnnnnnnnaggaggagagtggtgtcccaggcaccaccgcggcttgccaggatgaggtccccagttccgcggaatgctcgcagggcaccctggcggnnnnnnnnnngggaggggagtggtgtcccaggcaccaccgcggcctgccaggatgaggtccccagtgccgcggaatgctcgcagggcaccctggcgggcgattcacacggacgcggtcccggtattcagccccaggaggcgcgctgcgacgccctcctgcgccagcagagcggctcgagctacaccagcgcggcctcccatgccagcgacctgagcgctcccggcgacccactgccctccccgcccaccgaggcgagcgaggaggagggcgacaccggcccccatgggtggaagcacgtgcccttcaccaaggccgagaccttggccaccgaggcagggctcaggacaccggacgccgcgtgcgacgactcccgcagcctgcactcctcggagtcgggcgggtcgctgcgcggcgagagccccgcccgcagcgcccgccgccggccggagccggccaggcgccggcccggggcccccgnnnnnnnnnnaaagccggcgatggcacgcgtggcgtacacgaaggtgcccatggccagcatcatgcgggtggagagcaagacacccgcccgcaggaggggcaggacctcggccaggtcgggggggcgcagcaggtcgcgcggcctgcaggggggggaggagggctctggcgctcaggcaggggcgggggggatgaacagggcggggcgtggcagggtttgggggatctcctcagatggggaaccgagcatgccgatcgctgaggtgatgccaggggccacaagagcggcttggcagatgctcgaccatgcagggcatgccgcagcatgcatgcaccctgccgcactcgacatgcatcgaccaacacccttcccacctccccaccctccaccacgaggccagtgataccaaaggcctggcaggcctcgcacctcaggtggcccttgcggatgaccagggccccgagcaccgccaccgtcacccagtgggacagggaagtggccagtcccgcacccagcacgccccaccccgcccagtacaccagcccaaagtccagggcgacatgcacgatgttgctcagcagaccggcgatgaggggggtcctggggaggaaggggggaggggtgcagggctaagctcggggcgcaggcggaggacaggcactcgacgcttggcagagggatgggctgaacaaggcaggtggtggatttgggactgggacagacagcacggaacccccccggcccctgaccggcgctgcatgccagagaaccccctccagctcccacatgaacctgctcaccttgtgtccttgannnnnnnnnngtttctgcagaggtgagcgtggggcgcaggcggaggacaggcacacgacgcttggcagagggatgggctgaacaannnnnnnnnnaccggcgctggatgccagaaaaccccctccagctctcacatgaacctgctcaccttgtgtccttgaggcccctgaagacgccggccagcacgtagaacatgaggacggagggcgtggccaggcagcgcgctcggaagtagggcatgcccacggccatgacctccgggccggcgcccatggcgcgcagggcggcgccgccctgggtccagagcagcaggctcatgcccacgcccaggaccaccgccatccagaggccctgggccgccacgcggctgaccgcctccctgtcatcacgccccaccgcagtcgcgatcctgtgcaacgggggcagctagggtgaggaccggggacggcacgctctggctcacgtgcatgctgctcgctccaccctggctcgtatgcatggtccctgcctgggcgtcgtggtnnnnnnnnnnttcgcgtgcatgctgctcgcaccgccctcgctctatgcatggtccctgcctgggcgtcgtggtgaagagcaggaagttcctgcagcattgtggggaggaaggggtggctcgaggtcaacgaagaccccgtttatcccgggagggcgttcttaaaaacaccaaacagtgtccacacttttccttaaagacccgcatcccagccactgctcctcattcacgagatcaacactgccgcaccatatgaagaggctcaggttgaannnnnnnnnnaaagaccccgctcatcccgggggggcgttcgtaaaagcaccaaacagtgtccacacttttccttgaagacccgcatcccagccactgctcttcattcacgggaccaacgccgccgcaccatatgaagaggctcaggttgaacaccatgccactcaggcccactgctgcaaggctggtggtgcccaggctcccgacaatggctgaggggagggggggaggagggaggaggtgacaaaccatcgtgctttggtgaggggcgtccttgagtgcccgctacaattccaggggtgcgagtcgattgtataggcccactcgtcattgcatgctggcatcatggcggcccggggctctcagactcccnnnnnnnnnnaaggagggaggaggtgacaaaccattgcgcttcggtgaggggcgtccttgggtgcccgctacaattccaggggtgcgagtcnnnnnnnnnngtgtccacgaggcccatgaggggatccagcagcacccccaggagggccggcagcgcgatggccatgatctcgccatcatggggattggagaagaagcttggagcgtttgaggcgtgggttatctgcagagcgcctcggcgacggttctggagagcctgtggatatctctggtctgacggccatgcccgtgcgacctcccaaccgggctgagatcgggtgattctcgcgcattgaggcggtcgcagggaagctacaaacatccctcgacagatttggtgtcgatgatgttgcaatgggcacccggcatgaccctgaagtgcctgcaccatgcggtccagaggcccgcagggtgcaactgcggcggtnnnnnnnnnncccctcgacagattcggtgtcgatgatgttgcaatgggcacccgacatgactctgaagtgcctgcaccatgcagttcagaggcccgcagggtgcaactgcggcggtcccccttggagctgtaaggcgattggagactaaagttggaccaatgagtgccctgataacgaacgaaggatgagttccatacgcaatgtgtgtgctgtctccatgcttgagtcaaaaacatgttaagcaccgcttccccttctcggtggcgcccgggcgcgaggtgagaggcagccattcattacaggatacgggcacggcatccacagtcgaccatctagcactctgattagagtttaaaaaatcatttttgtctttcattattgtcctgcttgttacagccggnnnnnnnnnngtctagcactctgattagagttaaaaaaaatcattttagtatttcattattgtcctgcttgttacagccggtgttgatcatccagctcagattcacttcttcaaaccaaacgacatgacagaccgccttggctcatacccctgccggtgctttttacagtataaaaagcatgatatgccacagatttaatcagcgcagatttgcatcaattcacattggttggtggagttggcctgcactagggggtgcacagggcacgtgcgcgtcaaccatcgcggcggtaccatgcaacaactgggcgccctcaaaagatgatagccccaagagcggggctcatgcagcatgcgatgtggtaaacgtgccgagccgctccgtaaacctatttcagagcattggtagatcctagcacgcttcgccgcaccagcaccatggccgacccctcaagctgggtgctgcccgagaagtactcggacgatctgcttgacgagacgggcgcgaagctcagcaagaggtgagtgggacgaacactcgctgtcttcgcccggacgcgaggctgacctgccctgctcaccgcatgtggaaactgtgttcaggaggaagtgcctcaccagccaggcatccagcgccatccgcacgattcccacacaatcccgatgagcagcgagtggaagcgtcgcgtgactcaggcttccaaggagaagaagctggcagagaagaaggtgggcagcgcagtgtgctccatcggtgtgcgggtgacctcatgtgtggggggcctcgcagcttggtaaacctgtggccctggggctgtgaccatcaaggctccttgacaatgtgcgcaggcccggcaggccgccgctgccgctgctgccgctgctgccaaggctgacaagccggcagtggccgctctggatgacgacgccacagaggaaaccgatcccaccaagtactttgagaatcggtgcgtgggtgttgctgaatgacagggcaggcctagccatggggggagtccttgaagatctgcctaggcaccagcagcccgatgcttgcccatcacagccttgctcactcatcaccctcagggtcaaggctgtgatggcagccaaggctcgcggggagaacccctacccccacaagtttgcgaccaccatccagctgccagcgtacgtggccaagtacaaggacctggaagccggcgagcagctgactgacactgaggtccggctcgcaggtaggcagcttcgcgggagagcggcggcgatgtcgtctggtcttgtgcgcatgcctgtgcccttggggatcatcgctgcaaccgcatgcacacgaccccacccgcttccccgcttctccctcccaggccgagtggagcgcaaggcggcatctggggcgaagctggtgttcatcgacctccggtcggccggcagcaaggtgcaggtcatgtgcgacgccaggtgcgcccggggactcatggggtgctcaatggagtgtgagtcgagacttgctggccggcagtgtggtgacaaggagcaccttggacgctcgagatgaaggacccgaggtggtggctgggctccctcacccgaccaacctgcacctgtcccatccccggccccctccccaccaacccccgccaggaactttggcgacgctttccagggggccatgaacgccgtcaagcgcggcgacattgtcggcatcgtgggcttccctggcaagtccaagcgcggcgagctgtccatctttcccacctccctccgagtcctcacgccctgcctgcatatggcacctggcacccgcaccggcctcaaggaccaggtgggggagctcgaggggttgggcgagggttctggtgggggccagggacatgtctccccgggaaaggtcccctgagcacccccccctccctcagagattgctcctggcagcgtgctgtgggctggcgcgtnnnnnnnnnnaaggggtcgggcgagggttctgggggggggcagggacatgtctccccgggaaaggtcccccgagcaccccccccctccctcagagatcactcctggcagcgtgctgtgggctggcgcgtcgtcacctgcctggcctccaacccacgccaacatcacgctttcctcccaacctgcccccgcgctgcgcaggagacgcggtaccgccagcgctacctggacctgatcgccaaccccgccgtgtcagacatcttccgcacgcgttcgcacatcatcagctacattcgccgtttctttgacgaccgcgacttcctggaggtggagacgcccatgatggacaagctggcgggcggcgccaccgcccggcccttcatcacgcaccacaacgatctcaacatgcaggtgcggtgaggagggggcagatggatcaggacaggtactgcagtgtggctgatgcaggactgacagggctgacacgccctgccagcttggacactgagttggtgacaccagctccagaggtctttgtgtttgctctgggaacaaccgagcttgcaaactttgtcgctggagctgccagacccacgagtcctggaactctcggccccttcacccgctccctcccgtccccagctctacatgcgcatcgcgcccgagctgtacctgaagatgctggtggtgggcggcatggagcgcgtgtacgagattggcaagcagttcaggaacgagggcatcgacctgacccacaaccccgagttcacgaccatcgagacctaccaggtgggattcagagacggcgggattgcggggagcaggggtggggctggaggagatgcccgcgggaacaccgagtcatccgagttctggcgccctctctggcccctgccgcctccgccatcgcaccctcgccccagcgcgcccccatccactcacttgctcgtccacaagcacacatgcctgatctcctctcacccctgacacacaccaataccaaccacggcatgcccacaggcctacgccgactacaacgacgtgatggccatgacggaggagctgctgtcggggctggcactgcggctgacggggtcctacgtgatcggctaccaccccgacggccccgaggggcccgaggtacagatcgactttaccccccccttccgccgcatctccatggtgtccgggctggaggaggtgctgggcgtgaagatgccggcggacctggagagcgaggaggcgcgtctcttcctcctggaccagtgccggcggcgcggcgtggagtgcccgcccccgcagtccaccgcccgcctgctggacaagctggtgggggagttcctggagacggggtgcaccaaccccaccttcatctgtgaccacccccagatcatgagccccctggccaagtggtgggtggcgggcgttgttggtttcattgaggtgggggtccgatgggtgtcagggccctggggagtccgagtgggtggggagggctgagccaaacagcttgatcctgtgannnnnnnnnngtctccggcccccatgcggtacacccccgccagactgcattccactactcccctctcctcaccctcannnnnnnnnncgggggtccaatgggtgtcgggatcctggggagtccgagtgggtgggcagggctgagccaaacagcttgatcctgtgatgcggggtcgctgctggcgccgagcatgccgctcagcgaccatgggtcgatggtcaagagcacgcagccctcgacggtccggcagggctgggtgatttccattgccatcctcgcacatcttccgcacccatgcggtacacccccgccagacttcattccactactcccctctcctcaccctcacgacatctccccccaaacaccccaaccacaaaccaaaggcaccgctccctgcccggcatgaccgagcgcttcgagctgtttgtcaactgccgcgaggtgtgcaacgcctacaccgagctgaacgacccgctgcgccagcgcgagctgttcgagcagcaggccgcggccaaggcggcgggcgacgacgaggccatgtttgtggacgagaacttctgcaccgcgctggagtacgggttgccgcccaccggcggctggggcctgggcatcgaccgactcaccatgctcttcaccgacaccaacaacatcaaggaggtgctcctcttccccgccatgaagccggagcaggcgcgggggggggaggccgccgcccacagcaccgccgagtccatgagcacggtgggttggtggtgcgaggggtttggggggaatcgaggggctggagagtgtattaggttgcagagggggtgagtgtgtggagcttggtgatctgtgcgagnnnnnnnnnnggggggagaatcgaggggctggagagtgtattgggttgcagaggggtggagtgtgtggagcttggtgatttgtgcaagggatggagtgttttcggctccacggcaccctgagacaggcagggcatacctggcgctgatgtgcatctagcgaccagcgtttgaacgcttgcacaaccatccccggcggccccacccttccgcagacaaactgagcgctgaggggaaggcatgcatgccatgccattcgggtctgtggcgtgcagaaatggatgttgccagggtgtttgcagggcccacattgttacaaccagacgggcagagagggggattgaacattcaggaaaggagaggggtgagggnnnnnnnnnntgaaggcatgcatgccatgccatgcgggtctgtggcgtgcaggaatgggtgttgccggggtgtttgcagggcccacattgttacgaccagacgggcagagggggggggtgaacattcaggaaaggagaggggtgaggggaagggctggactgggagttgcatgtgtttgggtgcctggtaccggcaggaatctaagatgccagttgcaagcggggctgaggaagcgggagccggtggcgcagatgatcggagcctgatcctagaatatactcgttgtatgcctgcgagcgacgctccacgtcctcccgaccatgccgcgccaaggtccccactcagccccgcacgatggaacgggcgcgcaccgccgctcgcacgatcacacgtcgtccggacacccgccgtcaaagtccttgagccaggggtaggcgnnnnnnnnnncgatcggagcctgatcctggagtatactcgtcgtatgcctgcgagcgacgctccacgtcctcnnnnnnnnnntgcaccgccgctcgcacgatcacgcttcattcgcgcacccaccgtcaaagtccttgagccaggggtaggcgtatgccacctcctccgcgtcctgcgcatatggcgtgccaaactcctccagcatggccgcgccgtcgacgcagcgcgccttgcgccgcggcgcgggcgtgaagcgctgcgcggcggcgtacgcctgcagcatgtcgcgcgtgtagagcagcaggtcctgcatgcgcaccttgtcgcgcacgaaggcctgccccgccgccgcgatctgggtgggggtcaggttgctgccccagcggtacgtcccgcctgcaggtggggatttggagaagggggtttgaccatgcttgcttacatcaggggccggggaggggcgaggaagccaggacatgctggagagcaagaacgggaaatcgaggtggggcaccgccttcgccgccgatgcacgtcggagaggggtggcgcactgcaaagcctaccgagctgcccgcctgcctctgatccccccctccctcctctgctcccacgacaaaannnnnnnnnntggtggcgcactgcaaagcataccgagctgcccgcctgcctctaatcaccccctccctcctctgctcccacgacaaaacaaccacacgcacctcgctgcagctccacgctgcgcgcctccgcgtcgcccgcagacttggccagctccttcaggcgcggcatggtggcccacacctccttggccttgcgcagcgtgggcgtgagctcgaactcggtggcggcctcggccttgccggcgccgccctcccgggccagcagcgcgttcatgtcgcgcaccttttgcggggggaggaaaggagagaggattgatggtcagaatcctgggtgttgccttgcactcatgccagtggggcatttggtagacacatgtggagcttggggtgctgctgcagannnnnnnnnntagaatcctgggtgttgccttgcactcgtgccggtggggcagccggtaggcacatgtggagcttggggtgctgctgcagacggcacggcacccgacgcctggtgacaaaacacgacgcgcacgaacgacaggcctcacacacgtgctgtgcgcctgaatgtcagccacctgggcctgcacgtttgccccctgtgagaacagatttcccggcccccccatccctgccacgaactctgcgcatccacaccaccaggcccctcaccacgtcgacggcctgcgcgcacatctccggcacgcgcgcggggatctccacgtagtgggttcccgggaccagggcccgcgcaaaccactcgtagtacttgatgcccgtggccatgaccaccgacccccccgccagcttgtgccggatgttggacacccaggccaagggttcgatgtgcacctggtagcggtagtcgtcaaagtcctgcatcacgatgggctcccggtccacgttgagcagcgcggcgtcatcctcgcgccccgaggcgcgcagcgcgcgcacgcagtccaggaaggcgcggcgcagcgcgtcgcggtgcgggtagttgctgtccatggtgcgcccacgccacatggcctgcggcagccgcgacgccagcgagacgttggcgtactttgtgagcagcaccgaggcctgggccggccagccgtgggcggggttgccccaggggtccatcaggtagtcgtactcgtgcccgtagtaggtgaagtcggggaggacaaggtcagcgtacccctcgctggtggtgtagccgaacatgggcaccggcgtgcgccccgccccaggctcctgcgcgatgcaggtgaagtcgcccagctgcatcaccgcgtccaggtccgggatctgcgaggacgaggggtgtgatgtatatgtgggtgggtgcgggcgggctggggtgtggcgcaggggtgtgcattcatacttccagannnnnnnnnnaaaggaatgctcacacgcgggccccccacacctgccctgggaagaggcgcaggacgnnnnnnnnnntcatatctgggtgggcgcgggcgggctgggtcggggcgcaggggtgtgcattcatacttccagacccacaccccaccgacgcccaggccaatgctcaccccctcattggcccccgccccccaataaggaaggctcacacacgcgggcccacacacctgccctgggaagaggcgcaggacgtccaggaggaggagcatggcgtagggcacccgccccttggccgccacgtggccaggccccagctgggcggggtaccaaccaaagccccgggcggtaacgtggtagacatagagcttgccggagatgatctggaaacggaacatgtcgccatcgcagatgtcgtacatgttttcggcctcctccagcatttcctgggtgtgagaggaatgatgcgtggaggaaagaggatcaggatcagggaaaggggtgccctgtacaccgtccatcactgcacgcacagctgtaagcagcattatgcctgtctaaccctggctcgcagccgcagcactacgccaccatgagtcctccctcaccagcgtgatgccgtcctgcttccatggcagcatgtccttctctatccactcgtgcatgaacgacttcgtgtccttgagctgcagtggggtgtggggagaccgttctggctcggacctggttgctgccgcggcaggcctgcaccgcctcaaccccccacccaccacggattccgaggagcatggacctagggggaaccgaccccgccccgacaactccatgccctgccctgctcaccgactgcgcgtgctcctggatatactcgctgtactgagatgacacattggcattgaacgaggcccccgacgctccagggaagaggggacgcaggtaggcgtggctgttcttggccacctggacgaagcccccagtccaggagcgggaggaggcatccgtgtcctgtcccttgctgtcgaccgcgtgcaggcggggcagggggaagggcgggtggaagatggcgggtccaacgaagcagaagaagagcagcacccctatgacgttggcggtagtggcccggggcagccagccctcctcccgttggttcctcttcattgcagcaggattacaggcaccaggcgctgtggcacatggtgggggatacagggcacaggggctcggcacagcgttcaactactctgggaatcgaccgggcgcttgacgggcgaacatcgtgggccagcataggacgggccgagcgccaactgggcccctcgctgccgatcaccaggacgcgcataggcatataatggtctgaaggtacgaattatctgatcattacggcctggatgtaggtaggccgctcatcccgggaatcgcggggggggggggggggggtgcgggggggggnnnnnnnnnntggggctgcggaggtgaatcggttggtgtcaactaacctgctttgacaaagagcggcattatatgcccaccactttgcccacatatctaggatgcatctcaacgacatcaattgccctcaatcatcacactgttgttctgaaaggattgnnnnnnnnnngggatgcacctcaaagacatcaattgccctaaatcatcacactgttgttctgaaaggattggtgatgctgcctgacaggtcggcactgagaatggtcagcggccaatattggacaaccgtctctctagctactacacgaaatgattctcctggtaccctcctggcattcggctactccatatccagaatcctctcctcatgggctccctccgcccacagctggtagtctttctcgagctgtttcaggaatcgagggagagccacgtccagaactcgccccagcacagcattccctgcggttggggggtgnnnnnnnnnnnnnnnnnnnnnnnnnnnnnnnnnnnnnnnnnnnnnnnnnnnnnnnnnnnnnnnnnnnnnnnnnnnnnnnnnnnnatgcacagggcacgtaacacaggcagcttgcccgcacctccttcaggtccatttcagacaccgcaccactcgcctgtcgcctggacggcgcctcggggtagcgggaaccagcctgggagctccagcgtgaccgtgaggtcgacgtcgctgacgaggacacgagccccctcctcctcgcccggtttccaactgacccggttcctcatccgggcagtgaacctctcgttggcggcgcgcacagtgcgggaaccccgcagctgcagtggggtcgccggggaaggcatgtggaggctggtcgtgctgctgggctgggtcctttgttgaacatgccaggggtcacacccttcatcagatgcttccccagccgctaggatgcaacactccccacctcggtcttcagaaggtccaccgtggggccggtggggcccacgctgacggagactgtcagcacagggtgaacctcgaagctgaagaaggtgaggcccgccacatggcagaggaaggtgtcgtcgtccaggcgctccacagtttcggcatccagcacggagtattggctggcaggcagggccatgtagtccgctgtgggaggggtggtgggctcgtggctcgaggcacgggcggcagccagagggacggcagggcctggctgcccctggacactcacgaacacaaacacgagtcacagcatcagctcgtcccatggacaatgaacaaagcaatgcacggtacccaccaagggggcgagaggactcttggaggccatgcgttgccacctttgctgccttcaggatggctgtgcgttgttccggaggaggagcggctgaactttggtcctgattctccccatgctgagccgcaggcgcatcctcttccacattccaagtgtgtcgaatggcggcagccaactggtggcgacctgggccgttgcacaccctggtcggccaagtgcggggtctctgtatcaggggaaggcttgctctgggccaaggggacaccttcgtggtccccgcaccgccatgcattgctcgagagccggccaggccggctagtggagcatggatatcgatctactgagaaaccatttctctgtcgacctggatgtcggcccgtcgcagcttcgctacccactgtgatatgagaatgcgcgcctatcgacctctgatgatccggggggctccatgacacgccattgccattcccgcgcctccccatcacactcctgattcccatcaggaagccccttgccacaagcaaacacctccacaattgcaatacattctcctagcagactacaacaagctcttcacgggctgcattgtcgagtattggtggcggtgtacgagacagctccgcctctgcgacctaggttttcattgcggcgggcgtatgtagcgaagtgacgatgcctggcatgggttgagtcagaagtctcgccgtggaatccacaccgaggtgcagggtcatgtggctcacccagcgagcccccaatccctggcctggggcggtgctcctccccagaatctcccggaccccatctgggaaatgcagggcgagggatgaccccggtggcgacgaacttaggtccaagctctccaaatggaccggcctgtcccgtgtacggcgtcaggccccggaatcaggggcccctgcgccgcctgaggccagcgtggagcaggggggcccagcggtgccctcccagtggagtgattgggcaggtgcggggccctggtccctcgcatgggtacattttgagcatgcagcttggcaaacggcgcacttgatagccagtctgagcacttggatatgttttggatgtgttacactgattcatttgcaacaccacctcctcctcgggccgccctttcctccctcaaggccatgaccaggactgggacgagtggaagggcgaggctgagccagacctggacgacgccgaggacattgcagcgctgcgcagcgccgtgatcaagaagcggcgggcgaggaaagggcggcgcagcgtcacgcgagacgagtggctgcgccccatcgtcgatttccagggcatccgcgacaggtgggtgggtgctggtgtggaggtgggtgggggtagggggtgagcgtagacaacgtgaaggggggtccttttgggagcaggctggcaggagcgccctcatgtaacctacaagcctcctccctgacctgctgcgcccttcttcctttccaggctggcctttgatgagcaggacagtgaggagagggtgttcatcgaggccgctaccaaccagtttgagtcgcgggaggccgtcaagtatgcaggtgcaaggacaagggaggtcaagggtgtttgggctctgcattccacggaataactatgtctgccacagtgccggacagaatgtcactaccctgatcccatgggcccctctcccccccttcaattcccgctcagggctcatctttggggtgtcgatcgtcgccggctttgcggtgagccggctgctggcagagccgctgtggacctacgctgcgggcgtcaaccccgcggcgtttgccatgtcggaccagcagaagttcgaggcggttgaggagattcacgccgaggagctgcgcctccagatggaggccacggtgggccaggcgcccccgctgtccgatgccggggtcctggagcacctgcgggcggaggccaagcgcatccaaggtgcagagaggggggccgggtgggggaatgggggtccgggttttggaatctcggatggagtaggcagcctacagtagggcgaatacattctgtgcagcagtgtaactgaggctcctggattgatacggctgagtctcggcgcctcgtgggaaagagcagatgcaagtgcctatgcgtccttgccgagctgtgcaaccgccgacaatcaccccaattcaccctccttatatccctctcctgggcgcaggggagtacaaggcctacaatcgggcggcactaaccaacctggtgtccgactccgtcaccggcagcctcatcttcgccgccctgctgcagaacaacagccagaggaccatcctgttccgcaccatcgggcgcatcctgtccggcctctcaggtgtgcgcgcgagcgtttgttccgtttgtttgccaagcttggagggccgctggagtgatggtatgcctgagggcgtgcatgccactggtccagcagccgcaggcttgtggcctctgctgcagccatgcttgcaatgcactgccgccttccattccccccctctccctccccgcagacaccgctaaggccttcctgatcatccttgtgaccgacacgctgctgggctaccacagcgaggaggggtggactgcggccgcccagctcttcacccagcactatggcttccacccaagcgtgagcgccggggtggggatgggtcgggtgggaggggatggaagacggcgagacctccaggaaccgatcagggggaagtgggggaggtccaccgggaagagcctgcccatggatgcccagcaggaaggggggaggcacatggattgcgtgagcctcaaggcaagtccaaccctggggtcgtccctcnnnnnnnnnnggaaggggggcggcacatgtattgcgtgagcctgaaggcaagtccaaccctggggtcgtccctccacactgccgtgcgagtgacgcctcgaccccctcctctccaccacgcgcattgcaggaggacagcattcagatctttgtgtcaatcgtccccgtctgcctcgactcctacttcaagtactggatcttcgtcggcctgaacaagcaggaccccgccgccgccgtcaccctgcgcagcatggaccgccattgatgcagcaccgccgcggcccgatgggcgcctcgcctggcggggcagtgctgatgactgcactgccgagtgcagccctggagcctctgtcatacaaacccctcacttcacggcacggcaccgtgccctcccccctgaccagccattcacgctcagcttctctcttccgtccacctctcctctcccacccttgccttctccctgtggatctgcacaacaccaggagggacaatggcatggcccaccatgccttgcacgcgctcagcccctgagctgggactttcgggacnnnnnnnnnnggaccgccattgatgcagcgccgcagcggcccgatgggcgccccgcctggcggggcagtgctgctgactgcactgccgagtgcagccctggagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggtgcgggcctggaaacccgccttgatggcagacaccgtccgggaggccccgcactgcgggcagtggggatgggtgtttggaggaaacgggctgagaactgggctccaggatgggggagggggagggtcggggtccctggaaatgagccaggggccgctctctgacgatccccatacctttcagagggcacacggcgcttggcccccagacacacacatgccctcacctgctggcagcgnnnnnnnnnntgtacctctcagagggcacacggcgcttggcccccaaacacacacatgccctcacctgctggcagcgcatgaacatgatgcgggtggatgcatcgcgatccagcaacgtgtcgggtgacttgcaggagttgcacagcacgtacctgggggtatgcatgttggagagaaagggtgttgaaccccggggaaggggggacccaagctgggagcacaagcaggcattgcattgggcgaagaagaggctcggaggccgcatgaaccaggccccgatttctagtaaaaggcttctcactgacgcagggcacttggtgcctgtgcaggnnnnnnnnnntcatacatgttggagagacagggtgttgaaaccaggggaaggggggacccaagctgggagcacaagcaggcgttgcattgggcaaagaagaggctcggaggccgcatggaccaggccccgtttctcgtaaaaggcttctccctgacgcagggcacttggtgcctgtgcagggagcggcacagcacacgcgaaaatcagccctcctgtatcatttgatcccgaatcccgaacacccccacccaaacccactcgttgatgtatcgccnnnnnnnnnnaaaatcagctctcctgtatcccatgatcccggaccccggacgccaccacccaaacccactcgttgatgtatcgccggagcacaccctcgaaggccttgggcaggaagcgccccttcacaatcagtcgctgctgcccatccagggagcctgcggcgtgaagagggggtccgccgtgttccacggcccgcgacacacgcaggtggggcatgccgcaagaggccacagagccccgtgcgcagccagcatcctcccaggcccactttccacccacccggcgcggcacccaccggatgtgcccagctccgccaggaggaaggcctggacgtgctcgtggttcctgttcatggacttgcacagctccatgaagttggtgaacaccgtcttcttggtcccttcacgcgccacctggggcggcttcagcgtggtcctgcgccgctcgcctgtcagctccgggttgttctccttcaggatgccaaacacgcggtctagagggcgggggtggggtggggtggggggacggggagggaactcctgaatcgaacgcagagcatacattcactcacaagagaggggaggagggcgccggtatcgatagagcgccaggacctaaaatgcaaccccccctccactcacccagcagctcttcgtatgtgtagtcgcggtccgacccatcccaggggagccctgccttggcctggctgccctccacactctccgtgccctccgcggcctccagcccaaagtcctcatccttggcctgcgagtaaggggatgagtcatcagacgtggcaggggcgacaagataactgggccgggacaccccgtgccgcgctccccgctcccaccttggccttcttcttcttcttcttcnnnnnnnnnngcgtggcaggggcgacaagataattgggccgcgacacccccgtgccacgctccccgcgcccaccttggccttcttcttcttcttcttcttgcccagctccatgctgaggtccaggtcatcctcctccagtgcctcggcctcatctaccagctcctccttgatcttcaccgtcttcttcttcttctgcggtagtgaggggcggtaggagggtgtggagcaagtgacctacggtgggggcctgacgggattctggacaaagcaatgaactattatccggaccccagttcggaccgcaccttcttcccaaactccaggttgannnnnnnnnnggtgaggagcggtaggagggtgtggagcaagggacccgcggtgggggccagacgggattctggacaaagcaatgaagtattatccggaccccacttcgcaccgcaccttcttcccaaactccaggttgagatcatcgttcactgcagattcaagggggaagcatatgtaggggaacgtcaggagtaacctactggcctgggggacggggcagctcctcagcagcgatttttaccgctcaacgtgtccatgcagggacagctgatcttacctgcgatgtctgccaccccttccgtaatgttctcgacgtcctcgctctgcaggggagccgaggcatgacttagaactcgaccagtccgcccatcgccgtcgcaagcaccctcacctcacacgcccactcaccgccatgttgtgcttcccaccagctatctcgaagtagttagtttctcaagtagaaagctgactgcttctgacaagactccacattcttcgctggattaagagactggtgacccggccggcagggcgcgtaaagtgatggctctctcgaacgtgggacaaaagcagtgctgggctgttgcctcgccgatcgctttcctccaccccacattgctgggcaggttgatacattactgctgcactctggtgctcgattccatcgcctgactgatcacatggtgggagagccgacgctcgcgtgatcgagttcggcacaggcaacaccacccatgggggttgggcagtgtgcacttgcgtgcgtcctcctgaccaccctggtgctgctgcatccaagtctggctgatgtggggaggggtgcagacatccagctgcgagccaaatggaattccagcacctttgcccacgaggcagcggagttcctggtgggtgaaggtgttgtcatggggcagagagcttgagtaggctgcacgagcaatgctgcttcggcgtatgagaagctggagaattcatttcgtagagctttgccgcaggcagtccacccagcgccctgcagagcaccaatcatgtgctttcctcgcaggctgcgcaggacaccgccgcgttctggagctttgcaggggctttcaccctgccgcaggacagcaccgactgccttgaacacgtgctgcggcaggccaggtccttgctccacgacgagcccagcaggaggttgctgggggtcgaggtggctgcgcgcctgcacagccccagggccgagctcttccacgccgcagcggcccgtgagctgggggacgccagccccagcatgccctgctgctgggccagtgtgggcggcgcccccttcctgtccctgtcagcgctccgagccgcgctggcggcgcctgcgacgggccgcgcgagcgagggcccaagggcgtttgatcacgtgcaccccgggccgccagagggggcgccagaggttccctttgtggccctgtatgcgccgctggggaacgcgtgcggagccgccttccatgcagagctgcgggcgctggccagcgcaggtgggcatggcttggggtcgtgaggggggggagggggagcggaagggatgcatcgcaagggatctcttcgttggaggactggtggtgaaccctgtgcaaacccgtcagtgaggagaggcggagtcgtggaggcgtgggagcctgtccatgtcagcaagcaccaagacccaccctcgagaccctattcaggcaaaatcacctacgcctggcggcccctggccacggccgcgtgtgcgggtgacgacagctccccctgcttgcatgctggctcctccctggtactgccggggtacggcgtcgagctggccatcaagaacatggagtacaatgccgcagacgacaaggcaggttgaggggggaggaggctgtgacagggcggggagagagggcgatggaacaatgctgacggtggagtaaaagactcgttcatctcgcatgggaaagggtcatgacgtctccgacatctgacgactgtccctcttgtccccatacgcaggggtctgagccagcgtccgaggccgcagcggacgcaggtggggaccctgcgggcgcagaggacaccgcgccttcaggcactgcagccgtgggagccgcacgcgtgctcgccggcgagggcgacctggaggccctgcacgcccagctcgaggcctggagggacagcgcggcggcggagacggtgctgaccaagcgccagctccgtcggttgggcctgcaggcggccgcgcgcgtcgccgaggcgccggcctccccgctggcggtcctcgtggagctggcgcagaacctgccgtcatacgctgccctcttgtcagccgtgaacgtacccaagaacctgacgtgcgttgggggctggtgcaagggctgcaccgggccagggctctgttgttacgctgtctgcctgactnnnnnnnnnncccctcctgtcagccgtgcacgtacccaagaacctgacgtgcgtcggggggttgtgcaagggctgcaccgggccggggctctgttgttacgctgtctgcctgactgggcggcgacacccggtgcaccaatcactcaccgagccatgaccccgtgcagacgggcggtcgacctcctgcagcgcctcctcccccccgcctccggcatgctggcagtgaatggccgcctgctgcgcgcccgcgacctctccctccacgacctgctgggcaaggtgcgcgccgagctggccctgcacgcggcgctgatgcgcgaggcggggctgggcgccggcgccgcgcgcgccgcgctgctggcgcgcaccacgcggggcgcag

SEQ ID NO: 46930 - DNA, 13367 bp, Chlorella protothecoides
  modified_base (129)..(138): a, c, t, g, unknown or other
  modified_base (222)..(231): a, c, t, g, unknown or other
  modified_base (771)..(780): a, c, t, g, unknown or other
  modified_base (2194)..(2203): a, c, t, g, unknown or other
  modified_base (4529)..(4538): a, c, t, g, unknown or other
  modified_base (5743)..(5752): a, c, t, g, unknown or other
  modified_base (6091)..(6100): a, c, t, g, unknown or other
  modified_base (6557)..(6566): a, c, t, g, unknown or other
  modified_base (6962)..(6971): a, c, t, g, unknown or other
  modified_base (7615)..(7624): a, c, t, g, unknown or other
  modified_base (8883)..(8892): a, c, t, g, unknown or other
  modified_base (9099)..(9108): a, c, t, g, unknown or other
  modified_base (10923)..(10975): a, c, t, g, unknown or other
  modified_base (12391)..(12400): a, c, t, g, unknown or other
  modified_base (12692)..(12701): a, c, t, g, unknown or other
  modified_base (13040)..(13103): a, c, t, g, unknown or other
gacttgttgaaggccggggcgctcgccgactcgtggcgaggcccctacacaagacgggggagcataccacctccgacagaactcacctcatccagtcgctcacgctgcccctacatcgctgagaagtcnnnnnnnnnntaggcatcaagaatataaagcatgggtgccaggaactgaagccaccggaacatgacttgttgaaggccggggcgctcgccgacnnnnnnnnnnagaatataaagcatgcgtgccaggaactcaagccaccgggacacgacttgttgaaggccggggcgctcgccgactcgtggcgagtcccctacacaagacgggggagcatcccacctccgacaaaactcacctcatccagtccctcacgctgcccctacatcgctgagaagtcacagcattccgatttgtaagataaccctgtctcctgaccgcattgcagactgcgataggccggggcaggaggtggatcgccctgcaggggccgggggcccggctgcatggacgagggcaaaatatgccagcccgcattgcccagctaccgcggccgcatgcctggctggaagctggaacagaaagtatggtgttctgtaatgtcatcgcacgggttcgagcgtcacatacgttcttggaggtgcctccgcctcgcccatcgacgaagatgaagattcctgagtttacaacccggcgcgaacgcggaggaggcagcagccgggggggcacacagatttcacacggcacatcaccccaaagccagccttnnnnnnnnnnagcggaggaggcagcaggcggggggtaacacagatgccacacggcacatcaccccaaagccagccttgtcatggttgcgtcagcagccgcagggcgtcattgaggtacctgaccgccgtccgcacgtcctcaaaggacagagcgctcgtggccgtcttggtcaacctctgcgcctcggtgatggctgccagggagggctcgaacccgggcaccggggctgtagtcggctcaggcggcctggctggcggtcccgccgatgcaaggctggaagttgctggccgtgacggcggcgcgaccggcgaccgccccagcccctccccagtcttgggcttgggagggctcgggggaggcggcggccgagcctcgccccctggtggcgctggggggcccacatccgaggctccctcgcctttcagcccctccaactcctcctcgccgtcgccaggcatgcccgggggtcctgtcccgagtgcctcaatcctctcgatgctggtggtggagtaggtaccgtccgccaggcgcacggcatacgatggtggcctgtggtggcgcaagggtgggcacggtgatgatgtgtggtggggatcatgcgcgggcaaagagtcgagtggggggcttgatatcaacacacaacccagttccccccttctttgcgcgccgcaccagcgtgaggagtccaccgccgcgacggtggcgtccatcgtgaccccccctggggtgtgcaccagcacattctctccggtggccaggtctgggaccagggcctcagccccgcaggcctcgatgctgcctggaagttcattgttggaaggagctggagtgcagcgatccaaagaggcgatcgagaaagggcactgatagttttcgaggaagaagctgggcagagagctccatccttcccagccatcccaaacaattcctcacctgcgagggccacaaagtactttgcgggtacctgggcggacgtggcgggcgacacgcgcgccaccgtccccttggccggcgccgaggccccctcggggcagaagaggacctgcagggtggggtgagagggcttcatggagagacgcaccgggtgctgacggcatgctgttggtggcatggcatcgtggactgatgtatcccagccagaatcctcccagccaccagcgctagcaatgccgcagactgctgcagggcacgtagctcaggccctcgacgtccataacctgcaccgcaccttctggaaggtgtaaaaggcgcgaggcggcggcggcgtccacaccatgcccgagatggggcgggcctggccgcctacttctccgctccccatggggggggagaggggcggggaggggagccgcagggacccctcctcctcatccttcccgttgtgctcctgggtgcgcccttgacctccagcctctggccccannnnnnnnnncagttctccgctccccatggggggagagaggggcggggaggggaggcgcagggacccctcctcctcatcctttccgttgtgctcctggttgcgcccttgacctccagcctctggccccgccgccggccccgggccaggcaggtcggctgagtcggctgagggcccaacactggtcccgctcctctgcaccgacgcgtcgtggcgcgggggcaccgggaagtcatccagctgcgaggacgactcattcttggcctcgggttcagcaccaccctgcggcacgctgggcatgctggtcagggaggccagcagggcctcgtcctcctcggtaacgggggcctgggcggccgagggcggcgggtccggcactcggccctccgccagtgcccgccggatctctgccgcgcgccaggcagcgaatcgctgcttgagcagggtctccggggccagctcgccgaactggttgatgatctccatgaagatgctggccgcgtagtaggtgagcgcggtgttcttgtccgcctggcccacccgatccgcgcggtccgcgcgcccaaacacggtcagggcaaaggtctcgcacaggatggcgtcgtcgggccccagctccagggccttcttgtcgtgctccaggctggcgagcagggtgttgagcaggtccttgatgtcgggtaccaggttgctcacccccaggctcacggcctgttgtacgggcgttgcgacagatgggtggatgaatggtagcactgatgcagggttgtcaaagtaaagtgcaagtctgcaggcttccccgcacctgagacaccgcatagaggcgacagtagtaagcgatcttgggctctgcccgtgccacctcagaggctctctgcgagggagatccagtcacttcctcgacacgaagatgcattgttagccatgataatcacacatgctactcccccaacccacctgcagaaatggcaggatcagcttcttctgctcctgcagcgtcgacatggcccttgggtgtctactgcgcgatcggcccaccactctgccactgcggctctgcagaaacgtgaatgtttttgttgagcatgcagctattcaatgatatgctgcatcgcttggactttttgtcaacgcgtcctatgggagagttttgcccttcctccgcgcccacatcatgtcgccccgacaccactaatcccagaccggacgcgatcgacgatcaaggggtggcatttttatctcgattgtatatcttctctcttgactatcacatcaggtatctatcggctgccccgcccccgcggccgtccaccccatggccggtaacctcgccatgcaaggggcgtagacgcagcatccagccacctccagcttccggcatgcacattcttcgcctatcctccgccttggcccaggccgggaggggttcctggtcccgctcgatcgggtccaggactctggttaaccagacacaccctcaggccgacctgcgacagctcctcgccgcccggcattattctgaggatggcgacgaaaaggagtcgggcatgggacgcatttttaagtagtgagctacccttgctgggcggtcttggtgtgcttggcagggagcagggatggccctgacatgcctggtgccgtgtcactgagcgcctggcgctgctgagcaatgcaactcaccaccaacctcccgccccccctcaacccttccccagcttcaagagccaggaggcagcgccgcgcaatggctcccggcgcaccccatccggaagcggcaacggcggcggcaacggcagcggctccccctccgagtcaggccagggctctgacggctccgacggcgcctccgccctggtccccgcctcgcccgagcagcgccaccgagaggtgatggccgtggcgctgtcccgccgccccctcttccccggcgggatcatgcccgtcatcgtcagcaacaacaagctgatcaaggagctgttccagctgcgcaagcagaacgcgcaggcctatgttggcgccttcatgcagcgcgtccccgatgcgcccggcaccgccatggacggcgtggaggacggttcctttgccgtcgacctcctgggtgagcagggttgctggaggatgtgttccttggatgggatgcacatcattcgtcgttccctgccccacagacacctgatgtctcctgagccaccactgctccacctctccttgacccgccactcgccggtttccatcgatcatccaatcacctgcacagggagcgcagccccgccgcacaaaaacgacgatgcggacgccgatcctgccgccgacccgtctgccgccctgcacgaggtgnnnnnnnnnncaaacgacgatgcggacgccgaccccgctgccgacccgtctgccgccctgcacgaggtgggcaccttcgcccaggtgcacgccatcatcccgcacgaccagggcgcgcagctgctgctgctgggccaccggcgggtgcggcgcacggggctggcggggcgcgacccgctgtgtgtgtcggtgcagcacctgcgggacgggcggtacgaccccgagcaggacgagctgaaggccacgaccatggagatcatctccaccatcaaggagctgctggcgctgcacccgctgtacaacgagcagatgcgcaacttcatccagttcggcgccgacttccacgacctctcccggctcagcgacctggccgccagcctgaccaccgccgacgcaggggcgctgcaggcctgcctggaggagctgggcgtggcggagcgcgccgcccaggtcctgctgctggtcaagaaggaggtggagctgtgccgcctgcaggccgacatcgggcggcgcgtggaggagaagatcagcaaggaccagcgccgctacttccttatggagcagctgaagagcatcaagaaggagctgggcctggagaaggacgagaagagcgccctggtgcagaggcgagggctgcgtgggggctgtaggggagtgggtgaggggcggcggtgggggttgcctgacgcggtggggtggcgtgggactggtgccagacctcccccaaccactctcgatgcacaggttccgggagaggctggagccgctcgggagcggtgtgccggaggatgtgcggcgagtgatcgaggaggagctggagaagctgcaggccatcgaacccgcctcctccgagttcaacgtcacgcgcaactacctggactggctcaccgccctgccctggggcaagatctccaccgagcgcctggacatccccgccgcccaggaggtggggggagagggggcagaggaggggggtcccgctcgcggaggagaggggcctcatggcttctacatcgggaacgctaccaggacaacagcggacgatggcgggtgggagtagatcacttcggccctgcctgccagggactatcatgcacagaggggtacagatgtccccattcagcaacccgacaatgctgaccaaacctggtttgcaggtcctggatgaggaccactatgggctcgatgatgtgaaggagcggatcctggagttcnnnnnnnnnntggccctgcctgccagggactatcatgcacacagatgtcccattcagcaactcgacaatgccgaccaaacctggtttgcaggtcttggatgaggaccactatgggctggatgatgtgaaggagcggatcctggagttcatcgccgtcggcaagctgcgtggctccacacaggtgggtgtttgatggaggtggccggggcgagcggctgaagtcatgcatgccgtcaaacttcgtctgactctggcatccagcgtctaccactgacctggcctgcagggtgagagtctcatccactcccatccctacgccccccctccaacagggcaagatcctgtgccnnnnnnnnnnacgagtggctgaagtcatgcattccgtcaaactccatctgactctggcatccagcgtctaccactgtactggcctgcagggtgagagtctcatcaactcccattcctacgtcccccctccaacagggcaagatcctgtgcctggtgggcccaccgggcgtgggcaagacctctgtggggcgcagcatcgcccgagccctggaccgcaagtactaccgcttctccgtgggcggcctgagcgacgtggcggagatcaagggtgaggggaagcagggtgcaagggagggggccccatctcatcaccatggcgcttgcctgaaaccctgccattgagaaccgcgtcgatggtcctgtgcagctgctacgcccctggtccattcttttccactcatcccaatgccctgcctgcaatagcctcccagtgccttccaccaccacccctcctcatcgctcaacannnnnnnnnngagggtgcaagggagggggccccatcttatcaccatggcgcttgcctgaaaccatgccactgagaaccggatcgatggtcctgcgcagctgctacgcccctggtccattcctttccactcatcccattgccctgcctgcaatagcctcccagttccctccaccaccacccctcctcatcgctcaacagggcacaggcgaacatacgtcggcgccatgcccggcaagatggtgcagtgcctgaagaacacggggatcagcaacccctttgtcctgatcgacgagatcgacaagctgggtcgcggctaccaggtgtggtgattaaaagggcggtgggagtgctaggagatgccggttgtgaatcctgggggcagtcttagggccacaccagtctcagnnnnnnnnnncaaaggggcggtgggagtgctaggtgatgctggttgggaatcctaggggcagtcttagggccacaccagtctcagatggatggcccctgttgcattccctgcatcaaccggctgcacgccgtattcactgccaggcccttcttcctcaaaccctcctcaaacatggcaatccaacccctccgtcccacctcatccacacatccatctcgacccagggcgaccccgcctcggccctgctggagctgcttgacccggagcaaaactcctccttcctggaccactacctggacgtggccgtggacttgtccaaggtgctcttcatgtgcaccgccaacctgctggacaccatccccggcccgctgctggaccgcatggaggtcatccgcctcagcggctacatcttcgacgagaaggtggccatcgcccggcgttacctggaggtccaggcccgcaaggatgcgggcgtgccgcgtggcgccgtgcacatcaccgacgccgccatgaccgccctggtcgaggagtacgcgaggtgggtaaggaacccgcctggctgtagccctgtcgggcatggattgtgggatgcgtgttggcaccagtgtccgagtggcacgacgcggtacaggtggtggactgcgctgatgagnnnnnnnnnnggggtacccgcctggctgtggccctgtcgggcatggattgtgggattcgtgttggcactagtgtctgagtggcacgatgcggtacaggtggtggactgcgctgatgagggacctggtggggaggagtctacaagctctgcgatgggctttgccgcatggggctcagggtacggatccctcctcgagcccatgccccactgtcaaccagcgcacacaaactgcataacaccctacagggaggccggggtgcggaacctgaagaagcagctggagaagatctaccgcaaggccgcgttccggctggtcaaggagggcctggtggacattcctgtggtgaaagatgcgcaggagtctgatggggaggcgacggaaggccccgacacgctgccgcccagcacaccaccgaccgcctcgatacagggggaggtgccgccgcccgcggagagcgtggagcgtgagcgcgtggaggaggaggctctgcccgccttcgacgcccccgcggtcaccgtggacgcgggcgacctggcggccctgctgggcccgccccccttcaccagcgacaagatctacgcctcggcaaccccacccggcgtggtcatgggcctggcctggactgccatgggcggcagcacgctgtacatcgaggccgcggcggtggagcgcggcgagggcaagggctcgctgcgcaccacgggccagctgggggacgtgatgaaggaaagcgcggccatcgcgcacacctacgcgcggcgcgtgctgcaggcgcgcggcgacgccgccttcttcgagcagtcggcgctgcacgtgcacgtccccgccggcgccacgcccaaggacggccccagcgcgggctgcgccatcgccaccgcgctgctgtcgctggcgctggcgcggcccgtgaggcccgacctggccatgacgggggaggtgacgctgacgggaaaggtgctgcccatcgggggggtgaaggagaagacactggccgccaagcggtcaggggtgcggcacatcctgttcccggagggcaaccgccgagactgggaggagctggcggaggtgcgtgaggggtgtgactgtggtttggcgggggcgcgcatcatgtgggagggtggcagatgtacatcacacagggtgcctgacgaagcagggaggctgaaggggttgggcgacgcccctgtgagcgctgtgcggcctatccaaaggcatccacccaccgttgctgccgaaatgtacaaccaagcattacaacacggattccnnnnnnnnnnaggtccactttgtggaggagtaccagcaggtcttcgacctggccctgccggaggagggcagcgcatgaccagcagcggaatgcgaggctcggccatcacgcggacttgtgcgccctcagacgcatgcacagcgcccctgctgcggccagtgtggttttccagggcgcgcatccctatggagccggtcctccgggactgacgctgggnnnnnnnnnncccatcgcgcgggcttgtgcgccctcagacgcacgcacagcgcccctgtcgcggccaatatggttttccagggcgcgcatccctgtggagccggtcctccgggactgacgctgggcaacatgctgcataggactgcctttcgcggagaatgccgatcccatcatgataaatcggggccgccgccggtgccctccttggcagccttgatgagctgcttctccctggaaatctctcgcgcaagctcgcgctccgtctgcgtgcgggagcggcagaaaggcgctgagggtctgtccttgcagagcacatgtgtgcatactgaatgaaaagtcctccctcacccttcccatattgcacacactgtcaagctgtctggacgccaccgcatcgccctctggactccacaccagaacatcacccaactcacgtgcagggtttgcacctcgcgctgcgtggcgtatgtgagccctagagctgccgcaaaagccaccgcccacgataccttgtcctgcgagagggtgtgggcaaaaagctcttgttcgaggacgacaaacagggcaccgtacctccgcaatgattgtcaagttgaatcagctaaacgcaccgcccgcgatctgaagctgaacacattcctccagaaactgggggccggcttgtatgacatggtgccggcagtatatattatcggcgcgaaccacgctgacaggcagctttgctttggtgaattcgatacagtccgttgcatgcacagtggttttcggcatcaagtgcaaccactcctctacgtcccgaaatgcttccctgggcgcgcgctcacccctcagtcaatggacccacattagcaaaaactgataggatgtcgggccttcagcgacacgaaatgggtatattcacaccccgatgctcgaatatgctctgaagcaaagtctttcaaatgtcggatgtgcctgttgaggacagcctctgcacacccaggtctgtcgccggtgtagggtctcgtgcctggcgcacagcgagccgagcattggtcccggaatgcttcacattccctcacttccacacgcaggcccaattcggaggcgtccaccgagcgcgtggtgctcagcctgacatgcaccgtcgggggttgcagggtgtcccttcccttgctcagtctcccccctcgcagcagcccggggcgggccgcccccggtgtcgccccgccacccaggccggccacccctccccctccccccagcctcaagtcccccttcctgtcccagctccagtcggcgctgcccaccggcaccacggagcgcctgggcagctgcggcgagcccgtggacggcgtcttcctccagcgctggctgtcggcgcgcaagggttccgtccccgccgcggccgcggacatcaccgcccacgccgactggcgctggtccttcctcgggcctcagggcgtgaccgtggctgatgtggccgctgacctggcggcgggcaaggcctacttccagggcctgtcgcgcgacggctgcccagtgctggtgctgcgcgccgcccgcttctccggggacgcaccggacacgcaggccaccaagcgccttatgtgcttcctcatggaccgcgttggacccatgcacgaccctgtgctcaaccccctgggtcaaatgcgcgtcctcttcgacctgtcaggttttcaaggggggggggggttgtctgttgttttggagcaggagacgtgtgcgcagggggaggggcaggctgggtttcgcttgcaagcatgcccatacatgctcctgcctggcccaatctgcccagccacatgcaccaaagccagccacnnnnnnnnnnnnnnnnnnnnnnnnnnnnnnnnnnnnnnnnnnnnnnnnnnnnncaccccgcaggcctgaatacgcggggcctggatgggctgtacaagtccctgctggcagttttcgaggtcctgcagcagcactaccccgagcgcctgcgctgcctgtacttcctctccgcacccatgctcttctggggggtctggcgcctgctctccgcgtttgtggaccccgtcacgcgggagaagatccgattcgtccccggggggaaccggggcaaggcagagctgcttgccgacatccccgagaaggtcagggggacgctttaatacgtggggaaggcacagtgcagtgatcaaggctcatgcttccctccaagccccctctgagcaaaacctccttgccggccgccctccacacccgctcgcaggtgctgccagacgcgtttggcggggccgtgccctttataccggtgctggagggcctgaacctgtgccggtccggggcctcgccgccgcgcgccagccccgtggccgacgcccaaccgagcaggcgcggttcagagcacggactgggcgccgcacacgggttcaggccgtctcggtggagcgtggcgcatgcgctgcgcctgcgccgccgcagcgacagctgcaacaggggcggcggggaggggcccgaggccgcagctccaggactccgccgccgcgctcatgccacccactcccatgccccgcgccagctggcggcggcgctggcggatcggggcacgctgggtccgcgcagcgtggccctgctcctcctcgccttcctgctcctgcaggccctgctctggcgagcgctcttccccgggcaccagtggtggggccgggagcacaccgggcatggctcgtccacgtcgctgctggtgctgtgagccccagccttcacgcgggataagaatcttgctgcttgacacgtgcccttctttgccatccgctctctgcgatcggccccctcttactcgcctccttgtcaagctctgggctggaacatactttcatgattttcctctcttctcatcacccacccgggtgctcctgctcccagacgccttgaaaattttcatcttccccttccaaggcaatggctgtgggcgcctgatgcccccctctcctacagtgtagggtgctctcctcatgacttgctcttcttgctactcacccaacacctgtctctcatgctgctgtacatatacaatgaccctcagcgagaagcctgccaggccggcacaggcgcaggccagccacccacaagtgtcaatcaattgtcgcttttgccggggcccactctccgcatgcgggtctcccagtccggagatcggaagatcctttgcatcagctggcggttggacaggtccagggcatccagcttggtcctcagcacaaagcgggccagcctctccccgcgcgcatccaccctggcaatgcgcagctgggagnnnnnnnnnnagcatccagcttggtcctcagcacaaagcgagccagcctctccccgcgtgcatccaccctggcaatgcgcagctgggagggcttatcctcgtcgttctcggctacgtacacgtcgcctgatgggccccggaccaccagcgacaccacctccccagagtatctgtccttcactgccgagaggatggggtcatcgtccaatacatcgggaatggacccccgggacggcgcctgtggcctcccaacctgtgacggctctgggcgggtgccaagcacagatgcaaaggtgaagccnnnnnnnnnnctggcctcccaatctgcgacggctctgggccggtgccaagcacagatgcaaaggtgaagcctgctgccagcgttatccctgctgccgtgccgaccagaagcgcccgccgggatccctggggtgcagggggtttcagggcttgatccagggttggtgaggacatgtgctgaaatagagatgaccccttgccagcgagtgttcgacgtggggcagggggcggtatacctcaatcactggttcagcactccctccttttccacctccccgacaactcgatcctgtgcctggcctcaccagcaggtcgaatgcgtcgctcgggggtggagggggggggggtgnnnnnnnnnnnnnnnnnnnnnnnnnnnnnnnnnnnnnnnnnnnnnnnnnnnnnnnnnnnnnnnnctgtagccatatggaggaggtctcaaggtgggtacgggcatgcgattctctctatcttcatcgggctctgccctgccgaccgcccatcctggtggcggtctgcgcgaaggagtgaacggtctcggtgctaagtgctgcgtgctattcacgcttgaacccccgatacccgtgaaagaacagggacgaagggtcgccagatacattgtgttgatccaatggatattcctgcacgattttggttcttgaatgtgttacagcgtgtgt

SEQ ID NO: 46931 - DNA, 76 bp, Chlorella protothecoides
gattgtttgtggatgacaagcacaatgccattgcttgcaagtctttgcccctactaaaacgatcgccgtccctgcc

SEQ ID NO: 46932 - DNA, 67 bp, Chlorella protothecoides
ggccgggcagtgcctgcgcatgcacagagatctgtgtgactggccgggtggggaccgccacaccgca

SEQ ID NO: 46933 - DNA, 79 bp, Chlorella protothecoides
ggacgcacgggatcgtttcacgagggtgttattgcggattctacatccatgaaattgcaatcgttgcttggctgcatgg

SEQ ID NO: 46934 - DNA, 172 bp, Chlorella protothecoides
gggcgatggcgagcgggcgagaggaagagtgggggagaatgagggatactcggaaactcacagcctccccgcatcccctgcttttggcgctggtcatcccacccaccctcctcccgcagttgcctgccgtctcccggcaaaaagcgcctcacctcgtcaaagaggaggcgca

SEQ ID NO: 46935 - DNA, 73 bp, Chlorella protothecoides
agcccccaagagcctcactcccgcaccgatgcgctccgcagcgcaggcggcagagcaccgcatggctgcgccc

SEQ ID NO: 46936 - DNA, 61 bp, Chlorella protothecoides
caggcggcagagcaccgcatggctgcgcccaccctgtccacggccccagcaacccccaggc

SEQ ID NO: 46937 - DNA, 61 bp, Chlorella protothecoides
ttcccttcaggaagtctgggcaggtgcatgcaggctgccggcagatggtcacagagtacac

SEQ ID NO: 46938 - DNA, 61 bp, Chlorella protothecoides
cgcatgccgaagaggccgacgcagggcctgggggaacatcatccgcacctctgcctgccgc

SEQ ID NO: 46939 - DNA, 64 bp, Chlorella protothecoides
attagattggatgcctgcatccccagaagagctgtatatgggacagactgggatgtgtgacgtc

SEQ ID NO: 46940 - DNA, 61 bp, Chlorella protothecoides
cccgaccatcacactgcattcggggtctcgcctgtaacattcctactttaggtcatataca

SEQ ID NO: 46941 - DNA, 61 bp, Chlorella protothecoides
gtcggggagggggagggcgcaggagaaggggcgcggtgaggtgcaaggactggcgggcagg

SEQ ID NO: 46942 - DNA, 61 bp, Chlorella protothecoides
gagtgggtagttgcgtacggtaacgcacttagctgctggtgtacaccacatccacagtcac

SEQ ID NO: 46943 - DNA, 130 bp, Chlorella protothecoides
tcatcagccaggtgagcagaccgaggagggctcaaagggggaagggggtcccggggggatagacgcgcgcagatggagtgtgctcgcggcggtgatgggatcgaggcaggcgtgcaagccagcgttgccc

SEQ ID NO: 46944 - DNA, 14883 bp, Chlorella protothecoides
  modified_base (280)..(289): a, c, t, g, unknown or other
  modified_base (823)..(832): a, c, t, g, unknown or other
  modified_base (1453)..(1462): a, c, t, g, unknown or other
  modified_base (1552)..(1561): a, c, t, g, unknown or other
  modified_base (1661)..(1670): a, c, t, g, unknown or other
  modified_base (2331)..(2340): a, c, t, g, unknown or other
  modified_base (2538)..(2547): a, c, t, g, unknown or other
  modified_base (3059)..(3068): a, c, t, g, unknown or other
  modified_base (3698)..(3707): a, c, t, g, unknown or other
  modified_base (4520)..(4529): a, c, t, g, unknown or other
  modified_base (5022)..(5031): a, c, t, g, unknown or other
  modified_base (5252)..(5261): a, c, t, g, unknown or other
  modified_base (5679)..(5688): a, c, t, g, unknown or other
  modified_base (5947)..(5956): a, c, t, g, unknown or other
  modified_base (6706)..(6715): a, c, t, g, unknown or other
  modified_base (7229)..(7238): a, c, t, g, unknown or other
  modified_base (7379)..(7388): a, c, t, g, unknown or other
  modified_base (7687)..(7696): a, c, t, g, unknown or other
  modified_base (8085)..(8094): a, c, t, g, unknown or other
  modified_base (8967)..(8976): a, c, t, g, unknown or other
  modified_base (9166)..(9175): a, c, t, g, unknown or other
  modified_base (9385)..(9394): a, c, t, g, unknown or other
  modified_base (9618)..(9627): a, c, t, g, unknown or other
  modified_base (9705)..(9714): a, c, t, g, unknown or other
  modified_base (9840)..(9849): a, c, t, g, unknown or other
  modified_base (10063)..(10072): a, c, t, g, unknown or other
  modified_base (10133)..(10142): a, c, t, g, unknown or other
  modified_base (10397)..(10406): a, c, t, g, unknown or other
  modified_base (10880)..(10889): a, c, t, g, unknown or other
  modified_base (11838)..(11847): a, c, t, g, unknown or other
  modified_base (13409)..(13418): a, c, t, g, unknown or other
  modified_base (13481)..(13490): a, c, t, g, unknown or other
  modified_base (13818)..(13827): a, c, t, g, unknown or other
  modified_base (14140)..(14149): a, c, t, g, unknown or other
  modified_base (14801)..(14810): a, c, t, g, unknown or other
ctgggcacgctggtgctgcccctcgtcgcctccgcgcggcgcgaggcggccgaggggcccaagcgcggccgcccgggcgccgcacgctcgctgcgcctggccgccgccatgctggtcaaggtactgctggccgtggtggagatcctggctgccggtcccggcttctacgcgctctggtccgacagcctctccgtcctggcggtgagtttgcgggatggcggggggcactggctgggtgggttgggtggtcgaaccgatgatcggtgcggggctgtccctnnnnnnnnnngttgcagggatggcgggggggcactggctgggtgggttgggtggccgaaccgatgatcggtgcggggctgtccctgctgttccccaaaaccccagctcggacccaactcagcccacccccaacacccgatccaacccctccgatcccaggagtgcatgagcgtgccggacgagggcgtgcgcgactcggtgccggagaacgtgaagaacatgctcctggtcctggccaccaacggcgtgctggtgcccgggtggcgcgacgccaagggcgccagcctctgggacctgacctggggcaaggcgcacgccgtgtcctccggcctcaaccctggcctcctggtggcagcgggtgtggtgcccgggcaccagggcagcccacgcagccctctgggcggggcggcggtggcagctgggagcggcggcggcggcggcgacggcggggacgccccggctgtcgttgccgctggcgaaggaacgcctgccggcgagggcacgccgacccatgctcgcagcccgagggccggcgcacgagagnnnnnnnnnnacagccctctgggggcggcggcggcggcagctgggagcggcggcgacggcggcggcgacgacgcctcggctatcgctgccgcgggcgaaggaacgcctggcggcgagggcacgccgacccacgctcgcagcccgagggccggcgcacgagagtcgagtccaggcccagcagcggcggcggcaggcagcccccagctggcgcaggagggcgccacggggacgccagaggccgtgagcccgcccacccctggaaagccgttggcgagcggcggtgacgcgacgacgcccgcggcccccgacgctgttcctcccccaagcggcgtcgctgagacgaccggcgccgacccgccgcagaccagccccggctccgaccgcgaggaagggtctgtcgaggaggccgacggcgagcaggcgtcctcagggtgcaagcagagctgaaggagtggattacctgggcagcaccatgtcctgcggccgtgcatactcgcaccctgctgtgtggagatgagaatctcgagctccggtgcacccctgcatgtgttgaacctcccagagctccccacctgtcgtgacgtgcctactcgtcaaatgctttcgcacgctataacagtcacggcgtgannnnnnnnnncgcatgtgttgaacctgccagagctccccacccgtcgtgacgtgcctactcatcaactactttcgcacgctataacagtcacggcgtgannnnnnnnnnagtccaggtcacgagctagatttacacaggctgcctcgtcagcgcaatgacagcgcctcctccagcgcaccgcccagcccggccagaagttcctccaagnnnnnnnnnnggtccaggtcacgagctagaattacacaggctgcctcgtcagcgcagcgacagcgcctcctccagcgcgccgcccagcccggccagaagttcctccagggggacgacggggcgcggcgccggtgccccggccgaggccacagaggggatgtgccaggcatccttggcgcaggcatccacgcccagtcgcttcacgggcagggcgccgggctccgcgctgcgccgcgccaccagctgcagcgcggtgctcacgtcggccgcctgctcgtcgatcagcgcctccaggcgcgcggcggtctcgcgctggcgctgggtcagcgcgcgcgcctccgccaggtcggcgcgagcggaggtcagatcggcctccagcgcggcggcgcgctccgccagctccgcggcgcggtccgcggcgcgcgccgcctcgtgctggctgtcctgcagcctcgccgcggcctccgcagcggcacgggaggcgcgctcccgctcctcgtgcaggctgccgcccagctccgcggccttggcctcgtaccgctccgcagctgcccgccaggtcttgcactgggaagggggagcacggagggaagggggctggggtgaaggggtgaggtggggtggcggccacggtgcacgcgctggagcgcagcatgggacaagtccccccnnnnnnnnnnaaagggggagcatggacagaagggggctggggtgaaggggtgagctggggtggcggccacggctggagcgcagcatgggacaagtcccccctgcagcgggtgctatgacttccatcccccctgcaacagccccctgaaagccattcctcctcagcatgagtttaaaaccccccggcccccatcatacacccaactcannnnnnnnnnttatgacttccatccccactgaaacagacccctgaaagccatgcctcctcagcatgagtttaaaccccccccggcccccatcatacacccaactcacctcttccgccgcggcatcccgctcgcgctcggccaccgccagcgcctcccgcatcagccccgtctgggtttgcgcggccaccgcggcggcgcggtaccgcggcaccaccgcctccatcctggccattgcgctgtgcacgctggcgggggttcccgctgccgccgccgccgcggcgccctcctgctggaagagatcgcgcgggtccaggtctgggtccgcggctgcaggcggggtactctgcaggaagaacgacgcccgctgcggggagtccatcgggctccgcgccccgccggcgggtcccttgtccagggcctgcagctcttcacaggcctgtttgatgattttgggaggggagttggggggtgtttcttgatggcgtaccatgtgagtagggccggcaatggggctagggacnnnnnnnnnnaggggtgtttctgtatggcgcaccacgtgagtagggccggcaatggggctagggacccggatcaggagcgccaaagcggctcggatcggtgcagggcagcagtgccgccgcctcacgacataatggacagggcagccggccatccccacctcgccactcctgccccaccaccccgcacttcacatacgcaccgcatccagcagggacagggctcgggtgcggggcatgcctgggctcgaccctgggggcactgcctccaggatgacctggcgcagggctgccagctggcgcatcgtggcccggcaggcgccctgggttgccctggccctggcctggatggccttctccaccagcgggaggcgcgaggccagggcatgcatggaggcacgggtggtctgtgcctgctccttgcgccaacgccgctcggaacggacctcgtcttcgaggccgctgggaagggtaagttgagggtggaggttgcaacgggagcagccaaggcagcatcgaggaggctgggttctcatctagcatctacgggaccatatactgagtgcatgggacatgcatccatgcctcgatccagacctcagaggagcgccgggtacctggcgacatagcggagacgtgagnnnnnnnnnntgggtaagttgagtgtgcaggttggaacgggagcagtcaaggcagcatcgaggaggctgggttctcatctagcatctccgggaccatatactgagtccatgggacatgcatcaatgcctcgatccagacctcagaggagcgctgggtacctggcgacatagcggagacgtgaggcctcctgctgggctgcagttaaggcatcctggcaggcagctgcattctcggaagctcgctctctgcggcgccgctcccgatccagctgttcctttagagttcctatctccctcaggagggaggttgcctgcacagtcggcgtatatgggttggtgggcctcgtccagtgggctcaccgacccagatgccagtacactgaacacagcttgccacctcacctgcatctctgctcccttggatctgtgcaaattgatatttatatgctgtatgggatcgtttccatcgccattacagagtccctgcatccaaccgctgatcgataacggtatcgcagcttccgatctcccggtaccggcgggcatcggcatctgccgcgccttcatttgaacctgttcacgcgcgccggaggtactacaagcatctcacccacaccttgacatgttccttgaagtacgcactcaccgctttgattgaagcaataaaggtaacgttcaaaatttgggccaatggaatgcctcaatgggattctccaccactaaatcgcattctgccgcctcggcatgagcacttttgtttgcactgattgggcaaagtgggaactgcagtaggatgccatctataaacatctcagagcttggnnnnnnnnnntctgttcacgcgcgccggaggtactgcaagcatctcacccacacctcgacatgtttcttgaagtacgcactcaccgctttgattaaagcaatataggtaacgttcaaaatttgggtcaatggaatgcctcaatggggatctccaccactacatcgcattctgcagcctcggcgtgagtatttttgtttgcactgaatgggcaaagtgggaactgcagtacgatgccatctataaacatctcagagcttggaggtcttcttggagctgagccgtgccatgaccttgcccagcgcttctgtgacggcgggagagtcgagcgactcccagccatactcccactccgtctggcagtaggcggaccactgcgcgctgtactcctctcgcagcattctcttggttgcctgcaggaggacgagtcacccaagatatggctgaggaggacacttctcgagcacagtcttaccggagcatgacgaccagcctcccttgactnnnnnnnnnncctcttggttgcctgcaggaggatgagttacccaaagatggctgaggagaacacgtctcgagcacagcctttccggagcatgacgaccagcctcccttgactggcaaagcacatcgagtggtgagctcaggggctggcgggctcacgataccccttcccttgaccctgcgcaatgcgggcgcatgcagatgctggcccagcacggggaccaacggcgtcannnnnnnnnnggagtggtgagctcagtgggtggcgggctctcaataccccttccctgggccctgcgcaatgcgggcgcatgcagacgctggcccagcacggggaccaacggcgtcagaagacctcaccgcacgaccgacgtctggggcactcagcatggaggccagggctttctgggccgctgcatccagctgagcggtaggtaccacctcgtcgacaaggccgagcgacagggctcggcgagggtctggaagctccgcattctgcatggagggtgagagcgttggggctgggtggttggaagcttcgataccgggacgggcagctgctcccatcgaagtgtccatcacgcatggcaactgtgcatcaagcatctttgaaacctaagcaatgcgactaaacccggtcctggcttctgatcccatatcnnnnnnnnnnccaactatgcatcaagcatctctgaaacctaagcaatgcgaccaaacccggtcctggcttctgatcccatatcaaactcccggcgatgcaccctcgcacgcaccaggcaaagcctctcggcggtccttgccccgatgacacgtcccatcagccccgcccagaacttgggcacggagatgccgagtgccacctcgttcaggcctgtggcttgggagacatgcgcgcaaactgaaggtcgctgccacaaagaatgctgcannnnnnnnnnattcaggcctgcggggagggagacatgcgtgcaacctgaaggtcgctgccacaaagaatgctgcacagcacttgacccacagagtgtcggccccttccctcagaatccaacccaccgatgtgcccatgctcggtcatgactcggtaatcgcacgccagggaaatggcgcaacctccagccgggcaagcgccacggattgccgccacggtggccagtcgtgtgctgtacaggcgggccaggaacttgttggacgtcacccaaaactccctgcagtgatgatcaaggtggtcagtgttgcactcacagtgagccggtcagggggtgctcagccaccgcgttggttgcgcaaggtttggagggagtaaaagagcatgtgagtccagccaccacgcataccgacgatatgctcacctgtatcgctgggcagaggtcagaggggcgtagagctcccggatgtcgttgcctgccgagaaaatgtccttcttcaagcccgaccggaagatgatgccccgcacggccggatcttgttcgcacgcatctaggatgctggtcaggcccctccagaggtcgagggaaagcgtgttgacgggctcagagcgcacggtgacgacggcaaacccaccgctctggacgtcgacctggaacccctttggcacgttggaggcagccattttggggcggtaattaatgaaaaggaatgctcagagcatgtctgggttctcagtggtgacgacaagatgcagccagaannnnnnnnnntacccaccgctctggacgtcgacctggaaaccctttggcacgttagaggcagccattttggggcggtaattcatgaaaaggaatgctcagaccatgtctgggtcctcagtggtgacgacaagatgcagccagaatgtaattaaaggctcgcgggcattattgctaaaaccccgacagtgcgctgacgtcgcgcacttccgacatcccaccgtacttgagataatgctgcagtagcaatccacagatcgggctgcaatcggttttgagctgacgattgcttgcaagcaagggtgttttgggtgtgtagaggcagcactcctcatgcgttgactgcgtgcactgccagcatgtgtagcaaccgtcataagataaatcctgtagaagatggatcgttcaacttagcaatccatgcaaaacacgggacgatctttcccaaatgaatcgaacattgaagagcattcaatagtgaagttcattgagagctcttgcagtcagtcagcaaggcgtacataannnnnnnnnnaaaatgactcgaacattgaagagcatttattagtgaagttcattgagagttcttgcagtcagtcagcaaggcgtacataacatattaacggcacctggcctaggcatgctcacaggcacgagcaaggtggtagacatggtnnnnnnnnnngtaccaatggcacctggcctaggcatgcccacaggcacgagcaaggtggtagacatggtagtggtggttcaggctgcgctccgcctgcagccgcagcccccctgtgcccccgagagcgccgcccgccgcgtccgcgtcgcagaagatgacgcggcgcgccctactgtgcaccagggccatggcacacatgatgcacggctccaccgccaggtagacatcgtagccggtgcagaggtagggacaaggagcgccgtgcagcatgacttcctcagctagacgcgggcgcttggggcacccannnnnnnnnntgcgccgtgcagcacgactttttcagctagacgcgggcgcttggggcacccatcctgtgctgagccgccctcctcccgctgcaggcaggccctctgccccgctgccacggcctccactgccagcatgacagcgtgctgcagcgggtgcacgtcaggcgcagcagtgcagcaggccagcaccttgtctgcttggcgggtgattgggtatgaggcatcgactggatcagcagtccagacatttcgcgaggttgcagactttgtgtactcgctccacgaactgtgcctcagagccaggcgatgacgaggagaaatgcaggatcgccccctggaatgcaccgacccacaaacgcgcctgtgaaggggtcgaccacggcgcagacattggcgcnnnnnnnnnnaccctggaatgcaccgacccacaaacatgcctgtggaggggtcgaccacggcgcagacattggcgccgcaagcgtcggcccgcaccaccaccgccgccaggtgctgcctcatggcggtctcctccgcggggtccagggcgacgtgctcaggctgcagctgcgggtccggcgcgcgccaggtcagcggccagtgtgcgccccaccccgcccagtcggcgcgcgtcgccggcgccagctcgggcacccccacctcactcagagacagggagtgctcctgtacaatggcactcaccccctccggtaagtcctcgccgtcggggacggggcacaccagaatctgcagggcagctgcatcctggggatgccgccgaatgcgtttcacatggtgtagggctgtcaggggacacgggccggccagcgccctggtgaggatgccaccatggctggtgggaatggtggcggcgtaccatctggcgagttggagcgtgggtgggtcccgcgcggggatcacacggggtttggccagaggcggggctggggcccctgcgcacaccgcctccgcctgggagtcgcacatgctgttgcgtcagaacaggggacgcgcttgcattattaaatcacgcatggggtatgtacgcgctcttggcgaagctcaggacttcgccaggaagttgtctgtcggcagcttgcgtcgtatggacaagctcatgcgcgcgcgcgcgttgtgcagcagaaagtggagggacgaccaaacctcgccctcccccttgtacaagagccctggatttagtgctcaccgcaggatcgttatttacctttaacgctcggacatacaaaatcttgctcgtggctcctcaactacgggaatcacgnnnnnnnnnnatgcgtcgtagagacaagctcatgcgcgcgcgcgcgttgtccagcaggaaggggagggacgaccaaaactcgccctcccccttgtacgagaggccctggatttagtgctcaccgcagggtcgtaatttactttttaaacgctcggacatacaaaatctagctcgtggctcctcaactacgggaatcacgnnnnnnnnnngatgtaccatttggtatcccagtacgtcgctaggcctcatgactagtagagttgcctttcacccttacgctggcgcaacttaaaagtatgcacggaacctgtgccagggtccttcataacgcccccagcatctccttccacagcctaactttcccgatggagagattatggccgagaaccctcctcgactggctcccaacctccctccannnnnnnnnntcccctggctgagttcctggtgcccacggctgttttgtctcacacttcccatcctcagcaagacgtacgcctccaccacaatcgcatcgacgtaatgtaccatttcgtatcccagtacgtcgctgggcctcatgagtagtagagctgcctttcacgcttacgctggcgcaacttgaaagtatgcacggaaccagtgccagggtccttcataacgcccccagcannnnnnnnnngccggcttcctatccaatcaaatagttattgcttccaagaagtacacgattgtcctgcagatccctggcatatacagnnnnnnnnnnggagggccctcacttgggatgcccaccctcctccaaagatcatcatccctaaagaccgtggaacactgccctgctatggtatcgtctacggtgctctggacttggcagccccccaaaggtggacannnnnnnnnnagaggaccctcacctgagattcccaccctcctccaaagattatcatccccaaagacagtggaacactgacctgctatgatattgtacacggtgccctggacttggcagccccccaaaggtggacagtccccgcccgtccggcttcctacccaaccaaacacttatcgcttccaagaagtacatgattgtcctgcagatccctggcatatacagnnnnnnnnnncggctgccttggcaatcttttctgagggagttttcagcatggctgcccttcacgacttggnnnnnnnnnntggtgatgccctggcttctctcagtgtcttctggatggaagccgtgctggctgactggctgcccttggcaacttttatgagggatttttcagcatggctgcccttcacgacttggaaaatagaccgccgtcaccacctctctccacatccgaccactctcagccactgtcgtacacggccctccctctgtcaacataggcctctgtccttttcctcccttccctacaaactcagtcccagagtgggccgaggacnnnnnnnnnnttctgtcaacacacgcctccgtccgtttcctcccttccccacaaactcagtcccagagtgggccgaggaccaccgcaaccctttgttaccctgtgctcttgacccagctgagcacctccaccgcacccctccccggctcctgcccgagcctgagaagtttcttgacaattacctgcgcgtgagcatgatctgccccaatacctcatgttttggcgcgggtatcctgttcaacccccaagaaggacggcagcattttggttttgcggggagttcggggctctctatgccaatacggcgagcgatcgctcccccctccctctcgccatcgacatcttaatccagtcatatgttgccgccttctatggaaatgataaccgaggcgtacactatcgggagaggtgacgggtcccagagccgggtcccaatacgtttggtgcggaggtctggaagtcctggggccttgtgggccgccannnnnnnnnncggttttgcgtggagttcggggctctctatgccaatacggtgagcgatcgctcccccctccctctcaccatcgacatcttaatccagtcatatggtgccgccgtctatggaaatgataaccgaggcgtacactatcggaagaggtgaggggtcccagagccgggtcccaatacatttggtgcggaggtctcatgctggaagtcctggggccttgtgggccgccaagactgatgcataatatcttctgacacaagattttggcgcgatcgccatctgtttgtgcacagtattgtcgactgttgctgcatctcgaccccacgaggggcatcgtgctaggagtgctgtcctatcggaacacgggttcaaacacacaatcaagccatgtcacgccgaccgtacctggcggggatgagctggcatagctcgtgtaagccctatcaaccattcccaaccattgcagcgacaaacgcaataaactgaacataatctataatgtgtatgtagtgcacgagctggcgtcggtcgctggacccattgatttcgcactccccaggtccatcccgccggtcatggagaccgcacagctgcccctgccccacccctccgagtgtggatccgacgaatgggcgcgccagatgcgtcttcgcttcagtcccgttggcatgtgcagcgagactggcgacatcgtgcaggacttcttccggcccagcggccttgcactgtgcggcgaggaggggtcacgctggggcgctgcccagcaagcggccctttacatggcaagtagtgagatggagggcacatacgcaggccactccatttgtcagatggactggctgttgaggcgagggacaatggcatcatgtgtacgcctcactcctcatggtacacaccagaggcgcacagcatgatcccatgcccggcacccgccctcgagcagggtttggaaaannnnnnnnnncagtgagatggagggcacatacgcaggacactccatttgtcagatggagtggctgttgaggcaagggacaatggcatcatgtgtactcctcactcctcatggtacatatcagaggcgcacagcatgatcccatgcctggcacccgccctcgagcagggtttggaaaagtatggggtcggtaagtggcgggacatggccacggagcatccggcgctggaagcctttgatgatgcagccatccggaccaaggcggcccgccttttgggcacgcaatcgctggcccgccatgcggggtggaaaggtgcgagttttctagggggctcgaaccctgaatgccgcggcacggctggcatgccatagcccatgtgtcaagatgaccctctcagtagcggtgacttgccgagtccatgattctcaatccaatgacatggccacagcccccgctggaggaggtgacaagcactccgtatcataccatggccaaacccaatccctggctgccccccgcgtcccctagcaggcaaccaggcggccgtggatgccgagcgggcgcggcaccgggccattggtatccagctgggatgctggaagggaggagtgctggtcgaggatgcccaagggtccgtggccgccgccatggcaagctctacgcttccaggcgagcctgggtgctgagcagcacaatgcctggcataccccttgtgtaggtccattgaactctggtcggtccgatcgtccatcgtggcaaaggatttagagtgggtcaatgcttccagggtgcagcgtggatgagggcgccgtccctgccgcgagggcgccgtccctgccgcgcggcagtcgtctcatcgcaggcctcttctcgctttcaggagctgcaccgccgcctcagtccaggatgagcgccggcgcaccggcgcccgggtcctcccccccctgtgcgtcccgctgtccaaacggcagcgcctcgatctgtgccagggccgccctcaggatctgctgctcgatgcccaccaggcgcgcggccgccgcccgccgcgcgttcgtctctgggtcgcggtccggggtcgcgtccccttcgccccctgccaccggcgccgggtaccgcgccaggcgagcggccaggcgtgtgcgcagcgtgcccagcgcgcgtgcctcgctcccgccgtccagcggccccgcacccggcccgaattccaccgcccagacgtcgcgcggcgtgcgtgccagggccaggcgcaggaagggaaagagcggcgcgggcaggggtgtggccccccgcgacagctggaacagctgctgcgtggccaggccgccgccctgctccgccagccgactgcgcttcaggctgtacagcgggtcgctggcagggatgatggctgcggggcaacgagcagaggggggtgttacacgacgtgagcacaagtatcatcacccgctggcgggggtgggggggggtattcaccaaaacgtcagaagcaagccgcctggtcactgctttgccctgaaccatgccccggatcttgtactcctcatgccgaggcatctcgtcctctgacaccatnnnnnnnnnnggaggagaggggggggttacaccatgtgagcacaagtatcatcacccgctggccggggggggnnnnnnnnnnagccgcctggtcgctgctttgccctgaaccatgcccatggtcttgtacttttaatgccgaggcatctcgtcctctgacaccattgccaggatcagagcgccctgttgttcagcccaggcacagccatccatttgcgaaccaacacccatgcactgatctcctcgttgctttcggatgcctcgattgacaccgctcgcccaggaacagcatccccttcaaacccgcaacccccacccttccatcccacgcctcgcccttggcccccttgacacccacccaccttcaaggggtaggcgatcgtaggggttggcctcgtccacgatgccgnnnnnnnnnnacacccaccttccagggggaggcggtcgtaggggttggcctcgtccacgatgccgtagttgagcaggaggcgcgagttgggctgcggcccgcaccacgccagcaccggctcgcccgggcggtacgcccgatccgcggcgagctgcacctcgcgggacgtggggtcgtaccgcagcatggcgctggcggtactgctgtaggtgagcaagggcggccccaggggcaccaacgcaaatcgctgggacagcggcactccctggcgcgggggcggggatgagaggggtgtgtgattgatgcgggagggaggagccagnnnnnnnnnngcccaggggcaccaacgcaaatcgctgagacagcggcactcccttgcgcgggggcggggatgagagggatgtgtgattgatgcgggagggaggagccaggaaggcctggggtgactaaggggtcggtgacgagggttgcacactgacaatgagcacgcattccctggcctgcacgcgccggagcgccctttccaccaaccttggcagaacccccaggcaacaccctgcacccccatgcactccctttccttctaaaaaaacagccctcgaggcccctgcctgcctgcaggcaagacaccctgtgctccccaccccctccgctgtgctgacctggaggtgcaccacacaagactgcacggccgcaaaggcctgccggaagacctcgggcgtgaactgctcggtggggatgtcgtaggggtactggttgaacaggctgcccgccatgaaccacacggtgtccagctcagcatactcccggtcgatgccctgtttgaggttgttgggggaaagaagaggggaatgagcagggggaagtgcagggcaagaagaggagcataccgaggcgttgttcgcttgcgacgccgccccctcaagcaccacaggaacaagggagcgcggccacaccttcatgcgttcgttgacctgggcgacnnnnnnnnnnccgccgccccctcaagcaccataggaataagggagcgcggccgcaccttcatgcgttcgttgacctgggcgac

SEQ ID NO: 46945 - DNA, 61 bp, Chlorella protothecoides
cctgctggtggagggcgtggctgcgcagggggagcctttggtcaattggtgcgccgacatt

SEQ ID NO: 46946 - DNA, 61 bp, Chlorella protothecoides
gaaacccacatctgtgccgcccagtctctcacctaggacgctcttgagcaggtgcagccgc

SEQ ID NO: 46947 - DNA, 61 bp, Chlorella protothecoides
gggcagggccgcggccacgaccacaagcagtgcagccgccacgaggatgatgggcccggcg

SEQ ID NO: 46948 - DNA, 61 bp, Chlorella protothecoides
ctcgtctgcggcgccagctttatcccccccaccctcgccacgggacgccacccaggtctcg

SEQ ID NO: 46949 - DNA, 144 bp, Chlorella protothecoides
tgcagggcagcaaggtccgcccctgaggggtggactgttccaggatcttgggagggcaggtgcaataccctgaccttgtcacagccgagtcgtgcgcggagtcgctgtgcagatcagacaatgcatcacaggaagaggcgcaga

SEQ ID NO: 46950 - DNA, 67 bp, Chlorella protothecoides
agatctgtaaggtacaaaggcgctgcggatccggaatgacgtccgtggtgatcggatgtggtggttg

SEQ ID NO: 46951 - DNA, 74 bp, Chlorella protothecoides
ggtggtggtggagacttcttggcgggaggccgcggaagcttcttggcaggaggcggtggagacaacttggcggg

SEQ ID NO: 46952 - DNA, 61 bp, Chlorella protothecoides
gtatgcatgggtccttgccttcccaaccccacccgccaaaaagtctccacctccacccgcc

SEQ ID NO: 46953 - DNA, 79 bp, Chlorella protothecoides
ctgcaggtgggcctaagagtgggaagtttgactattgcgcactagtgaagctggcccggcagagcgccgtccacaggag

SEQ ID NO: 46954 - DNA, 61 bp, Chlorella protothecoides
tgaacgctcggatgcagacccctcgcatcagggcaggcgagggagccgcacccagctgaaa

SEQ ID NO: 46955 - DNA, 70 bp, Chlorella protothecoides
agtgccactaaagcttcaccttgaccagattttagagtccaaagcacggcattacattatcactggttgg

SEQ ID NO: 46956 - DNA, 59210 bp, Chlorella protothecoides
  modified_base (668)..(677): a, c, t, g, unknown or other
  modified_base (1112)..(1194): a, c, t, g, unknown or other
  modified_base (1949)..(1958): a, c, t, g, unknown or other
  modified_base (2141)..(2150): a, c, t, g, unknown or other
  modified_base (2820)..(3036): a, c, t, g, unknown or other
  modified_base (3137)..(3146): a, c, t, g, unknown or other
  modified_base (3346)..(3355): a, c, t, g, unknown or other
  modified_base (4045)..(4054): a, c, t, g, unknown or other
  modified_base (5382)..(5391): a, c, t, g, unknown or other
  modified_base (5818)..(5827): a, c, t, g, unknown or other
  modified_base (5919)..(5928): a, c, t, g, unknown or other
  modified_base (6092)..(6101): a, c, t, g, unknown or other
  modified_base (6824)..(6901): a, c, t, g, unknown or other
  modified_base (7072)..(7081): a, c, t, g, unknown or other
  modified_base (7728)..(7737): a, c, t, g, unknown or other
  modified_base (8395)..(8404): a, c, t, g, unknown or other
  modified_base (9246)..(9255): a, c, t, g, unknown or other
  modified_base (10019)..(10028): a, c, t, g, unknown or other
  modified_base (10575)..(10584): a, c, t, g, unknown or other
  modified_base (10958)..(11001): a, c, t, g, unknown or other
  modified_base (11231)..(11287): a, c, t, g, unknown or other
  modified_base (11354)..(11363): a, c, t, g, unknown or other
  modified_base (11925)..(11934): a, c, t, g, unknown or other
  modified_base (12393)..(12402): a, c, t, g, unknown or other
  modified_base (13106)..(13115): a, c, t, g, unknown or other
  modified_base (13314)..(13323): a, c, t, g, unknown or other
  modified_base (13834)..(13843): a, c, t, g, unknown or other
  modified_base (14467)..(14476): a, c, t, g, unknown or other
  modified_base (14592)..(14601): a, c, t, g, unknown or other
  modified_base (14710)..(14719): a, c, t, g, unknown or other
  modified_base (15397)..(15406): a, c, t, g, unknown or other
  modified_base (15750)..(15759): a, c, t, g, unknown or other
  modified_base (17268)..(17277): a, c, t, g, unknown or other
  modified_base (17746)..(17755): a, c, t, g, unknown or other
  modified_base (18353)..(18362): a, c, t, g, unknown or other
  modified_base (19418)..(19427): a, c, t, g, unknown or other
  modified_base (19961)..(19970): a, c, t, g, unknown or other
  modified_base (20466)..(20475): a, c, t, g, unknown or other
  modified_base (20727)..(20736): a, c, t, g, unknown or other
  modified_base (21342)..(21351): a, c, t, g, unknown or other
  modified_base (23817)..(23826): a, c, t, g, unknown or other
  modified_base (24380)..(24389): a, c, t, g, unknown or other
  modified_base (25577)..(25586): a, c, t, g, unknown or other
  modified_base (25982)..(25991): a, c, t, g, unknown or other
  modified_base (26752)..(26789): a, c, t, g, unknown or other
  modified_base (27338)..(27347): a, c, t, g, unknown or other
  modified_base (27695)..(27704): a, c, t, g, unknown or other
  modified_base (28195)..(28204): a, c, t, g, unknown or other
  modified_base (31198)..(31207): a, c, t, g, unknown or other
  modified_base (31593)..(31602): a, c, t, g, unknown or other
  modified_base (32157)..(32251): a, c, t, g, unknown or other
  modified_base (34276)..(34285): a, c, t, g, unknown or other
  modified_base (35366)..(35375): a, c, t, g, unknown or other
  modified_base (35581)..(35590): a, c, t, g, unknown or other
  modified_base (37502)..(37511): a, c, t, g, unknown or other
  modified_base (37754)..(37763): a, c, t, g, unknown or other
  modified_base (38166)..(38175): a, c, t, g, unknown or other
  modified_base (38596)..(38605): a, c, t, g, unknown or other
  modified_base (40743)..(40752): a, c, t, g, unknown or other
  modified_base (41672)..(41681): a, c, t, g, unknown or other
  modified_base (42058)..(42067): a, c, t, g, unknown or other
  modified_base (42749)..(42758): a, c, t, g, unknown or other
  modified_base (43027)..(43036): a, c, t, g, unknown or other
  modified_base (44594)..(44603): a, c, t, g, unknown or other
  modified_base (45505)..(45514): a, c, t, g, unknown or other
  modified_base (45680)..(45689): a, c, t, g, unknown or other
  modified_base (45794)..(45803): a, c, t, g, unknown or other
  modified_base (46559)..(46568): a, c, t, g, unknown or other
  modified_base (47361)..(47370): a, c, t, g, unknown or other
  modified_base (47503)..(47512): a, c, t, g, unknown or other
  modified_base (47592)..(47601): a, c, t, g, unknown or other
  modified_base (47739)..(47748): a, c, t, g, unknown or other
  modified_base (48260)..(48269): a, c, t, g, unknown or other
  modified_base (48651)..(48660): a, c, t, g, unknown or other
  modified_base (48958)..(49005): a, c, t, g, unknown or other
  modified_base (49090)..(49099): a, c, t, g, unknown or other
  modified_base (49526)..(49535): a, c, t, g, unknown or other
  modified_base (50467)..(50476): a, c, t, g, unknown or other
  modified_base (51449)..(51458): a, c, t, g, unknown or other
  modified_base (51613)..(51622): a, c, t, g, unknown or other
  modified_base (52050)..(52059): a, c, t, g, unknown or other
  modified_base (52122)..(52256): a, c, t, g, unknown or other
  modified_base (52662)..(52671): a, c, t, g, unknown or other
  modified_base (53211)..(53220): a, c, t, g, unknown or other
  modified_base (53404)..(53462): a, c, t, g, unknown or other
  modified_base (53520)..(53529): a, c, t, g, unknown or other
  modified_base (53934)..(53943): a, c, t, g, unknown or other
  modified_base (54397)..(54518): a, c, t, g, unknown or other
  modified_base (55225)..(55353): a, c, t, g, unknown or other
  modified_base (55996)..(56005): a, c, t, g, unknown or other
  modified_base (56491)..(56500): a, c, t, g, unknown or other
  modified_base (57365)..(57374): a, c, t, g, unknown or other
  modified_base (58167)..(58203): a, c, t, g, unknown or other
  modified_base (58645)..(58654): a, c, t, g, unknown or other
ccccccccccaaacgacaggatcacctttgacaaggagaacgtgcgcgacctgtccacccccgtgtcggtgaccacggcggagggggaggaggtggccatcggcacgaccttcatcccctcgcacatgcagcgcgagtcactggcccgccagctggaggccacgcacgtggagccggcgccagccgcggccccgggtcccgcctgccacatcgaccccgcgctctcctgcctcgacccggtgctgggccaggacctgtgccgcgccaagtgcagcgtgtcggccgccgccaccgacgacgctgcggtggcgggcgtggaccccgccatagtggatgccgccacctccgcgcaccaggggcaggcggcgaggcggggcgcggagccgcgcgccgaggcctactccgtgccgccctgcgagaaccacgcgcgtgccgtggagcgcagcctgcgtggcgagtcgggctagggggaccggtcgacggtggggatggcggacggccctcacacgacagagccggacagcccctgcacgacagcaggctcgacggccgcgcacgacgccgccgcgcgcgacgatacgcgcgcggcggcagcaccaaacccctgtaaaacacactgcgcgcgcgacattcggcgcggcgcgtgcacgccatgaaccatacgcgcnnnnnnnnnngccaaacccctgtacaacacaccgcgcgcgcgacattcggcgcgtgcacgccatgaaccatacgcgcgtcctgatcggccggcgggcgtcgccgcgcccaccctgcaacgcacccgatccctccattcttttgcgtcgaggcctacccaaacccctttgtccgacgcccactcgtagcactgccccccctctccccccccttggaacggggggaaacccatgcagaacctagccccgccccttccccttttgtacatgttgccccaacctgctccgcccagtacttcttgcccacgctgctgtaaaggcgcgtcacatcagggcccggccgtcaggcacaaggcactccacccccgcggcccgcgccgcgcccgtgagcgcggcgcgcagctcgcccagcaggcgcgggtcgcagcgagcggcggcgggcgccgnnnnnnnnnnnnnnnnnnnnnnnnnnnnnnnnnnnnnnnnnnnnnnnnnnnnnnnnnnnnnnnnnnnnnnnnnnnnnnnnnnnggcccagcggcgtgaccgagatccagcgccgcgacaccgcccaggagtcggtaccctcctcctcgtccctggcgggcgtaggggttggggggggggaggcatggaagcggggaggaatgaggccggggcgcatacggtcgccgttccagggcaatggtgtcgtttgcccgttgacggagtgtgcatgcgcccgagacgcatgaagcagcatgggaggccccgagccggaatgagtgggacatcctggcgggacggagcggccaggggtgtgtcctctttacaacccagccaggcaggccccaccttcgaaagtcgccgcccacgttgttgaaggcccgcagcacgacgccgggcccagccacggccagcgcctcggccaggtccacgtcctcacgaggcccggcctccgtgaagagcgggagcaggcactgcctcccctggtgcgccaggcagtacccccgcgcctcgccctcgggcacattgatgttgagcaagtggccggacaggggctccagcagggatgcggacccgggcagcaggcccagcacggcctgccaggcagggagaggggccgacgtcgggcaggtctggccaaggagccagagctgtgccccgggcgctcaggtgcatgcatgctgacatggacgggttgcagatgatgggggtcctcatgacagtgcagcccacatgcagcccaccctttttacacacacacaatcacactgacacacacaaaccttgatgaggacgacgcnnnnnnnnnntccctcatgacagtgcagcccacatgaagcccacccttttgacacacacacaatcacaacgacacacacaaaccttgatgaggacgacgccgtgcctggcagcttgggcgaagccttctatgctacgtgcgctgtggttgtccagcgagagcgcgatggagggcacgcccttgcaggcggccnnnnnnnnnncacgctacgcgcgctgtggttgtccagcgagagagcgatggagggcacgcccttgcaggcggcctcgcgcgcggcgcccactgtcccgctgtagatgatgtgcaggccgcagttgtcgcctcggttgatgccggagaccaccaggtcaaacttgttgttctgggcaaggacggggtccgggagagttggtgggtggcacaggcctggccactcgggcccccttttgcagtctgcccgtcagcgcataccttgagcaggggtccgtagagcgccagcatgaccgagtctgccggggtgccactcacggcccaagcctcctccgcgcctggcacggagattgggaaggcatgcagggggtggtggatgttgatggagtggctctgggccgagcgctccccgctggggccgcagacgctgaagtcgcagaagttctcctggtgcagcagcgtggcgagggacacgaggccgggggccgtgacgccatcatcattgctgatcaggatgtgagggcgcagtggggtcattgcgagcggggtgggcccccgggtcccctgcttaagctcggaaactgaatgctcctcgaaaaggactgtgtctaattcacaagacctaagtggtttagtatagaccctcggagcccgctccttcatcgtctggagtattggctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatgcgcatcgatctaacggcagtgtttgacatggtttgttgagtgaggggggatgatgtcggtcgatacatgcgggcatggcattccaatgagcatgcnnnnnnnnnntgctttcggtgctggagatgctcgacctccggagtcacgtgaactccggtgctcgcctccttttaaatcggcggtggatgccgtacgcatgtatcgccattgtggtcctcatcagcctctccatcaagcaaaaaaatagtaatgacattgtgactcagtaatcgagtgaaatgtcgcctcactccctcccagcgctgctnnnnnnnnnnattttaaatcggcggtgggtgccatacgcatgtatcgccattgtggtccttatcagcctctccatcaagcaaaaaactagtaatgacattgtgactcagtaattgagtggaatgtcgcctcactccctcccagcgctgctcgcacagagtgccggcatgcgcatcgatctgacggcagtgtttgacatggttagttgagtgaggggggatgacgcctgtcgatgcatgcgggcatggcattccaatgagcatgccatcagaattcatccctactcatgccccattccacaccagaccagcggcttgctgaacgctcaggcacacctgtcgcccgatcagcgggaagtctgcatgaagatcgtgaagaggtaaggcgccgagacattgagacagcagtgagctgctgtggctttagggcattaacaagcacagcttctcacgaataggctgcacgaggacttcttcccggatcggaaggcgagactggtggactctgtgcgtgcctccctggagcagactgcgaatttggcagtgctggtccaggctgccgagagcagcagggaagctgtgttcatattcagctcagacgccaggcaggtcgattgtgggatcgcttgtttgtttctataagctgttgcaatagctggagacgctgatgatggggagggtgcggcaatgtcacctgaacannnnnnnnnnagggattgcttgtttgtttctataagctattgcaacagctggagacgctgatgctggggagggtgcggcaatgtcacctgaacaccatgggatgccagatgatggacaggaacacatgccagcaggaaggagcgtacacatcagcacaggcctgaaaacgctccaccccatcgaatccagcaggctgttgaagcagacatccgttgggcgactcaagcctgctcctcagtatgcaacacattgcttgcatgcatgcagcaacgactggtttcaggcccgctgcgaactccaagcactcattccagacctggcgaggaagagtgcacgcttgctgtgcctcagctcccccagtcaaactcgatctgtggccacgcccctgccacaccagccccctcgcgcctccctccagctcagcgtggagcccggcgacaccgtgcgggcggcaatcttcctgtctgacaacacggttgactgccagctggctcgggccctgcacagtgtccagtccgcgctgactgccgccaggatgcggcagggcatgtgggggagggccatcgcagccagcaggcggaaaccgcgcgctgtgcacgctgcgcacctggcgatgcaggtgaccgtgccctgcaggcccctgtcccgggccatttatgcaggcggcgctgctgccgctgacgctgacgcggcgaggcaggccaggcgtgcgaaacaggctgcgctggtccagggtgtggttgccatccatgagcagctacacaaagcgtggctggaggccaggtaggcaaggcggggatcgcatccctggcatgatggtaggagatgtatgtttgtttgctgtgaggctctcccttgatagcacctgatggcagacagcctatactagttgaccctgtggtcacattttctcgatgcaaatgggccgctcgcggattcctgtacatcaacttttatgctctgctgctcatgtccctttctccaggatccgggctcagaaggagcgtctggctgcgctgcgatccaatgacatggccgcatatgtcgggctggtggctgtggcggggagctcgcagctggacaagctcctgtgccagacggatgcctgcctgagggcactcacggcccgcctgtccagcacgcgggcggtatcctctgtggggaaaggcctggagggaccaggcacggagtgcagtgagtgtggctgctggggcttcctgagaaatgtggagtgagggtttggtgggccctgggtggatggcgctccgatccgctgacggtgctgaagtgttttggcaggaaaggcctgtagagtgtcagggagcagcatgccctcnnnnnnnnnnagcttcctgagaaatgtgaaatgaggggttggtgggccctgggtagatggcattccgatccgctgacggtgctgaagtgtcttggcaggaaaggtctgtagagtgtcagggagcagcatgccctcataaacttactctatgacgccaaaagtgccccacatccccttatgcttttggaacaaatgaggtcttcctggtccacctttctccacccttttccacccccttcccagggtcgagaggggcagtgcaggagagcagcgctgactggaaccagctggcctgccgcgtgctggccacagaaatctccgagcagcctgccgggctgattggaggccggctgtggccttaccaaatgcaggggttgtgctggatggccggcctggcccgccacagcctcaatggcattctggcggacgagatgggnnnnnnnnnngcacttactctgtgacgccaacagtgccccacatcctcttatgcttttggaacgaagaagatcttcctggtccacctttctccacccttttnnnnnnnnnngttgggcaagacggtgcaggtggggcatgggaggggcggctgagcgagactcgcgggtgagggtttcgccctcatgcgtagacagcaggacaatcattggccggcccctgctgagaatcatggccctcgccgtgaaaccatatctgcaggtcatagccctgatnnnnnnnnnntttgggcaagacggtgcaggtgggcatggggggcggctgagcgagactcgcgggtgagggtttcgaccacatgcgtagacagcaggacagtcattggccggcccctgcggagaatcatggtcctcgctgcgaaaccatatctgcaggtcatagccctgatgatgcacctggtggaagcggatgctgcctgcctgcctttcctcatcgtggtcccagcctccctcgtgcccaactggcaagctgagctgcagcggtgggcgcccgggctcaagaccgtaatctatcgtggcccagccgccgagcgggagaacatttacaatcgccaggtcagactgagacgctggtggcctgggtctgaacgcttgaaccctgtcgtgccgacagtaagtgactcagggccatcagcatcagccggccaggatagccactataccattcacagggcatgtgtcaactccgcatcaccatgagctagcactctcaatccacctttcagatccagcgtggcgtgaggcggcctggaacattccacgtcgttgtgacgacctatgaaatcctgatgggcaagctcgataggtacaggcttcaggggtcgagaagattggctgtggaccgcatcgtgcatgaaatcatgccgccagcttggactttgcatactgttgccatcctcatctggtcaggcttcacccacaccttctattcccaatcccctacaccactccnnnnnnnnnnnnnnnnnnnnnnnnnnnnnnnnnnnnnnnnnnnnnnnnnnnnnnnnnnnnnnnnnnnnnnnnnnnnnnggtccctgctcaatttcctgctgcccgacctcttcaacagctgcgaggatttccagacctggtgaggaggaagaatgcgatgcagcctctgggcaaaaatttgtggagtgcaaatggccagagaagactttgctgcattacgtgggccattacctgatcagaatctgaagnnnnnnnnnnggatgcagcctctgggcaagaatttgtggagtgcaaatggccagagaagattttgctgctttccgtgggccattacctgatcagaatctgaagggtaagcatgtcagaatggtcatgtctggatgtatgtcccagagaccctctatgaggcatatgtcttacctatgccacacacgttccaagcatcgctgacctttaggtttggaggtgccccgcggtcaaccacccatcccccagaccaggagggtgatgagtcggccgctctgctgactgaggaggagcagctggtcgtcaccagccgcctgcaccaggtcctgcggccttttgtgctccggcggctgaaggaaagcgtggcaagccagctcccagaaaaggtggagttctgaacagaggatatgctggggaacagattctgattgtcatgttacgttcagcaaatccacacagggaatgggtgtcgctcagtccccaccaccactgcagatcgaggtcctggtgaggtgccccatgtcgccctaccagcaagcgctgacaaatattattgctgaagggaccagagcaaggccaggtacagggaatggtggagagcaattcagggcttgcctttgtccatcatcgtcaaagttgtcaaccttggcaatgtccannnnnnnnnntagcaattcagggctcgcctttgtccatccgcgtcaaagttgtcaaccttggcaatgtccatgtaggttcccggatgctccattccgtggaaatgctgtgcgagtgtaccccacaaatctagccttctcaacacctcgacccgcaacctcccatggttcttaggtggaggcatccaaggcgttgccggcgtcaacaatgtagtcatggagctgcgcaccatctgcaaccaccccctgctcaggtttgcgagtcacacgattgcctggccctgccagcggttgtcggggaggtcatgccttgctcctccaaacaccgtgctctcttcctgtcagaactgccgcaaaatgttcactcatcacccgtgcctcaaccctgtggacccctcacagccggctgcacgtgccaggcagtgagtgcgagttgccggcttcaaacctcccggcagaactccgtctgtgcgggaaactggcggttctggaccgaattctgggcaggctcaaggccgcagggcaccgggtgaggcgtgaggggtgttcctagggttggggagtggcgtctggtgggctgtttggcgcaaggagcttggtggtgcacctgcaatttgccacatgctgtgacaatcacctactcttgcacaggtgctcatcttcagcacgnnnnnnnnnntgttgctagggttggggagtggcgtccggtgggctgtttggccaagaaactttggttgtgcacctgcaatttcccatatgctgtgacaatcactcactcttgcacaggtgctcatcttcagcacgatgactcgggccctggatgtgctggaggagtacctgaactggcgggggtacacgtggcagaggctggatggaaacacgggcgcacaggagcgtggtacagaggtggctgccttcaacgcccctggtgggtgatacagtctcgcgcttggcatctgtgcatgcagatgccaagcgatgccttccgtcaatctgtggggagggggtggagtgatgatcgtaccgccaccaccagccctgcacatcaggatgccgcatgatctgtcatcagcatcactccctcaatctcattctccctttccaggctccagcacgtttgtcttcctgctcagcgtgcgggcaggaggcgtgggcctgaatctgcagagcgctgacaccgtcgtgatggtggggcaggggattggtgtggctgaaccatgcttggtcagtttgggtgggcacattggtagcccactgcattgcatgggcagaagtacctcccgctgcaggatggcggcgcctcacatgccagccaaagcaccctttgtcactgcagtatgacacggactggaatgctcagatcgacctgcaggcccaggcccgagtgcatcggctcggccagacgaaaaaggtgtaaaatggagcggtgaaggcgacagtacttggcgcaccggtgcacagggtttttctggtcatctgcgttgtgactgtcagcatcctggccgcatgccaaactcaggnnnnnnnnnnattctggtcgtctgcgctgtgactatcagcatcctggccgcatgccaaactcaggctgctcccgcccttgatcatgcttcgagtccgcaggtgttggtcatccgcctccagactgcgggctctgtggaggagcgggtggttgacgtcgcacagagcaagaggacgtttgtggacagatccatcacctgtgcgtggaagaatgtgggataggagattgttcagggtcgcggatgagatgccttagactattgaccagatcccttgcccttgacaacaaaacatgtcaggcggattctttgacggcaagaccagcgccgcagagaggcagcgccacctcctggaattcattgctgcgtctgctgacagcagcggcatggctggcactagagacggtggcgctgagatgactgacgaagaggtgagatccatggtctgactgaggttctggagtgcatgcgtatcggaactttcaggcagtgcacatagcttcacactctcagcccttccaccgcttccgcccccatgcggcagctgaatgggctggtggccagggacgaagacgacctggcagccatggctggcatctccgccccagcctccgtgctggcagatgcagacggcattgggggcatggtggcagctgcccgagacgcggccactcccaaggaccccgatgccggtgcgtggtcagcagtcagggcgcagtgacaccactcagctctgtcgtatagttcagcaggccccatgcgtcccgaccgccaaannnnnnnnnntggtgcgtggtctgcagtcagggcgcagtgacaactctcagctctgtcgtatagtccagcaggccccatgcgtcccgaccgccaaactcgcgccaatactttcctttgcaggccgcgagtttgggaggggggtgaggcaccgagcggcggcgttggcggcaaaacctttcaagaagagaccacggcgagagtgagtctgcccatggcttttggagtgatggtgggaggtagctggctcacaagtttaacttctgtctggagagtccatgtgttgaatggacccgtgcccatgcctgccatcctcaggaagtcgatctcggagtccctcctcatgtctcagtcctcgacttgttacatccccaaaccacgcagtaggggccagagcaacagggtcgcacacgagcagtgactgcatggcaacgtccctcggaggcggctggcctaacccctgtcccagcaccagcgcgctctgcacccccccccctccctgtcccccacaaacctctcacaagagtttcatccaggcactgcagacagatcttactcnnnnnnnnnngacgtacctcggaggcggctggcctgacccctgtcccagcaccagcgcgccctgcaaccccccccccctccctgtcccccaccaacccctcacaagagtctcatccaggcactgcagacagatcttactcgctcagcaccatgacaagcaagttcactcaggtgtgggtgctggtgtttggtcacttcatgcgtcggggcacgtggcgatgctccaggagcatcgcagcgcgcacttcctccgcgtcgctcgccgtcgctccggtccgcggcgccactcacgccttgggcgccccgccgccgccctcctggcgcagcaggggcgcgatgaggtccagctggtcccgaaccccctgcgccaggtgggtggcccgnnnnnnnnnnnnnnnnnnnnnnnnnnnnnnnnnnnnnnnnnnnnccggcccccgcccggcccggggcgaggaccggcctgggcccgacgtcccctgcgccagccagacacgcgcgacggcggggccgtccctggctctggcgttgtcctgggcggcgctgctcggcccattggaagcctcggcgcgcggagtctgcggcccctctgcatttggcacgggaccgccccccgcgctggcctgtgcggcggccgcggcgggggtgggcgccgccccnnnnnnnnnnnnnnnnnnnnnnnnnnnnnnnnnnnnnnnnnnnnnnnnnnnnnnnnngccgtcacccgactccccgctcgagcgcttggccgtgccaggcctctgctccgccaagctcctgccnnnnnnnnnnaccgtcacccgactccacgctcaagcgcttggccgcgccaggcctctgctccgccaagctcctgccgccatccgccccctccgtcaccgtgcccagctgccgccccgcctcgaaccccagctctgcggccgccagctcgcccgaggtcatggcctccagcaggcccgagggcgccgacagcgacagcaccggcaggttcaggctgctgcgcgagggggagtggggccccgccccgccccgcgccagcgtgtccagctcgctggcggcgccgatgcgcggcagcacctggcgcgaggtcagcatgcggcgcagatgcaggggcagcgagctggccagcgcgcgcgcattcacccgcatgctgtgcatgttgtccacgtacctgggagggtggggtgcggggaatgggaggtgtgtttcttgtgggcagagggttactggaaggaggagggtcgtgaaggcaagcaggctgggcagcggataccacgagcatatatgactgacaggtcgatgcagtgccattcaagcaggcggaggctgccggtgaatgatcaacgaccaaaannnnnnnnnngggtggggtgtggggaatgggtggtgtgtttctcgtgagcagagggttactgggaggaagagggtcgggaaggcaaggaggctgggcagcgggtaccacgagcatatatgactgacaggccgatgcagtgccattcaagcaggcgaaggctgccggtgaatgatcaacgaccaaaatctgggtcaatgccgcgccctatcccgtggctacatgccccatcacaggccgggaccacccgaacaaaactactcccgagctcactggtctgtctcgtccacgatctcaaactggagcagctcctccagcacatcctcgatggtgataatccccacaggctccagttctgagcgggttcacgtgggtaagaaggtggcgagagggcgtgtaaaggccctgccaacatgcggaggcaaggatgcccacccagttggtgacatcatctcgccatcccatgtccannnnnnnnnnaggtggcgagagggcgtgtgaaggccctgccaacatgcggaggcaaggacgctcacccaggtggtgacatcatctcgccatcccatgtccacaagacaagcaggtgcccgtgctcggtgacgccctccaagttaccctgcagccggcaggcaaacaccccttccaacgcacccgacagctgccagtcgacaaacaagtccttgtcccggttctcgcccgctgcctggctggcctgcaggatgtgggaggaggtggggggtggcctttgatgcgggatgtagcgccgagttcgcccgtgcttctgggagcttcaaggcccacggtgcacgcagctgtggccatcgacattgcacgacagtgtcaatggcaagccccccatcagcccgcccctgcacccacaccctcgccgcccctgcacccacatccgatagggtgtccgagctgtccgagtcatacatcaactcctcgcgctcggcgcgggcggccgcgcgcgccgcccgcgcggcctcggtgggccgagacaggacggccatgtgggtccggccgatcttgaacagcttcagcatgtcgtacatgggcgtctctgccaggtggaagcggggagtgcaggtttcctggtggggcgatgctgtgcggcaccaggtgaaggcctggatggagagcctggagcccagacagcggcgtgctcccccttgaaagctgcnnnnnnnnnngtgctgtgcggcaccaggtgcaggcctggatgcagagcctggagcccggacagcggcgtgctcccccttgaaagctgcatggaatccgacagcaggtgccacaccccgcagcacccgccccactcagtacacgtggcgcagacagcctgcgtgccaaaacgcccttggcgcactccaagccccagtcctccctcgagcnnnnnnnnnnaaccccgcagcacccgccccgctcagtacacatggcacagacagcctgcgtgccaaaacacccttcccgcactccaagccccagtcctccctcgagcccagcgactcagggcccccaccccccgccacccgataaacagcaacgcactggccaggaggtagggcagggacctgatcttcagctcccccaccagccgggtctccgacccactcagctgcaccagctcctttgccagagcaatgcccagaatgtggttcctgggtggagagattgagggaagcggggaggaggggtctcgggccgggtgtccaggcgtgccgacccattgctccacccatgttgcttattctttggaacctccccccttaaccccccccccaacacaaagcatctgagccaggcataacccataccccacctcccaacctccccttcccaccccctgttccacccgcgaacctgtttcccgccctgaagacggggatgcgggagtggcccgaggccaggatgnnnnnnnnnntcatgttgcgtattcttggaaacctccccccttgaacacccccccaacacaaagcatctgagccaggcatcacccacaccccacctcccaacctccccttcccaccctctgttccccccgcgaacctgtttcccgccctgaagacagggatgcgggagtggcccgaggccaggatggcggtctgggtgtcggcgtccagcaccgcatcggacgacagcatgaacaccaggtccaggggtgtcatggcctgatccgcggtcttggaggtcaggtccagcgcgcctttgatgatgcccacctcgtcggagctgagctggccgccaaaggtctggccctcgtggtggatgtccaccagcgccttgagctgcgcgcgcttgaacagcgcggtgcggtgcgcgcccagcaggcggtccagcacccagccgatgggccaggccaggggcgcgcagaggaacatgaagacgtggacgaagggcgcggcggcggccccggcctccagcccgtagctggagcacaccgcctgcgggatgatctcgccgaagatgagcaccaccgtgacggagacgatcacggcggtgacggggttggccagccggtccaggtacaggggcagcgcctcggccnnnnnnnnnnagagcacaccgcctgtgggatgatctcgccgaagatgagcaccactgtgacggagacgatcacggcggtgatggggttggccaggcggtccaggtacaggggcagcgcctcggccnnnnnnnnnnacgtaggatctgaggtggggggtggggaggggaggggagtctcctgaaggtcatggttaactgctgctgctgctgctgcgtgtctatgtgtgtgtgtgtgtgtgtgtgnnnnnnnnnngccaggctgttgcccagaagcagtgtcaccagcaggcggtgcgggttgcgcagcagcggcataatggccgcggcggaggcctgctgggagggtgtccccgttctccgtaggatctgaggtggggggtggggagaggaggggagtctcctgagggtcatggtttaactgcttctgctgctgctgtaagagtgtgtgtgtgtgtgcgtgtgtggacagggggggcctggggataatagacacaggctgacacatgcgcccagattgaaagtacctgcgtcgatatgcagtagactgaaaggcaacggcagggaggccactttcccgcccattggggctcgtcctgtacaaccctttcaccatgcaaatcccagtctatcacaagctcagacattggcaccctgcaaacacccccccacccacctccaggtccacgctgtccagggacatgaggcccagggttaggccagacatgaggcccgccatgaggatgaggaagaccaccatagcgacatagtaccagaataggaaggcgccctcctgttctttccccacggcaagctcctcgacggtctgagacagtctacaggacgtagttagcggagttgaggcagtgggaaggggagggaaggagagtgaatgtgctacacgcaaggtcatgctgccccccctctcagccannnnnnnnnngtgaggcagtgggaaggggaggaaaggagagtggatgtgctacatgcaaggtcatgctgccccccctctcagccagcgggcacacctgcgagtgcgagcaatgcccatggcgaggcccatcccctgcagcaggagagggcgcatcctgctttaaatatgcctaaatttccggtacgatcccatgtgcagccccggcatgggtgtgtgagacggtagggctccactgcgggacaccctcgcggcggtcgtcggacgcaaataaactcttggtgagcgttacaagggtaccatcacaggctccaatttatgcatgctcgtgatgatgctgtcaacccctcacacannnnnnnnnngtaaactcttggtgagcgttataagagtaccatctcaggctccaatttatgcatactcgtgatgatgctgtcaacccctcacacagtttcccatcccctgcagtactcttattatgctgagcgggtcctgaggaatatgcggagtgcccacgtgcggaagtcccccagctctcatcatccatcatgtgctgcttgcccagcatcccgggctgggcaggccaaacctaaggtcacctgggtgtctttgttaccatcactcttccttgacagcaatgtgcgcagatgcaccagcatgacgacgctgcagccaggcagacatcaaggccagggcgccaaaccccaggcccaggaggattgcccgggcgtcgtaaagatctgcaagggagttcatgctggataggcgcgttccggcacccactgccacaaagttattgggcatgcaccccagcagcgtgcctggaggggaggggagaaggcagggaggggttgagctggactgctatgatcatagagtagtggtgctgacctgtactcttgcagcttgccttctaggaccactttctcctatcgttcacctctccacaaagcactgatcacctagaggtcagggccaggcccctctcttggcatcccttgcggtggcccaaatccatcaccacgccccacggcacagtggcaacctaccaagggaaaagggccagacggggacgccggccaggggcgaggccacattgatgaaggtgttggggaggaggggagtgacgcgcaggaagatgacgaaggggaggagctggccgcggcgggcggcgacttccgccgcaaagcgctcggtgcgcagcggccacagcgcgcgcacgatgggcctgccgatgagcagggacagcgtgtagcaggacagcgcgcccagcgtgctgatgcctgcaaaacaatgccgggaagggttggaatgacggagcgcggggggcgaaaggggggaggtgcttgatgcaggccggtttgagcgtgttgaatgaggactgagcggggaatatagcatggcatgaggcagcccaccgggatcctagtactgcatgcctgggctagatcccgcacccatctcgctcctcacccgagaccagagcccagcccctccagtgcccatagatggcccccgccaggacgctcagcaccagggtccctgggatggccagactctgcatgaccacataggccatgcagaagcacaccgccacgatgttgggggaggtggctgcgtagcgcaggataacctcacgctgctccagtagcgtgcccaacgtgcgggggggaaagcttttcagtatagccaagtcctctgcctgtgtgttcgtgaatggggaatcgttgtaggaagcatggcttaaaaggggcagttaaaattataatgggaagccgtccctgcaaaaacctcatgaactggcagcaccacaaggcggtaagggggcaggagcgtcccccataatctcaccgagagggctgggaggcaccagnnnnnnnnnngaagcttttcagtatagccaagtcttctgcctgtgtgttcgtgaatggggaaacgttgtaggaagcatggcttgagaggggcacttaaaattatgatgggaagccgtccctgcaaaaagttcatgaactggcagcaccacgaggcggtaagggggcaggagcgtcccccacaatctcaccgagagggctgggaggcaccaggtgaggggcacgagggagagcagcagcactgccagtagcgcaacaccagctaacaggctccttcgagcctccctccataccctagcatcgtcgccactctcacggtcgggacctcccgacgccatgagggggtcgcgatgccgtagcactgccctgctatcgcatgttttgtgctatgggtttctcaaacaggtccgccctactccatcactctttcgcaatgattctgctgctaactcatgcaccctgctgatcgaaaagtgcaatnnnnnnnnnnttttctcaaacaggtccgccccactccatcactctttcgcaataattctactgctaattcatgcaccctgctgatcgaaaagtgcaatatgccaagttttttcaaattcggaactccatataccggaatcagggtttcttggtgattgaaggaggtcatgcgaataaataactggggcaccggacttacagagctcgacctgtgaaaagcctgcagggtcctacattcagcaagatatgcgtacatcaaagatgaattttaggccagtcctcgagagcgagactcacaattgaagattccgaaggaagcctggaaggttgtgtaaacaagtgcacctgggctttgactattagaacttattactgatatccagcacaaagatgacagttcaaaagtctgagcttcttccattcaggcaagatatgggtcgttcgcttttggaggactttcatgcctccaagcaccatgctgtaacggggaaaccgagcaagtggcccgggctcagcagaatggccgtggcctgcggtaacattgcatgacacaggtatatacttgccttcatattagctctgttgtgcctcgggcgtaagcgggccannnnnnnnnnaggccagtcctcgagagcgagactcgcgattgaagattccaaaggaagcctggaaggatgtgtaaacaagtgcacctgggcgttgactattagaacttattactgagatccagcacaaagatgacagttcaaaatactgagcttctagattcaggcaggatatgggtcgttcgcttttggagaactttcatgcctccttacctccaagcaccatgctgtaacggggaaaccgagcaagtggcccgggctcagcagaatggccaaggcctgcggtaaaactgcatgacacaggtatatacttgccctcatttttcctctgttgtgcctcgggcgtaagcgggccagatacctctctttcgttgttcattcacatggcggcctgctttcctctcgttgcgcgtcacatggatggtctgctcgcatgcggaattcgtcacacgccagcgaagcataccctccgagttctgggctagctgatgccattataatgctctggagtttgtcttgcgcccttccctgaccgggatcccctcggacctgctcaccgtcccaccggctctagtgcctgggcttgctcctccatccggcaccatgtacggcagcgcaggcgtgcactccaatcccagcggcatgctcctgtcgggaggaagctttggtcggaaaagtgagcgctccagggcctcggtggtgtgtgtctgtgacggtgcccgtcacttccggcggttcacggcgtgtgtcacatccctgtgtcttcatccccagtcgtgctaccataccaagccctcaaacccctcatccctccccctcttcctgcacccccttccccaggccaggcgctctgggcctccgccggccagctggtgtccatgggccaggctgggctgggcctggtcatcatgctcctctcctggctcttcttctacgagttcacggaggccacgggcctgatgctgggcgcggccatgctgggcgcgggcggcgtgggttgggcgggcggccgcgcccgctccgccaacctgagcaacctgcacctgctggccaccctcctggccctcnnnnnnnnnnccgcgggcggcgtgggttgggtgggcggccgtgcccgctccgccaacctgagcaatctgcacctgctggccaccctcctggccctcctcctgtccttcaacttcatcggccaggtggtgcgagaggtgcacgtcgactgcggcctggccgagctcttcctgcagggccgcgtgctggaggagcgcgtgacggcgctgcgccagactgaggccatgcacaccgtctactcccgcctgaacgagatggaggacatgctgacgctggtgcaggagggcgcggccaagaccctggagctcaagggcgagcaggagcggctgcgccacaccgacgccgcctacatcggggccaagctggacctgctgcggcgccacgcgcagtcggccctggacaacatcctgtccaaccccaacctgaacgagaccgtggtcagggtaggtgatcgattgtgcaggggtggtgactgggtgggtgggtgagtgtgggtgtgcagttggggggtcatggacgggacagagggacagggtctgtctggannnnnnnnnngggttgtgcaggggtggtgactgggtgggtgagtgagtgtgggtgtgcggttggggggtcatcgacgggacagagggacagggtctgtctggaagtcacctttggtagacaggtgttctataagagtcagcagaccacaggcaaggtgcagcctggcacaccaggccaggccttattgaccgatgcatgagcatgacgacgcacgcccacggtctcgctccccccatccccttccgcccagaacctgaatgaggcagacaaggactacctgcgcaagcgtctggacaccgcagacagggtggtggcccgcatccagaagcaccacgagtgcgtcgggtggatgtgttgtgtgggaaaggaagggtttgggggagggggtatgcagggcggcatcctggggaggtccctgatcgctgcaatcatgtggcgtgtctgccctcaaatcgaaaagtctcacgctcggattgcgagccatggctgccttgcttccctgccnnnnnnnnnngtatgcagggcggcatcctggggaggcccctgatcgctgcaatcgtgtggcgtgtctgcccctcagatcgaaaagtctcacgctcggggtgcgagccatggctgccttgcttccctgcctaccccgcacgccctatgcacccgctgcctctgcgcctgcagctttgcatccacctccaccactccccacgccccacggggcccccccctcaagcaaacccattctccccatcccaccgtgcgcagggaggannnnnnnnnncccccccctccagcaacccctttctccccatcccaccgtgcgcagggaggacggccaggacatcaccttcgaggagtacaacgagctgctgagcgcgctgacggacgccagcgtcttcgccgacaagcacggcgacggcgatctggtgcaggcccgggccgagctgcccaacatggcgggggcgctgaagcggcggcgcgatgatgagtaccacaacctgctccccggctcggcccacaaggacctggagcggataaacgcgcggcgcgcgcgctcgcgcgccgagtgggagcgccagctgacccagatcctggacgcgcaggcgcgggcgggggcgggtggcgccgacatgggcacccagctggcggagcattgcgtgcgagagtcgcgggggcatgcgatcaccatggcggcaggcctgctggcggtggccgtgcagctggcctccgcctacgtggcgctgtccctcagcatgcgcctgcccctcaagggcgactagggatggggaggatgaggggagtgggagggggtccgggggaattggtgaggtgggagctgacaagtgaaggggccggcagcgccccgacggcgctgccactccctcgnnnnnnnnnngtggggaggatgaggggagtggaagggggtcctgggggattggtgaggtggaagctgacaggtaaaggggccgccagcgccccgacggcgctgccactccctcgttgataccatcccaggacagacctcttcaccctcccccaaggaagccaccccaccaccatccactgcgtttctgctaccaaaaacctctttcgtctgttgctgactgtgttgctgcgttctgttgatgacctgaccctgccgagaggctgaaccggaccctcgtcttcgtgtttccctgatcctcttattcgtcgtgtgcacatgttccaaactgtcaccgagaatcattcagctagctgctagaaagagggggtgccagatcacagattgggtgcctcatcatggcaatatgacgacgccaggcctgcatgcgacggcactgcgagtacctcccagcttccttgtcctcgcacatctcgcaggcatcccgccgctgtgatatcagcggcccgcacctccactccctgactctgcagcttcacaccctggcctcttccctggctcccatgccagcatgccatgccctgaactcctgtactcccctccgctcattgcgggtggtacaccttgtggccgtactgctcgtcgtaccgcctggtgtgctccagcacggccttgatcgcgtcgcaggaccccgggtccacgccgacgcgcagcgccttgtagtcgcgcgcgcccgcccagatcttgtgcaccgcgccgcggacgtcccagcctgcggtcgttgggatgatgtggggtttcatttggtggacaggacggagcatgtggtcgtggccgcacagccagacacagggcacagggggagaagccatgatgcacgcctgcagcagtcctgcgacacccctacaggggctgtcccggacagaacatcgggccaggctcaccatctccctccagggagtccaggacggtggtctgcacatgccgcgctttctcggggtccacctccacgacccagggcagtgccgccagggcaccaaagagggggtccatctgctgcatccgcagcttccacctaagcgccgcgctctccttcttcgcggccgccgactcctccggctgctgtgtacacgattgaggacgggaattggggatgtgcagcgcagttcaagcagcccagcgggagtgtgccaggggacgctcgacatgagcaagcaggtcccaaccaaacaggtgagcagagaagacctttaacagagcatcacaagcatctctggcccctgctatccagggcatgtgcacagggtgtgtgccaccctgctgacgctccatccggccccgtacctcagagtccctgctcaggatattaatctgctcctcagacatggggggctccgggggcgcgctcgacctgggcgccgccgccgggcgggctgcctggccagtctgctccctcagacccgctgtcttgcgcatcatggcgcgcagaaaggccgcccgcccgccgaagaactcccggtcctggaagctgaagctgggatccacgcccgcccgctggaacagggcggcgaggtcggccttcacgctctcctcgcagtcggcccccgtcgtgcgcagcaggccccgcgcgtagtcgatgcccttgggcttcctgcagcggtggtcagtacagcctttgtgagtgggggacggaaggaggggtcccgaggatgggcatgtgcagggcgtggtggcagcggcaggcagaggacaatgtgcggcaagcacccatgtgcagtccccgaggtgaacgtacttgacggcaaactggaccctcagggtttccttgggtgggaaggaggatggcatggacagccggaggcagaagccctgcagcctccgtagcatctcccggttcccatccaggatgcttggtggcaactgggggttggtcaccacgccctccagatcggacagggcgtcaggcagcgatcgctgcttcgcacccttggaagagggggacaccagggaatccttggcttggcgaagactgtccaggatgcggcggccgatgccaagcccggagttgggccgggtgcccatctcccggaagcaggctgccgggcgtgccgagcgggtagccacggcagccagcattgtaccgatttgaagctctcaacttgaatacggtgtggtgctccgtcgatcgacgatgtgaagtgccgtcggggagtttgctgtatcagtcagtcggcagcgggcagaagacgagcccaagctgatgcaacgcatgcatcgagaatattcaatcagaatttcataacagcaactccactttaatctgtgcagggtttgctacaggatcatgcagaggcaataccggctttggcgcgcgcgtccagtcctacctgcgtgcactgcaatccactgccaggactgacctcccctgcacgacccacaactcctggaagtctgccctgcctagggtcacagacggannnnnnnnnnctggcgcgcgcgtccagtcctaactgcgtgcaatgcaatatactgccaggactaacctcccctgcacgatccgcaactcctgaaagtctgccctgcctagggtcacagacggacagcctgttcaggcaaacaggagtgaggtggcatgcaccgtactataaaacagagtgcccgccagcggcacaaactgccccgtcagcagcttaatggcctcctggctggcgatggagccaatgatggccgccacgcagtgcagctccaccccgccccatcgcacgagttccgtggtggcatcctcgggcaggtggacgccggagatccccgactcggccaggaggccctgtgcgatggcatgcagctgcgagacctcgccctcagggacctcgctgcagtgaggaatggggttggggggggggcaccgtgggtgactttgcgcagcgtgccggacaagacaggtgctcaactcaatgaggagagactcttagcctcaaattggttttgggccaagtactgcatacagggtaagctgtgcttctactgaccttccccaaccnnnnnnnnnnaggggttgggggggcaccgtgggtgaccatgcgcagcgtgccagacaaggcaggtgctcaactcaatgaggagagactcttagcctcaaaaggttttgggccgagaactgcatacagggaaagctgtgcttctactgaccttccccaaccattatccctctcatctcgcatgaatggtgccccccttcccaacccctaaggcccttcccacctgccctgcagcgatccagggaagcgctgatgtgtcctgtagtatctatccgcagcaggtaccagcaccgagaacgcagccgtgctcgctgtggcgtcctcactggccagcgcctgacgcaacgcgtctgtccctcctttttctggttctgtcctcactggcaggccgtctgggtgcagggcggggcaccgaatgactctggcaagggacattgagggcggggcaagtacaaattttcaattatatgaggggttatctcttgagggccatatttgatcaagggatgtggacctactgcttctgcctgacggtgggtgcccagtagtaacatctggtcgatcctcctcacagccgtccttgtggcccgtcacaagagggcaggcagcattctgtgtggcacaacaacatccggccatcctctccagcctcctctcctacctgaggcgccgcgcattcttgcacaccgagcgaacatatgccgaggtcaccctgctgacgctggcaccggcggctccagccacgtcgtgcgccagcccttcgactgcaaacagggggcgaatgtaatgggcaacaagattttggcgctgacgctgtggcaccatggcaaagcgctgcaggtctgtcatgttctcacatgcccggccccgcagatacatcccgcccggccctcaccctcttgagcgtcagcctcggccttggctcggtacagccgctgcagggccaggaactcctgagacccagcatgcatgtcaggaatgtttccctggtgcgaggtaggagagaggaagaattggtgctcgtgggataggaccttggatatcgagcgttggagagcttttccatagcgctaagcgtctctcacaagccatgcatgaccgaccatgcaggccaggctgtctgccacatatgtaccattcaaactgtgttctagagccgttggggcatgccccaccacacaatatacctccaggggcagnnnnnnnnnnataccatccaaactgtgctctagagttgttggggcataccccaccacacaatatacctccaggggcagggcgcctgctgcattggaggccacaaagcggctcagggccgccacgcagatccagaagggggaggagccggcgcggagatgctggcaggcttcgtcctggaacaagcgcaccagctccggggctgcaggcagcatggaggagggttgaatgtcggcgggggtggcctgaagggattatgagtctcgcccaccaggcatgatcgcgaggcgcactgcttgataacttgaatccatgcatagacgctgcagccagcaagcatttcaaggacactggaggtctctctgtggacagatgggcccccctcaaacatccagcctgttgtcaaannnnnnnnnnccattgaatccatgcatggacgctgcagccagcaagcatttcaaagacactggaggtctctctgtggatagatggccccccctcaaacatccagcctgttgtcaaacacagacatacttggagcggagctcccagaccacactctgtgcgcattggcgatcgcctctgtgatgttttcttcctgtgagggggtgtcagattctgtgcgtcgcgagaaggagatgcacaaattatggggaactactccaatcagaggttcataaaggggtgccctgaaatctgagaagtgtataggttttggcacctgagagtactatacatgtcccagcaaccaggatgcaacatgtaaactgcctagaatacgcatctctcccaggcagcacccccccggcatatcctttacctcaatggggacgccctcgatgcagcgctgcaacgatcggaggccctccttgaagtctgccttctctgccgatgtacgagggaacggtgcaccatgcgtcgcggcccaggctgccgccgccctgatgagcaggagggcatatgggacgtgacccctgacgtggtcatccagcaggccggcatcgacttgcgccgcagcctctgccagctctggccagggctcggtcaacctgtcggagaaacgtggtgttgtgctcgacggcagtgtgcgaagctgaaagacacacgcttcccgtccctccccgcaaaacgagtggcaaaatggtccttcaacccccccccccccccccccccccccnnnnnnnnnnnnnnnnnnnnnnnnnnnnnnnnnnnnnntcaggtcttctatcgtgttgtctggcttggactcgacgacgcagtgctcagcgacgcacacctggtgggcagcaggaccaggcatgggcatgaggatccaagcaggataagctggcagcatcgtgctgagacgattccgggtgaccaaggccacactgcgtccctccaggcaacccatcggcacaaggaggcccaacactgcatccgaggggtcaggggcccgaggccatttgaccctgttcacctggacgagtccgacgaggccataggcccggcccaggatcaggggaatgcccctctcgcgacacacagcgtccagcgctgcagcgtcgctagatcgcagctgcgagaggagcttgggtggggattcgtaagtttgtgctgggtgccgctggcatctgggattcaaaaacaaggcacactgcgggcacgtggctgtgagtctactatgacatttctgcaaagatcagtcgctgaatgcctatacagcagtacaaagcagtatagcaagtacctgagcgccgatgaccaggtcgtactcatggaagnnnnnnnnnngggcaaagatcagtcgctgaatgcctttacagcagtacaaagcagtacaacaagtacctgggcgccgatgaccaggtcgtactcatggaagaaggaggggttgctggagatgagctgcgcaggctcatctaccacgtaactcccccctacggcctcgttcagctccttgaggctggctgcacaatggtgggggttgttcagaccttcaagccagcctagcatgcgctcagcatggggccaggcaaggatgccaacacgcaggcaggaccaccccagcatggcccggcgtgcctgtcacgacctccgccctggggcggcccaaggcatcctggtcaatcatgaagttannnnnnnnnnaaccaccccagcatggtccggcgtacctgtcacgacctccgccctagggcgccccaaggcatcctggtcaatcatgaagttattgcccaggtcctggggtcccaccctctcgccatccaccacggtgaaggatcggatgcctcccagcaccaagtttttcagggcttcagccccggtaggtccagcatgcaggaggcacaccgaagccctttccagggcgtcctggccctccgcaccccaaatgcgcatgcccctgtcatagcgcacgcgcgattcccgggcagggctgcaggtaggggcaccgctggaggagggggacccagcctccgcggaggccatgagggctgactgcgatgccagcgtcgtcttgcagtaatagatctgctctataaaggttggtaaaagcgagtcatgacatgccagcggagtccgatcggcagcatggcccgatgtgacttcggggcgcggatcagtctttccgtgcccgggtnnnnnnnnnnatctatacaggttggtaagagcgaggcatgacatgccagcggagattggcagcatggcccgatgtgacttctgggcgcggatcagtctttccgtgcccgggtgcatgcgccgcgcccgatttgatttcaaagcaggttccatggagtagggacccacacgagtgaccatagcgactgacactgagcatgtacacggtcgttgcgcaggagtcgaccagggaggtctagaagtgtctcgcccccacccgcggatcacttattgggcccctttcgtacacagccatagcgagctaaaagccacggacatggctagcgacaaggaactcgatactccagacgacacagggaataccgaggacctggccccatcggacatcctggatggctgggatgagctctcccgaccacccagcgtcaggtccatgccagcctcgctggccagccgctctgccggccccgcctcgaggtctgacagcctgggatcgtcccccagtgcgacttcatcgcccagcaaggcgtcgcgggcggagggggcgaccatggcacccccgaggctgggtcaggctgaagcctcccacccgatccccaacattcaagagggagatgggggcctagagtcacggaaccctcgcgtgccgcctccccagcgacctgcggcgcgagcgccagcctcgaggtcccagcggggccgcgggaggctgggcatcatgcgggccggaatcctggaggccaggcagccgggaggcgcgctcgccggtgagcccaccgcaatgcagtcccgctcgcaggatcctgcgcctgcgggcaacactgcctcgagtgtgtcggtgcggaccgaggcacggcccatgtggcctcctggggccgccgaggcgggcctggctggaaaggaggggcctgcgaggcagcgccccacaccgcgccccactgcggctcccaggaagtctcagactgatgtgaagccgagccctgcctcgtgcagcgccccggctggggatcccagcgccggaaagggacctgcagggcaggtggctggggacgacggggctgctgctgctgaggagtcccggccgcccgcagccggcggctggggcggctggggtgcactcaccaagctgaaggccagcgtgcagcaggtcgccgccacggcggtggatgacgtcacgcagctcaccaccagcttccagcaggtgttgtgggccattagctgctgcggcggggcgggggaaggggggtaaggtgtgcacacgaggtgcccggcccagcacgagtgagtgtgacggtggtgtcctgggccagctcagggccaggggctcgtgtgcgctcagcctgagccctctcccatgcaccctcaaagactctgacatcccccgccgcccctgcatcaggtgctgcaagagattgcggcagaggaggacgaccttcctcctgcaccaggcggtcaggacccggtctcatccctgcgcccttgccagggcaggagcatggcgcccaaggcccgcgaagtcgacgacgacgacccagcctccgccgcgctctcccccgggcgcctggccaagcgcgaggccgtgctgtcgcggctggagggcgccccgcccccgctggccgcccgcctgcaggcggtggaccagggggttgagagggtggcgcagggggccggggccgcgctgtcctccctgtggggctggggcgcgggcctcgcccggcacgtggagcaggcggtggatggcgaagcagcgggggccgacgcggggaaggccgagccgcgccagccctccgccgcgccctcggcggccggcctgctgggcgcgctgcgcgccactgccgcacagctggtggccgaggcggtgggccccgggggggactctgccgacgagggcgccggcgtgaggccgaggtccggaggcgcccgcgaggccctgaccctggaccagagcctgtacgtctacggcggcagccaggcgcgggaggagctgcaggagctgggcgccgagtgctcacggctcggacaccgagcctgcgccgcagagcaggaccccgtgcgccgcgctgcgctggaggacgcgctgcgcacgctggccgaggcgctggggagtctggatgagggagcaggagcgggtgttggaggtgccgaagcgggcggcgatgcgggggcgaggggaagcgaggagctcgcgagggacggcgcggcttcgacccagccaacggagtcgcagtgggccccgcccccacgcagcgcggcgctggagcgggggcacgcggtggtgcgcgatgtcgccgaggaggcggtggaaagcgcggagtcgctggggtccagggccgacgtcctgcctgcaggtgggtttttcccgtccctttgccaaaggggaaaaggggtgtagaggtgtgaagtatggcatggacatgggtcgacttgtgggtggaagctgctcagatgaggaggtccgcctccgacccaccctcccccaacccctccaccccaaccagggacgaagcacctggcggaggtggcaagcctgggcatggagcgcacgctttctttggcgcgcagcgtgctgcacagcgcgcgctccgcccgccccagcgacgaccgcatttcttggcccagcgaagcgccggccgtggcgcggatcctgcgcggcgaggcggcctgcgcgctgcgcgagctgggaagcgtggaggcggcgctcctggccgcgctggaccggctgcggggggatggcggtggtgaggtggcgcacgatgacggtgaggcggcgaggggtcgtgggcgtggctccgatcctgatgctgggattggcgatcggcattcctttgtttgggaaccgcgtcgcttggatctggagcaagacccgaggggtgcttgtggctgggaaagtgcagctgctccttcgcctgaaggcatgcattctcatgtgcccctgcaaccgccaatacacacagacgccgagaggcgcgagctcatgcggctggcggaggagtgccgggcggcgnnnnnnnnnnagggaggggggtccatcctgatgctgggattggcgatcggcgttcctttgtttgggaagcgcggcgcttgcatctggaggaagacccgaggggtacttgtggccgggaaagtgctgctcctcagcctgaaggcatgcattctcatgtgcccccgcacccgcccacacgcagacgccgagaggcgcgagcttatgcggctggcggaggagtgccgggcggcgatggcggcctgcctcgccctcagcacccccctggtctggtggtcctgctgcgcctcccgggccggccccgcggcggagccgcgatgacaccccatgtcagccgaggcacccattggcagcatgattcacaccctcgcgaccctcttgctctgcaccctgcacgcnnnnnnnnnngtgtcagccgaggcacccactggcagcataattcacacccccgcgaccctcttgctctgcaccctgcacgcaacagtcccacccatggccatgcctctcgaacagtcagggtccagagcgaccctcagcccttgcttgtacaaaatgtgttcacatacagagtagaaagggtagatactggggcacggagagggagccaaaatacacatgcgttgttcaaagcgtgttcatagggggctggggtgcagtctcggccgtcggtcaaaaggcgccagccagccagcagatggatgggagcggcaagcagggagacagaggctggaccctcacagacagatccatgagcgctgggcgatggggagctgcggcatgcggcgcatcccgtccccacacaaaaggaaggggacgcaacccatggcggtgaggggtttcggcgcagcagggcggcaaggggtgtggggttctatgggcgtggggttctatgggcgtggggttcgtcacaggtgcgctggtcagcaatggtcagcctgcctcctggggaaggtaggtgcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctccccccccagctcccaggctctcagcccgagggcccgctggccgcctgcaccgctgcgtcagagatgacgcgggagtagagcaggaggttggccgtggaggccggcagcgcgtcggccccgatcttgccctggctggcggcgcccaggatggcgctggacacgtcggcgggggtggactgcgggtaggactccaggtacaccgcggcgacgcccgccacgtggggcacggccatggaggtccccgaggcgtaggtgtaggcggcgtcgtccaccaccgcgcagcgcgaggagccgccgcaggcggagtagatgttgaccccgggcgcaaacagcttgacgcaggggcccgagttgctccacttgtacacgccgtccggctcccccgcccccgagccgttgtacttggtggccaggtccgaggccgcaacggtgagcgcggcggggacgttagcgggcgcgacatagcacgcgtccacgcccgagttccccgccgccaccaccacggtgatgccgtgggtgttgaccagcgcggccacggcgtcctccagcacgcgcgaccaggaccccacctggatgcccagggacagggtgaccacggcgggcgcggcgtggttggccgccacccagtccagcgccgccacggtgttggagatggtgccgctgccctcgcagtccaggatgcgcaccgacaccaccgacgcggccttggccacgcccaccgtcaggccgatggcggtcgcggcgacgtgcgtgccgtgcccgtcgcagtcgtcgcagttgtcgtcgttgtccacaaagtcgtagccgtaggcggcgcgggacgcgccgcccccccaccgcgcaaactcctggtggtccttcttgatgccggagtcgacgacgtagatggtggtgccgttgccggtgccagtggtgccggcggtaccataccgatacttgccatccaggggcgggtcacgctggcccagccggtccaggttccacatcttggtgcccagcacctctgtcttctcgccgggggcggccatggcggggccgccggtcacgcccgccgcgtccacgggcgcgccctccgtgccgtctgtcttcaccgactcctcgaaggagtgcagggtggggaggggggaggcaccgcccaaaccctgctgcatgcgtcggcggccgccgagcgcgccgcggccggcctgctcccgccgctcctccagggggcgggggcgccagaaggcgtcgtcctccgccttgtgcacgatctggttctcctccttgtagtagagctgcgcgtggttgtcgaggggtgggaggggggggtgggaaagcaggcttccagatgatgcagaaacaaactgctcctccaaaagtgcacgaatccaatctcacagatgcgtctgagacttctgtcgtcctcagggggccccaaagggcgccatggagagtaatagcctccaggtgcaatgaggcatgcgcgcccacacatttgcatggcaacatttgtgcccgtgctctctttcctccaactcaccgcgccagggaggcacgtctgcagcttctggagctccgcttccgtcaccttgccgctgaagcctgcgcagcaggcacgaggcagaccaggtgtgcgactacagcaaagatgcttcccgcacagcagtctcctgaatgggcactgcgcagcagccaatgcccaaggataccttggaaaggtcgtgatacccatctaccagccactcttgaatagattgctcaccgaaaatcgtgttggaaaacacgtgctggcacagcccaggcatgtggcattcggtagacagtccaaacacaggggccagcatcttaaatcgcaggggcgatgtcccgcacataaggttcaattttgggatgtagaatatatcctgtaggaagaaaaggggggaggggcagtggattgtaagacctgctgggcataaccatgagtgcgtaggtcgggggggcgggagctgctcaagaacatggggtatccagcagcaggcgcgacaaccgggaacgtgcannnnnnnnnngaaaggggggagggtcagtggagcgtaagacctgctgggcataaccatgagtgcgtaggtcgagggggagctgctcaagaacatggggtatctagcagcaggcgcgacaaccgggaacgtgcatgctgccgcccacccgccgccgttctgacccattgaatgtacactccatctcacctcgaacacgacgatgaggtctgtcgtggcgttggcctccgacggggccggggcaggcgacggtgaaggggggtgggtcccgaaaccaaaccactccgtgccccagccgctggacggcgcaccggtcgcacatccagcaaacatgcagcatgctagcaggaaaacacatgcgtgcctcatgccgccctattccaggcacttggctgcacagattccgggtcccgcgcggaaggtgggactcaagctgtcgcgcaacggtgcgtcaggacgcgggcacgggccctcgtgcgccaaagaagattttaaacggctccaaccgacattacagtccgagtgagctggagacaagatcctcagcgtggtacttgaagagggaggggcccgagagaagccacacgacacggcagcaccaggcgggaaccaggtcctgtccgcacggagggctgcagaaggtgtaaaattgtaatgcagcttttctatgatgaaagtgggtaagaggggtccccgtactggcgatgggccgagtggaacgcgctgaactcccgtcacacgagtgtggctaatcgaccccgtgccatgacaccaggacccgacggatcgcccgctgctaccatgtggaggaggtgcgcagggagcgcggagctgagaaggtagctagctgctcgtaatctgaattgaaacaaggacttgaaagaaggtccattgaagacggtagcatgcaccttccggcaacgtcattcttgaggttttgggggccgggtcgcgtgagtgcgtgcgcgcggaatggtgtctggccactatcttgcattgatgaaggcaacaagtatttttcagtcccagcgaccgtttggaatggctgacagcagtgagtacgatgctgagttaccgcggtgatccaggccgnnnnnnnnnnctcaagtcccaacgatcgtttggaatggctgacagcagtcagtatgatgctgagttaccgcggtgatccaggccgctgctctgcagcattcatcgagactgtttcggctatcgagcgggacccggcagcattgtcacatcaatctcgaatgttatgaataacattgcttccacaccatatttgatcgatatctcttattcatgagnnnnnnnnnncctgtttcggctttcgagcagagcccagcagcattgtcacatcaatctcgaatgttgagtataacattgcttccacatcatatttgatcgatatctcttattcatgagtgaagagtacctcacctccacccgagagtagtgtgccccttgacaatcactttgggccgcgcggcctgtgtatggcgaaagtgctgtgagaaggctcacattcacggtcccaaagagacgaatctgggcaatgcaggctcaaatctctatcagagcgcttggcttcgcataagagcaccgaaccaggaaccttacaatgttgaaatttgatatacaaggagatccagtctctatagaaaccctggaggatgacaaatggtttgctgttcttttctgaaactcatgtattgcgggcccatgctgccacacccgaacataaatcaggactctgactatccagtgccatccgagaaactccttttccctgccgccccactagaacgtcagtcttcctttgatgtcaactttgtccgctgggtggctgctgcttgaagcaccgtgactcctgcaagcatacatcacgagttcacatcagcctggatagcacgagtcttatcaacggcaatcaaaagaatacattgggacgcacatcctttccaggagcaatgacaccccctctcctacctagtagcatgatgctggctccagcccaccaccatgctcgcaaaggctccccaaagacggctcggcccagaattccgctgaacaccatgttggcggcagtactggctgccgtggcaaacaaggaggaggtgtgggctagggtccgatggaagagggccagtccgaggatgttgcactgcgtgtaggttggcgagtgccaatgttactacgtcctcgcagcatgcctgggagtcccaatgtttgattgaacgacacaccaggtgtgtgcagccctgcacacatttcaaattgccggattcaaccatttgaaaccacgcaccagtacaaggccaacatagcagagcgccaccaggatgacattcagttcgggcctgccagcgagcttgccgaacactggtcctagtgctcccagcgcccctcccgaccctattgccagcagggcggcagccttatgcctgacatccaacgccccaaggtggggcatctcccatgcgcgatgctgatcgggactgaatgcccaagatatccgcaatcgctggttctataacccccacgatcactgggtcatcgaccgacactgctcgaatattgcaacacctttgctactcgctgctcatacccggaacattcttgccggtccacgctttacaatacatcaaatcatccaggcagctggaacaacatcctggaggcgccaccctccccgccgggcaggtacgtgacattccgggacttggcgagggtccccgccacgtcacgggcggcctcgatgcggcgcagctcaatcatgccagcccccgcagcccgggtggcctcagaaatgaggcgagcagcctcggactctccctccgccctcaccactgccgccttgcgctcctggaggggattcggtgggtttgaggggggtggggtgagcacaagttccctgaggcatctggtacctggaggggcagcagcagcccctgctccacattgtgatgtgccttgcgcagccgcctgggtctctgacctgccgccaccagcaagcagctagaccttcaggcgcgaggtctcacctggtcggccttcatgacaacaaaccgggcgcgctcagcctcctgctgggccacctgcttggactccacagccttggtgaactgcgagggcgagcaggcagcgggagaacaggtgggtgggtgtgtttgcaaaagggtttgagatcacctcatccacgcctcacgacatggtagggcgccgcacnnnnnnnnnnggacaggtgggtgatggccacatcgtcaatgaggatgttgaactccgcggcgcggcgcgtgagctcgctgcgcaccgcggtggatacctggggaggtggaaacggtgggagatgggggttgagctaggcgcacatgggtctgtctgcctcattcctggagttctgtcccgcccgcacagacagatgcatttctggttccacacctggtacctacaatcccgcatcgccatgcccagtcgcacnnnnnnnnnngggtgggagctgggggttgcgcgaggcgcacatgggtctgtctgcctcctttctggagttctgtcccgcccccacagacagctccatttctggttccacaactggtacccacaatcccgcatcgccatgcccagtcgcaccttgtcacgctgagtcagcagctgctcggcctggtactgcgccaccacagacttgagcacctcattgccgatggacggcagcacacgctcatcccagtcgaggcccaggttctggaaagggatggtgtgattgacgagaggaccaggcattcagttggtaacaacagaaatgagaggtggggcttgtaaaaccatcagagacacgtcttcccatgcaggactcggcgtctgaacgcagatctgcagccctaagacggtggaannnnnnnnnnaacgagtgaaccaagcattcagttgttaacaacagaaatgaaaggtggggcttgtggaccatcagagacatgtcttcccatgcaggactcggcgtctgacacgcagatctgcagccctaagacggtggaaacggctgtgcctttcccattcccaaaccagcgcatgtctcgcccaccctgaacgtgagtgccagtctctcgacatccggcttggaaagcacacgtagggtgatgttgaccatctggagatctgcgtacggtcacggatggggcgcatggcaggagaggtgaggatgcggcttctcaatgaccccgactgtctgctgtccgcacaggcgccactgtgaacaggttcggcaaaggcactccttggtagcctccgacaaaacccctcacccttggtcccggtcacggagctgannnnnnnnnntaggttcggcaaaggcacccctcggtagcctccgacaaaactcctcacccttggtcccggtcacggagctgatggagcggggacgggtgcggatgtccatgacgttgggcgtctggaggtagggcacgcggaaatgggtgccctcactcacgggagtctccagcactcccgacacgcggtcgaacatgatggcccgctcgccaccatcgactgaaggggaggtaattgcgacgtttttccaatgcatgcatgcagggggatgcagggcacccacactcgcttcactccgggagagaagcatcaacccgggcaggcgtcactcaccggtgtacagggaggcctgcagagcgctggcgccgattcccagtcccacggagtagcgtgcaaccttggagaggatgttggccaaggccttcgcggcctgctgctgagccatggtgacaaactcccgaggactcttctaggcgttgagccaacggtgccactccctgacgatccctcgctgatttgatggggtatgacaagaatcgatgataatgcgggggataggcgtcacaattggggcctcccggtgcagcgtgtgggcgccgagatgacggtggctttccaccaggcgtgattcacccccacgacatcggctctaggctggggttgaggggcctggatgaagtagttgcagagctgacattgcagcaagtgcgctctgtgattcctttggaactctgtgttataagtaaggacgatcaagccttcagagcgtgccttaagctgcgggccccacactgagcttggcaatggccccatagagctgccctgcgacacggacctggcatggtacgtactctactggaactcatttggacgcctagattctgtagccccaagctgtgcatcgctcctccgcgcagggccagacccacggcaagggcccacgcacggtgtcggatggggacgggtaccccgtcccgggctccccttccccctccgccttctcccccggctcccccctgacctacagtccccagatgcccatggagcccttttcctctcgctccgaaacgcatcgctccgccatcccccaggcggagttcgagggttgggctgcccaccccagggtggtacccaccgtcatcgcatgtgcgcgcggtgatgggggtaatggggctgtgccctgtctctagggacctgacggggtgttcgctgacgtggtattcggcccccagccgcaattaaagggccttccctttggactccctggaccgcagggacgcatggcggtagccatgtggagctggaggggagctgggacaactggtcgcagcgccacgtcatgcaggcctccggcaaggactacaccctggtgaagctgctgacgccgggcatctaccaggtgcagcaccgagcaggctgcggggaggaaccgggggtgggcctgggtgtgggtgtgagggtgacccctgatcagccccccctcccatctcacggcccgaccggccccgtcccctgtcccttcatccccacagtacaagttcatcgtggacggcatgtggcggcacgaccccaacctgtcgtccatgtttgatgaggtgggcaacatcaacaacgtgctggaggtgcaggagtacgtgcccgagaacctggactcgctgagcgggttcgagccgccgccctcgccgccctcgtcctacgcctcccccgcccccgcccccgaggatacggccaaggagccgccggccatgccgccccagctccagctcagcctgctcaacgtgcccccggccctggacgccatcgccgcgctgccccggccccagcacgtggtgctgaaccacctctacctccagcgcgcctccaccagcaccaacgcgctggtgctgggcgccacgcgccgctaccgcgccaagtatgtcaccgtcgtcgtgtacaagccgcggcgccggcggcggccggagggcttcggcgcggggacggggcaccccgccggcacggcggccgctgccaggcacgggcgcggaacctcggcgcccatggacgtctcctccccggccgcctcgggcgtgcaccagggggagccggcgttgcgccactcctcaggcggctactccctgcacgaccacgcctccagctaccaggtcccnnnnnnnnnnagctgcctcgggcgtgcaccagggggagccggcattgcgccacccctcaggcggctactccccgcacgaccacgcctccagctaccaggtccccggcttctgaggaggaggggcggcgaggtggcggggaggcggaccgggatgggaatcctccgactcaagggtgcagccgtgctcaggcggcggtggaggttcccctttgcagtccaggatgcgacctgacccaagccctgcctgctggcaggcaggctaggaccgcgttccaggctgcgcgctctagtgccatgtacatgtgcgctgctgtgctcatggagggtcaatatttacacccaggcagtgtaagagcacagcgcactgagctcagtggtgaggattgtgcactgactgcaggtcacatcagggagctgtcaggagggtaggggtggaggtcccggctccagggaggtctccctgtccccattgcttgaaggccaccaccgcccgcccactctcagtcagtcctcgtcggaggagctgtcgccgccccccagcgcatcgtcttcctcctccacgtcccactgcggccccaccagcccgctccgcgacccggcccggccctcgggcgcgccaaacgcgctgcgcaccgcccactccgcctggtagaacttgaccacctggctgagtaggtcgcgcaccatgttcagccggaccatggcgtcctcctgctgcagcacaatctgctgctgatccgggaaggcaggaaatagggaggccacccacagggacagcgaggcggggctcagcgtgcacagcttgagcagcagctcctgggtttggtgggaggggggaacgaggggggtgggggttggagggtggagcatcagagaaagcatgcatagaccccctcccagagggatcattgtgctccccctctctgcagnnnnnnnnnnaaacgaggggggtggggtttggagggttgagcatcagagaaagcgtgcatggacccccctcctgagggatcattgtgctccccctctctgcagtttcagggggtcgtgcaaacaatttacccagccatgcgtctgccattgtgcccaaccctcctgctcacatctggtatccggatggtccccagcttgccgcccagctcagacatggacttgaagaggtccaccacatcctttgcagcgctggctgcctgctgatgcgggggtgggcaggggtctgctggtgcacgatctgcccgtcaggcaactgttaccatgccctggctgacggcctgcaatcctccacgagacccacgtgcactcaccgcatccgagttgannnnnnnnnngtgcaacggtgaccatgccctggcggacggcctgcaagcctccacgacacccacgtgcactcaccgcatccgagttgacctcctcctctgcaaagtactctacttcacagacgatgacgggctgctgctggacgaccttcaagatcttgaagcgctggcgccctggtgcagtatccgggtggtggggaggggctgagccatcacttgatcgaggcagaagtcccatgtggcatgcaggcggcccaagaatccgctagcctcagcagatgccatgcataggagtcatgtgcacagcctttgcatagcaagacccgacccctcaccctttgtgctgatcaggatgcggccgtcgtccagccggcggtgccgagtaatctccagcagcgttcccacggaagatatgccatcctcaaggacaaaggtggttccgaatcgacgggtgcccacccatggcttgtcctctgagatgagtccctcctctagtctgcagccaaggagggttcacagagttagtggaaataaagcatgaagtatggctgatgaaagcctggatgttgtggggcggtgcgaaccccccccccttctcatgggaacttcaggactggtcataagtgacacttgcaaaggcagggacatggccagcatggatggctcagacgatgctcacccatctgccccggcnnnnnnnnnnccttgcaaaggcagcagggacatggccagcatggatgcctcagacgatgctcacccatctgccccggcaagaagggtcgagaacaggaccctgtaccgggcctcgaagatctgaaggggcagggccgtctctgggaaggtcaccttcctcaaagggaaaatgggcagggattccctgcgtgtcgctcttgtcggtgatgggaaggatctaccataacgtctcaatgtacgtgccggttgagggccgaggccacaggctggaagtctggnnnnnnnnnnccgtctcaatgtccgcgacggtcgagggccgaggccacaggctggaagtctgggtgacggcacccgaaacgatgtccctgctgccatcatggtgtggccatccgccggcaccccctccacagagatctaggggccgcttccctttttagcaatatgtcccgatcagaccatctcctgcagaatttctttcacagggatgcatgcaaccggcttgagctccgcaggtgggcccgccatgaaaggggtggtgatgagatgcgggccaccccctccatggcgaggaggaaacggggatccatgtcgtggagccgatacgaatgagggtccagggccgagccctaccagctcaagcagcagagtcgacccttccaaaggtccttttgtctctgtgcaccccagtcggggtttcagagagccgcactgacggggaggcgcagccctgccctccgcgcctgcgccgacagtgggtgccacagccctgagcaccctgccctggctcccggcaacaactgcccgccctaaagactccatcccgcgggggatacggacccatggatagggtcgggtggagagcaggaagctgcgctcagggccagggcttgtggagagcgagactgggcacggttcccagggcataccacccccacctccatggctccagcccaggcagagccggtacgccgcatgggcatgcggggataacgtgaatatataatgactcagaaatgtgcatggatccctgcgctgcctgcccgttgaacacctttcccatccgtctacccaggtgttttttttccacacagccagctgccacggcaggggctggcttgggcacggggcggcaaggtttcctccacccatggcagcgcgccgggaggtgccgaccacgatgcaccatccgaccccaggggcccttccattgaaccgtctgcggaggagcagcctggagcgcccgacacgaagactaccagccaggagcctggggccgcccggccgacgatgcgccggcggcggcggccctccaccctggcccgggtgctactccagttccccctggagctgagctccatcctgtccaaggaggatgcgcactacctggagaagcgcgcgcggcggcggtggtggagccggcgctccttcccccgcgtccccaccgacacgctggaggtggcgcatcgcacccccccccccctggccgtctggcagaaggtgctgcccctcggcgccatcttcttcgccgcctccttcaacctcaccatcctggccaacctgaaggacgccatcatggtgaccacggcgggcgcggagacgctgccctggctggcatcctgcggcatcctccccgcctccgtcgccttcttcgtcgcctacggcaccatggtggagcgcttgccccagcgcgccgtcttctacgccgccgtggccccgctcctggccgcctatgcgctgttcgccggcgcgctctaccccgcgcacgctttcctccaccccgtgggcctgaccgccgcgctggccggggcgacgcctccgggcctgcacggcgcgctcaagatggtgnnnnnnnnnncggccttaccgccgcgctggccggggcaacgcccccgggcctgcacggcgcgctcaagatggtggagcactggaccttctcgcttttctactgtgccgcggagctctggggctccgtcgtcatctccatcctcttctggagcttggccaatgaggtctgcaccgtgaacgaggccaaggccgtgtaccccctcatgggcatcgccgccaatgtggcgctggtcatcgctgggtcctacctcaagtgggtcaacgccagcgtcgcccacggcaacacccaggtgggtggttggggaggggcgtcgtgtgatgggggagcaagcacaggaagtgggggtcccaagagcagggtccaagtggagtggagtgtgggatgggatcatgggaagggagaagcctcgacgcagtgcagcccgggccaggcaatgagctggggcagcgcggttgagaggttggcagtctcaatctacagacactcccacaaccccttcctcatttccccatgtagctcatgctgaatgtgctggtgggcactgtcattgccatgtctggcgtcatggccgttgccaagtttgttattgatacgtgagtgcctgggctcgattcctggtcttgtcggtgtgtttgtgagtggggcttgggcatagaccatagcgatagccatcttttcacggatgtcatgccagccagtgaatggctcccatttgccttgggaggcctgcctcatgaaatacactgcacaccccctgccatgtaagctcatgccatgctgtccaccctccttcctaccaggtatgtggtgggtccctactgcagcctcgacgagcgctccagccccaaggtgcttaagaagaagaagaaaaacaaggggtcgctggccaacagcctttcaggtaggggggnnnnnnnnnnctgtcggtgtgtgtttgtgagtggggcttgggcatggaccagagcgatagccatctttcacggatgtcatgccggccagtgaaagggtcccattcgccttgggaggcctgcctcatgaaatgcactgcacaccctctgccatgtaagctcatgccatgctgtccannnnnnnnnnttggagttcgggcgggatggcggctgatgtgcaagggtctgccatggtggacttgccatgctctcccggctcccattacaagctccgacctcccccccgtccacnnnnnnnnnngtggtgttctggcaggatggcggccgatgtgcaagggtctgccatggtggatttgccatgctctcccggctcctattacaagctccgacctcccccccgtccacccttacccggcctttccctgcagtgctgaaggagtcgcccaaggtccggaacctggcgatgctggtggtcagctacagcgtctcccaccgcctgtttgagttcgcgtggaagggcgcgctgcgcacgctgcaccccactcccggcgcctaccagtcggtgctggccgatgtggccatcgccacaggctatgccaccatcgccctcatgctgctcagccgctacgtgtttcagtacgcgggctgggcggcggccgcagccgccacgcccaccgtcatgctcgtcaccggcggcgccttcttcggcctgtccatcgcggcgggggcggggctcacgcttggctccctggggcccctccagctggcggcgctgggggtgggcacgggggtggcaacccaggtatgtggtggggggaccctggcaagaacgggggcgggacttttggctgatcatgtgcagcatgagtgcttggaggggtgctgatgaggctgtcgcagagggctccaggctgctccaactgtctctggacagcttcaagcccactttgtttgtcggcccgcatatggcctgggcccacccgcccattacctgagacgcacgctctcaccccgccctaggtctttgcgcggtcggccaagttcagcttgtttgatnnnnnnnnnnctgtttgtcggccccgcatatggcctggtcccacccgcccattacctgagatgcacactctcaccccgccctaggtcttcgcgcggtcggccaagttcagcttgtttgatccggccaaagagatggtgtacattgagatgacgccggaggagaagtccaagggcaaggcggccgtggacctgctgggcagccagatcggaaagagcggcggggcctggatcacgcagggcctgatcctggtatcggggtccatcacagccagcctccccctcatctccgccgtcttcctggcaacgctgacgacctggctgggcgcggtgcgcagcctggcccggcagatcgcagactacgaggccgagaagcaggcgcgggaggaggcgggggacccctcggcgggcaccgggggggagcatgcgcggaccaccccgccgcctggcccgcagcaaccgagtccgccgcccggcaacggcgcacatgcagacgcgccgaccgcccgcaggcccctggcggcgtgaggggaggactgttgctggtccctcgctcctggatccgacctgacactggaccctgggaacccattggggccccccttgctcggtggtccaccttctcccacttttagcgcgcctgctctgctgaagcaggggctgctgctgctgccgagctccttgcgtagaatcgcttgtgcacttgcaactgagcctgcgaacgaaccctctcatgctcaccaagatttgtctgacatcccttgtcaaagagcgagagagtgtgcacactagcatggcagggaggnnnnnnnnnntcggcggaggacacctcggcgggcaccgggggggagcacgcgcggaccactccgccgcctggcccgcagcagccgagtccgccacccggcaacggcgcacaggcagacgcgccgaccgcccgcaggcccctgnnnnnnnnnncgctcggtggtccaccttcccccactttcagcgcgcctgctctgctgatgcaggggctgctgctgctgccgagctccttnnnnnnnnnnagaaactagaagggctcaactgcattacacctcagcacacagcagtagacaggctggacatatctcatctggtctactcgtatgggggatcctagcaaagtacgtcaggcacactcaccgccgcctcagtcacagaannnnnnnnnnggaacctagaagggctcaactgcattacacacctcagcacacagcagtagacaggctggacggatctcatctgttcaaatcgtatgggggatcatagcaaagtacgtcgggcacactcaccgccgcctcagtcacagaaataccggtcgccaaactcgccgacgccggggataacccggtacgcctccaagccctcgtcaatctcgctggtgatcagcttgagtttcgggaaagcgcggcagacgcggtgcacagcctctggcgcggcgatgagcgacaggaacagaatgtggtcctcctgtacccccttgttcagcagtacctgtcagaaggaggcacgggcttggtggctcaccggggcctttcgagcactgtggccccgatgcatcatgcagttgcgtgtcatggggcggcaggccagccacggcacagacatccgccggaataaccatcataaactgcgacttcgcagcttccctgttcccaaccccttaagctcccaaccccttaannnnnnnnnngcgggcttggtggctctcaggggcctttcgagcactgtggcccccatgcatcatgcacctgcgtgtcatgggggcggcaggccagccacggcacagacattcgccggaacaaccatcataaactgcgactttgcagcttccctgttcccaacccctcaagctcccaacccctcaagctcccaaccccacctgaacggccttcaccgcagtctctcccgttcccacgatgggatccatgagcagcacatagcgatccgcaatgtccgcgggaagcttctcgtagatggtgtcctgctgcagaacatggtcgcccaccctggaaagcgcagagggtgggcgaggttagggtctgcatgaatgcggcagcctgggagccctaaannnnnnnnnncacatggtcacccaccctggaaggcgcagagggttggcgaggtggggtccgcatgaatgcggcagcctgggagccctaaacttatctcagcaggctcgaggaattactgcacggcggatggctgccccaacacacatccctctctacctgtggatgaggatcttgccgatcttgatgcccttgcagcaggcgcgcagcgccggctccatgctctcccccgatcggatgatggaaacgccgcacaaccgcttggcaaagtccacgcccacgtaggggtggccggtgggggtgatcaccnnnnnnnnnnnnnnnnnnnnnnnnnnnnnnnnnnnnnnnnnnnnnnnntataggcacttttggggtcagggcaacacgactctcagagccgagggtgcgggtaaggctcctgtggctatgcatcttgtgcatnnnnnnnnnncataggcatttttggggtcggggcaacacgactctcagagcggggggtgcgggaaaggctcctgtggctatgcatcttgtgcattccaatgcaccccctgccctggcgtgcatgggctggggctgagacacccatcagcggaagatcgaaccgcgccaccccacctaccagtcgtagcaggcgatccgagtaaaaggcaaagtctgcggtggaagtttcgcgatcgcggatgatggtgtgcatcccacggatctgcgatggagtggtgggacgtttggagggagctggcttgggaaactgcacgacctgaaaacttggagggtggtacccaatctccccacagctttccttacctcttcatctcaccacttctttcccctccccccacacaacccaacctggtatgtgctggggatgagctccaggnnnnnnnnnnacaatctccccacagccttccttacctcttcatctcatcacccctcttcccccctccccccacacaaccccacctggtatgtgctggggatgagctccaggttggtgtacaccctcctcaggtcgtgctgctgcagcttggttcggatgtgctccgtgataaggtgaatggcgaccgagttgccttccctgcggacaggccgtcaggcgatggggatggatgaggccggcatagcccggcagagggttgatggtgcgcgatttctgtctctcccttctcccgaggccgcggcggccgcccctgcagccagaaaacacgcccccaccctgagcagtgcccaggcagctggtccgcaccctgtccaggggactatgatgtcggcgtgcttccggctgggcgccacaaactgctggaaggctggcttgacgaagcgggtgtactggtgcagcacacccgccacgtcccggccccgacagctaatgtcgcgctggatcctgcaggcggcgagggtgttctggggagcttgcccacccgcagacatgaggagggcagggggggagtcccagcagcagcaagtctgtttcctgagaagcttcccgcccccggcctcccatcccccccccacagcctcagccacctgcgagccaaccggacgtcatcgtcggtgtccacaaagatcttcatgttgagcaagccccgcaccccctccatgtgcagcaccaggatgccctcaatgatgatcacgtcggcgggggggactcgtcgcggcgtctcggtgcgtcgatgcctggtgaagtcgtactctggcacgtccaccaccttcatcgcctgcgttcgcagagcaagcacacacactcaatcagagggatgggagcatggcgtcgcaatatttggactcgcccttggacgcgtgtggggcgcatgcattccannnnnnnnnnccactcaatcagagggctgggagcatggcgtcgcaacatttggactcgctcttggacgcgtgtggggcgcatgcattccaacagtctcagacctcaactgcccacccctactcgccttgagatccctgaggcactccacgatcgcaggctcatcgaatgccgtgggatggtcaaagtcgtggtctgcgccgtgctcgtccggaagccggtcagtccacatgctcagacagggaagttttgcggtccaaccacaggagcgatcagcagcccccgccccaccacagtggccccacactcacccccagcatttgcactctgctccggtgtcaggccacagtaaaaggagtcttgtgagagcatcactacacactggtctgtggggggcagggcacacacaggcgtgatggcgatgggctgcggagcgagggcgcacgccgacggcatggacccagggatgctgagggtgcatgcccgcccgctccccagtccaagccactccccatgcccaccatggaggttctgcatgatgagatcacacacagtggtcttcccgctggctgttccacccgccactccgatgatgaagggctctgcgcgccgggacacgcggctgcgggagcgatggggccggggcaagcccgagccaggggacagctcgtcagtagcggaggtggggctgatgcactgatcgaggccatccagtgcgggacaggaggctgagaaggccgacactgtgtggtttgggtccgtcatggggcctggacgggggtaatttcctttgccaagacgctgtgcttccgctcactgctcgtctctctgcatgaaaccctgcgccttgatctcacggcgccaacgcctagacaggacccgatctcgtcattgtgctgacatgaatgcatactgcttagcgcaatggtatagggtcccaaacgtattgcttcagggggtggcccgggtgtcgtggtctgcatgnnnnnnnnnntgcgcaatggtatggggtcccaaacacattgtttcggggggtggcccgggtgtcgtggtctgcatgtgtcgtggccggagggtgtgatttgattccgcgccacgtccggttcgcgcacgtcctttttcaagggcgcatcatgggctggagattcnnnnnnnnnnatgtgattccgcgccacgtccggttcgcgcacttcccctttcaagggcgcatcatgggctggagattcacacgcatcatcatcacatggcattttcgaaggaggtatgcggtgcatcctcgtatcacgatgacctggtgcagcgaccaggagaacaagcttcagggggttctgtgccggcgcctgcccgagcctcagtcgcagaagtagcggtcgccaaactcgccaacacctgaggggagagggcattcaagtgcgggctgtatcagggtggaagttgcacttttcggcagccacaaccctcaagacctccaaagcaacaacatcccagcatgcggcaccccccacccacccactcgacgacgcactcacctgggatcacggcgaaggcctccagcccctcgtcgatctcgctggtcaccagcttgnnnnnnnnnnttctgtgccgccgcctgcccgcgcctcaatcacagaagtagcggtcgccaaactcgccaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcactcgacgatgcactcacccgggatcacggcgaaggcctccagtccctcgtcgatctcgctggtcaccagcttgaggcgggggaaggcgcggcagatgcgatgcacgccctccggcgcggccaccaggttgaggaacaggatgcgcccctcatcaacgcctttgtccagcagcacctggatggcgcgctgggcagagtacccggacgctaggatggggtccatcagcagcacatagcgctcggcgatgtcggtgggcagcttctcgtacacgatctcgcgctccaccgccgcccgcaccccaagctcgctgtcggcagagtggcgcggcggcgccgggccggcgggggagggggggtcgatgcaggagagagacgcgacgggcgcggcgggcgagctgcgcccnnnnnnnnnnagaggggggggcgatgcaggagggaggcgcgacgggcgcggcgggcgagctgcgcccggcgggtccggcgggcacggccgccgatccctcccccgccgcccccaggtcggggctggaggcgctggagcggtgggcgaagccggcgccggccgaggcgcggcgcggcaccgccgaccacgtcttctcgcggtgcaccaggatcttgccgatcttgatgcccttgcagcaggcgcgcagcgcgggctccatgctctcccccgaccggatgatggacacgccgcacagcttcttggcaaagtccacgccgacgtaggggtggccggtgggggtgatcaccgtcatctcctggaagggaaggtggcccagccccgcctccaccacctgggagggaggtgagggtgggttgggccggggggagcatgagggtatgatatgcgggctagagtggaggctgtgctggctggagagagagggaggcgcagctgcctggagcagagcgcacgtcctcaaatcattgagccagagggctggacggctgannnnnnnnnntgagagagaggcgcagctgcctggagcagagtgcacgtcctcgaatcattgagccagagggctggacggctgaggaggttccaggcaggggagaaagtgcagcaacaaaggtccgagcaggcagcggcacattatttgagcacccttcctgctgctcctgcctcaggcaaacacacgacctggnnnnnnnnnnnnnnnnnnnnnnnnnnnnnnnnnnnnnnnnnnnnnnnnnnnnnnnnnnntttcggtgctttgtaagaggaactgcaacgtgcagccaggaggtagcgcgaaccgcannnnnnnnnngagcaggcagcggcacatgatctgagcacccttcctgccgctcctgcctcaggcaaacacacgacctggcctcaccagacgcaggaggcggtcagcgtagaatacaaagtctgccttggatgtcctcacatccctgatgatggtgtgcatgccacggatctgcagtgggggaggcctcggtactctgtaagaggaactgcgacgtgcagccaggaggtagcgcgaaccgcacaagccaccgccccatcagtcctggccagtcctggctcgtcaagtttgcaggcagatactcatcaaaaaccagggaccaagcaagtccaggcacctgcctacctccagtcagctgcttagacacctgccaagcacccccccacctctctgagcatcccatctccctctccaccnnnnnnnnnnaacaccgccccatcagtcctggccagtcatggctcatcaagtttgcaggcagatactcatcagattcaggaaccaagcaagtccaggcacctgccaacctccagtcagctgcttagacaccatgccaacccccccccccaactctctgagcatcccatctccctctccacccacccacctggtagttgctggggatgatctctaggttggtgtagatccgtctgagatcatgctgctgcagcttcatgcggatgtgctctgtgatgaggtcgatggccactgcattgtccccccgtgcccagggaatgatgacatcagcatgcttccgggagggggccacgtaggtgtcgaaggcgggcttcacaaactttgtgtactgctcgatcacacccgccacgtcacgccccctgtctgcgacatcgcgctggatcctgcagcggttgggtttgaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttccacacccctcccatgcaccccccatccgtcaatcttgctcctgcctcccagctcccactttaaatcccccccccccctttccccacctgcgagccagccggacgtcgtcatcggtgtcgacgtagatcttcatgttgagcatgccgcggatgctggcaatgtgcagcaccaggatgccttcgatgatgaccacgtcagcaggcagcacgcgccgcgtgcgatcgctgcgagtatgagtgttgaagtcgtactccgggacctcgaaggacctctgagcctgagcaaggttggatcaccagcggagggatgcatgggtgaagggcacagaccttcaggtgttcgggactcaacattgtggtcgctcctgctatccccaccatgaccgcaccttgagcgctgtcaggcagtcgatgatggtctcctcgtcaaaggcctctggcacgtcaaagttgtactctgcaccgtgggcccagggtgggagttggagcatggcatagcaggcagaggggcactagccagtatctgctgcatgtaaagttcacgctcacatgcaggtccatgcctagaagttatccccccatcacttgccctggacattctccagctccttgggtgtcaaggctcggtagaaggaatcctacgagggaaattcactgttagtggactacatccctacccatctgcacatgctggaacgcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcaggcgctgaatgatgaggtcacaaacagtggttttgccactggctgcgtttggaaagggacgaaatgggaacgtggatggggggtggccggatgagtgaagggagaagtcgatgggcagcttagccccctcaccggtgcccgggcctgcccatgcccctctccgccatacctgtgccgcccgccacaccaatgaagaagggctcctgcctctgagtccatcgcttgcgatgaggactgcccagattactgtcttgccgacccagcgagctgttcggcgccggcatgcctccacacgacagcaggctagtgcagtcctcctctaccacctcgagcctccaggatgcccggctcagacgctctcaaagaaactgatacaccgcaacgcgccgatttagattgccgcgcacgctcttcagactgttaccttcgccatgctaaggcattgagcgctctctccgggcgcgctcgctccctccctcgagtagtggccgggcagcccactggctagccagcttccaacaacaaaaccagtgtacactcatctccatcatttctacccatctctgatcgccaatctgcatcagctctttgatctacatgacgagtgacccagcgcattcttccaggcaccacccctnnnnnnnnnngatctctaatcaccaatctgcatcagctctttgatctacaagacgagtaacccagcgcattcttccaggcaccaccccttgcggtcatggcagggggcgatcgtacggccggccgctgcccagctgcttcctctcctcgttttcggccttgacctgggccagggtctcatccaggtagaagttgaagggcgtctgctgctcctggatctcgtgcggcagctcactgtgcttcatcgacatgtccatgccacgcttcaaccgctggttgcgggcatgcacctcatcgggggagaggcggcgcagagcctcggcggtgtcctgaaggtcgcagggtatgccggagaggatggtgaggacgagcgcaggcactggaacaccagtgcgggcatgcaggagatagaggggttgggactgttgagtgtcctcctcacagcctaagacccagaccctaaccgatcacacagacaccaatgagccttcacacannnnnnnnnnacgggcatgcaggagacagggggattgggacttttgtgtgtcctcctcacagtctgcgacccagaccctaaccaatcacacagacaccaatgagccttcacacatccgccaacctctgatcactcaccaagtcgaactcagggtcgtacaggtcctcgtaccgcagtcccaccttccgcaactcgttgccaacagccgcctggtaggcgggggcgagcctcgcaaccagagggtcaaacagctttgcgatggctccctggagtgggtaattcatggggcagaggtgaagggctcggcattccaggagggccaatggtacgcatcaacatcctcgtagacactcttcactctgagaaaactatgaaaggttcatggagactgcagcaccaccttaccttggcagccatgctgattcagtctccgagacccccgcctgtgagagacagccctgcgcaaagatggtcatggagcactcaagtaccgagcatatgctcacagcacaccaatcaacgcgcatgcggacaaggatcgtggggcgtcggaaaactttgaagacattgagactggggtcacgggcgcgagcctcgctcaagatgagtgtcgtcattcacccaagcacagaagcatggccaagatgagaaaccacaaggaaatacggcaagactgcccgcgaactcagggtcggcaacgcacctgctgggaagagtgagctcacagcttgtcacccgggatgttctgcgccccggcagccgttcgcgtatccgacagcctcaatatcactcgggctttggagcaggagactggttagggtattctcggtgccagggtcctcgtcaggcccgggcctcgtcgtgcgagtgtcgcnnnnnnnnnngatcactcgggctttggagcaggagactggctagggtattcacggtgccagggtccccggcaggcccgggcctcgtcgtgcgagtgtcgcagcacgggggttggatggcgggaaaggttgagtcatgccgggtagttctgggcgcgggtaggtcaatttacaacccggggataggtttggggcaatgagcaaactttcaacagctgctggtggcaagagggaccttgcgtaggtgcctgtgtaaaggaacagaggccaggcctcacggctggggcaggagcggctccctcgcggcatgccgcccctccgccagcgccatcaggcggcccatgaccgcgcgcgcatcggcgccgcggtccacccagaccgcgggcgtgccgcacgcgccgtagggcttcagctggacgtaatcgggcgcgtgctccgccaaggcccggatcccggcctccagctcggcgtccgtcccggcgcccgcgccgccgcgcagcttggccagcaccgcttcgcgcgtcagcgcgcgcggccccgccgtgccaaacacgcgctggaggcggctgaaggtcctgggcagcgcggccagaacggcagaggcctcgcgcgccgccaccgcctcggcgccgctcagccgccgctgcgcgtcctcgttccgggacaggcggcgcagcgtgctcaggctcaccacgccttcgctggaccggcgtcgcagcgcggccggtatggaggacagcagcgccgcgtcggcggcggaggggcggggcggggcggcgggcgtgccgtcgccacgcccctcggnnnnnnnnnnnnnnnnnnnnnnnnnnnnnnnnnnnnngccgtcgccacgcccctcggcggcggccagggccgcgtcaaagtcgtcggcagccaggatgccgccggccaggggctcgaagtccgagtccccggggagcaggggctccagggcgccggcgtcgggccgtgccgggcgcatcgcgccgcgggacccctccccacccgccgcgctcgccgcgccctggacctcggcatgcaggcggtccagcgccgaagcgccggcgtcggcggccaggctgaaggacagcctgcgctggcggacggcctgcggctgccgggccgaggcaggatacactggcggcctgcctgcgaggggatgaggggaggtatgtgcaggctcagtaggctggagacggacgtggtgggcagctaccttggacaaggctggtctgcggggctgtctgacacttcagaaagtatctccagcagccctgcccccnnnnnnnnnncttactttggacaaggctggtccgaggggctgtttgacacgtcagaaagtatctccagcagccctgcccccaacccaggaaccattctccccttcctcctcactgcactgagcctacacccagcttcgacgccgcagcaatccctccaatctccccctgctccatttctcaccagaggtggagggcatggccctgctgcccagcaggcgctgctgcagggcgctctccggggtctcgcagggagccgccgcccggccccgcgccgaaggcgtggcggggagcgagtcggggcgcggtggcaggtcggccagcggcacctccggcacggcctcggggtagggcgggaggaagtcgtggcagggcgcgacgacgcgccccgcccgcgcccgcagcgcctcgccctcctcggcccgccccgcctcctccgccagcatggcccgctggtgcaggtgctcggcgtaggagtccaggaggtgccggctcagggcgccctgcagcgcctcccggtcgtgctccagcgccgcggccgggccccggcgcgggctgctggcgccgc

SEQ ID NO: 46957 - DNA, 61 bp, Chlorella protothecoides
ttttgacaaacacttttccaagggctcaataccgccataccaatcctgccttgcgatgcac

SEQ ID NO: 46958 - DNA, 75 bp, Chlorella protothecoides
gcaagctactgacgatattggcatcatgtgttggccctgggcaccccctctggtatagaaacacaccaagcgccc

SEQ ID NO: 46959 - DNA, 73 bp, Chlorella protothecoides
cccgcgacctgtagcggagtgcagcatggagctcttcttactttgtgtgtgtgtgtttggggggggggggggg

SEQ ID NO: 46960 - DNA, 76 bp, Chlorella protothecoides
tcgtggggcaaggaggcgcagtgcagggaactccgtgagggcgcgagtcgctctccccaccaaaccgaagaccgag

SEQ ID NO: 46961 - DNA, 127 bp, Chlorella protothecoides
gcccgccccagagacgcgcctggtgcccagtgcgcggggcgcgacgggtcttgtccccggagctcccgccgcaggcactcgggaccctgccagcgagagcgaggaggagggaggcgcgggccagggc

SEQ ID NO: 46962 - DNA, 73 bp, Chlorella protothecoides
tcaggctccaatcccactgatctgcctgctctccacccccccaccccccaccacacacacacacacattgctc

SEQ ID NO: 46963 - DNA, 11955 bp, Chlorella protothecoides
  modified_base (491)..(500): a, c, t, g, unknown or other
  modified_base (884)..(893): a, c, t, g, unknown or other
  modified_base (3386)..(3395): a, c, t, g, unknown or other
  modified_base (4376)..(4385): a, c, t, g, unknown or other
  modified_base (5795)..(5804): a, c, t, g, unknown or other
  modified_base (6073)..(6082): a, c, t, g, unknown or other
  modified_base (6845)..(6854): a, c, t, g, unknown or other
  modified_base (7122)..(7131): a, c, t, g, unknown or other
  modified_base (7389)..(7455): a, c, t, g, unknown or other
  modified_base (8703)..(8712): a, c, t, g, unknown or other
  modified_base (9515)..(9524): a, c, t, g, unknown or other
  modified_base (9594)..(9603): a, c, t, g, unknown or other
  modified_base (9734)..(9743): a, c, t, g, unknown or other
  modified_base (10372)..(10381): a, c, t, g, unknown or other
  modified_base (11491)..(11500): a, c, t, g, unknown or other
ccctcccgccccctcccctccccagcccgccgcccgccggcgaccctccccccggctccctccccttcctgctgccgcgctgcaccgacgggaatgcgcagtgcgacgcttggcacggcatgggcgagtgcgtccgcaacccgggctacatgtactacaactgcccgcgcagctgcctggtctgcaacgtcacctacctggacacggtgccggaacaggtggaaatcgcgcccggcgtctggatgcccaccatcgggtttggcaccgccggtctgggggacgccactgcagaggccgtcgcctccgccctggcaaatgggtaccgcctgctcgattcggcgcaggtgtgggaggggaggtgggagagtgtttcagggctagtggcatggggggatgaagggtggaggagactgagtgggggacggggattttgatcctggccggtgaaggcgagaggtcgcctgctgccaaaccccaggctcctggaaggnnnnnnnnnngggagactgcgtgggggacggggattttgatcctgaccggtgaaggcgagaggtcacctgctgccaaaccccaggctcctggaagggtattgtgtgttcccctcaaggcatgcactggcagctgtcgggaagagcgggttttctcttgggcacagaagatcatgcatgaacgtccctcctcttcatgtgatctcctatgtcattccctgggatgagcatgctgcgctgtcgcatggccccccctccccctcctgtgcggcagcctaccacttcccagtccgcactgttcgtacatgtccgcgggactccccttcgcagaggcacaccccctctctctgtcattgctggcgcaaggggggggggctggctgagcacctttatgannnnnnnnnntcgcgagagtcctcttcgcagaggcacaccccctctctgtcattggcggcgcagggggaggggcctggctgagcacctttatgaccccctttctttccgtgggccctcttttccccctggaggcccgactccccaggcacgagccccctccttggccccctgacccggcttctcccacagtctgatccagcgacatccctcttccctgagaccaccccagcacccacctcgtaaccttgaatttcccccccttcctggacccccctccccctcctctcaggcccgcgaatggtaccgggaggacctggtgggcgaaggcctggcggccagcggcgtgcctcgctcccaggtgttcctcacctccaagctgcacccgcgcaacctggggtactggaacacgctgtccatggtacgccagtcgctggccgacctgcgcaccgactacctggacctgttcctgctgcactaccccgactgcggcgccgggctctgccccggcctgaaccccgagggcacctggcaggactcctgggcggcgctggaggagctggcggcggagggcctggtgcgcgccatcggcgtggccaacttcgacgtggtgcagctggaggcgctgcgcctggcggcgcgcacgccgcccgcgctggtgcagacgggcatggagccgcgcgaccccggcgcggcggtgcgcgcctggtgccggcgccacggtgtgcggcaccaggcctactccagcctgggcacgcagcgcggcgccgccgcgctgctgagccacccggtggtacgcggcgtggcggcggcccacgccgatgccggcgccacgccggcccaggtgttgctggcctgggcgctgcgccacggctccgccgtggtaccgcgctccgcctcgcccgcgcaccagcgcgagaacctggccgctgcgaggctggccctgagcgccgcggagatgcaggacctggacggcctggacggggcgtgatggcgcaaggatatcatgccggcagtatgcttcctcctcccctgtcaacttgtgcatacagcaatgagagggagcaggggggggggtggagcagggtacaaggtgggccagtgttggcagaggaacggaagcgtagaagcatatgcagacgcggctggagagccagtccgtgcgtggatgctgggagaatctttgagtccatttagcgctgtgcgggacgccgacggccatgctccaggggtaaagggggctgggcccgcccatcaggcagacgcagcagggacggaagcctcctcctcggcggccttcttggctgccgcagccttctccgcaggagtcttcagcaggtcgccgtaccgctccatgatgcgggccatgcgcgcgccctccacgctgatccccgtctcctcgcccgtccagaaggggtgagaggtagtgtcctgcacagggagtgggtccatggttgacagcaggtgcgggagttgtccagcgcgctatggcagtcggttgaatataccactccaagttccactcaccacttggagcttccagggcgtgtgccggttcaggaccgtgctggcgcggaagctggagccgttgcgcaagaccacggtcatcgtccgcatgagggggtggatgcccttgcgcgccatcctggcaaggacaccacactcgacagaccgacgctgttgatgctttgatgtgaagttgataaaatgtgcgtgcgtgtgtccagaggctgcgatggtcccggcccgtgggccaacccgcgctgggcgtgctgtgcacaagggctgcaccaccctcccagcgcatcgagcatctcatcacaccaccctggcccttctctacagcttggtgagtcgctttcacataccgcctgtcaggttcagatcaaaaacacaaagggttgggggtggggggggttggcacagatacaacatgatttgcaaaatgcgcgccgccgggcgatagctccggcggatcaccttgtgaaccaagcaggagaggtgcccccactagagcatgccgttaacagcctcccgggggcgggagggggtggtgacagcagcaggtacgatgggatgggacggagcaaaaagcaggggggtgcccgggcgtgggcagggagagtacggaaccccctccacgccacctcctccctgtgtgggaggggcaggtcgtggggtcgaggacgccgcggccccccagaccacgcgcatgggcggatcaggcaaggcatactactgttcgaaaggtcggtgcgcactcagttggggccccaaggggccgccatgtggggggttcagtaaccgccctgctggccgtagccctcctggccgccaccgtagctgtggagaaagaaggggaatggggggagggggagggattggatggtaggtgtgtgtgattccaagacacgcaaagactgaagggtgaactgtaggattgcaatccaaatcgctgcctgcagtgattactcgctcacccgccctgctggtagccaccctccnnnnnnnnnncgcgattccaagacacgcgaagactgaagggtgaagtgtgggattgcaatccaaatcgttgcctgcagtgatcactcgctcgcccccctgctcacccgccctgctggtagccaccctcctgtccgtatctgtagagtcgagagatgatgtgcagaggtgagtttatactggcgtcggcaaacaaggcatgggctggcactgcaacatatcaatggacatggaagctgccgaccatgccggagagccccacgcccacatggcagaaagccaccgcccttccccgccacggttgtagccgccgccgccgccgccgccacgggcaccaaagccaccaccgcggccgccgccgaagccaccgccgccggcggagtagccaccgccgccaccgccgccgaagccgccaccgccgccctgctggaactcacggcggggggcaccctgcggcgagcacggggtcatgggagaggggatcggacaccaggtcgcagacgtacgggacaatcaacttgccgcttctctgctgcaaatgaaacgtgaagctggcgaggtcttgggccaccggggtatgcgctcaagggcccaccattcatgcgagctccaatctggccccctcacctcgggcgcggcgccatcggggccggtcacctgcaccgccttggcgcggccatcgtcggagttctcgacgaagaactcgacgggctctccctccttcagggagcggaagccgtcagtgatgatggcggtttggtgaacaaacaggtcctcaccacctgctgggagggcgatcagtggggaggaaatcaggcatggggtcatcccatgcccacaggacagtatgcacaaacgccccgattcgcaccctggtcgggggtgatgaagccgtagcccttggtgacattgaacctggggggatcgagggagcgggcctctgaggattggtgggcacggtgagagccgcggatcagggagcgtgtgcacgtnnnnnnnnnnaggggatcgagagagcgggcctctgagggctggtgggcacggcaagagccgcggatcagggagcgtgtgcacgtcctcgaccgaccgcacaaaccccgggctttcagggtatccctgtcgacgtgttgctgataccaagccgacgctcaccacttgacggttccggaggacttggcggcagcggccatcgtgacttgatgccggcctgcggagggggttgaggagccatgagcaggggcctgcggacctccaacctcactgcaggcacgtggtggatggatttggggcagttcagggtgatcctgctggccggacccgagtacagcaagctctatccccgtgcttacgaagtgcgggcaagatgggccttgtgaaggagagacgctggagcagcatgcaagcactggaacagaccgttgcaaagaagcaaggccgatgtaatggatgagagctgtgggccgccccacggtcgtgttgcaatagttggctgcgggtctggtcagatggtggcgggaaggttgtgggggaagctcctcacttgaccacggttgtatacgttggcatccttttgaggtggaaaatcgcccccgagctcatgggtttgtccttcaatgctcttccttttccgcgagatccatcggttccctcccatgtgatggctcgggcctggtctgatgtgtcggggacaactcagatcgggtcggaagatacgccgagatacacatccgacattcctgccggctaaccctgcctagggcagtgatatcaaacactcactcaggacctcataaggcttgcatcttcgcctatcagaaagagtatgacccaaaccctatgtattatggaactctgacagaatgtctcaccacggagcaggtggtgcagcgtttaccgcaatcaccaagccagtattcttctcgtatgtggctctctgatagctctagtatggctttctcatggattctcgtggagttattacctttggtagattctatccttgtttgttcagggtgtcgttgagagtgtctgatgggaaaagccttccctgtcagcgcgcgggatgggggacagcatcctgcgctggtgaatttgaatccctcagcgagatgtgcatcaagatggataaggagaatgcacatgtcggatcactgcaacacgcgcgtgccggaccacgactgcagtggctcgccgcgtggcgttcgcaggggtcggaacacagggcaccggaaccccctcgagatcaaacgggagcgcggctcgagggatcgcccattccagcacctctccttcgtacccaacactttctcgcgctgggaatagactcgacgtgcctcaggcaagcaggaattccccacagacatcgggaagcctaggtaggtacagtctgtccttccgacacgttctgggcannnnnnnnnngatgtcgcaccacggagcaggtggtgcagctttttccgcaatcattaagccagtattcttctcgcttgtggctctctgagagatctattatggctttctcatggattcttgtggagttcttaattttgatagattctatccttgttttccagggtgtcgttgaggatgtctgatgggaaaagcctcccctatcagcgcgcggcatgggggacagcattctgtgctggtgaattcgaaaccctcagcgagatgtgcatcaagatggatannnnnnnnnngcagggcaccggaaacccctcgagatcaaacgggagcgcggctcaagggatggcccattccagcacctctccttcgtaccgatcactttcttgcgctgggaattgactcgacgtgcctcaggcaagcaggatccccccacagacgtcgggtagcctaggtaggcacagtctgtccttccgacacgttctgggcagacgcgtgccccttggacggtgtcgagggctctcctcgttgtgagggaggaatcccccgtgcgtcgcgcatggcgcacgcgatggcctcgcaggcctgcacagccaaggtgccagccatctccaagcgcatggcagccacagatcacccccccatctccaagatcctgacgcatatcgctgccagtggccgcgacgtcctcaccctggcacaaggtttgtgggaatacctgaccagacatcagacactgggtgcggcacgatcgacgcctgggctcacatctgtggatggcgaggcgcactctcgctgtgttgggccgggcgcgcacccctgccgccagctgcctccaccccctgccaccatgccccaccaggcatctcgcactggggcccaccccccgcctgcctcgaagccgcccggcaggcgtccagtgagccagagacatacgcctatgggccggatgagggcttgccagagctgcgccggctgctgaaggagaaggtggagacgcagaatggcctggagggggtgagcgggcatcccttggtgctggattgcttctgaggggcnnnnnnnnnnacggctgctgaaggagaaggtggaaacgcagaatggcctggaaggggtgagcgggcctcccttggtgctggattgcttctgaggggctgtgtgacctggatggccaaccggcatgctgtgtgtggggggttgggaggggtatcttggtgtcgaacaatgcgtttcagactgcccagcgccgtcccggggcagggcaaggattcgaagtgggcgaaggagagatcgggaggctctcgtattgactgcactgcgcagtccatgctgcccnnnnnnnnnncaagggcaaggattcgaagtgggcggaggagagattgggaggctctccgattgactgcactgcgcagtccatgctgccctgtctcctgctcagtgccccttccctgccttcccccccccaacagtacgatgtggtggtcaccccgggggccaaccaggcattcatgaacgtcgtgctggccacgctagaccccggcgacggcgtggtcctgttcaagccctactacttcaaccaccacatggcgctgcaggtgggggnnnnnnnnnnnnnnnnnnnnnnnnnnnnnnnnnnnnnnnnnnnnnnnnnnnnnnnnnnnnnnnnnnnagggggtggagcaagggggtgtattccgtcacagcagcagtcaacacaagcaatacttgctaaacacccctcccaccgtgtaaaaaatccatccgctcccccccccctttccctctatgcccagatgacggggctgggcccttccatcgtgtacggcccctgcacgcccgagcacctccaccccgacctggactggctggaggcggccctggcccgcccctccccgccgcgcatggtggtgctggtcaacccctgcaaccccaccggcgcagtgctggcgcgcggggagctggagcgcgcggcgcgggtctgcgcagccgccggagcctggctggtggtggacgacacctacgaggactttgtgtttgggggcgaggcccactgcgcggtggcagggccgcacgtggtacacctcttctccctctccaaggcctacggcctcgccgggtggcgcgtgggctacgtagcgcacggcgcgggccccgccctggcctcggccctgctccgcgcgcaggacaccatgcccatctgcgcggcgcaggccagccagcgcgtggcgctggccgcgctgcgctgcggcggccgggcctgggtcgcggggcgggtgcaggcgctggcgccggggcgggaggcggtgcgcgccgcgctggcccgcgcgctgggcgacggcgcggtgaggggccagggcgccatctacttctgggcgcggctgccggggcgcgcgccggacgacgaggcctttgtcgcctgggccatccgccgccacggcgtcagcgtcgtgccggggtctgcggcggggggcccgggcttcatccgggtcagctacgccaacgcgccgccggagaccatcggcgcggcggcggagaggctggagcgcgcgctggtggagttcgcggcgtgcgagggcggggagctgccccagggcgcggcctgagcttctgagatggggaattggtggggtccggtggcgctgagttggaaggggtgcagagattatttgcactgttgagttgcttggtggaatctatggtgtcgaatcccgagtactagagtcggcgaggggggcggaggagggcttgggaagtgtgcatgggtgccgccgcattgtggggcaggggtgggcgcatgggcgatcccagcggcaccatgcacattgccatgcacggggcggggcatgcccctttgagagtatgcagcaaagacattaaaagtagatcggagtctgctggcagggcagtacctcagccnnnnnnnnnntgcaccatgcacattgccatgcacggggcatgcccctttgagagtatgcaacaaagacattaataagaagttggagtctgctggcagggcagtacctcagcccttcgattcatcaatgagctgagcctggaaattcgaacggctgcctgcctgtcacctccacgtggggcgggcgcgcagaaggcacccgatgcgcccggacgggaggggggtgttccaaacagccgcacagccacccctggggtgcctgtagacagtgcacggctccattcgccaccattatggacggcacggcgtatgtgatgcggtctccaaagggcctaacgtagtgagaacctcttgcgcacgtgccgcactcccccggggtccctaccaccgaccggcccggggtatcatgaaactccggcccgacctcacacgatgggggaaggcggtagagaatttcttggcaggctatcgcatcgagcacgtcgtgctggctctccaggtgggcttacatggcacggccactggaccagtgcagcggacgctgagcaccctgtcgaggctggatggcgcatgcgcagcctgatgggtatttcacgcgtagcactggtcccagttcttgaaagcgagttccaattcccccttgtcgcacgcgcagatgtttatctgcatcatagtttccatgctgccggtgctgacagaccgtgcgtcgtgggccggggatggggtcctgtgtggagtctggtcctgcatgccaaggattttgggacagttccgtcgacctaccgtcctgttgggtgggcctgccctctcctgcnnnnnnnnnnagcgtagcattggtcccagttcttaaaagcaagttccaatcccccttgtcgcacgcgcagatgtttatcnnnnnnnnnngtttggggcagttccgtcgacctatggtcctgttgggtgggcctgccctctcctgcccctttcaatcagcccttgaagtgcagctgcctgtgatccccaacccccacctcccttcaaccccatccctctcnnnnnnnnnnggtgcagcggcctgcgacccccagcccccacctcccttcaaccccatccctctccctcggttcctccccgctccaggcgcgtaccgcgacctggacgaggctgccaccttctggaccgtgatcgctgcagcagtggtgctggagccctgcaccggcaacgtgctgcgaaagtttgtggtgcgcatgctggccgtcggactggcaacatccatgggcgtgctcgtgctctacatctcctttgccatctgccacaccgagccggaccaggcgccccgcaacttcccgctctttggccacatggtcagcatcggcctcgccttctgcgcgtgcgtgcgttgttgtggatgggtgttgggtggggatgggggaggcagaggggcctgaggcacatcgtcaatcccctgtgcgcccctgccgaaagtgggatacacagggcatacatggcaggttctacttgcctgcagcatatgaatctggggcgcgctcgtcgcggagcccaagccacacgaccgggaaccgcgcggggacgcaccctgcagctcacaggggattttcccacctgcctccccctctgccccgcgcagggccctcatcatgctgcatcgccagcgctgggcgcaggagtacgnnnnnnnnnntccaagccacacaaccgggaaccgtgcggggacgcaccctgcagctcacaggggacttccccacctgcctccctctctgccccgcgcagggccctcatcatgttgcatcgccagcgctgggcgcaggagtacgagtacgctttcttcctgtccctgctgtccctctgcgtcgtcacggtgcctgccctcaggtggggaatttgagtgcagagctcacagatcgcggctggagaatggtgttgctggcaccatgtgtcttgtccctctgctgggcatactttggagatgtgagtctcacatgtactccttccatgcccatgggttgctgaccgctcgacctcaccccaccgtccccacccctgtccactcaccccgccgccacaggcagacgcccggcgacgcgctgtcggatgccggctaccgcgcgctgaacatcgtcatcggcgtggccatatcggcggtcgtggcgttcgccatcttccccatcaaggcgcgatcgctgctgcgcaagcagacggccgttgcgctgatgcaggcgggggatctggccgcatgggtcttcacccaggtgggcgtggagcccactgccaaggactccaacgccctgccccacgccagcggcacagacaagagcatgtgggtctttggattgtcttgtggggtctggggtcatggaggggaatgcatgtggggccgaggcgaagggggttgggcggcaccgcagttccacatggtgccacggaccttgggcttgcagggtccacccgtgctcgccagtggcccgacatgccctgcctgcatcaatgaaatccatgcgggcaacccgcacgtccacatccacccatgcaggaggtacatcgacgacgggctgcaggtggagatggcgccgctgtttgccgccacgcagcggctggcagtgagcctggcggggctggacgacctgctgcgctccgcgcgcgcggaggtcaacctcttctccaggccccaccgcttccccagcaagacctacgggtgaggcgattgggtggggggagtggggggggactcagtgtgccggggttgatgtctgtccgggaaattggtaccccgccagcagcaatcccctgggannnnnnnnnnggagtggggggaacgcagtgtgccggggtcgatgcctgtcccgggaaatggtaccccgccagcagcaatcccctgggacctggaatgcgggatgactcgcctgcacctggcacgggcccacccacatgaacatccccaccctccccctcgccaccgcagcgcgctgctctccagcctgcacacgagcgtgggcctgctgcaaacccagctctacttcatggccaccggcaacttcagcctgggcgccatccggcaccacgccggccccatctgcgacgccggggtccagctctccattgtgttcagcgccctcagccggctatcgcaccagcggcgcacctggcggcaaaggctgcgcgccctcgcccggccccgggagtggggctggtttgcggccggccgtgccgaggcggcgcgctcgtccgggcgggcgcgggacgcggacgccgaggccg

SEQ ID NO: 46964 - DNA, 74 bp, Chlorella protothecoides
cccttcgtacacaactgaaccttcaatcacacacacacacacctcccttacccagccaccccacaaatgcacat

SEQ ID NO: 46965 - DNA, 78 bp, Chlorella protothecoides
agggcatgctcgtcccactggcgcacaccctgccgctcgcagggagatcacccaggcccacctttcaggtagccgaat

SEQ ID NO: 46966 - DNA, 67 bp, Chlorella protothecoides
caccccactgttgcaccctacttggtgtatgaccgattgttcctcccccttcaaccgccccgcaacc

SEQ ID NO: 46967 - DNA, 75 bp, Chlorella protothecoides
cgaccaccaacaggaatctcgcagcgacgatggagccacgggagacattaccagggaacctacacgagcccagcc

SEQ ID NO: 46968 - DNA, 65 bp, Chlorella protothecoides
gccttcctgatcctgcggcgctcgtgaggtgccgcccgtctcgttcttgagcatccctctccccc

SEQ ID NO: 46969 - DNA, 89 bp, Chlorella protothecoides
ctaacataaacaagattgggcgatcgccaacaggcggggggggttagagggaccaccacggcagcaggttgacgcaaaaccgttccctc

SEQ ID NO: 46970 - DNA, 71 bp, Chlorella protothecoides
gcggagggccgagctgcagcggctcctggtgactgagcccgccatctgaagcttggactttgtgaccatgg

SEQ ID NO: 46971 - DNA, 75 bp, Chlorella protothecoides
gcttaaagagcaattcgctcccacgcttttcatacccgagcacaagcgcattcccctccctgcctttccatgccc

SEQ ID NO: 46972 - DNA, 33522 bp, Chlorella protothecoides
  modified_base (295)..(304): a, c, t, g, unknown or other
  modified_base (949)..(958): a, c, t, g, unknown or other
  modified_base (1865)..(1874): a, c, t, g, unknown or other
  modified_base (2178)..(2187): a, c, t, g, unknown or other
  modified_base (2825)..(2834): a, c, t, g, unknown or other
  modified_base (3150)..(3159): a, c, t, g, unknown or other
  modified_base (4696)..(4705): a, c, t, g, unknown or other
  modified_base (4867)..(5099): a, c, t, g, unknown or other
  modified_base (5189)..(5304): a, c, t, g, unknown or other
  modified_base (5566)..(5575): a, c, t, g, unknown or other
  modified_base (6914)..(6923): a, c, t, g, unknown or other
  modified_base (7603)..(7612): a, c, t, g, unknown or other
  modified_base (8321)..(8330): a, c, t, g, unknown or other
  modified_base (8544)..(8553): a, c, t, g, unknown or other
  modified_base (9952)..(9961): a, c, t, g, unknown or other
  modified_base (10887)..(10896): a, c, t, g, unknown or other
  modified_base (11834)..(11843): a, c, t, g, unknown or other
  modified_base (12973)..(12982): a, c, t, g, unknown or other
  modified_base (13765)..(13774): a, c, t, g, unknown or other
  modified_base (13917)..(14121): a, c, t, g, unknown or other
  modified_base (14191)..(14200): a, c, t, g, unknown or other
  modified_base (14694)..(14703): a, c, t, g, unknown or other
  modified_base (15309)..(15318): a, c, t, g, unknown or other
  modified_base (16229)..(16238): a, c, t, g, unknown or other
  modified_base (16700)..(16709): a, c, t, g, unknown or other
  modified_base (16767)..(16889): a, c, t, g, unknown or other
  modified_base (17155)..(17164): a, c, t, g, unknown or other
  modified_base (17999)..(18008): a, c, t, g, unknown or other
  modified_base (18938)..(18947): a, c, t, g, unknown or other
  modified_base (19391)..(19400): a, c, t, g, unknown or other
  modified_base (19836)..(19845): a, c, t, g, unknown or other
  modified_base (21902)..(21911): a, c, t, g, unknown or other
  modified_base (23000)..(23009): a, c, t, g, unknown or other
  modified_base (23587)..(23596): a, c, t, g, unknown or other
  modified_base (23852)..(23861): a, c, t, g, unknown or other
  modified_base (25121)..(25196): a, c, t, g, unknown or other
  modified_base (25720)..(25729): a, c, t, g, unknown or other
  modified_base (25949)..(25958): a, c, t, g, unknown or other
  modified_base (26105)..(26173): a, c, t, g, unknown or other
  modified_base (28209)..(28218): a, c, t, g, unknown or other
  modified_base (28310)..(28319): a, c, t, g, unknown or other
  modified_base (29167)..(29176): a, c, t, g, unknown or other
  modified_base (30114)..(30123): a, c, t, g, unknown or other
  modified_base (30508)..(30767): a, c, t, g, unknown or other
  modified_base (30851)..(30860): a, c, t, g, unknown or other
  modified_base (31194)..(31203): a, c, t, g, unknown or other
  modified_base (32592)..(32601): a, c, t, g, unknown or other
  modified_base (33226)..(33235): a, c, t, g, unknown or other
gcaccgggctgtccgcccgatcgccgccgcttgggccggccgttgatcaggtagaagccgcccatgtcctggccgggcctgcgcatggcatgggcattggaggggtgttgggattggctgtacatgccctcgtcccgcgcaccaagcgatgacctccacctgcgccatgctagactgtgtgaggaggtggcaccctttccagccaggacgtgcggccaccagaagttggcggtgacatcgataccagggcccctggcagtgaaatctccccagcggaacacggcaacacaccaannnnnnnnnncttggctgtacatgccgtcgtcctgcgcaccaagcgatgacctcctcctgcgtcatgccagactgtgtgagggggtggcaccctttccagccaggacgtggggccaccagaagctggtggggacatcgataccagggcccctggcagcgaattctccccagcggaacacggcaacacaccaacatcagggaccggcctgccttcgcaggacagacgcacctgcgtggcgagggtgggcggatttgggccggaggcccctcccccgcgtcctcggagtgctgcgccccacgccccgtgggcggcgtgctcctgggagcgagtccgctggcgccggggctgaggagggcagcggcggcggcggggctcccgccgtccgcaaaatactggacggggcgggaggtgcctgcattgagggcaggtcgggagttggagggctcagatgtaccctacctggctcaggcaaggtgctggcagcatacaggatctggaaggctggggatgaatctgcgtcccttgcgcacccactttccatcagagacccctgagccacaaggtccccttccccctcccaatgttctccctccaacatcgggggcggggcccagaaaatcacatacgcaccgtgtcgcttcagccagatgccgnnnnnnnnnnggcgcacccactttccatcagagacccatgagccacaaggttccctcccccctcccaatgttctccctccgacatctgggcggggcccagaaaatcacgtacgcaccgtgtcgcttcagccagatgccgcaggcattgcagagcatgccgtccggactgatgtcccgccaccatcttggggtttgctgggagccgcagtgggagcaggtggaaggggcccgtgcctgcagcgccgacggggagtgggcccgggagggtctgtcatccacatcggcgtgtgcggcttgtaagagcctcgtagcaccacaggttcaggcctgcccacctggttgcggtgtccacggccccccgatattgcaggccccgcccccgccagcgccttgatgaagggctccggcactttggaccagggctggcctacgggggaagggttgtgtgcaggcactgaacatcgccgcatgcgcagggcaatcagcctcccatgcgccacaagccgctgccttgccaagacagggtacgcaggctcccggcatcacgccttgctgtccaccccaatagaaacagcaggggcatgccttggggtgcagctctgggctggcccagatgagcttgtgggaaggaggcacacgccgctcccgtggctcccccgaggaaggtgagcagctccaccgcatccctcatcggcgccttatcttctattggaccgggagcggggatggcacgatccttgcccacgctcgttcctgcatccgatgcaggcccggacgcccgggtctggttgggaggctccagctcttactgcaatgatccgattgaggttcctttgcatatcctaggttgatcgtgcaggttcacgacctcaaagcagcgagagaacgctgcttgccccagacctgagcccacgtgnnnnnnnnnngactgcaatgatcagattgaggttcctttgcatatcctaggtttatcgtgcaggttcacgacctccaagcagcgagagagcgctgcttgccccagacctgagcccacgtgcgcagcagtcgccgacttgctggcgtgcgagtaagacaacacaggcaggaaaggccctcggatggaataaatattccaggcaaaggccattcagcgtaccttgagaatgtgggatcgacctcgaggctctaaaagctcgccagcactcctacaagctgtgcaggatggtcgagtttctcgcaatgtatcggaannnnnnnnnntttaaaggcaaaggccattcatcgtaccttgagaatgtgggatcgaccttgaggctctaaaagctcgccagccctcctaccagctgtgcacgatggtcgagtttctcgcaatgtatcggaaggctttgtcaagttgatgaaataatgggttctcaatcctctttcatagcaaaataaacatgctcctgctgtggcttaggaggcgcctttgcaaaagcacgcgaagcctggagatgctgatcagtcggcaggtcaaccccgcatttgaggcgcattagcccgaatgctctcccaagtcaactagaaggcattcatgcttgttgattgacggtaagggttgattggactctcgaaaattggagggcaatgcggtccgcctgatctgcagattctggtactaccactcccaaacacttcatggttcggccctggagcacatctgttcaactcgaggctcacatcctcccattcatggcatgaattgaagactttgcacaaggacataatgcttcaaaagcagccacccagctggcgtcttcatgcacccgccgacctgtaaaatagcaatgctgtggaccgagaggcaataatgcggtctgctatattcttcttataagttcgaatctcactgagcatgnnnnnnnnnncagttgatgaagtaatgggttcccaatcctctttcatagcaaaataaatgtgctcctgctgtggctaaggaggcacctttgcaaaagtacgcgaagcctagatatgctgatcagtcggcacgtcaaatccgcatttgaggccgcattagctcgaatgctctcccaagtcaacttgaaggcattcatgcttgttgattgaaggtaagggttgattggacactcgaaaattggagggcaatgcggtccgtctgatctgcagattctggcactaccactcctaaacaattcatggttcggccctggagcacatctgttnnnnnnnnnngaaatagcaatgttgtggatcgagaggcaataatgcggtcttttatattgttcttataagttcgaatctcactgagcatgagctacacgaggatactgtgaaaattacgtgcccatgatgtcgcaccttcatcctgcctgcccccggtgatcgggaggtgccgaggctccgttacacacttaaatgaaagaatgcaacaagcaccagacgaccccatcagcatcattgtgaaaggcacacatatgtataaattcaattacatcttgttcttagctttactgtcggcttgagcggtgacgctcgggggcgagaggcgatcgctgcgccttggggggcgtactcgcagacctccagcggggtctgctcgctccccaacccagagactgaatggacttggatgcctggatcgtgcagctgaaaagatgcgagcccctgaaggaggcccaagtgaagctgttgtgcgagagagcgatagagattctagtggaggagggcaacgtgcagcacatagaggccccagtcacgatatgtgagtctagcgaaggtgggaggaacaccaagagtcaccaggtcggtggtgggagtgctcactgccagcgcctgaccctgcaggtggcgacatccatggccagttttatgacctcatggagctgttcaaggtcgggggcgactgtccaaaggtgagcaggctggggctgcacccggaacatccatccctgtcccacgcatgctgtccacctcattccctgtgccacgcaatgatagggctgttggcgacctccctctcccccctccgcgcagacaaactacctcttcatgggcgatttcgtggacaggggattccacagcgtagagacctttctcctcctgctgaccctcaaggtgtgtgcttgggtgcgggttcatggggctggccctcctcgggggagggctcgaggccagccgccacccctgggagtgccgacagcccccagcgcacgcgccgcctcggcacgtcgcacacccaaccccgcaaacccgcgtgcacacgtgtcccctgcgccacaggtgcggtatccggaccgcatgttcctgattcggggaaaccacgagagcaggcagatcacacaggtctacggcttctatgacgagtgtctgcgcaagtacggctccgccaacgtctggcggtactgcacagacgtcttcgactacctcaggtgcggcgcgttcccttgccagtgcagcgcactgcctgaatgagtcgggccagtccttgaccggggccaggcagggcacggggccttccttcccgtcaggctcctggggccgtgaaaccctggcagcctctggtgtggccgcgtattcgtaccgtctgcccaccacactgcccactccccgacctcgccccactgcgccctgtctgccgcgcagcctggcggcgctcattgacaactccgtgttttgtgtgcacggcggcctgtccccgggcatcgcaagcctggaccagatccggagcatcgacaggaagcaggaggtcccccacgaggggcccatgtgnnnnnnnnnnaagccctgggagtgccgacagcccccgcgcacgcgccgcctcgccacggcgcacaccccaaccccgcgaacccgtgtgcacatgggtgccctgcgccacaggtgcggtacccggaccgcatgttcctgatccggggaaaccacgagagcaggcagatcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtgcccccgtattcgtactgtctgcccaccacactgcccgctccccgacctcgcccaactgcgccctgtctgccgcgcagcctggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagggggtggacggatggggcctctctccgcgaggcgcgggcttcctgtttggaccagagatcaccacccagttctgccaaaccaataatgtatgctgcgggtccagggcatgggggaggatgcgagatggggcggtgcgcgcgtggaagcgggcatgtgcgcgcctgggcctctgcatcccaggctggagctcctgccgacactccctcccccctccccaccgcgcatccatcccccaggtggacctcatcgcccgagcnnnnnnnnnncaatgtatgctgcgggttcagggcatggggggggatgcgagacggggcggtgcgcgcgttggagcgggcatgtgcgcgcctgggccactgtatcccaggctggagctcctgccgacgctccctcccgcctccccaccgcgcatgcatcccccaggtggacctcatcgcccgagcgcaccagctggtgatggagggctacaagaccatgttcgattccaagctggtcaccgtgtggtcggcccccaactactgcttccgctgcggcaacgtggctgccatcctctccttcgacgaggccctggagcaggagttccgggtgtttgaggcggcggagggggaggcccgtggagtgcctggcaagcaggctgcgccagactacttcctctgaaggggggcgggaccccgcgctgcccctgcgacgcctgcagatatgttacaaatcgctggcttgcaaggggtttagctaggcacgaggggcggggcccaccattgaggcccctcaaggaatacaaggtgagtgtttcagatgcaggctgagctatgtgtgtcaaggcatggttatctcgggggggtggagtaggcgggcaagctgctgtaatgttcacgggaggggtcctggggctggtgaggtgggggcggcaggcccaagggcttcaccacaggagggtctggacacagggcaggaggcgtcttttgcttggacttgggggtgcgaggctcatccacctcgaggttcatggggtggagacgtgacagtggtggcctcattcacggattggggggagaatcacatgccgatccggggcctgccgtgctctgtccggaggaggtgggtgcagaggggtgacgatgcaaaagtcatagggtgcaagcagcggacactgcagtcccctcgcaggcttacatggtctcggattggtgagcgtgacaggacggggtacgagttacatattaatgccggaccccactcgcgactttgcggaggcccgacttagttgatcatggcgctgtatagcttcagtgcgcaagaacactgatctgagattgctgggacctgtgtgggcgctcgctggcgacgtcaccactatgtccaaaatggacggtgtccagggacggcgccggaacgttcaaaaccgcgttggatggcggggaatctggggcaactgcatcttcactcctctgggacgaccagattcagctaggaaagcaaacctcggcccgatccgctcgtaagcatgtcataaggaagaagcaggaatcgagagcgcgcctaaggcggaaggagggggttgggtccggaggagtatcatgcggtgagtctcacgccgcgctcgacccnnnnnnnnnnagacgaccagattcggctaggaaggcaaacctcggcccgatctgcttgtaaacatgtcattaggaaaaggcaggaatcgagcgcgagcctaaggcggaaggtgggggttgggtccggaggagtactatgcggtgagtctcacgccgcgctcgaccctcgacagtctgcatcgcaatctggctacagccctcgaagcttggccggtaaatatgttttcctgtggcgggaggcgacatcaacagggcgagaccgcgaaatctcaacgccgaggatgcaggccctccagccagggtaaaccctatccacgcagctgggcgaggaagcacccgtttcccgtcccaagcaataatttagtcagcccctgtgagcatgcccagggcagcggcggctgcgtcatgcaggcgctgccagtacagtggcagcgcagccgcctcggtctgcacccctgcagccatgtccagacagagcggggcgtaggcgtgctgcaggggctcgcactcgcgcagcacccagtccagtggcaggacgggttgcagactgcgcgcggggccgggcctcagcacgaggccatggcccgcgaggccggcgaggccgggcatgcgaaccccttggtgccgctcaaccatgcacccccgtcgccggcagaccccagactgcagccaggccagcagcagccaggnnnnnnnnnncaacccctgggtgccgctcaaccgtgcacccccctcgccggcagaccgcagactgcagccaggccagcagcagccaggttgacgccaccagctccagccctgcgctggagccggggcaggaccgtgccaggctggcgcagcgccctgccagggcatctgccaggggccatgccaggtctgagagccagcctccggccccccccgccgcctggccggcatgcatcgtgtggcagagcgccaccaccagctgcaccaggggcgggggggtggttgatgcagcgtcgcgcccctcagcgacgcctggcgcgctgtgcaggctgcgtctcgcctgctgccggcagcggtgctgcagctgatccgcccagcacgtcacatctggcatgggaaatgatatgggttgggggaatggggggcaaagctcaaagtgcaagctctggaaggagcaggaagagacgtcggcgtgggttggtctagaacttggcagccgccacaccagcccagacccctgtcccacagtctaccttgcagggtcgcatgcatgtccctctccagggactgcatggtgctgccggcatcgtcccatacgttcccgagcaggagcacgcacctggggggtgggaggcaggtttgggatcccgggtgagaggcatgcatgagcagcgtgcatcaggccagcaaatggtggcaaggaacaggagctgtgggggcnnnnnnnnnncctcctggacgctgatgatgatggggtgccgtcccggctacagcaagcatccgagctgcatcgcaggtgccgcagctgctgcccgccctcgagggtgcatgtcagcttgcaagggagtgccatggccgtgcatggtcgccacaggcgtcctcaaagctttagggacccccctccccccccccttgcttggaaaagggattgccttcccacctgnnnnnnnnnntgcatgcatgtgcagcatgcatcaggccagcacatggtggcaaggaacaggagctgtgggggcagcctcggacaatattgaagcctcttctggacgctgatgatgatggggtgccgtctcggctacagcaagcatccgagctgcattgcaggtgccgcagctgctgcgtgccctcgagggtgcatggcagcttgcaagggagtgccatggccgagcatggttgccacaggcgtcctcaaagcttgagccccccaccaccccaccccatgcttggaaaagggattgccttcccacctgagcttggctcggctgacgacatcagggcatgctgaaagatcagtctccctcctcagctgtctcagcagggacaccaggttggctcgcgactgagggaagggtctggttgcacccattgccctgcacattgacaaaggccaattaggtggggagggtttcttcctcgccaagaaaaatctctcccgacaagcacctgcgtaatgcacaccgcctcccacagcgatgaggaccgccatgtgcatagcggggtggaggtcctcgaaagtgggccgtgtccccagccaattgccggacccacctgaggtagttgtacatggcgccaagcgggtcacggggggctggtcgacaggtcgcgagcacagcaagctggttgaagggcgcccccgaggcagcgtggatggaggccgccgtctgatacgcgcgctctatggcctcccagtccacctcgccagcggtgcgcatggtcgacttgtacctgcatacgccggtgaatggaggggcagcccgttggcagcacgcaacaacccaaggtggggtggcagcagacccggcccctgcttcttgtggaaacccggccccgcccagtacctgagcaggtcccccatggcgacgtggcagtggcacaccgccgcctccacatcggcgtgggggctagcgctgtgctcccctcgtggcgcgccggcgagctccacgagggcttcgtcctccggccccaggctctgcaccagacccacgcttccatacacgcgctgtatcttggaggccaggaggacgtagaacacataggcctcgtccaggaaggcctccccagcgacctgcacctgtgcatcggtgggcgagggcatgtgtgtactgagaagatatagcttgtcgcctgctgaccttataacaacaaaagtacagacaacgcaccttctctgtcacatcgtcttgagccccgcaggtcaatctgcgtcggaattcttcgatgggcttgtaaaagaccgcactccacagcaagcggtccacgcctttccgctgtaagagggagcgacgaggggctttagggccgcaatttagatgggttttgtcatcatttcattacaatagtacatctagtagnnnnnnnnnntggagggagcgacgaggggctttagagcagcaattttgatgggttttgttatcatttcattacaatagtacatctagtagctatctgtcgtaggtgtaatctgagctcaccttagacagcgccaggtctttgaggatggcactctcgcacccgtcccgaaggatcgccctcagtccccgagcatctggatgaaaaatcgtgcatgaagcactcagctccctcagctgcttgtccaggcgagcgcagcgcaccaactgatcggccatccctctgtccaccgcgtgctgtacatggagagttcatacgtcgtcgagcagggccaaatttggcgggaagaaaatagtagaaaggaagggcactctcccactgcaaggccgccgacgatcgcagggcgcttacagcgcaggaggcccgacaggccctccctctttcaagcctcgttggccaggagcagttaatcagccgccatggtgggagagggagcgcgtggctgggaggcagtgtcgggctggcgtcccgacccgggcacgacccggcatcggggtgtgggcctacgtcttctaccgggtgccagggaactcatcatggtaatatacattcctacccgtgcagggtatcgacctgagggccggaggccgcaacaccaaggtgcaccgcaccgcaccaaagtctcagaacccctacgtgaagctgctggtgaaggtgcggaggcgccacgcgacatctgtgggcacctgggattcacatgcacctgaaggaggtgctatctggtggtcacgagtggcttggaccggtcgcccgcctaatcgcgcattgttgtcgcgactggggcacacccccacctggtggccttcttgccccctgaccaacctcatcccctttcctgctgccccttttcaccaccacagctgtaccgcttcctggtnnnnnnnnnnccttgccccctggccgacctcaacccccttcctccccccccaattcaccaccacagctgtaccgcttcctggtccgccgcacggagtccgacttcaacaaggtcatcctgaagcgcctgttcatgtccaaggtgaaccgcccgccgctgtccctgtccaagctggccaagttcaccgcgggccagcccggcaagatcgccgtgctcgtgggcaccgtcaccgacgacatcaggctgcacgaggtccccaagatccgcgtcgccgcgctgcgcgtcaccgagaccgcccgcgcccgcattgtcgccgccggcggggaggtgctgaccctcgaccagctggccctgctggcgcccaccggctccaacaccgtgctcctgcgcggccccaagaacagccgcgaggcggtgaagcactttggccccgcccccggcgtgcccgggtcgtccaccaagccctacgtgcggtccaagggccgcaagttcgagcgcgcacgtggccgccgcagcagccgaggctacaaggcctaggcgcgtggaccggttgtggaggtggcggtcgtggtgccgcccgctggcaccgccccgcgggcgcgcaccggtcgagaaggcgccccctgggagcctgtcgccgggcgcccacctgctgtgctggcgtgaggaccctgcccacatctcatgcctgctgtgcctgtgctggcacctgctgtatagtgtgggaagcacacgagtagtgcagggaaggggtcgggagggtccgcaaggttgtgtgacagatccagtgtggagcctgggaaatgtggcgcaaggtgcaacactcctcttctgcaggagtccctatcggtgcagtatccagaatgtcatcatcacacccgggcggaatagatcactggtgtgagaggaatattgttgggaggggtcaagctcgacgcaggaccagcnnnnnnnnnntagaatgtcatcattacacccgggcggaataggtcactggtgtgagaggaatattgtcgggaggggtcaagctcgacgcaggaccagccccggcaagggtaaacaagaacatgcactctcgcgctggcgtcagagcctggccggggcgcggtaggcgaccaccctcagcgcagtccaggcggccaggccgagcgtggcggcggccacgatggccaggcgcgcggcgcccagccagggcaggcgcgcggcgaaccccgtgtcggccaccaggcgcagggtcgagtcggcggcggccagcgcgagcgcgacaagcgtgacggcaacggccggcgcgttgcgccgcgcaaactgcagcaggcgcacggcgacgagcagcgggcgggccgcggcgtaagccggcgccagcgccaggctcaccgccaggctgagcaggtacttggcgacccacacggcgaagcgcaggaggccgctcgggcgcagcgccgcccagcggccacgtgcgccgcgtttctgagggatcccagcccgctgcggcggcggctcgcgcaccggcagggcaagaagccaggcctcggccgcgcagcgtgcccccgcacgggccgtgtcggtgaggaacagggacagcaggccggagccggcggcgcgcgcggtcaggcccatgcccgccgccagcatcgggtccaggccttggagagaggcggggccgcgggggccgggcctcccgtgcccggcccacagctcgcgggcctccagcccgaggcccaacgccgccaggccggccagccccaggtcagcgccgcgctggccacgcgggaggcgcgcgtgcggcaccttgcgcgccgaccacagcaggcccagcgtgccggcgcccaggaaggtgcccagcagcgccgccgacccggcgcgcgcctcgatgtgggcccccagcacgaccagggacgccaggttgacgagcaggtggatgagggactggatgcacagagcgtggatagcagggaggcatgagtagaagaagggtgacactgtgcaggggactcgtccagcatgatatacctgcacatggctcccatcccctcgacaagcctccactctcatgcttggcacgagacacagtcgcagtccccagatgnnnnnnnnnngtacctgcacatggcccccatccccacgacaagcctccactctcatgctcggcacgagacacagtcgcagtccccagatgcaacgccgcgcatcccccccctccatcctcatcacccaccgcgtgggagaggttggcgagcatggctgccggcaggccacccccaggctcgcgccccagcgcccccccccgcacgcagagccagcgggcggcggcctcgggcggcgccagccaccaggccgcatacgcggcgaccatgccggcggccaggagctggacgccggggtccgacgcaagcacgcccgcgccgccggcgcgcagggccctgctgccggcccagggcaccgccacgcgcagcgtgccccacagcatgcgcagcgcacccagcacgacgcccagcggcgcgcccagcgccgccggcagcgcgacccagctgccaaaggcgccggcgtaccaggtgccgcgcaggttcaccagccgcgccaggcccaggtggaaggcgcggatgcccgtggccccccccagcaggctggccgccagggggatggggtccgcgatctcgctcagccgcccctggatgcccgcgatgggcgacagggaggccagcgtgggcagcgtggcccaggctgccgccagcaccgcgtagagcgtggcggccgccagcaccctgccgcgcgtgaggctgctcccgacgtccgccggagggacagctgcgcaggggctagccgtcctgccctcagattttacatgacgcccagacggcgtggcggagggtccgggcacnnnnnnnnnnttggagggacagctgcggaggggccagccgtcctgccctcagattttacatgacacccagacggcgtggcggagggtccgggcaccccacgtgcacgctcactgcctcgctgctgcagtgagacaggtgggtcatggctggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatacacaccttcctccacacccatgccgccacctgatccccactcaccccctgcgcgccctggggacnnnnnnnnnncaccacgcccagaaaggagggcccatcccggacaccaccaccttccatcttgagctcaggccaagaatgcagccacggaaacgggaggccagaagatgtgcatcagggtcgccagccggaacctctggccccacattcaatcggacacaccttcccccacacccatgccgccaccagacccccactcaccccctgcgcgccctggggacgagttcccccgtcgccccaccgccccgagccgtgggtgcggggtgtggcccgccaccatgcgcgggtgccaccgggccccgcaagcaagcagggcctgacgaggtagacgtgagccagcccagccaggatgcccgccaggtggccaacaaacgaggcgcgcggcatcatgaactggacgaggaacagctcggcccagcacacatactgtgggttgcggtgtgtgtgtggggattggggtgggaaggggtgcgtgccaggtgaaggaggggtcgagtaacagggcnnnnnnnnnngtactgtgcgttgcggtgtgtgggggggggttggggtgggaaggggtgcgttccaggtgaaggaggggtcgagtaacagggcggccactcgagcggggaggccgagcgcgatggcctcacagcgagccctcggagatgcactgcacgggtgggcagagtgcgtgatcccaccctggaccatccacccccgtgtcctaccttggagggaagggtgatgccggccacgctgctccacccggcggactcggcgctcagcacgaccttgaggccgaagaggacgccggagaagcccacggcacaggatcccatgaggcccaggcccagcgccggggacaggagcgcggcacccgccgccagcgccacatatgccaggctggaggtcagcgccagctcagccaccaggagcaggaaagcgcgggtccccagcaccggctccagctgggcgccctgtgatggtcgaggtggggggagtggccgggtgacgcggtgaggaggtgctgggggggaacctcatgcgcacccgggcccaaagctccatgcacacccccaagcgtgcagccccatcacccctcacgggtgcaccttccagatgaaggaggacatgtnnnnnnnnnngacctcatgcgcacccgggcccagagctccatgcaccccaagagtgcagccccatcacccctcacaggtgcaccttccagatgaaggaggacatgttgtaaaacaggtgtgcctcgtcggcatggagcaagggagcccataatagccggctccattcgccctgaggatgaggtggacatggtcagggacatgggcaggcccaccacccctttgaggacacaggccagactccaggcagcgcagagatcccccggcagcagcctcacattgaagagcatggcgtgcggctggaggcaggcggatgcaatggacggcagaccttcgaatccgtcaggtcggaggtgcagcaggacttgcactgggaggggggaatggccaaaggcgttggggggcttgaatgaaacagtcattgctcagctcagcccaggtcgatcacaaggacacccctttcaaaaaagcacatcatgctccattgacactactcacaggctaccagcgccatcgtgacaggtggtttgttctccaacatagcgatctgatggtatagcaagaggccgagctgcattatgcgcgcggatgatccagccctgcctcgacctcgcgtcctggtgccgaagaacgagtccaggccagggccaaacgggttggcctggcgcaccatgctggacacgactagcggctcccaataacgtccttcatagatcgattatattgatcgagattttgaacggcgcattggtgttccactggcaactgtggtgctgcagaagtatggcctatgccttccgcgtagcagcttgcttagatctaacacgtcactcggagggaaagtacccagcagcagtgaatgacagacatgatgtcggtttctgaggtccggcccaacatccgtcaaagcacacaatatgatnnnnnnnnnngacacgtcactcggagggaaagcaccccgcagcagtgattgacagacgtgatgtcggtttctgagttccgccccaacatccgtcaaagcacacaatatgataatatgttctttgcccagttgaccgcacacttgattgaagagtgcacgcccgccaatattgtatgctgagcatttgagaatcgccatgcagtccctggacgagtatattgatacaggggcagaagctctcggtgcattagtgaagctaacagatgcatcttgagacgtactggaattcagttggtggtgggctggtgatgcaggtactctgctgctgctgttgtcctatagaagtatttaaactctactgcttgtcctccctagcagattaagcatttgcattgctatgccaactataccaggcagtaagatgacgtgattgcgaatgcctcaagtcctgttctaccaagttgagtatgtnnnnnnnnnnatccccggatgagtatattgatacagaggcagaagctctcggtgcattagtgaagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttacattgctatgccagctggaccaggcagtaagatgacgtgattgcaaatgcgtcaagtcctgttctaccaagttgagtatgtttcaaaggctaaactcccaaagtatcccactcgccatcctggtcgccctttcctcctcgtcgatggatgatggggctggctcccacacccaaaccacggagtgcaatgcccaaagctcctcttacccgcaccaaatcgcgtcctagaattcagagcacccccagttttgttgtcaatttnnnnnnnnnncacccgccccaaattgcgtcctagaactcagagcacccccagttttgttgtcaattttgccatgagtgctcggggccttgtaatgggatgtcggtccccactggcgggcccgcccgctcacacactgcgtgtctcaaggccctgtctgagccgcgcagtacctcgctcccgcttgcgaggtaggaagacggcctgaagtctgttcgagcattaggctcggagccatccactgccaggtgtgtaaaattgatgacactcttctactctctgccctcagggtctcggcctggaccccagctcgcggtgagagcctccaagggcgacacccccgacgacatcccagagtacttccgtactgaggtgggctcggcttcacgggcatgcatgtatcaccacactcgctgagccatcccatgcacatgagcaaaattccgtgctgggcaggtgttcacgggtgttctgccaccatgaatgccttccgttgtatttccagcaggcgacgaagcctgttacccaagagcaacagtaccaatcggtgtcgtcgacctaccgtccagcccctggaccccagtcgagtgctggatctcagatccctcccctggtctgggtgggagtcggtgagttggttgttcgtggggtagagcagcagcacgcccgtatggtccaaggcaatgttacgaatcgttaacacctcagttttcctatgcctgctactgggaccctgccatcctcgcggccgctttgttgacaacctgcattgcaagtcgtgcgccagctgggtgtagcggcaatcttgccatcccgctcaaacccacaggcgtcgtggtggccaccnnnnnnnnnngctgggaccctgccatcctcgccggccgttttgttgacaacctgcattgcaagtcgtgccccagctgggtgtagcggcaatcttgtcctcccactcaaacccacaggcgtcgtggtggccaccctggtcaagcccgtgctcaacttcttcaccggcggcccagccaagctgcagcagctggccatggagcaggccatgaagcagatgatgaagcaggccggcaatggccagggcgccagcccctttggccccgccggcagcccctttggcgccggcccggccagcccctttggggcgggggccggcggcatgccggcaggcttcccctccttccccaccatgccccccaccccagcccctgcggcgcccaagaccgtcgacaccacggccaccaccagtcagactgccagcaccgcaacccctccggcgccggcgaccagcgatgcgcctgcgccgaagcgcgcagcattcgtggacgtgaccccctctgccgccgcgggtcgagaggtggactcctcggagatctcggacctgaggcctggtgccgagaccggtgcggtgcccagcggcagcgccggggccgaggccggggtggcggccggccaaggcccctccagttcggcaggcgcgggccccagcggcgagtctgtggtggacatgctgcggaacccggagatgcagaagacgttgtacccctacctcccggagcacatgcggaacccgcagactttcgagttcatgctttccaacccggagtctcgcgcgcagctggagcagatgatgtcgcagcaggtgggtgttgtgattggggagagtcaggcatctgttcttgcacttacgggggccctaggtgacatggtggctagctcacgagtcccctggtacgtgcgccccgattacccactcccccacaccccccatcacactttnnnnnnnnnncacggaggcactaggtgtcttggtggccagctcacgagtcccctggtacgtgcgcccctattgcccactcccccacaccccccatcacacttttcaaccgatcaatatggacaccccctcccaaacacagatggaggtggcggggacgccggagatgaaggacatgatggcctctatggactcggagaaaatgtccaagcagtttgacgcgctgggcatgacgcctgagcagatgatgcagaaggtgatgtctgaccccgagctggcgacgatgatgaccaagcccaatgtcatgacagcgctgatggagatgaacaagaatcccatggccatgttcaaataccagtcggacccagaggtgcggcgcagggcgtgtggggggggtgggtcgcggcaggcctgtcgccctgcgcggggtagatgcgcggtctccagtgtcttgcnnnnnnnnnntgggggggtgggcggcggcaggcctttcgccctgcgaggggtagatgcgcggtctccagtgtcttgcagaggacatatggacggtacagggccgacgtttgcgagccgcccatgtctcgagacccttgctcaaggcacggagtcgttccatcaagcactgacacactgccctgagcctgtactcacactcccgacccacccaccctcccctcgtcacaggtgtccaaggtgtttgagaagctgagcggcctgttcccccaggcggcaggtgccaagtttgactgatggatcggacccggtagattcggggtgggtgcggggcgcgcacgagaacagcagcggccttgtgatttcagggtacgctgctccctctctgtgcatcggcatgcctggccgtgtgggtagtaacaagctcagcacaggacatctgccaggnnnnnnnnnnatttccgggtgggtgcgaggcgcgcacgagaacagcagcagccttgtgatttcaaaatacgctgctccctctctgtgtagcagcatatctggccgtgtgggtactaacaagctcagcacaggacatctgccaggggcagacgacattctcaaaaatgtacgggaaatgggggctcagttgggagtgaagaaaaaggggaagagactcaacggcttcccacaggggaggaagccatccagtatgcatgcctcagaacctaggtgccgtgggggatggaggtggccatgtcaccagcagaccggcatcgaaagcgcaacgggggaagtgaggtggaaaagccgcaggggaaccttttgcagggaacgtgcgggggacattcagggtcaaacagcccctgagcatggcaggtggggaacggaaagcgggatcctcctcaggccgtgctggcaatcaaccgcggctgcttgaagcccgtgtgcgccttgtcctccagggcgttctcttgcgcgcatgtctgtggggcgctggtggcccgcttgcgtgaccccggcgtggcgtggaggggcaggaactgattggtccgcctgcgtggggtagaggagcaggtggccgatgtgaaaaacatgccaacagcgatgaaggagcgagccagcacaggccgcgggcatccattcaacgcagggttgtaccagcaagtcccacctgtagcgcgtcccgcaagcattgcagagcaggggcttgtgtgcaggtccacgccgccactggggggactctgcgaattggggagtggggcgcgtgtgaggcttggtggcccgggatgacaccatccccacccctcctgacccagctccagggcacccacccgtgactccgcagtgagagcaggagggccccccgaacgcagcccgcgatgccagaatctcctggagggacatggatcggtgctgtgcagcgctgtgccggggcatgggcggagggctggaggcaggggaatctatgccggccaggtcagactccgtcgcgggtcgcaacgcggtccccgtgaactcgtcacagagggcgagaataaagagctgcttgtcctccacagcacttgaagatgtggatgggtgcggcatgctgctaggatcgacaggggctggggtgttacaaacttgcgctggccggaagcctcgttagggtggggaccgcacaagtgctgattgtatttcaaagggcgtgatcaggctacaaagcggcggggatgaggcgcagaggatgaatgtgtggggtttcggggcgcaacgaggctggtcaactgcgtcgcgtgctccacgcgggtcatgaaaaccatgtgcaggggcgacgagcagggcagctcccgggaattgaaacttattcctccggggtcgaagcctcggggaatccgagggcttgacggacaagctggcaattgatcaaccaccggcatgctgtgactgctcatatgccttgaaacgccgcaagagcgtcattcctcaaatgtcgtcgtttttaaggtagggtgggtgacgccatggtggcccaggcactgtgtgtatgcttcaccatcagacatcaaacacacgcaggttgtggtctgaggcgcccaccagcagacgcttggcgtctgttccgaatcgcagtgaggacacgccctgcgcaggttgagagggacggtacaatggcttaatcggacaacggcaggggagggcaaggtggggttgggagtcggtgcatggaaggggtccaccacctgcattgcattctggcctgagagaaagcagcgttcccaacccctctcccaccctgctccagccagctccgcacaccttcttggggaagccggtgagtgtcgccagctcagcccagtcctgcttagctcccaccactcgcacatcggaccctccgaccccgaggaagaggccggagtagtcaaacgcgacggcggtggttggggtgccctcagagaagaggttcagagtcctggcgagcgtgtgggcgtgatgtggcgggtgagggaggcccgcacaggcagcgttgcggctaagattcctgcnnnnnnnnnnagagtagtcgaacgcgacggcggtggttggggttccctcagagaagagattcagagtcctggcgagcgcgtgagcgtgatgtggcgggtgagggatgcccacacaggcagcgttgcggctaagattcctgcacgccccctcccctccttcaggccggcctcctccaggacccccaacacacccacccacctgatggtcttgagcttgcggaggtcccagatccggacgccgtctgtggcggcggatgccatgtagtagccgttctcggagaaagacagcgagttgatgcggccagtgtgcccctcgaagttggccacattctgtggttgcaggaggacgggtagaggtgttcctcaatgatgtcgaggctctgttttcccagcgtgaatcaccctggcgtttggcccctaggaccccagtgacttcccgcagcgcatcgtctcatgagtctctccgccccacaacagcaatcactgcgcatccagcctcgttcgacgcgagaaagtccccacgcggcgccaggaatcgcatcatcatgcttcccgccctgtcccccttccggcccccatcccgcacacccactcccagacccagggccccaccccacaaaacgccagtactgcaccttctgcgtgcgcgtttcccagatcttcaccgccgcgccctccgtccccgtgctcaggatgaggccgtcggggtggagggccgccgcggagtaggcggccccctcgtcggccaccttggtcaggcacagggcctgggcgacgtcgtagaaggcccaggtcccatcggcggcggccgccaccaggtagtcgttggaggggtgcaccaccagggccacgacctcgcccgcctggtcggccagcgtggcggcggccgcgtagtcgccctcggcctcgccgcggcgccacaggcgcaccgtgcggtccgcggaggcggaggccagcaggtcggcgctgcccaggaagcgcacgtcgttcacgcgcttggagtgccccgccagctccgccacgctgcgcgctcctgtcacgtcgtacacctgcacgcagccgtccgcccccgcggtggccgccaggtcgccgctgcccnnnnnnnnnncgccacgtcgtacacctgcacgcagccgtcggcgcccgcggtggccgccaggtcgccgctgcccggggccaggtcgatggccaggatgccgcccttcctcgtcttgtgcaggggcagggtgtgggccagggccagccgccccacctcctccggggtggcggtgctcggcggcacgacccgcttcttgcgcccccgcgacagctcgtccgacgccgccgtcagcgcctccaccacccgcgccgtcacgccgcccttggccttcttggcgtcgccgccgtcctcaccgccgtccgcctccgcgccgcgcttgccattggcgtcggcgggcgcggccgcgcgcgtagcagcggcggcctcggcggccgcgcgatagccgtcgcgctcctgcagcaggcgcgcgatcacgcgcgtcgccgcgtcgtgctggtacagcgcatgcgacagctcctgccgtgtcttgtgcagcgaggtgcgcagctggtgcagctccagcaccgtcgcgtcccactcctgtgaaagggggggagaggggggaggcatgtgtgtcagaagtggtgggtgggatgctccccgccagnnnnnnnnnntacgtcccactcctgtgaaagggggaaaaaggggggaggcgtgtgtgtgagaagtggtgggtgggatgctccccgccagggggcgaggggggcgaggggggggtgcgcagggagaacgcgccgcggctacgagcaatgagcagccccggcggcatgcgaggactgggctcgccgagcatgcgccgagccccgcgagtgaaccaggcgagctccccccgaaatcgcccgggtgacgctcagatgtttgacacacccnnnnnnnnnncaggggggcgaggggggtgtgtgcagggacaacgcgtcgcagctacgagcaatgagcagccctggcggcatgcgaggactgggctcgccgagcatgcgcccagccccgcgagtgacccaggcgagctcccccggaaatcgccgggtgacgctcagatgtttgacacaccctcgccacatccaaacgcaggcgtccgctcacagaccacactttccaacccacattttggaagagggagaggaggccagggatggatgtggcgggggtgggacgggggttgatggcctgcgatacagagttgatgctcggggtgagccatggcctgtgccgtacgtgaggtgacgctgtcccaggtgccgcaccgtcggccagcgctccgacgctaaatcatgcgctgccctgaaaaactggcatgtgacactcgcttcccctgcaagcaggactgatgccagcagggctcatgagagcagtcgtgagcgcaaccctcaggctgcccaactgaccttgcccacttggagggtcaccaggtcgccagcggcgaggggttcgtctgtgactgggtcgcgtcccgtctcctgcatcccaagtgtgcggcctgagggtcagcaccaggaagcatgcggggtgtgccacccagcacaatatctctgtgaaaatctcctgtcaacagtacactgtcactcccactctccagatgcaggagccatcgttagcactggcatgcacctgaatgatcttcagcaccaggcgcttctcgtagaggtgtccggacacctttgagaccactggctcctctgggacgctcccactgactgttcggcgagccgggcatgcggagactgagcaagcacagacagggcacagctaggtacccaagtccaggcacatccagcactcacttgaacacagcatcactgcgtctgttctccggtgtggggcgctcaggtgtgctacaccgtagcagacgccagaagactgctgtgcgccggtggagctcctgtcgcggtgtgcagaatgtcctcgatcgtgcacagtctcgcgagacagcgggcacaggggccgcagatctttagagagcctacaaagggttgcaagagggtgtccgtcgaaagccaggcccctggtagcgacacctcccttcccctgcaatctgctcggcactggcctgccgcgatgggttttggggaaacagggtcaaaatgcccatgcccccacttactgctgccgccgggacccccgtcaaaggactcgcggaagccnnnnnnnnnnnnnnnnnnnnnnnnnnnnnnnnnnnnnnnnnnnnnnnnnnnnnnnnnnnnnnnnnnnnnnnnnnnncaccatgccgcccgcaccagtgcccgagtccatcctgtgagtggcgcagccggccccccctcgcgatgcctggtcgctgtccgtcgcggcggtgatactgattggactcccccccaaataccgcgtgcaggaagaagaggaagagggacgagcagtgggcggagaagaaggctgctgccaccgtcgcggtgagggatggggctcgccagcgtgcagtgccagtggccgtgcgaggggtggacacttcgctcgacccccgcctccgtccaaaatcccaccacaggctcagaagaaggcccgtgctaaccgctcggagatcttcaagcgcgccgagcagtatgtcaaggagtaccgctcccaggtacgagcaggaaggcgtggcgttggccggggaggattgcgagggatggctgccatggattgcaggcagccgtcctgtggtgtggatgctagcaaatgatccacatctgttggagagggtgaatcgtgacctatggcatcgtgctggagaacaagcatggccnnnnnnnnnncggctgccagggattgcaggcagctgtcctgtggtgtggatgctagcagatgatccacatctgttggagagggtgcatcgtgacccatggcatcgtgctggagaacaagcatggccatctggggcgaggatggttcccagcacatggtctggcggctttccctgggcagcaccgactatcgggctcttttatcctgcaagatgtgcatgtgaccatgtcnnnnnnnnnngtggttcccagcacatggtctggcggccttccccgggcagcaccgactatcgggctcttctatcctgcaagatgtgcatgtgaccatgtctccatcagggaggtgtgcatttgaccctcgggattgatcaggtcccccgtggcccgnnnnnnnnnnnnnnnnnnnnnnnnnnnnnnnnnnnnnnnnnnnnnnnnnnnnnnnnnnnnnnnnnnnnnaagcgcgaggccaaggccaagtccggcttctacgtcgagcccgaggccaagctgctgctggtggtacgcatccgcggtgtgaacgacatcgcgcccaagaccaagaagatcctgcagctcctgcgcctgcgccagatcaacaacgccgtcttcctgaaggtgaacaaggccacgctgagcatgctgcagcgcgtggagccctatgtcgccttcggctaccccaacctgaagtcggtgcgcgagctgatctacaagcgcggacatggcaaggtcaacggcaaccgcatcccgctcaccgacaactccgtggtggagggcgtgctcggcaagcacaacatcatctgcgtggaggacctgattcacgagatcttcaccgtgggcccggccttcaagcaggcgaacaacttcctctggcccttcaagctgtctgcggccaagggcgggctctcccacaagcgcctgcacttcatcgagggcggccaggccggcaaccgcgagcacttcatcaacaacctcgtccgcgcctccaactagatgcctggccagggctgctggtgatgttacgtgtgtgtaagcacgctgtccttccgaagccgggcacacaaggggggcaagatcttgaggctggactgaggtgaagtgtctccaagtagacagcagtgaagcggcaggcgctcccaaatcgatgcccaattctcgccaaagaccaccaggatgagtgaggggccaagggtgagcaaaggtctttcgggcccggtggtgaaatgggacagcaaggtccccttgcaatatgctgtcgacatgccgggagccggtgatcccgtacccggagtacccgatgcccatcacgagatcgccacgtcctgggagatcgcctgataggtctaaaccaatggatggaggcatttcatgctccttctcccgggaactatgcctccatggggaggtctggggcgggctgggacacgatgcgccctggtgcaggccccaccaggaacccggctctggcagtcgggccatggcctgcgccatctggtcgcgcgcaatgcgccgagcggccgatccacacgcacgctgaggatccatgctagtgaaaatggtggcgatcccatccttcctcctgtcggcaagggagcgccgggcctggtcagagtggtcctcaagggcgccctcaagtacgcgcatgcatggatttacgtgcatgtggcttagggaccgaccaccataccgcattgcaagatgtctggtaccattgtagctatcgtgccgcagcccaggacaactggggatttgcctggccttcatcgcatgtttcccacgtcttggtccccagcgctgggccccatcttagcactccatgccccctcccacccacccacctctgaatccagaatcctggggtcggtggtgctgttttccagcctggtgctgggctccgccccctacctcctgtcaaccaagttcggtctggagacggcgctgttcgcggccaatgtggccatgcccgccacgctcagcgtggacggggtgtctgccggctggggcaggccgctgtccatccatggcattgtgctgtccgaggagtggcgcagcgcggggcccaggcaggaccggcaggccggggaggagaccgggctggccccgccgggcgcgcagcgccccctgctccagatcgagcgcgtgacctcgagcgccccactccactccctgctgaccagccgcgccccgctcacgctgacggtgcaccgcccggtcgcggacgcgacgctggggccagacggcacgctgcgcctgctgggcctgctggagcgctgcggcctgctgcgctcccccgcccccctgcaggcggtggcccccgccgaactgctgtgcggcgcgggggagggcaaggcgacccgcgccaccgccgacctgaaggagcgggtcgtgctggcccgggcgctgggtggggcgccggccgcgcaggccgttcgcgccaacgcccgggccgccgccggcggccagcggcaggggggggcgcatgatgacactgacgnnnnnnnnnngcatgatgacactgacgacggatctggcaactgcaaggactcggcaggggaccaggctcaccagcacgatccggaggcggcggaggtgaagnnnnnnnnnncgccgggtctggcaactccaaggactcggcaggggaccaggctcagcagcacgatccggaggcggcggaggtgaaggccgccgcctttggctggcgcgaggccacgcgccgcttccggctgccggcgctcgaggaggagagcagcgcggggcgcgggtcggagcgccggccgttgatcctggtgcggccagagggcgcggccgcccccgcgccgcacgcctgggaggaggagccggcaaataaaccgctgtcattgcgcgagctggcggtgcggctgtggcgcgggcgggagggccgagcgcagcgcgaggcgcgcgcgcggcggtcgcgcggcgcggtgcccccggcgctccagcgcgccgacgcggccgtggccttctccggcgagctggtcacgccctgggtgcactgcctgaccgccgacggcgcgctcaacctacccctcgccttcaaggaggctgccggcgagcacgtgcacatggaggtgctgcagggcctggccgcgctggaggaggccggaaaggatggcgtgggcgaggacctggcctgggcgcagcgcaggccccagatggtgctcccccttgcggcgggtgggggtggtgggggtgctgctgggggtcgaggtgttgagcgggggagtttgtgaggtggcatgcatgccgccggcccatgggcgtcccccagcctctcagctggggcatcagcagccgccatgctgtggtcttacggcacaagccctctccctgccgggcccccgctccctgctgtgtgcagagcccaagagcatgccacatctatgctgctcttccttttaggttcccacccccattcagcccggttcccacccnnnnnnnnnnacagccgccatgctgtagttttacggcgcaagccctctccctgccgggcccccgctccctgatgtgtgcagagcccaagagcatgacacatctatgctgctcttccttttacgctcccacccccattcagcccggttcccacccctgtgctgctcgatcaaacatcctcccttcccccgcacaggccggccccagcttcccaccagcatccgcgtggactcccgggttgcgcacggcacgctgcggggctggaccaccagccagggctacacgctgctcaccgccccgctggagctggcgctggagtgcccgccgccgctggcccggcgcctgctggcgcggctgaacccgctgctgggcgcgacgctcacgctggggcccgaggaccggcccctggccgtgcgcctgagcgtggtgccgcaggacgcgctgctcccggccgcggcctgcctggtgcgggtcgacccgctggaggtcacgctgtcctccagtggcgcgctgctggagccgctggcgcgcctgcgctcgctgggtggcgccgtgccgcgcctgcccgagcgcgtgagcgcgggcgtgtccgggctggaggcggtggtggacgacggcggcgggctgaccgccgcggcgctggacctcacgctcatgctccccgctcgcacccggctggggctgaccacctggggcagcgccgcgctgcaccaccccgagcgcctggattgggtggtggcggtgccgggggccacgctgcaggcgctgggcgtccggggcgtggaggaggaccgcggggtggccatgctcgtcaccgggtcgcccctggccccgacaccgcagctggcgaggtgtggtgatgtgttgtggtgggggccggggtgcagaagtgggtcgaggtcagtgcgaggcaggcatctgacccaggcaggcacgaggtggcgcccctnnnnnnnnnngggtgggtcgaggtcagtgcggggcaggcatttgacccaggcaggcacgaggtggcgcccctcagtgagactcctgtcggtcctgcgatggccactcagccgaccccaggggccccgcccccaagtcccccctctcctgctttcctgcccaggttcggggctgacctggcgcgcgtgatcgtcacccaggccgccggcgacacgctgcgctccaagcgctccccgctctctgtgctgccagactggctggcgcagcacgtcagcctggggctggagggcgatgccgcgcagggcacggtgcaactcccgccctcgtccagtcagcgggacaaaggcgaagagaaggtcggaaaggaggaagactcggatgcctcgtagaattgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgatgctcgcttcttagtggacatggtcaggccggccttcccagggtttcgagcccttcatgaacagcagggctttgcttgnnnnnnnnnnccgtctagtcagcgggacaaaggcgaggagaaggtcggaaaagaggaagactcggatgcctcgtagaattgtcagcggagaaacaccatggtgcaggaatcaggcgctgcctcgtacatttgccctcctctgtatgaagaagggattgaccctgagctcacagccggcatgtcatcacgcttcagaaggcccagccgatgctcaagggtgcagcctggccatggcccatggatttcatgtgtgcttgcatgggtgccctcatcctgtacctgctcgccattggcaagaaggtttgtctcattagcatactgcgtctctcctacaagggacagcnnnnnnnnnntgcctggccatggaccatggatgtcatgtgtgcttgcatgggggccctcataccgtactcgctcgccattggcaagaaggtgtgtctcctttgcatactgcgtctctcctacaagggacagcaatacctctcttccccctgcaacaaacaaatgatgctcgcttcttagtgaacatggtcaggccggccttcccaggctttcaagcccttcatgaacagcagggctttgcttggtgactggttacaaaaaggtagatcttggtggaccccctgcggtccgtggcatgcatgttcagaggatgatccgagtaggttcctagttggtcgctgcacaatgcagcgacatcggcttgggcccgacaatatgggcggcacgagtgaggctctatcctggatagacatactgaaggcaaaacatgtagtagcaaaaggagagggactgggtacgagaaagcgaggaaaatgagtgtttcaatatcctccacccttgcccagtacagcgcatggggtgaggagtctctgtccgacagggttttgtcgatgaggagggcgaagaatgaaagggcaagtactgggaccgaaaagatgggtgaggagctgggcgcagtggagccgcccagcccatcagtggccggcagcaaaccctgtccgggagccgccctcgcggctgccacagcccaaaaacgaaagtgtgggtggccggtggcgacgctcagtcgcgctctgcccgggggctcaggggccctgcctgcttggcggcggccccctcggcgcgcgccctgcctgcgatcctgcgcagcctgtccacgacggtggggaagtcgggccgggccgcggggtcctccgcccagcactcctgcatcagcgcgatccagccaggccctgtgatgggatggagggggggagcagcaagggtcagggggcattggacgggggccgacgacaggggcgtcggacacccttggatctgggaacaggtgccctgtacagctgtgaacccgagctccttggcatgcccagtgcggctgtggctgtggtgaaaaaaccctcgtccctccagcaaagtgcccagcgctcgtgggtgcgcaccaggctcgaccacgctgcccagctcgccgtccagtcctggcacgggcggccggatgacatcccgggtgttcaccaggcggagcaggtaggcagacaggtcgtccttgaagggcgcggccatggtcagcgcctcccacatcacgatgccaaacgaatagatgtccacctggagtgcagacaggagaggggttggggaatggaagggggaccttagaaggcccgccacaagcagaccgacgatgcccggcgcacttgccgcaaagtgactagccgagggggcgagcagactcacgtgccccnnnnnnnnnncgaggggttggggaaagggggggacctcagaaggcccgccacaagcagaccgaccgacgatgcacttgccgcaaagtgactggccgagggggcgagcagactcacgtgccccggtcggtgcgcaggcgcagtgatccatggccgccagccgtcccagccacccagagtcgacattgcctggtcccccacccacacgagccgagaaacagcagggcccctcaccttggccgacatggtctccggcgccctgacgatctccggcgccgtccagggcaggacgccatggctgctgggcattggggcgtgcgttcccacgtggctgtgccgcgacatgccgtacccgcagacctttgccacggggcgccgcccgcgccagcccagcaggatgttgctgtgtggggcaggagaggggggagtgaagggtggagtgcatggtgagcagatcgcggggtgtgacgcggatgctgcctgggcgtccagcgcgccaccaaccccaggcttcaggcgccccggcagggtcgatccggatgcctgggcgcccgttcagggacacacaagcgccggcacttgcacctcgaaggaggggggatacacgcgtgtgccggccctgttccccccccccccnnnnnnnnnnccaggatgcctgggcgcccgttcagggacacacgagcgccggcacttgcaccttgagggaggggggatacacgcgtgcgccggccccgttccacccccccacccccccggccgccccttggctcccgggactcacgaggacttgaggtcaaagtgggtgacgcccttggcgtgcaggtctgcaggagtgagtggtcggggggaggggcatggcccgaggctctcctgcgctgcagtccggcgcctgcacggcgtcgtccccggccccggcccccaccccgcccctcc

SEQ ID NO: 46973 - DNA, 61 bp, Chlorella protothecoides
agtgctgaacacagatgaatggggcactgctcggtctgggccccaggctgggctctgctgc

SEQ ID NO: 46974 - DNA, 61 bp, Chlorella protothecoides
ctcgattgcacatcgtccaatcgaacccccatggcgcagcctgtcgacagccagaacccga

SEQ ID NO: 46975 - DNA, 61 bp, Chlorella protothecoides
tctgcttcttggctgcagaggaagcggcggtgaggggcagctggggcgctgtggatgggtg

SEQ ID NO: 46976 - DNA, 62 bp, Chlorella protothecoides
gcaccggatccatatgcatgcgaggctcagatagtgtgcgtcgtgtcgcgaactcagccgtg
